US012590386B2

(12) United States Patent
Johnson et al.

(10) Patent No.: US 12,590,386 B2
(45) Date of Patent: Mar. 31, 2026

(54) RECOMBINANT POLYCLONAL PROTEINS AND METHODS OF USE THEREOF

(71) Applicant: GigaGen, Inc., South San Francisco, CA (US)

(72) Inventors: David Scott Johnson, San Francisco, CA (US); Adam Shultz Adler, Belmont, CA (US); Rena Aviva Mizrahi, Pacifica, CA (US); Yoong Wearn Lim, South San Francisco, CA (US); Michael Asensio, South San Francisco, CA (US); Sheila Keating, South San Francisco, CA (US); Renee Leong, Daly City, CA (US); Jackson Leong, San Francisco, CA (US)

(73) Assignee: GigaGen, Inc., San Carlos, CA (US)

( * ) Notice: Subject to any disclaimer, the term of this patent is extended or adjusted under 35 U.S.C. 154(b) by 1092 days.

(21) Appl. No.: 17/607,497

(22) PCT Filed: Apr. 30, 2020

(86) PCT No.: PCT/US2020/030878
§ 371 (c)(1),
(2) Date: Oct. 29, 2021

(87) PCT Pub. No.: WO2020/223573
PCT Pub. Date: Nov. 5, 2020

(65) Prior Publication Data
US 2022/0243197 A1      Aug. 4, 2022

Related U.S. Application Data

(60) Provisional application No. 62/841,097, filed on Apr. 30, 2019.

(51) Int. Cl.
*C40B 40/10* (2006.01)
*C07K 16/00* (2006.01)

(52) U.S. Cl.
CPC .............. *C40B 40/10* (2013.01); *C07K 16/00* (2013.01)

(58) Field of Classification Search
None
See application file for complete search history.

(56) References Cited

U.S. PATENT DOCUMENTS

| | | | |
|---|---|---|---|
| 2004/0009168 A1 | 1/2004 | Kaisheva et al. | |
| 2010/0310558 A1 | 12/2010 | Oleksiewicz et al. | |
| 2018/0258422 A1 | 9/2018 | Gigagen | |

FOREIGN PATENT DOCUMENTS

| | | |
|---|---|---|
| CN | 101395182 A | 3/2009 |
| CN | 101688204 A | 3/2010 |
| CN | 102199593 A | 9/2011 |
| JP | 2007-505611 A | 10/2007 |

(Continued)

OTHER PUBLICATIONS

PCT International Search Report and Written Opinion, International Application No. PCT/US2020/030878, dated Dec. 21, 2020, 11 pages.

(Continued)

*Primary Examiner* — Christian C Boesen
(74) *Attorney, Agent, or Firm* — Fenwick & West LLP

(57) ABSTRACT

Provided herein are compositions comprising recombinant polyclonal proteins (RPPs) derived from mammalian plasma cells and plasmablasts. Also provided are methods of using the RPPs.

6 Claims, 7 Drawing Sheets
Specification includes a Sequence Listing.

c Product region complementary to d
d Product region complementary to c
e Polymerase
g Polynucleic acid target #1
h Polynucleic acid target #2
i Fused product between polynucleic acid targets #1 and #2
j Physical reaction container or emulsion droplet

(56) References Cited

FOREIGN PATENT DOCUMENTS

| JP | 2015-521850 A | 8/2015 |
|---|---|---|
| WO | WO 2004/061104 A2 | 7/2004 |
| WO | WO 2005/042774 A2 | 5/2005 |
| WO | WO 2007/101441 A1 | 9/2007 |
| WO | WO 2008/145133 A2 | 12/2008 |
| WO | WO 2009/030237 A2 | 3/2009 |
| WO | WO 2014/005042 A2 | 1/2014 |
| WO | WO 2016/200577 A1 | 12/2016 |
| WO | WO 2018/170013 A1 | 9/2018 |
| WO | WO 2020/223573 A2 | 11/2020 |
| WO | WO 2021/253002 A1 | 12/2021 |
| WO | WO 2022/031834 A1 | 2/2022 |

OTHER PUBLICATIONS

Adler et al., "Rare, high-affinity anti-pathogen antibodies from human repertoires, discovered using microfluidics and molecular genomics," MAbs, Aug. 28, 2017, vol. 9, Iss. 8, pp. 1282-1296, entire document.

Ferrara et al., "Recombinant renewable polyclonal antibodies," MAbs, Dec. 20, 2014, vol. 7, Iss. 1, pp. 32-41, entire document.

Reason et al., "Human Fab Fragments Specific for the Haemophilus influenzae b Polysaccharide Isolated from a Bacteriophage Combinatorial Library Use Variable Region Gene Combinations and Express an Idiotype That Mirrors in Vivo Expression," Infection and Immunity, Jan. 1, 1997, vol. 65, No. 1, pp. 261-266, entire document.

Bendig, M.M., "Humanization of Rodent Monoclonal Antibodies by CDR Grafting," Methods: A Companion to Methods in Enzymology, 1995; 8:83-93.

Bloch et al., "Deployment of convalescent plasma for the prevention and treatment of COVID-19," The Journal of Clinical Investigation, vol. 130, No. 6, Jun. 1, 2020 (Jun. 1, 2020), pp. 2757-2765, XP055815868, GB ISSN: 0021-9738, DOI: 10.1172/JCI138745.

Branche, E. et al., "Human Polyclonal Antibodies Prevent Lethal Zika Virus Infection in Mice", Scientific Reports, vol. 9, Article No. 9857, Jul. 8, 2019 (Jul. 8, 2019), pp. 1-12, XP055664845.

Colman. P.M., "Effects of amino acid sequence changes on antibody-antigen interactions," Research in Immunology, 1994, 145:33-36.

Cross, "Searching for a coronavirus cure in the blood," Chemical & Engineering New, Apr. 7, 2020 (Apr. 7, 2020), XP055850922, 7 pages, Retrieved from the Internet: URL:https://cen.acs.org/pharmaceuticals/biologics/Searching-coronavirus-cure-blood/98/i14 [retrieved on Oct. 13, 2021].

Frandsen, T.P. et al., "Consistent manufacturing and quality control of a highly complex recombinant polyclonal antibody product for human therapeutic use", Biotechnology and Bioengineering, vol. 108, Issue 9, Sep. 2011, pp. 2171-2181, XP071108999.

Gigagen Press Release, "COVID-19 Antibody Therapy: GigaGen Initiates Development of rCIG," Outbreak News Today, Mar. 30, 2020 (Mar. 30, 2020), 4 pages, XP055850665, Retrieved from the Internet: URL:http://outbreaknewstoday.com/covid-19-antibody-therapy-gigagen-initiates-development-of-rcig-21518/ [retrieved on Oct. 12, 2021].

Goldstein et al., "Massively parallel single-cell B-cell receptor sequencing enables rapid discovery of diverse antigen-reactive antibodies," Communications Biology, vol. 2, Article No. 304, Aug. 9, 2019 (Aug. 9, 2019), pp. 1-10, XP055758874, DOI: 10.1038/s42003-019-0551-y.

Hammarström et al., "Development of passive immunity against SARS-CoV-2 for management of immunodeficient patients-a perspective," Journal of Allergy and Clinical Immunology, Elsevier, Amsterdam, NL, vol. 146, No. 1, May 12, 2020 (May 12, 2020), pp. 58-60, P086207336, ISSN: 0091-6749, DOI: 10.1016/J.JACI.2020.04.043 [retrieved on May 12, 2020].

International Preliminary Report on Patentability, Patent Cooperation Treaty Application No. PCT/US2020/030878, Nov. 2, 2021, 8 pages.

International Search Report and Written Opinion, Patent Cooperation Treaty Application No. PCT/US2021/037232, Nov. 8, 2021, 16 pages.

International Search Report and Written Opinion, Patent Cooperation Treaty Application No. PCT/US2021/044523, Nov. 18, 2021, 19 pages.

Keating, S.M. et al., "Capturing and Recreating Diverse Antibody Repertoires as Multivalent Recombinant Polyclonal Antibody Drugs," bioRxiv, preprint, Aug. 6, 2020, 78 pages.

Keating, S.M. et al., "Generation of recombinant hyperimmune globulins from diverse B-cell repertoires," nature biotechnology, vol. 39, No. 8, Aug. 2021, pp. 989-999, XP037534475.

Khantasup, K. et al., "Design and Generation of Humanized Single-chain Fv Derived from Mouse Hybridoma for Potential Targeting Application," Monoclonal Antibodies in Immunodiagnosis and Immunotherapy, 2015, 34(6): 404-417.

Lou, Y. et al., "Cross-neutralization antibodies against SARS-CoV-2 and RBD mutations from convalescent patient antibody libraries," bioRxiv, posted on Jun. 6, 2020, 32 pages.

Murphy, C. et al., "Enhancing recombinant antibody performance by optimally engineering its format," Journal of Immunological Methods, vol. 463, Dec. 2018, pp. 127-133.

Non-final Office Action, U.S. Appl. No. 17/386,504, filed Mar. 2, 2022, 27 pages.

Paul, W.E. (ed), Fundamental Immunology, 3rd Edition, Chapter 9, Structure and Function of Immunoglobulins, 1993, pp. 292-295.

Ravichandran, S. et al., Antibody repertoire induced by SARS-CoV-2 spike protein immunogens, bioRxiv, posted on May 13, 2020, 34 pages.

Rudikoff, S. et al., "Single amino acid substitution altering antigen-binding specificity," Proc. Natl. Acad. Sci. USA, 1982, 79(6):1979-1983.

Shen et al., "Treatment of 5 Critically Ill Patients With COVID-19 With Convalescent Plasma," JAMA the Journal of the American Medical Association, vol. 323, No. 16, Mar. 27, 2020 (Mar. 27, 2020), p. 1582-1589, XP055725009, US ISSN: 0098-7484, DOI: 10.1001/jama.2020.4783.

Sheridan, "Convalescent serum lines up as first-choice treatment for coronavirus," Nature Biotechnology, Gale Group Inc, New York, vol. 38, No. 6, May 1, 2020 (May 1, 2020), pp. 655-658, XP037167671, ISSN: 1087-0156, DOI: 10.1038/D41587-020-00011-1 [retrieved on May 1, 2020].

Tanno et al. "A facile technology for the high-throughput sequencing of the paired VH:VL and TCRβ:TCRα repertoires," Science Advances, Apr. 22, 2020, vol. 6, Issue 17, 8 pages, XP55851688, Retrieved from the Internet: URL:https://www.science.org/doi/pdf/10.1126/sciadv.aay9093 [retrieved on Oct. 15, 2021].

Tiberghien et al., "Collecting and evaluating convalescent plasma for COVID-19 treatment: why and how?", Vox Sanguinis, vol. 115, No. 6, May 3, 2020 (May 3, 2020), pp. 488-494, XP055815870, Ch ISSN: 0042-9007, DOI: 10.1111/vox.12926.

World Health Organization, "Landscape analysis of therapeutics as Feb. 17, 2020," Feb. 25, 2020 (Feb. 25, 2020), XP055809736, Retrieved from the Internet: URL:https://web.archive.org/web/20200225223659/https://www.who.int/blueprint/priority-diseases/key-action/Table_of_therapeutics_Appendix_17022020.pdf?ua=1, pp. 26,28.

Yuan, A.Q. et al., Isolation of and Characterization of Neutralizing Antibodies to Covid-19 from a Large Human Naïve scFv Phage Display Library, bioRxiv, posted on May 19, 2020, 15 pages.

Chi, X., et al., "A neutralizing human antibody binds to the N-terminal domain of the Spike protein of SARS-CoV-2," Science, Jun. 22, 2020, vol. 369, Issue 6504, pp. 650-655.

Partial Supplementary European Search Report, European Patent Application No. 20799387.7, Jan. 4, 2023, 12 pages.

United States Office Action, U.S. Appl. No. 17/386,504, filed Dec. 7, 2022, 22 pages.

United States Office Action, U.S. Appl. No. 17/469,493, filed Dec. 30, 2022, 11 pages.

Wang, B., et al., "Functional Interrogation and Mining of Natively-Paired Human VH:VL Antibody Repertoires," Nature Biotechnology, author manuscript, Feb. 2018; 36(2): 152-155, 14 pages.

(56) References Cited

OTHER PUBLICATIONS

Wang, Q., et al., "Molecular determinants of human neutralizing antibodies isolated from a patient infected with Zika virus," Science Translational Medicine, Dec. 14, 2016, vol. 8, issue 369, 10 pages.

Berger, M., "Antibodies to vaccine antigens in pooled polyclonal human IgG products," TRANSFUSION, vol. 58, No. S3, Dec. 2018, pp. 3096-3105.

Chao, R. et al., Recent advances in DNA assembly technologies, Jan. 6, 2015, FEMS Yeast Res., 15/a, pp. 1-9.

Dekosky, B.J. et al., "High-throughput sequencing of the paired human immunoglobulin heavy and light chain repertoire," Nature Biotechnology, vol. 31, No. 2, Feb. 2013, pp. 166-169, Online Methods.

European Patent Office, Extended European Search Report and Opinion, EP Patent Application No. 23192977.9, Feb. 5, 2024, eight pages.

Extended European Search Report, European Patent Application No. 20799376.7, Apr. 6, 2023, 8 pages.

Lai, J.C.Y. et al., "CD45 Regulates Migration, Proliferation, and Progression of Double Negative 1 Thymocytes," The Journal of Immunology, vol. 185, No. 4, Aug. 15, 2010, pp. 2059-2070.

Mourad, G. et al., "The role of Thymoglobulin induction in kidney transplantation: an update," Clinical Transplantation, vol. 26, No. 5, Oct. 14, 2012, pp. E450-E464.

Ramisse, F. et al., "Passive and Active Immunotherapy for Experimental Pneumococcal Pneumonia by Polyvalent Human Immunoglobulin or F(ab')2 Fragments Administered Intranasally," The Journal of Infectious Diseases, vol. 173, Jan. 27, 1995, pp. 1123-1128.

Rinaldi, C. et al., "Modulation of Innate Immune Responses by Influenza-Specific Ovine Polyclonal Antibodies Used for Prophylaxis," Plos One, vol. 9, No. 2, Feb. 28, 2014, e89674, pp. 1-9.

Rothstein, S.S. et al., "Passive immunization for hepatitis B," Journal of Oral and Maxillofacial Surgery, vol. 40, No. 1, Jan. 1, 1982, pp. 34-37.

Slifka, M.K. et al., "Passive Immunization—an 1-13 overview: Science Direct Topics," Apr. 19, 2016, pp. 1-9.

Todd, S.C. et al., "Brief Definitive 2 Report: CD81 Expressed on Human Thymocytes Mediates Integrin Activation and Interleukin 2-dependent Proliferation," J. Exp. Med., vol. 184, Nov. 1996, pp. 2055-2060.

g Polynucleic acid target #1
h Polynucleic acid target #2
i Solid support, such as a bead
j Physical reaction container or emulsion droplet
k Plasmablast or plasma cell a Left primer for target #1
b Right primer for target #1
c Primer region complementary to d
d Primer region complementary to c
e Left primer for target #2
f Right primer for target #2
g Polynucleic acid target #1
h Polynucleic acid target #2
i Solid support, such as a bead
j Physical reaction container or emulsion droplet a Left primer for target #1
b Right primer for target #1
c Primer region complementary to d
d Primer region complementary to c
e Left primer for target #2
f Right primer for target #2
g Polynucleic acid target #1
h Polynucleic acid target #2
j Physical reaction container or emulsion droplet c Product region complementary to d
d Product region complementary to c
g Polynucleic acid target #1
h Polynucleic acid target #2
j Physical reaction container or emulsion droplet c Product region complementary to d
d Product region complementary to c
e Polymerase
g Polynucleic acid target #1
h Polynucleic acid target #2
i Fused product between polynucleic acid targets #1 and #2
j Physical reaction container or emulsion droplet

RECOMBINANT POLYCLONAL PROTEINS AND METHODS OF USE THEREOF

1. CROSS REFERENCE TO RELATED APPLICATIONS

This present application is a 35 U.S.C. 371 Patent Application of PCT Application No. PCT/US2020/030878, filed Apr. 30, 2020, which claims the benefit of and priority to U.S. Provisional Application No. 62/841,097 filed on Apr. 30, 2019, the contents of which are incorporated by reference in their entirety for all purposes.

2. SEQUENCE LISTING

The instant application contains a Sequence Listing with 120158 sequences which has been submitted via EFS-Web and is hereby incorporated by reference in its entirety. Said ASCII copy, created on Apr. 30, 2020, is named GGN035WOsequencelisting.txt, and is 30.3 MB in size.

3. FIELD

Provided herein are recombinant polyclonal proteins (RPPs), also called recombinant polyclonal antibody proteins, recombinant hyperimmune globulins, or simply recombinant hyperimmunes, with binding specificity for antigens comprising, e.g., vaccines and libraries and compositions comprising such RPPs, including pharmaceutical compositions. Also provided are methods of making RPPs, and methods of using RPPs, for example, for therapeutic purposes.

4. BACKGROUND

Widespread use of active vaccines has greatly reduced the incidence of preventable infectious diseases, but vaccine failure due to low or no vaccine-induced immune response remains a significant problem. Certain populations are especially at risk of infection, including the elderly or individuals with congenital humoral immune deficiencies; their weakened immune systems prevent induction of adequate immune responses to vaccine antigens. (D'Acremont et al., 2006; Jilkovi et al., 2009; Weinberger et al., 2010; Langley et al., 2011; Cramer et al., 2016; Bader, 2007; Goldacker et al., 2007; van Assen et al., 2010). Poor responders suffer from a significantly elevated risk of infection, leading to increased rates hospitalization, requiring antibiotic or antiviral therapy, or causing long-term illness or death. These patients would benefit from antibody replacement therapies that would provide protective immunity as an alternative to failed vaccine modalities.

Passive immunizations (McDonagh, 1966) offer alternative protective strategies for immunodeficient individuals who do not respond to active vaccines. For example, intravenous immunoglobulin (IVIg) is a broad-spectrum polyclonal antibody therapy derived from the plasma of thousands of human donors. IVIg is used as an antibody replacement therapy for patients with humoral immune deficiencies (Lucas et al., 2010; Resnick et al., 2012). However, IVIg has a low titer of antibodies directed against many common pathogens, which leads to significant morbidity and mortality in immune deficient patients (Orange et al., 2010). To increase anti-pathogen titers, some groups have developed high-titer plasma-derived antibodies, often called hyperimmunes (Bozzo & Jorquera, 2017). Hyperimmunes are commonly derived from the plasma of donors soon after administration of active vaccines, such as Hyper-HEP B (Grifols), which has a high titer against Hepatitis B virus.

Hyperimmunes derived from donors recently administered active vaccines are excellent choices for passive immunization, but to scale such products commercially is a challenge (Kreil et al., 2012). Importantly, it can be difficult to identify strong responders who are willing to be vaccinated and donate plasma repeatedly. Therefore, hyperimmune manufacturing lots are necessarily derived from different sets of donors, resulting in lot-to-lot variability. The anti-pathogen titer varies significantly across hyperimmunes, from as low as 2- to 3-fold (Schampera et al., 2017) to as much as 50-fold (Kreil et al., 2012). In some cases, therefore, physicians may simply administer larger doses of IVIg (Polilli et al., 2012). Physicians and patients would benefit from more consistent, higher titer hyperimmunes that are easier to manufacture at large scale.

5. SUMMARY

Provided herein are novel libraries of RPPs (recombinant polyclonal proteins, also called recombinant polyclonal antibody proteins, recombinant hyperimmune globulins, or recombinant hyperimmunes) with binding specificity for antigens comprising, e.g., vaccines, and methods of using such RPPs, e.g., as human therapeutics. The RPPs are recombinant, and their sequences are derived from peripheral blood plasma cells or plasmablasts. The peripheral blood plasma cells or plasmablasts are mobilized by, e.g., a vaccine administered to a donor, and the peripheral blood plasma cells or plasmablasts are specifically separated from other peripheral blood cells. The peripheral blood cells can come from any mammal, for example a mouse, a rat, a human, a monkey, a horse, or a cow.

The RPPs specifically bind antigens. Examples include but are not limited to, a *Haemophilius influenzae* b polysaccharide, a Pneumococcus polysaccharide, a Hepatitis B virus antigen, or a human thymocyte. Some RPP compositions are derived from plasma cells or plasmablasts mobilized by, e.g., vaccines comprising protein antigens derived from viruses. In some embodiments, the vaccine is a mammalian cell, for example an immune cell or a cancer cell. In other embodiments, the vaccine is a killed or inactivated pathogen, for example, a bacterium or a virus. In other embodiments, the vaccine is a bacterial polysaccharide. In some embodiments, the vaccine is an agent cleared by the US Food and Drug Adminstration for prophylaxis against an infectious disease. In all embodiments, the vaccine mobilizes plasma cells or plasmablasts in the peripheral blood, or causes plasma cells or plasmablasts to be mobilized in the peripheral blood.

A library of RPPs comprises a mixture of RPPs, e.g., antibodies, and can be termed a polyclonal antibody. The mixture of antibodies can comprise 10, 100, 1,000, 10,000, 100,000 or more than 100,000 distinct antibody sequences. In some embodiments, the library includes RPPs having the cognate heavy chain CDR3 and light chain CDR3 sequence disclosed herein.

In some embodiments, the antibodies are chimeric. In some embodiments, the antibodies are humanized. In some embodiments, the antibodies are human. In some embodiments, the RPP comprises a mixture of antibody fragments. In some embodiments, the RPPs comprises a mixture of single-chain variable fragments (scFvs). In some embodiments the RPPs comprise full length antibodies. In some embodiments, the antibodies are IgGs, IgAs, or IgMs.

The RPPs provided herein can induce various biological effects associated with binding to an antigen that comprises a vaccine. In some embodiments, an RPP provided herein prevents binding of a virus to a cell, which therein prevents entry of the virus into the cell. In some embodiments, an RPP provided binds to the cell surface of a bacterium, which enables lysis of the bacterium by an immune system. In some embodiments, the RPP binds to the cell surface of a patient's cells, in order to eliminate cells associated with a pathology. In some embodiments, the RPP binds to the surface of T cells, in order to eliminate T cells associated with autoimmune disease or graft-versus-host disease in transplant.

Also provided are isolated polynucleotides encoding the RPPs provided herein, and portions thereof. In some aspects, the present invention provides a mixture of polynucleotides encoding the RPPs provided herein. In other aspects, the present invention provides a mixture of vectors comprising the isolated polynucleotides. In other aspects, the present invention provides a mixture of host cell clones comprising the mixture of polynucleotides or vectors.

Also provided are methods of producing the RPP using the polynucleotides, vectors, or host cells provided herein. Some aspects of the present invention are related to a method of producing RPPs, comprising: expressing the antibodies in host cells using a library of polynucleotide vectors, and isolating the RPP.

Also provided are pharmaceutical compositions comprising the RPPs and a pharmaceutically acceptable excipient.

Also provided are methods of using the RPPs provided herein, e.g., methods of treating or preventing a disease or condition in a subject in need thereof, comprising administering to the subject an effective amount of an RPP provided herein, or a pharmaceutical composition comprising such RPP. In some aspects, the disease or condition is a cancer or Alzheimer's disease. In some aspects, the disease or condition is a viral or bacterial infection. In some aspects the method further comprises administering one or more additional therapeutic agents. In some aspects, the additional therapeutic agent is an immune stimulatory or suppressive agent. In some aspects, the RPP is used to modulate graft-versus-host or host-versus-graft response in a transplantation setting. In some aspects, the RPP is used to moedulate viral disease in a transplantation setting.

In some embodiments, the RPP is in an amount sufficient as prophylaxis against infectious disease when administered to a subject. In some embodiments, the RPP is an amount sufficient to clear infectious disease in an individual actively fighting infection.

In yet a further aspect, the present invention provides for a method for generating a library of recombinant antibodies, comprising: injecting a mammalian donor with an antigen for Hepatitis B Virus (HBV); isolating the donor's plasma cells or plasmablasts; generating the library of recombinant antibodies from the plasma cells or plasmablasts; wherein an activity of the library of recombinant antibodies exceeds a serum titer activity of said donor against the antigen by at least tenfold. The mammalian donor may comprise more than one individual. In one embodiment, the mammalian donor may be a human, mouse, humanized mouse, rat, humanized rat, horse, or cow. The method of the present invention may generate at least 100 recombinant antibodies, for example at least 1,000 recombinant antibodies, such as at least 10,000 recombinant antibodies. In one embodiment, the method of the present invention may generate at least 100,000 recombinant antibodies.

With reference to the method of the present invention, the activity titer may be measured by an in vitro pathogen neutralization assay. Alternatively, the activity titer may be measured by an in vitro binding to antigen assay. In on embodiment, the activity titer may be measured by an in vivo efficacy assay.

In one embodiment, the method of the present invention may further comprise the steps of: obtaining a plurality of first linear polynucleotides, each comprising a first sequence encoding a heavy chain variable domain from a cognate pair from the single plasma cell or plasmablast; and a second sequence encoding a light chain variable domain from the cognate pair; and a third sequence linking the first and second sequences and comprising a restriction site; and obtaining a second linear polynucleotide, not operationally linked to the first polynucleotide, comprising a fourth sequence homologous to a portion of the first polynucleotide; and circularizing each of the plurality of first polynucleotides with the second polynucleotide to generate a library of polynucleotides encoding the library of recombinant antibodies, wherein circularization is effected through Gibson Assembly; and expressing the library of recombinant antibodies in mammalian cells comprising the library of polynucleotides encoding the recombinant antibodies, thereby generating the library of recombinant antibodies.

6. BRIEF DESCRIPTION OF THE DRAWINGS

FIG. 1 summarizes the method of generating libraries of polynucelotides derived from transcripts expressed in peripheral blood plasma cells or plasmablasts isolated from mammalian hosts administered a vaccine.

FIG. 2 summarizes a method of encapsulating plasma cells or plasmablasts into physical containers with lysis mix and solid supports that capture nucleic acid targets from lysed cells.

FIG. 3 summarizes a method of encapsulating target-specific primers with nucleic acid targets affixed to solid supports.

Figure 1:
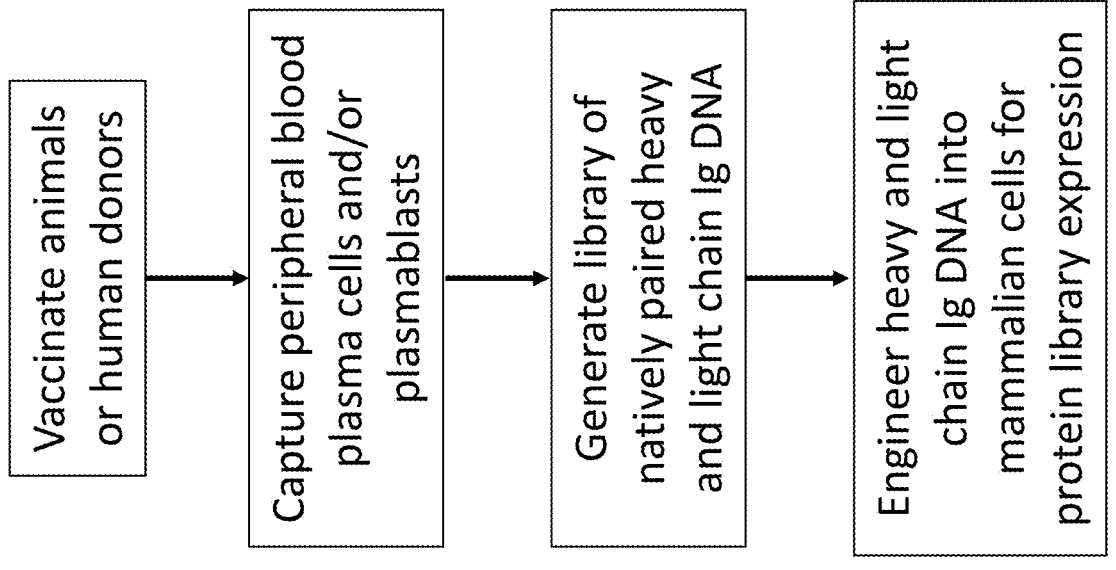
Figure 2:
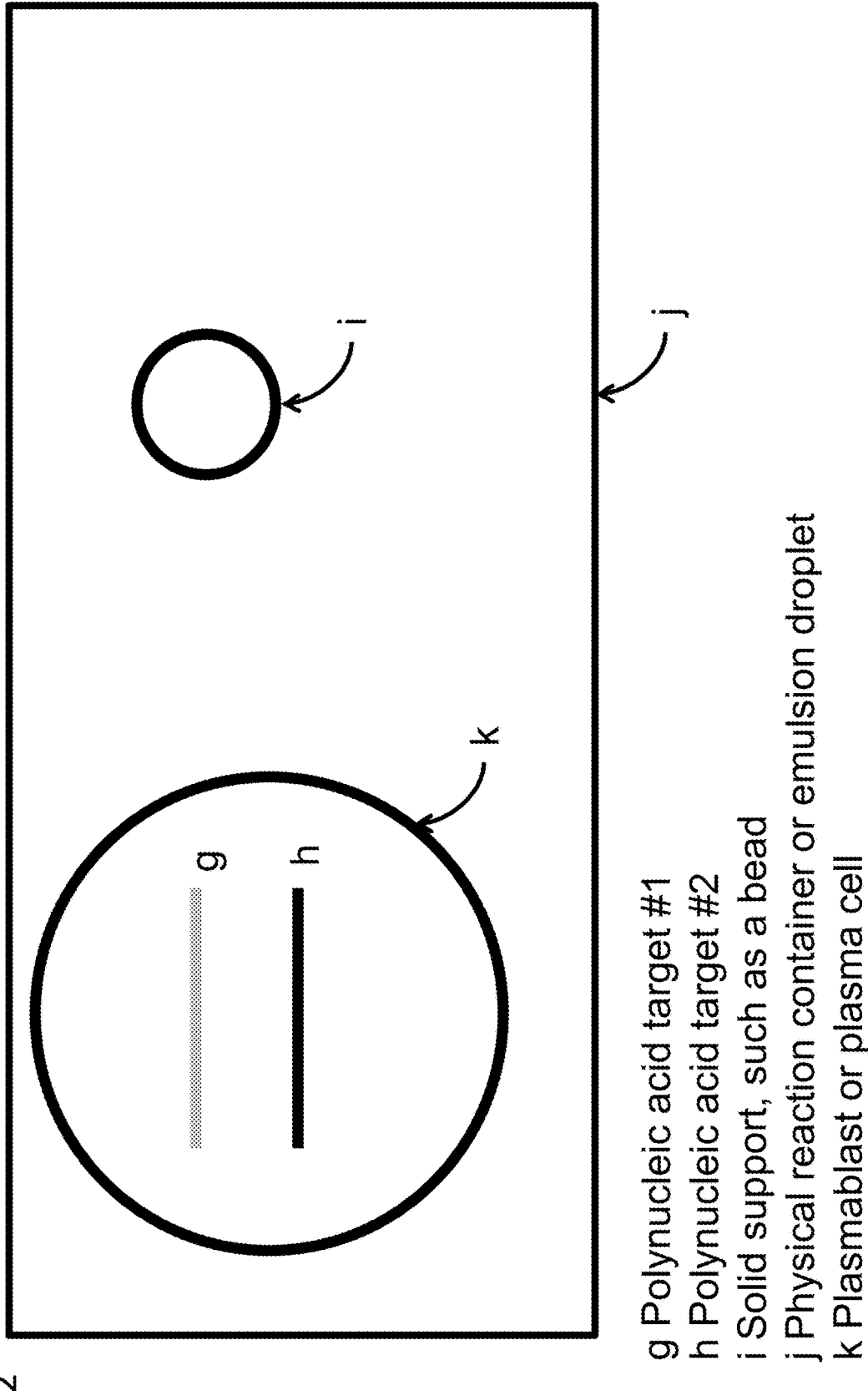
Figure 3:
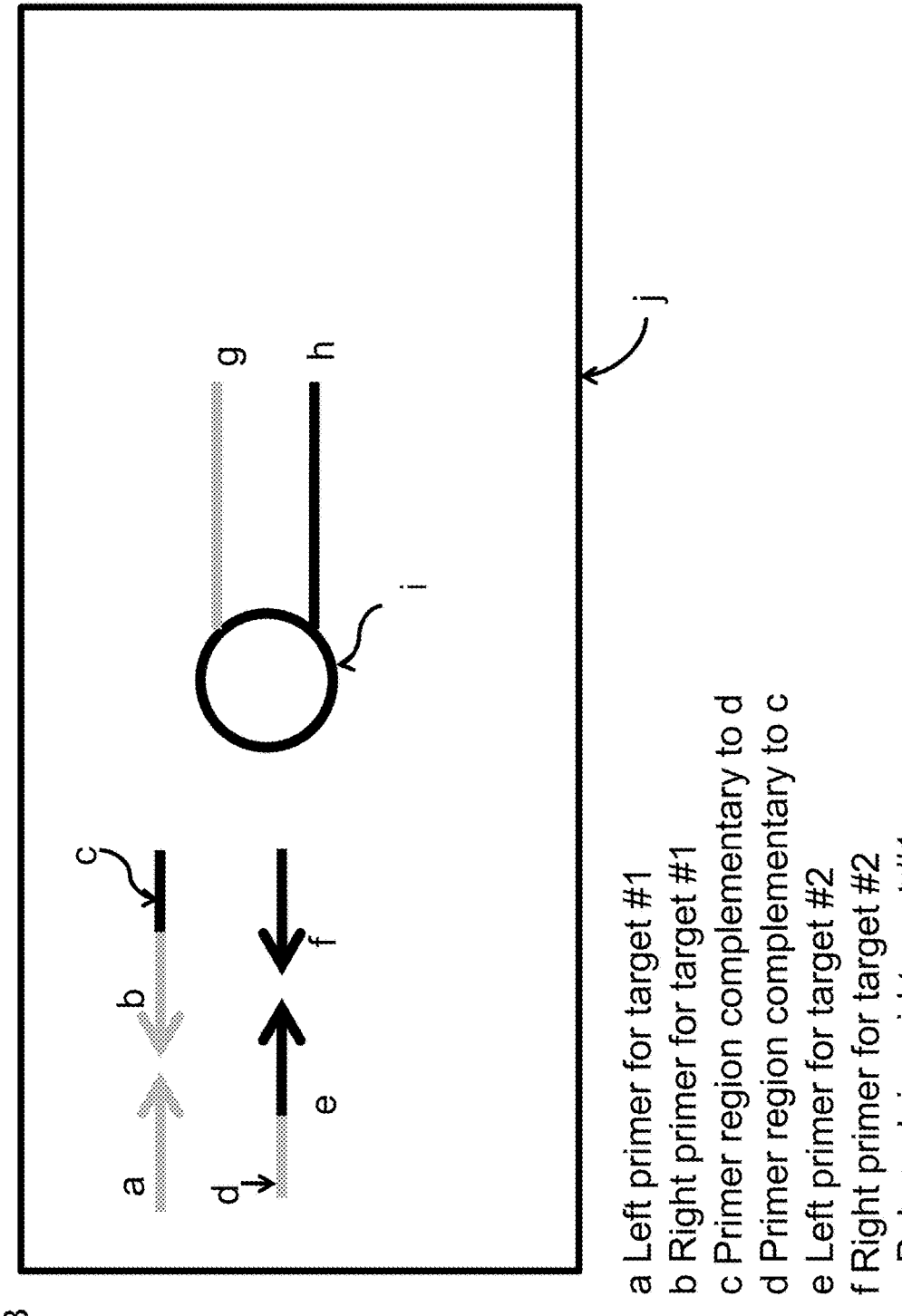
Figure 4:
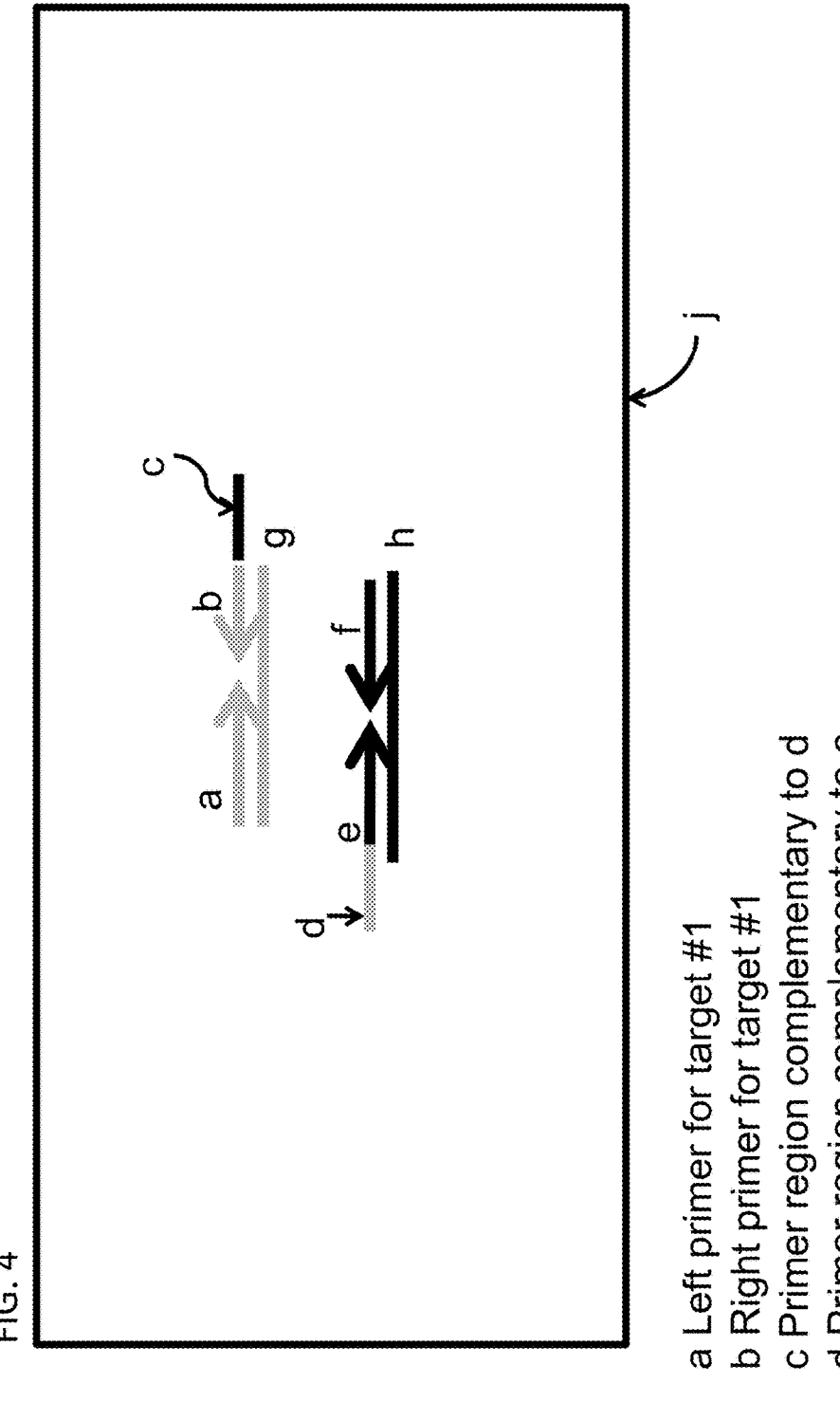
FIG. 4 shows the method of amplifying individual target nucleic acids with complementary regions.
Figure 5:
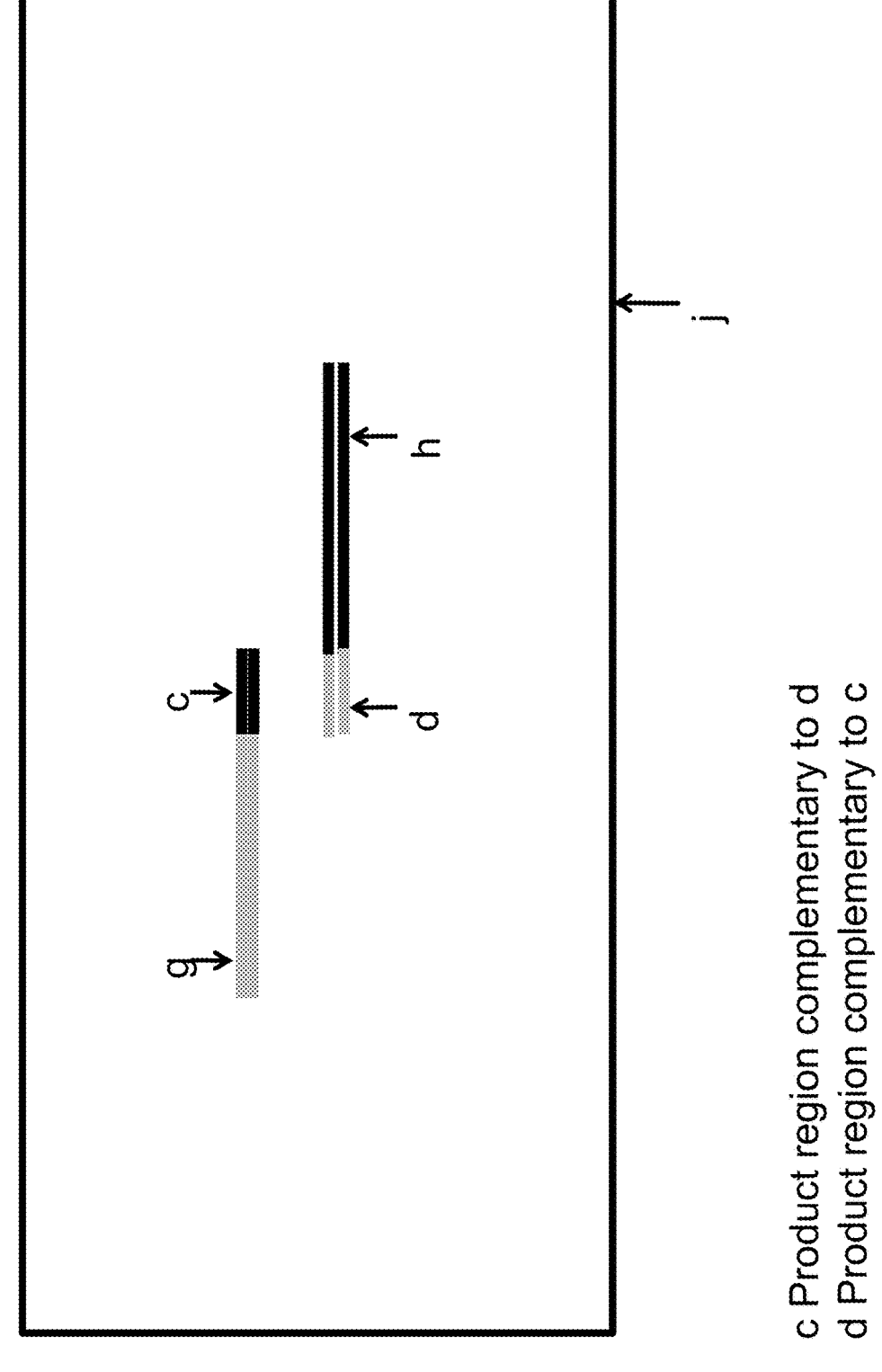
FIG. 5 shows the individual amplified target nucleic acids with complementary regions.
Figure 6:
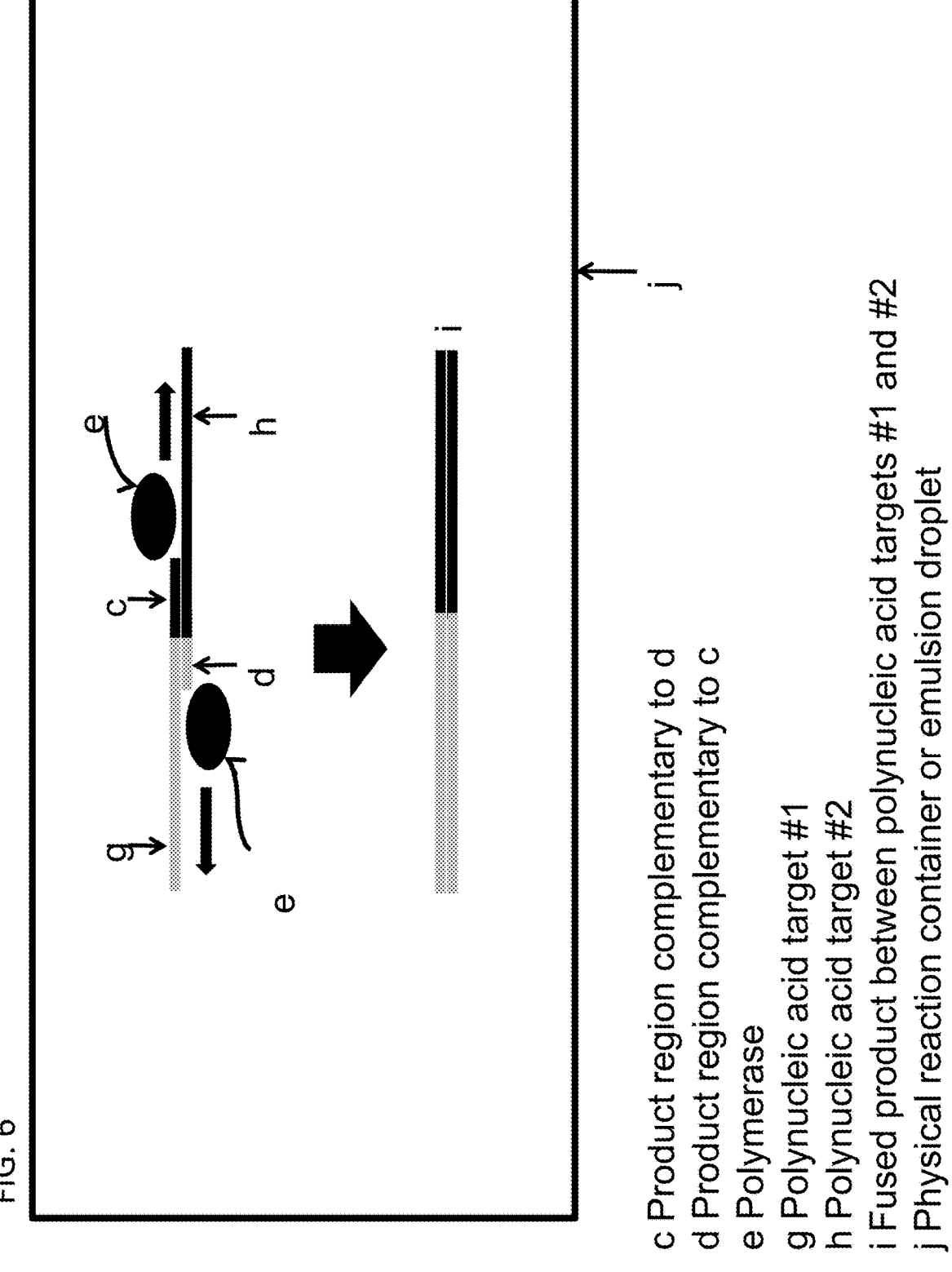

FIG. 6 summarizes a method of fusing separate amplified nucleic acid targets into single fused nucleic acid constructs.

Figure 7:
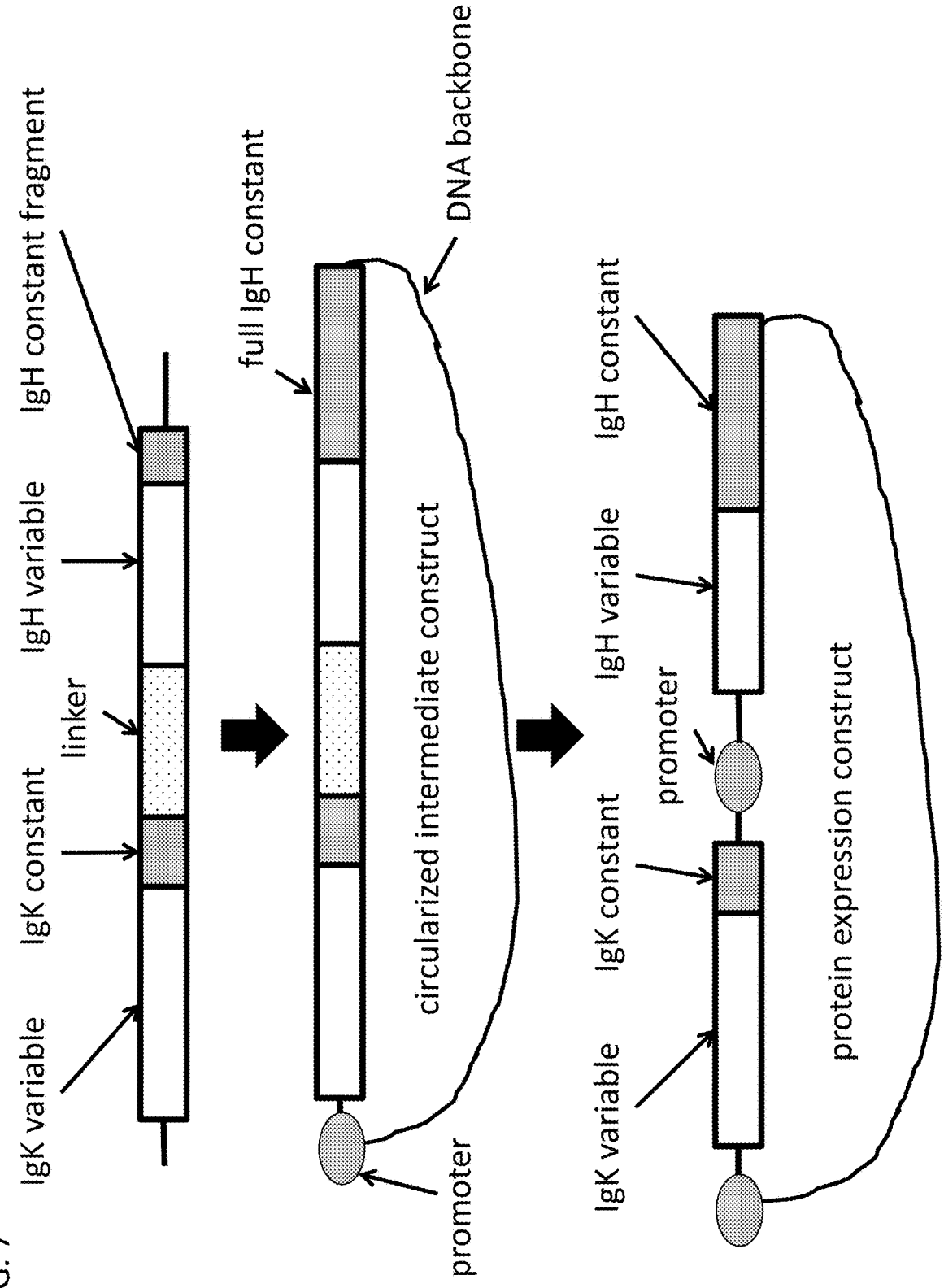

FIG. 7 shows the method of generating circularized gene expression constructs from the fused nucleic acid constructs.

7. DETAILED DESCRIPTION

7.1. Definitions

Unless otherwise defined herein, scientific and technical terms used in connection with the present invention shall have the meanings that are commonly understood by those of ordinary skill in the art. Further, unless otherwise required by context, singular terms shall include pluralities and plural terms shall include the singular. Generally, nomenclatures used in connection with, and techniques of, cell and tissue culture, molecular biology, immunology, microbiology, genetics and protein and nucleic acid chemistry and hybridization described herein are those well-known and commonly used in the art. The methods and techniques of the present invention are generally performed according to conventional methods well known in the art and as described in various general and more specific references that are cited and discussed throughout the present specification unless otherwise indicated. See, e.g., Sambrook et al. *Molecular Cloning: A Laboratory Manual, 2d ed.*, Cold Spring Harbor Laboratory Press, Cold Spring Harbor, N.Y. (1989) and Ausubel et al., *Current Protocols in Molecular Biology*, Greene Publishing Associates (1992), and Harlow and Lane *Antibodies: A Laboratory Manual* Cold Spring Harbor Laboratory Press, Cold Spring Harbor, N.Y. (1990), which are incorporated herein by reference. Enzymatic reactions and purification techniques are performed according to manufacturer's specifications, as commonly accomplished in the art or as described herein. The terminology used in connection with, and the laboratory procedures and techniques of, analytical chemistry, synthetic organic chemistry, and medicinal and pharmaceutical chemistry described herein are those well-known and commonly used in the art. Standard techniques can be used for chemical syntheses, chemical analyses, pharmaceutical preparation, formulation, and delivery, and treatment of patients.

The following terms, unless otherwise indicated, shall be understood to have the following meanings:

The term "immunoglobulin" refers to a class of structurally related proteins generally comprising two pairs of polypeptide chains: one pair of light (L) chains and one pair of heavy (H) chains. In an "intact immunoglobulin," all four of these chains are interconnected by disulfide bonds. The structure of immunoglobulins has been well characterized. See, e.g., Paul, *Fundamental Immunology* 7th ed., Ch. 5 (2013) Lippincott Williams & Wilkins, Philadelphia, PA. Briefly, each heavy chain typically comprises a heavy chain variable region ($V_H$) and a heavy chain constant region ($C_H$). The heavy chain constant region typically comprises three domains, abbreviated $C_{H1}$, $C_{H2}$, and $C_{H3}$. Each light chain typically comprises a light chain variable region ($V_L$) and a light chain constant region. The light chain constant region typically comprises one domain, abbreviated $C_L$.

The term "recombinant polyclonal protein" (RPP) refers to a protein comprising more than one antigen-binding domains that specifically bind to an antigen or epitope, or multiple antigens and epitopes. In some embodiments, the antigen-binding domains bind an antigen or epitope with specificity and affinity similar to that of naturally occurring antibodies. In some embodiments, the RPP comprises antibodies. In some embodiments, the RPP consists of antibodies. In some embodiments, the RPP consists essentially of antibodies. In some embodiments, the RPP comprises alternative scaffolds. In some embodiments, the RPP consists of alternative scaffolds. In some embodiments, the RPP consists essentially of alternative scaffolds. In some embodiments, the RPP comprises antibody fragments. In some embodiments, the RPP consists of antibody fragments. In some embodiments, the RPP consists essentially of antibody fragments.

The term "antibody" is used herein in its broadest sense and includes certain types of immunoglobulin molecules comprising one or more antigen-binding domains that specifically bind to an antigen or epitope. An antibody specifically includes intact antibodies (e.g., intact immunoglobulins), antibody fragments, and multi-specific antibodies. One example of an antigen-binding domain is an antigen-binding domain formed by a $V_H$-$V_L$ dimer. Antibodies comprise one type of RPP.

The term "alternative scaffold" refers to a molecule in which one or more regions may be diversified to produce one or more antigen-binding domains that specifically bind to an antigen or epitope. In some embodiments, the antigen-binding domain binds the antigen or epitope with specificity and affinity similar to that of naturally occurring antibodies.

Exemplary alternative scaffolds include those derived from fibronectin (e.g., Adnectins™), the β-sandwich (e.g., iMab), lipocalin (e.g., Anticalins®), EETI-II/AGRP, BPTI/LACI-D1/ITI-D2 (e.g., Kunitz domains), thioredoxin peptide aptamers, protein A (e.g., Affibody®), ankyrin repeats (e.g., DARPins), gamma-B-crystallin/ubiquitin (e.g., Affilins), $CTLD_3$ (e.g., Tetranectins), Fynomers, and (LDLR-A module) (e.g., Avimers). Additional information on alternative scaffolds is provided in Binz et al., *Nat. Biotechnol.*, 2005 23:1257-1268; Skerra, *Current Opin. in Biotech.*, 2007 18:295-304; and Silacci et al., *J. Biol. Chem.*, 2014, 289: 14392-14398; each of which is incorporated by reference in its entirety. Alternative scaffolds comprise one type of RPP.

The term "antigen-binding domain" means the portion of an antibody that is capable of specifically binding to an antigen or epitope.

The terms "full length antibody," "intact antibody," and "whole antibody" are used herein interchangeably to refer to an antibody having a structure substantially similar to a naturally occurring antibody structure and having heavy chains that comprise an Fc region.

The term "Fc region" means the C-terminal region of an immunoglobulin heavy chain that, in naturally occurring antibodies, interacts with Fc receptors and certain proteins of the complement system. The structures of the Fc regions of various immunoglobulins, and the glycosylation sites contained therein, are known in the art. See Schroeder and Cavacini, *J. Allergy Clin. Immunol.*, 2010, 125:S41-52, incorporated by reference in its entirety. The Fc region may be a naturally occurring Fc region, or an Fc region modified as described elsewhere in this disclosure.

The $V_H$ and $V_L$ regions may be further subdivided into regions of hypervariability ("hypervariable regions (HVRs);" also called "complementarity determining regions" (CDRs)) interspersed with regions that are more conserved. The more conserved regions are called framework regions (FRs). Each $V_H$ and $V_L$ generally comprises three CDRs and four FRs, arranged in the following order (from N-terminus to C-terminus): FR1-CDR1-FR2-CDR2-FR3-CDR3-FR4. The CDRs are involved in antigen binding, and influence antigen specificity and binding affinity of the antibody. See Kabat et al., *Sequences of Proteins of Immunological Interest* 5th ed. (1991) Public Health Service, National Institutes of Health, Bethesda, MD, incorporated by reference in its entirety.

The light chain from any vertebrate species can be assigned to one of two types, called kappa (κ) and lambda (λ), based on the sequence of its constant domain.

The heavy chain from any vertebrate species can be assigned to one of five different classes (or isotypes): IgA, IgD, IgE, IgG, and IgM. These classes are also designated a, 6, F, y, and p, respectively. The IgG and IgA classes are further divided into subclasses on the basis of differences in sequence and function. Humans express the following subclasses: IgG1, IgG2, IgG3, IgG4, IgA1, and IgA2.

The amino acid sequence boundaries of a CDR can be determined by one of skill in the art using any of a number of known numbering schemes, including those described by Kabat et al., supra ("Kabat" numbering scheme); Al-Lazikani et al., 1997, *J. Mol. Biol.*, 273:927-948 ("Chothia" numbering scheme); MacCallum et al., 1996, *J. Mol. Biol.* 262:732-745 ("Contact" numbering scheme); Lefranc et al., *Dev. Comp. Immunol.*, 2003, 27:55-77 ("IMGT" numbering scheme); and Honegge and Plückthun, *J. Mol. Biol.*, 2001, 309:657-70 ("AHo" numbering scheme); each of which is incorporated by reference in its entirety.

Table 1 provides the positions of CDR1-L (CDR1 of $V_L$), CDR2-L (CDR2 of $V_L$), CDR3-L (CDR3 of $V_L$), CDR1-H (CDR1 of $V_H$), CDR2-H (CDR2 of $V_H$), and CDR3-H (CDR3 of $V_H$), as identified by the Kabat and Chothia schemes. For CDR1-H, residue numbering is provided using both the Kabat and Chothia numbering schemes.

CDRs may be assigned, for example, using antibody numbering software, such as Abnum, available at www.bio-inf.org.uk/abs/abnum/, and described in Abhinandan and Martin, *Immunology*, 2008, 45:3832-3839, incorporated by reference in its entirety.

TABLE 1

| Residues in CDRs according to Kabat and Chothia numbering schemes. | | |
|---|---|---|
| CDR | Kabat | Chothia |
| CDR1-L | 24-34 | 24-34 |
| CDR2-L | 50-56 | 50-56 |
| CDR3-L | 89-97 | 89-97 |
| CDR1-H (Kabat Numbering) | 31-35B | 26-32 or 34* |
| CDR1-H (Chothia Numbering) | 31-35 | 26-32 |
| CDR2-H | 50-65 | 52-56 |
| CDR3-H | 95-102 | 95-102 |

*The C-terminus of CDR1-H, when numbered using the Kabat numbering convention, varies between 32 and 34, depending on the length of the CDR.

The "EU numbering scheme" is generally used when referring to a residue in an antibody heavy chain constant region (e.g., as reported in Kabat et al., supra).

An "antibody fragment" comprises a portion of an intact antibody, such as the antigen-binding or variable region of an intact antibody. Antibody fragments include, for example, Fv fragments, Fab fragments, F(ab')2 fragments, Fab' fragments, scFv (sFv) fragments, and scFv-Fc fragments.

"Fv" fragments comprise a non-covalently-linked dimer of one heavy chain variable domain and one light chain variable domain.

"Fab" fragments comprise, in addition to the heavy and light chain variable domains, the constant domain of the light chain and the first constant domain ($C_{H1}$) of the heavy chain. Fab fragments may be generated, for example, by recombinant methods or by papain digestion of a full-length antibody.

"F(ab')$_2$" fragments contain two Fab' fragments joined, near the hinge region, by disulfide bonds. F(ab')$_2$ fragments may be generated, for example, by recombinant methods or by pepsin digestion of an intact antibody. The F(ab') fragments can be dissociated, for example, by treatment with ß-mercaptoethanol.

"Single-chain Fv" or "sFv" or "scFv" antibody fragments comprise a $V_H$ domain and a $V_L$ domain in a single polypeptide chain. The $V_H$ and $V_L$ are generally linked by a peptide linker. See Plückthun A. (1994). In some embodiments, the linker is a (GGGGS)$_n$(SEQ ID NO: 5). In some embodiments, n=1, 2, 3, 4, 5, or 6. See Antibodies from *Escherichia coli*. In Rosenberg M. & Moore G. P. (Eds.), *The Pharmacology of Monoclonal Antibodies* vol. 113 (pp. 269-315). Springer-Verlag, New York, incorporated by reference in its entirety.

"scFv-Fc" fragments comprise an scFv attached to an Fc domain. For example, an Fc domain may be attached to the C-terminal of the scFv. The Fc domain may follow the $V_H$ or $V_L$, depending on the orientation of the variable domains in the scFv (i.e., $V_H$-$V_L$ or $V_L$-$V_H$). Any suitable Fc domain known in the art or described herein may be used. In some cases, the Fc domain comprises an IgG4 Fc domain.

The term "single domain antibody" refers to a molecule in which one variable domain of an antibody specifically binds to an antigen without the presence of the other variable domain. Single domain antibodies, and fragments thereof, are described in Arabi Ghahroudi et al., *FEBS Letters*, 1998, 414:521-526 and Muyldermans et al., *Trends in Biochem. Sci.*, 2001, 26:230-245, each of which is incorporated by reference in its entirety.

A "monospecific RPP" is an RPP that comprises a binding site that specifically binds to a single epitope. An example of a monospecific RPP is a naturally occurring IgG molecule which, while divalent, recognizes the same epitope at each antigen-binding domain. The binding specificity may be present in any suitable valency.

A "polyspecific RPP" is an RPP that comprises a binding site that binds non-specifically to more than one epitope. An example of a polyspecific RPP is a mixture of antibodies that bind to different serotypes of pneumococcal bacteria.

The term "monoclonal antibody" refers to an antibody from a population of substantially homogeneous antibodies. A population of substantially homogeneous antibodies comprises antibodies that are substantially similar and that bind the same epitope(s), except for variants that may normally arise during production of the monoclonal antibody. Such variants are generally present in only minor amounts. A monoclonal antibody is typically obtained by a process that includes the selection of a single antibody from a plurality of antibodies. For example, the selection process can be the selection of a unique clone from a plurality of clones, such as a pool of hybridoma clones, phage clones, yeast clones, bacterial clones, or other recombinant DNA clones. The selected antibody can be further altered, for example, to improve affinity for the target ("affinity maturation"), to humanize the antibody, to improve its production in cell culture, and/or to reduce its immunogenicity in a subject.

The term "polyclonal antibody" refers to a mixture of at least two monoclonal antibodies. Polyclonal antibodies may be either monospecific or polyspecific.

The term "chimeric antibody" refers to an antibody in which a portion of the heavy and/or light chain is derived from a particular source or species, while the remainder of the heavy and/or light chain is derived from a different source or species.

"Humanized" forms of non-human antibodies are chimeric antibodies that contain minimal sequence derived from the non-human antibody. A humanized antibody is generally a human antibody (recipient antibody) in which residues from one or more CDRs are replaced by residues from one or more CDRs of a non-human antibody (donor antibody). The donor antibody can be any suitable non-human antibody, such as a mouse, rat, rabbit, chicken, or non-human primate antibody having a desired specificity, affinity, or biological effect. In some instances, selected framework region residues of the recipient antibody are replaced by the corresponding framework region residues from the donor antibody. Humanized antibodies may also comprise residues that are not found in either the recipient antibody or the donor antibody. Such modifications may be made to further refine antibody function. For further details, see Jones et al., *Nature*, 1986, 321:522-525; Riechmann et al., *Nature*, 1988, 332:323-329; and Presta, *Curr. Op. Struct. Biol.*, 1992, 2:593-596, each of which is incorporated by reference in its entirety.

A "human antibody" is one which possesses an amino acid sequence corresponding to that of an antibody produced by a human or a human cell, or derived from a non-human source that utilizes a human antibody repertoire or human antibody-encoding sequences (e.g., obtained from human sources or designed de novo). Human antibodies specifically exclude humanized antibodies.

An "isolated RPP" or "isolated nucleic acid" is an RPP or nucleic acid that has been separated and/or recovered from a component of its natural environment. Components of the natural environment may include enzymes, hormones, and other proteinaceous or nonproteinaceous materials. In some embodiments, an isolated RPP is purified to a degree sufficient to obtain at least 15 residues of N-terminal or internal amino acid sequence, for example by use of a spinning cup sequenator. In some embodiments, an isolated RPP is purified to homogeneity by gel electrophoresis (e.g., SDS-PAGE) under reducing or nonreducing conditions, with detection by Coomassie blue or silver stain. An isolated RPP includes an RPP in situ within recombinant cells, since at least one component of the RPP's natural environment is not present. In some aspects, an isolated RPP or isolated nucleic acid is prepared by at least one purification step. In some embodiments, an isolated RPP or isolated nucleic acid is purified to at least 80%, 85%, 90%, 95%, or 99% by weight. In some embodiments, an isolated RPP or isolated nucleic acid is purified to at least 80%, 85%, 90%, 95%, or 99% by volume. In some embodiments, an isolated RPP or isolated nucleic acid is provided as a solution comprising at least 85%, 90%, 95%, 98%, 99% to 100% RPP or nucleic acid by weight. In some embodiments, an isolated RPP or isolated nucleic acid is provided as a solution comprising at least 85%, 90%, 95%, 98%, 99% to 100% RPP or nucleic acid by volume.

"Affinity" refers to the strength of the sum total of non-covalent interactions between a single binding site of a molecule (e.g., an RPP) and its binding partner (e.g., an antigen or epitope). Unless indicated otherwise, as used herein, "affinity" refers to intrinsic binding affinity, which reflects a 1:1 interaction between members of a binding pair (e.g., RPP and antigen or epitope). The affinity of a molecule X for its partner Y can be represented by the dissociation equilibrium constant ($K_D$). The kinetic components that contribute to the dissociation equilibrium constant are described in more detail below. Affinity can be measured by common methods known in the art, including those described herein. Affinity can be determined, for example, using surface plasmon resonance (SPR) technology (e.g., BIACORE®) or biolayer interferometry (e.g., FORTEBIO®).

With regard to the binding of an RPP to a target molecule, the terms "bind," "specific binding," "specifically binds to," "specific for," "selectively binds," and "selective for" a particular antigen (e.g., a polypeptide target) or an epitope on a particular antigen mean binding that is measurably different from a non-specific or non-selective interaction (e.g., with a non-target molecule). Specific binding can be measured, for example, by measuring binding to a target molecule and comparing it to binding to a non-target molecule. Specific binding can also be determined by competition with a control molecule that mimics the epitope recognized on the target molecule. In that case, specific binding is indicated if the binding of the RPP to the target molecule is competitively inhibited by the control molecule.

The term "$k_d$" ($sec^{-1}$), as used herein, refers to the dissociation rate constant of a particular ABP-antigen interaction. This value is also referred to as the $k_{off}$ value.

The term "$k_a$" ($M^{-1} \times sec^{-1}$), as used herein, refers to the association rate constant of a particular ABP-antigen interaction. This value is also referred to as the $k_{on}$ value.

The term "$K_D$" (M), as used herein, refers to the dissociation equilibrium constant of a particular ABP-antigen interaction. $K_D = k_d / k_a$.

The term "$K_A$" ($M^{-1}$), as used herein, refers to the association equilibrium constant of a particular ABP-antigen interaction. $K_A = k_a / k_d$.

An "immunoconjugate" is an RPP conjugated to one or more heterologous molecule(s).

"Effector functions" refer to those biological activities mediated by the Fc region of an antibody, which activities may vary depending on the antibody isotype. Examples of antibody effector functions include C1q binding to activate complement dependent cytotoxicity (CDC), Fc receptor binding to activate antibody-dependent cellular cytotoxicity (ADCC), and antibody dependent cellular phagocytosis (ADCP).

When used herein in the context of two or more RPPs, the term "competes with" or "cross-competes with" indicates that the two or more RPPs compete for binding to an antigen (e.g., pneumococcus polysaccharide). In one exemplary assay, pneumococcus polysaccharide is coated on a surface and contacted with a first pneumococcus polysaccharide RPP, after which a second pneumococcus polysaccharide RPP is added. In another exemplary assay, a first pneumococcus polysaccharide RPP is coated on a surface and contacted with pneumococcus polysaccharide, and then a second pneumococcus polysaccharide RPP is added. If the presence of the first pneumococcus polysaccharide RPP reduces binding of the second pneumococcus polysaccharide RPP, in either assay, then the RPPs compete. The term "competes with" also includes combinations of RPPs where one RPP reduces binding of another RPP, but where no competition is observed when the RPPs are added in the reverse order. However, in some embodiments, the first and second RPPs inhibit binding of each other, regardless of the order in which they are added. In some embodiments, one RPP reduces binding of another RPP to its antigen by at least 25%, at least 50%, at least 60%, at least 70%, at least 80%, at least 85%, at least 90%, or at least 95%. A skilled artisan can select the concentrations of the antibodies used in the competition assays based on the affinities of the RPPs for pneumococcus polysaccharide and the valency of the RPPs. The assays described in this definition are illustrative, and a skilled artisan can utilize any suitable assay to determine if antibodies compete with each other. Suitable assays are described, for example, in Cox et al., "Immunoassay Methods," in *Assay Guidance Manual*[*Internet*], Updated Dec. 24, 2014 (www.ncbi.nlm.nih.gov/books/NBK92434/; accessed Sep. 29, 2015); Silman et al., *Cytometry*, 2001, 44:30-37; and Finco et al., *J. Pharm. Biomed. Anal.*, 2011, 54:351-358; each of which is incorporated by reference in its entirety.

The term "epitope" means a portion of an antigen the specifically binds to an RPP. Epitopes frequently consist of surface-accessible amino acid residues and/or sugar side chains and may have specific three-dimensional structural characteristics, as well as specific charge characteristics. Conformational and non-conformational epitopes are distinguished in that the binding to the former but not the latter may be lost in the presence of denaturing solvents. An epitope may comprise amino acid residues that are directly involved in the binding, and other amino acid residues, which are not directly involved in the binding. The epitope to which an RPP binds can be determined using known techniques for epitope determination such as, for example, testing for RPP binding to pneumococcus polysaccharide serotypes.

Percent "identity" between a polypeptide sequence and a reference sequence, is defined as the percentage of amino acid residues in the polypeptide sequence that are identical to the amino acid residues in the reference sequence, after aligning the sequences and introducing gaps, if necessary, to achieve the maximum percent sequence identity. Alignment for purposes of determining percent amino acid sequence identity can be achieved in various ways that are within the skill in the art, for instance, using publicly available computer software such as BLAST, BLAST-2, ALIGN, MEGA-LIGN (DNASTAR), CLUSTALW, CLUSTAL OMEGA, or MUSCLE software. Those skilled in the art can determine appropriate parameters for aligning sequences, including any algorithms needed to achieve maximal alignment over the full length of the sequences being compared.

A "conservative substitution" or a "conservative amino acid substitution," refers to the substitution an amino acid with a chemically or functionally similar amino acid. Conservative substitution tables providing similar amino acids are well known in the art. By way of example, the groups of amino acids provided in TABLES 2-4 are, in some embodiments, considered conservative substitutions for one another.

TABLE 2

Selected groups of amino acids that are considered conservative substitutions for one another, in certain embodiments.

| Acidic Residues | D and E |
| Basic Residues | K, R, and H |
| Hydrophilic Uncharged Residues | S, T, N, and Q |
| Aliphatic Uncharged Residues | G, A, V, L, and I |
| Non-polar Uncharged Residues | C, M, and P |
| Aromatic Residues | F, Y, and W |

TABLE 3

Additional selected groups of amino acids that are considered conservative substitutions for one another, in certain embodiments.

| Group 1 | A, S, and T |
| Group 2 | D and E |
| Group 3 | N and Q |
| Group 4 | R and K |
| Group 5 | I, L, and M |
| Group 6 | F, Y, and W |

TABLE 4

Further selected groups of amino acids that are considered conservative substitutions for one another, in certain embodiments.

| Group A | A and G |
| Group B | D and E |
| Group C | N and Q |
| Group D | R, K, and H |
| Group E | I, L, M, V |
| Group F | F, Y, and W |
| Group G | S and T |
| Group H | C and M |

Additional conservative substitutions may be found, for example, in Creighton, *Proteins: Structures and Molecular Properties* 2nd ed. (1993) W. H. Freeman & Co., New York, NY. An RPP generated by making one or more conservative substitutions of amino acid residues in a parent RPP is referred to as a "conservatively modified variant."

The term "treating" (and variations thereof such as "treat" or "treatment") refers to clinical intervention in an attempt to alter the natural course of a disease or condition in a subject in need thereof. Treatment can be performed both for prophylaxis and during the course of clinical pathology. Desirable effects of treatment include preventing occurrence or recurrence of disease, alleviation of symptoms, diminish of any direct or indirect pathological consequences of the disease, preventing metastasis, decreasing the rate of disease progression, amelioration or palliation of the disease state, and remission or improved prognosis.

As used herein, the term "therapeutically effective amount" or "effective amount" refers to an amount of an RPP or pharmaceutical composition provided herein that, when administered to a subject, is effective to treat a disease or disorder.

As used herein, the term "subject" means a mammalian subject. Exemplary subjects include humans, monkeys, dogs, cats, mice, rats, cows, horses, camels, goats, rabbits, and sheep. In certain embodiments, the subject is a human. In some embodiments the subject has a disease or condition that can be treated with an RPP provided herein. In some aspects, the disease or condition is a cancer. In some aspects, the disease or condition is a viral infection.

The term "package insert" is used to refer to instructions customarily included in commercial packages of therapeutic or diagnostic products (e.g., kits) that contain information about the indications, usage, dosage, administration, combination therapy, contraindications and/or warnings concerning the use of such therapeutic or diagnostic products.

The term "cytotoxic agent," as used herein, refers to a substance that inhibits or prevents a cellular function and/or causes cell death or destruction.

A "chemotherapeutic agent" refers to a chemical compound useful in the treatment of cancer. Chemotherapeutic agents include "anti-hormonal agents" or "endocrine therapeutics" which act to regulate, reduce, block, or inhibit the effects of hormones that can promote the growth of cancer.

The term "cytostatic agent" refers to a compound or composition which arrests growth of a cell either in vitro or in vivo. In some embodiments, a cytostatic agent is an agent that reduces the percentage of cells in S phase. In some embodiments, a cytostatic agent reduces the percentage of cells in S phase by at least about 20%, at least about 40%, at least about 60%, or at least about 80%.

The term "tumor" refers to all neoplastic cell growth and proliferation, whether malignant or benign, and all pre-cancerous and cancerous cells and tissues. The terms "cancer," "cancerous," "cell proliferative disorder," "proliferative disorder" and "tumor" are not mutually exclusive as referred to herein. The terms "cell proliferative disorder" and "proliferative disorder" refer to disorders that are associated with some degree of abnormal cell proliferation. In some embodiments, the cell proliferative disorder is a cancer.

The term "pharmaceutical composition" refers to a preparation which is in such form as to permit the biological activity of an active ingredient contained therein to be effective in treating a subject, and which contains no additional components which are unacceptably toxic to the subject.

The terms "modulate" and "modulation" refer to reducing or inhibiting or, alternatively, activating or increasing, a recited variable.

The terms "increase" and "activate" refer to an increase of 10%, 20%, 30%, 40%, 50%, 60%, 70%, 75%, 80%, 85%, 90%, 95%, 100%, 2-fold, 3-fold, 4-fold, 5-fold, 10-fold, 20-fold, 50-fold, 100-fold, or greater in a recited variable.

The terms "reduce" and "inhibit" refer to a decrease of 10%, 20%, 30%, 40%, 50%, 60%, 70%, 75%, 80%, 85%, 90%, 95%, 2-fold, 3-fold, 4-fold, 5-fold, 10-fold, 20-fold, 50-fold, 100-fold, or greater in a recited variable.

The term "agonize" refers to the activation of receptor signaling to induce a biological response associated with activation of the receptor. An "agonist" is an entity that binds to and agonizes a receptor.

The term "antagonize" refers to the inhibition of receptor signaling to inhibit a biological response associated with activation of the receptor. An "antagonist" is an entity that binds to and antagonizes a receptor.

The term "effector T cell" includes T helper (i.e., CD4+) cells and cytotoxic (i.e., CD8+) T cells. CD4+ effector T cells contribute to the development of several immunologic processes, including maturation of B cells into plasma cells and memory B cells, and activation of cytotoxic T cells and macrophages. CD8+ effector T cells destroy virus-infected cells and tumor cells. See Seder and Ahmed, *Nature Immunol.*, 2003, 4:835-842, incorporated by reference in its entirety, for additional information on effector T cells.

The term "regulatory T cell" includes cells that regulate immunological tolerance, for example, by suppressing effector T cells. In some aspects, the regulatory T cell has a CD4+CD25+Foxp3+ phenotype. In some aspects, the regulatory T cell has a CD8+CD25+ phenotype. See Nocentini et al., *Br. J. Pharmacol.*, 2012, 165:2089-2099, incorporated by reference in its entirety, for additional information on regulatory T cells.

The term "dendritic cell" refers to a professional antigen-presenting cell capable of activating a naïve T cell and stimulating growth and differentiation of a B cell.

The term "plasma cell" refers to white blood cells that secrete large volumes of antibodies. They are transported by the blood plasma and the lymphatic system. B cells (for example, either germinal center naïve B cells or memory B cells) differentiate into plasma cells that produce antibody molecules closely modelled after the receptors of the precursor B cell. Once released into the blood and lymph, these antibody molecules bind to the target antigen (foreign substance) and initiate its neutralization or destruction. Terminally differentiated plasma cells express relatively few surface antigens, and do not express common pan-B cell markers, such as CD19 and CD20. Instead, plasma cells are identified through flow cytometry by their additional expression of CD138, CD78, and the Interleukin-6 receptor. In humans, CD27 is a good marker for plasma cells, naive B cells are CD27−, memory B-cells are CD27+ and plasma cells are CD27++. The surface antigen CD138 (syndecan-1) is expressed at high levels. Another important surface antigen is CD319 (SLAMF7). This antigen is expressed at high levels on normal human plasma cells. It is also expressed on malignant plasma cells in multiple myeloma. Compared with CD138, which disappears rapidly ex vivo, the expression of CD319 is considerably more stable.

The term "plasmablast" refers to antibody-secreting cells in the peripheral blood, which differentiate from activated B cells, such as memory B cells, upon stimulation with an antigen. The most immature blood cell that is considered of plasma cell lineage is the plasmablast. Plasmablasts secrete more antibodies than B cells, but less than plasma cells. They divide rapidly and are still capable of internalizing antigens and presenting them to T cells. A cell may stay in this state for several days, and then either die or irrevocably differentiate into a mature, fully differentiated plasma cell.

Differentiation of mature B cells into plasma cells is dependent upon the transcription factors Blimp-1/PRDM1 and IRF4.

The term "memory B cell" refers to a B cell sub-type that are formed within germinal centers following primary infection and are important in generating an accelerated and more robust antibody-mediated immune response in the case of re-infection (also known as a secondary immune response). Memory B cells do not secrete antibody until activated by their specific antigen.

The term "naïve B cell" refers to a B cell that has not been exposed to an antigen. Once exposed to an antigen, the naïve B cell either becomes a memory B cell or a plasma cell that secretes antibodies specific to the antigen that was originally bound. Plasma cells do not last long in the circulation, this is in contrast to memory cells that last for very long periods of time.

The term "titer" refers a measurement of how much antibody an organism is producing that recognizes a particular epitope or antigen, expressed as the inverse of the greatest dilution (in a serial dilution) that still gives a positive result. Enzyme linked immunosorbent assay (ELISA) is a common means of determining antibody titers.

The term "peripheral blood" refers to blood which travels through peripheral vessels. Peripheral blood is typically obtained by venipuncture (also called phlebotomy), or by finger prick for small quantities.

The term "vaccine" refers to an agent that stimulates the body's immune system to recognize the agent as a threat, destroy it, and to further recognize and destroy any of the microorganisms associated with that agent that it may encounter in the future. The term vaccine can refer to a biological preparation that provides active acquired immunity to a particular disease. A vaccine often contains an agent that resembles a disease-causing microorganism and is often made from weakened or killed forms of the microbe, its toxins, or one of its surface proteins. Vaccines can be prophylactic (example: to prevent or ameliorate the effects of a future infection by a natural or "wild" pathogen), or therapeutic (e.g., vaccines against cancer are being investigated). More generally, the term vaccine can refer to any agent that induces an immune response. For example, cancer cells can be used to vaccinate an individual against certain cancer antigens. Some vaccines contain inactivated, but previously virulent, micro-organisms that have been destroyed with chemicals, heat, or radiation. Examples include the polio vaccine, hepatitis A vaccine, rabies vaccine and some influenza vaccines. Some vaccines contain live, attenuated microorganisms. Many of these are active viruses that have been cultivated under conditions that disable their virulent properties, or that use closely related but less dangerous organisms to produce a broad immune response. Although most attenuated vaccines are viral, some are bacterial in nature. Examples include the viral diseases yellow fever, measles, mumps, and rubella, and the bacterial disease typhoid. The live *Mycobacterium tuberculosis* vaccine developed by Calmette and Guerin is not made of a contagious strain but contains a virulently modified strain called "BCG" used to elicit an immune response to the vaccine. The live attenuated vaccine containing strain *Yersinia pestis* EV is used for plague immunization. Attenuated vaccines have some advantages and disadvantages. They typically provoke more durable immunological responses and are the preferred type for healthy adults. But they may not be safe for use in immunocompromised individuals, and on rare occasions mutate to a virulent form and cause disease. Toxoid vaccines are made from inactivated toxic compounds that cause illness rather than the micro-organism. Examples of toxoid-based vaccines include tetanus and diphtheria. Toxoid vaccines are known for their efficacy. Not all toxoids are for micro-organisms; for example, *Crotalus atrox* toxoid is used to vaccinate dogs against rattlesnake bites. In protein subunit vaccines, rather than introducing an inactivated or attenuated micro-organism to an immune system (which would constitute a "whole-agent" vaccine), a fragment of it can create an immune response. Examples include the subunit vaccine against Hepatitis B virus that is composed of only the surface proteins of the virus (previously extracted from the blood serum of chronically infected patients, but now produced by recombination of the viral genes into yeast) or as an edible algae vaccine, the virus-like particle (VLP) vaccine against human papillomavirus (HPV) that is composed of the viral major capsid protein, and the hemagglutinin and neuraminidase subunits of the influenza virus. For conjugate vaccines, certain bacteria have polysaccharide outer coats that are poorly immunogenic. By linking these outer coats to proteins (e.g., toxins), the immune system can be led to recognize the polysaccharide as if it were a protein antigen. This approach is used in the *Haemophilus influenzae* type B vaccine. Dendritic cell vaccines combine dendritic cells with antigens in order to present the antigens to the body's white blood cells, thus stimulating an immune reaction. These vaccines have shown some positive preliminary results for treating brain tumors and are also tested in malignant melanoma. For recombinant vector vaccines, by combining the physiology of one micro-organism and the DNA of another, immunity can be created against diseases that have complex infection processes. An example is the RVSV-ZEBOV vaccine licensed to Merck that is being used in 2018 to combat ebola in Congo. An alternative, experimental approach to vaccination called DNA vaccination, created from an infectious agent's DNA, is under development. The proposed mechanism is the insertion (and expression, enhanced by the use of electroporation, triggering immune system recognition) of viral or bacterial DNA into human or animal cells. Some cells of the immune system that recognize the proteins expressed will mount an attack against these proteins and cells expressing them. Because these cells live for a very long time, if the pathogen that normally expresses these proteins is encountered at a later time, they will be attacked instantly by the immune system. One potential advantage of DNA vaccines is that they are very easy to produce and store. Vaccines may be monovalent (also called univalent) or multivalent (also called polyvalent). A monovalent vaccine is designed to immunize against a single antigen or single microorganism. A multivalent or polyvalent vaccine is designed to immunize against two or more strains of the same microorganism, or against two or more microorganisms. The valency of a multivalent vaccine may be denoted with a Greek or Latin prefix (e.g., tetravalent or quadrivalent). In certain cases, a monovalent vaccine may be preferable for rapidly developing a strong immune response.

The term "hyperimmune" refers to a polyclonal antibody preparation similar to intravenous immunoglobulin (IVIg), except that it is prepared from the plasma of donors with high titers of antibody against a specific organism or antigen. The term hyperimmune is often used interchangeably with the terms "hyperimmune gammaglobulin" and "hyperimmune globulin". Some agents against which hyperimmune globulins are available include hepatitis B, rabies, tetanus toxin, varicella-zoster, etc. Administration of hyperimmune globulin provides "passive" immunity to the patient against an agent. This is in contrast to vaccines that provide "active" immunity. However, vaccines take much longer to achieve that purpose while hyperimmune globulin provides instant "passive" short-lived immunity.

The term "in vivo" translates to "in the living", and refers to scientific studies in which the effects of various biological entities are tested on whole, living organisms or cells, usually animals, including humans, and plants, as opposed to a tissue extract or dead organism. This is not to be confused with experiments done in vitro ("within the glass"), i.e., in a laboratory environment using test tubes, Petri dishes, etc. Examples of investigations in vivo include: the pathogenesis of disease by comparing the effects of bacterial infection with the effects of purified bacterial toxins; the development of non-antibiotics, antiviral drugs, and new drugs generally; and new surgical procedures. Consequently, animal testing and clinical trials are major elements of in vivo research. In vivo testing is often employed over in vitro because it is better suited for observing the overall effects of an experiment on a living subject.

The term "activity" refers to a quantitative measurement of an RPP or antibody against an antigen, vaccine, protein, epitope, cell, bacterium, or virus. Activity can be assessed using in vivo or in vitro methods.

The term "recombinant" refers to proteins that result from the expression of recombinant DNA within living cells. Recombinant DNA is the general name for a piece of DNA that has been created by the combination of at least two separate segments of DNA.

The term "in vitro" translates to "in the glass", and refers to scientific studies that are performed with microorganisms, cells, or biological molecules outside their normal biological context. Colloquially called "test-tube experiments", these studies in biology and its subdisciplines are traditionally done in labware such as test tubes, flasks, Petri dishes, and microtiter plates. Studies conducted using components of an organism that have been isolated from their usual biological surroundings permit a more detailed or more convenient analysis than can be done with whole organisms; however, results obtained from in vitro experiments may not fully or accurately predict the effects on a whole organism. In contrast to in vitro experiments, in vivo studies are those conducted in animals, including humans, and whole plants.

The term "neutralization" refers to the ability of specific antibodies to block the site(s) on viruses that they use to enter their target cell. The effect of a neutralizing antibody can be negligible even with large excesses of antibody production if they lack specificity to this antigen. The production of specific antibodies can be learned for a faster response at next exposition. The reduction or destruction of a homologous infectious agent can be partial or complete and can make it no longer infectious or pathogenic to other cells.

A "variant" of a polypeptide (e.g., an antibody) comprises an amino acid sequence wherein one or more amino acid residues are inserted into, deleted from and/or substituted into the amino acid sequence relative to the native polypeptide sequence, and retains essentially the same biological activity as the native polypeptide. The biological activity of the polypeptide can be measured using standard techniques in the art (for example, if the variant is an antibody, its activity may be tested by binding assays, as described herein). Variants of the invention include fragments, analogs, recombinant polypeptides, synthetic polypeptides, and/or fusion proteins.

A "derivative" of a polypeptide is a polypeptide (e.g., an antibody) that has been chemically modified, e.g., via conjugation to another chemical moiety such as, for example, polyethylene glycol, albumin (e.g., human serum albumin), phosphorylation, and glycosylation. Unless otherwise indicated, the term "antibody" includes, in addition to antibodies comprising two full-length heavy chains and two full-length light chains, derivatives, variants, fragments, and muteins thereof, examples of which are described below.

A nucleotide sequence is "operably linked" to a regulatory sequence if the regulatory sequence affects the expression (e.g., the level, timing, or location of expression) of the nucleotide sequence. A "regulatory sequence" is a nucleic acid that affects the expression (e.g., the level, timing, or location of expression) of a nucleic acid to which it is operably linked. The regulatory sequence can, for example, exert its effects directly on the regulated nucleic acid, or through the action of one or more other molecules (e.g., polypeptides that bind to the regulatory sequence and/or the nucleic acid). Examples of regulatory sequences include promoters, enhancers and other expression control elements (e.g., polyadenylation signals). Further examples of regulatory sequences are described in, for example, Goeddel, 1990, Gene Expression Technology: Methods in Enzymology 185, Academic Press, San Diego, CA and Baron et al., 1995, Nucleic Acids Res. 23:3605-06.

A "host cell" is a cell that can be used to express a nucleic acid, e.g., a nucleic acid of the invention. A host cell can be a prokaryote, for example, *E. coli*, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Examples of host cells include CS-9 cells, the COS-7 line of monkey kidney cells (ATCC CRL 1651) (see Gluzman et al., 1981, Cell 23:175), L cells, C127 cells, 3T3 cells (ATCC CCL 163), Chinese hamster ovary (CHO) cells or their derivatives such as Veggie CHO and related cell lines which grow in serum-free media (see Rasmussen et al., 1998, Cytotechnology 28:31), HeLa cells, BHK (ATCC CRL 10) cell lines, the CV1/EBNA cell line derived from the African green monkey kidney cell line CV1 (ATCC CCL 70) (see McMahan et al., 1991, EMBO J. 10:2821), human embryonic kidney cells such as 293, 293 EBNA or MSR 293, human epidermal A431 cells, human Colo205 cells, other transformed primate cell lines, normal diploid cells, cell strains derived from in vitro culture of primary tissue, primary explants, HL-60, U937, HaK or Jurkat cells. Typically, a host cell is a cultured cell that can be transformed or transfected with a polypeptide-encoding nucleic acid, which can then be expressed in the host cell.

The phrase "recombinant host cell" can be used to denote a host cell that has been transformed or transfected with a nucleic acid to be expressed. A host cell also can be a cell that comprises the nucleic acid but does not express it at a desired level unless a regulatory sequence is introduced into the host cell such that it becomes operably linked with the nucleic acid. It is understood that the term host cell refers not only to the particular subject cell but to the progeny or potential progeny of such a cell. Because certain modifications may occur in succeeding generations due to, e.g., mutation or environmental influence, such progeny may not, in fact, be identical to the parent cell, but are still included within the scope of the term as used herein.

7.2. Other Interpretational Conventions

Ranges recited herein are understood to be shorthand for all of the values within the range, inclusive of the recited endpoints. For example, a range of 1 to 50 is understood to include any number, combination of numbers, or sub-range from the group consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50.

Unless otherwise indicated, reference to a compound that has one or more stereocenters intends each stereoisomer, and all combinations of stereoisomers, thereof.

7.3. RPPs and Libraries of RPPs

Each member of the libraries of RPPs described herein is a polypeptide that specifically binds an antigen, e.g., is an antibody or an antibody fragment. In some embodiments, the RPPs include cognate pairs of the heavy and light chain CDR3 sequences disclosed herein. In some embodiments the RPPs are scFvs. In some embodiments the RPPs are full-length antibodies.

In some embodiments, the RPPs are antibody fragments. A Fab fragment is a monovalent fragment having the $V_L$, $V_H$, $C_L$ and $C_H1$ domains; a F(ab')2 fragment is a bivalent fragment having two Fab fragments linked by a disulfide bridge at the hinge region; a Fd fragment has the $V_H$ and $C_{H1}$ domains; an Fv fragment has the $V_L$ and $V_H$ domains of a single arm of an antibody; and a dAb fragment has a $V_H$ domain, a $V_L$ domain, or an antigen-binding fragment of a $V_H$ or $V_L$ domain (U.S. Pat. Nos. 6,846,634, 6,696,245, US App. Pub. No. 05/0202512, 04/0202995, 04/0038291, 04/0009507, 03/0039958, Ward et al., Nature 341:544-546, 1989).

Naturally occurring immunoglobulin chains exhibit the same general structure of relatively conserved framework regions (FR) joined by three hypervariable regions, also called complementarity determining regions or CDRs. From N-terminus to C-terminus, both light and heavy chains comprise the domains FR1, CDR1, FR2, CDR2, FR3, CDR3 and FR4. The assignment of amino acids to each domain is in accordance with the definitions of Kabat et al. in Sequences of Proteins of Immunological Interest, 5th Ed., US Dept. of Health and Human Services, PHS, NIH, NIH Publication no. 91-3242, 1991.

The term "human antibody," also referred to as "fully human antibody," includes all antibodies that have one or more variable and constant regions derived from human immunoglobulin sequences. In one embodiment, all of the variable and constant domains are derived from human immunoglobulin sequences (a fully human antibody). These antibodies may be prepared in a variety of ways, examples of which are described below, including through the immunization with an antigen of interest of a mouse that is genetically modified to express antibodies derived from human heavy and/or light chain-encoding genes.

A humanized antibody has a sequence that differs from the sequence of an antibody derived from a non-human species by one or more amino acid substitutions, deletions, and/or additions, such that the humanized antibody is less likely to induce an immune response, and/or induces a less severe immune response, as compared to the non-human species antibody, when it is administered to a human subject. In one embodiment, certain amino acids in the framework and constant domains of the heavy and/or light chains of the non-human species antibody are mutated to produce the humanized antibody. In another embodiment, the constant domain(s) from a human antibody are fused to the variable domain(s) of a non-human species. In another embodiment, one or more amino acid residues in one or more CDR sequences of a non-human antibody are changed to reduce the likely immunogenicity of the non-human antibody when it is administered to a human subject, wherein the changed amino acid residues either are not critical for immunospecific binding of the antibody to its antigen, or the changes to the amino acid sequence that are made are conservative changes, such that the binding of the humanized antibody to the antigen is not significantly worse than the binding of the non-human antibody to the antigen. Examples of how to make humanized antibodies may be found in U.S. Pat. Nos. 6,054,297, 5,886,152 and 5,877,293.

Fragments or analogs of antibodies can be readily prepared by those of ordinary skill in the art following the teachings of this specification and using techniques well-known in the art. Preferred amino- and carboxy-termini of fragments or analogs occur near boundaries of functional domains. Structural and functional domains can be identified by comparison of the nucleotide and/or amino acid sequence data to public or proprietary sequence databases. Computerized comparison methods can be used to identify sequence motifs or predicted protein conformation domains that occur in other proteins of known structure and/or function. Methods to identify protein sequences that fold into a known three-dimensional structure are known. See, e.g., Bowie et al., 1991, Science 253:164.

An RPP may also be any synthetic or genetically engineered protein. For example, antibody fragments include isolated fragments consisting of the light chain variable region, "Fv" fragments consisting of the variable regions of the heavy and light chains, recombinant single chain polypeptide molecules in which light and heavy variable regions are connected by a peptide linker (scFv proteins).

Another form of an antibody fragment is a peptide comprising one or more complementarity determining regions (CDRs) of an antibody. CDRs (also termed "minimal recognition units", or "hypervariable region") can be incorporated into a molecule either covalently or noncovalently to make it an antigen binding protein. CDRs can be obtained by constructing polynucleotides that encode the CDR of interest. Such polynucleotides are prepared, for example, by using the polymerase chain reaction to synthesize the variable region using mRNA of antibody producing cells as a template (see, for example, Larrick et al., Methods: A Companion to Methods in Enzymology 2:106, 1991; Courtenay Luck, "Genetic Manipulation of Monoclonal Antibodies," in Monoclonal Antibodies: Production, Engineering and Clinical Application, Ritter et al. (eds.), page 166 (Cambridge University Press 1995); and Ward et al., "Genetic Manipulation and Expression of Antibodies," in Monoclonal Antibodies: Principles and Applications, Birch et al., (eds.), page 137 (Wiley Liss, Inc. 1995).

The variable region domains of RPPs can be any naturally occurring variable domain or an engineered version thereof. By engineered version is meant a variable region domain that has been created using recombinant DNA engineering techniques. Such engineered versions include those created, for example, from a specific antibody variable region by insertions, deletions, or changes in or to the amino acid sequences of the specific antibody. Particular examples include engineered variable region domains containing at least one CDR and optionally one or more framework amino acids from a first antibody and the remainder of the variable region domain from a second antibody.

The variable region domain may be covalently attached at a C terminal amino acid to at least one other antibody domain or a fragment thereof. Thus, for example, a $V_H$ domain that is present in the variable region domain may be linked to an immunoglobulin CH1 domain, or a fragment thereof. Similarly, a $V_L$ domain may be linked to a CK domain or a fragment thereof. In this way, for example, the antibody may be a Fab fragment wherein the antigen binding domain contains associated $V_H$ and $V_L$ domains covalently linked at their C termini to a CH1 and CK domain, respectively. The CH1 domain may be extended with further amino acids, for example to provide a hinge region or a portion of a hinge region domain as found in a Fab' fragment, or to provide further domains, such as antibody $C_H2$ and $C_H3$ domains.

As described herein, RPPs comprise the cognate pairs of heavy and light chain CDR3 sequence disclosed herein. For example, CDRs may be incorporated into known antibody framework regions (IgG1, IgG2, etc.), or conjugated to a suitable vehicle to enhance the half-life thereof. Suitable vehicles include, but are not limited to Fc, polyethylene glycol (PEG), albumin, transferrin, and the like. These and other suitable vehicles are known in the art. Such conjugated CDR peptides may be in monomeric, dimeric, tetrameric, or other form. In one embodiment, one or more water-soluble polymer is bonded at one or more specific position, for example at the amino terminus, of a binding agent.

In certain embodiments, an antibody in an RPP comprises one or more water soluble polymer attachments, including, but not limited to, polyethylene glycol, polyoxyethylene glycol, or polypropylene glycol. See, e.g., U.S. Pat. Nos. 4,640,835, 4,496,689, 4,301,144, 4,670,417, 4,791,192 and 4,179,337. In certain embodiments, a derivative binding agent comprises one or more of monomethoxy-polyethylene glycol, dextran, cellulose, or other carbohydrate based polymers, poly-(N-vinyl pyrrolidone)-polyethylene glycol, propylene glycol homopolymers, a polypropylene oxide/ethylene oxide co-polymer, polyoxyethylated polyols (e.g., glycerol) and polyvinyl alcohol, as well as mixtures of such polymers. In certain embodiments, one or more water-soluble polymer is randomly attached to one or more side chains. In certain embodiments, PEG can act to improve the therapeutic capacity for a binding agent, such as an antibody. Certain such methods are discussed, for example, in U.S. Pat. No. 6,133,426, which is hereby incorporated by reference for any purpose.

An RPP can have, for example, the structure of a naturally occurring immunoglobulin. An "immunoglobulin" is a tetrameric molecule. In a naturally occurring immunoglobulin, each tetramer is composed of two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function. Human light chains are classified as kappa and lambda light chains. Heavy chains are classified as mu, delta, gamma, alpha, or epsilon, and define the antibody's isotype as IgM, IgD, IgG, IgA, and IgE, respectively. Within light and heavy chains, the variable and constant regions are joined by a "J" region of about 12 or more amino acids, with the heavy chain also including a "D" region of about 10 more amino acids. See generally, Fundamental Immunology Ch. 7 (Paul, W., ed., 2nd ed. Raven Press, N.Y. (1989)) (incorporated by reference in its entirety for all purposes). The variable regions of each light/heavy chain pair form the antibody binding site such that an intact immunoglobulin has two binding sites.

Different RPPs may bind to different domains of disease targets or act by different mechanisms of action. As indicated herein inter alia, the domain regions are designated such as to be inclusive of the group, unless otherwise indicated. For example, amino acids 4-12 refers to nine amino acids: amino acids at positions 4, and 12, as well as the seven intervening amino acids in the sequence. Other examples include antigen binding proteins that inhibit binding of a pathogen to its target cell, i.e., neutralizing activity. An antigen binding protein need not completely inhibit a binding to target cell to find use in the present invention.

The RPPs describe herein can include an FC region, e.g., a dimer Fc polypeptide. One suitable Fc polypeptide, described in PCT application WO 93/10151 (hereby incorporated by reference), is a single chain polypeptide extending from the N-terminal hinge region to the native C-terminus of the Fc region of a human IgG1 antibody. Another useful Fc polypeptide is the Fc mutein described in U.S. Pat. No. 5,457,035 and in Baum et al., 1994, EMBO J. 13:3992-4001. The amino acid sequence of this mutein is identical to that of the native Fc sequence presented in WO 93/10151, except that amino acid 19 has been changed from Leu to Ala, amino acid 20 has been changed from Leu to Glu, and amino acid 22 has been changed from Gly to Ala. The mutein exhibits reduced affinity for Fc receptors.

Antigen-binding fragments of RPPs of the invention can be produced by conventional techniques. Examples of such fragments include, but are not limited to, Fab and F(ab')$_2$ fragments. Antibody fragments and derivatives produced by genetic engineering techniques also are contemplated.

Additional embodiments include chimeric antibodies, e.g., humanized versions of non-human (e.g., murine) monoclonal antibodies. Such humanized antibodies may be prepared by known techniques, and offer the advantage of reduced immunogenicity when the antibodies are administered to humans. In one embodiment, a humanized antibody comprises the variable domain of a murine antibody (or all or part of the antigen binding site thereof) and a constant domain derived from a human antibody. Alternatively, a humanized antibody fragment may comprise the antigen binding site of a murine antibody and a variable domain fragment (lacking the antigen-binding site) derived from a human antibody. Procedures for the production of chimeric and further engineered antibodies include those described in Riechmann et al., 1988, Nature 332:323, Liu et al., 1987, Proc. Nat. Acad. Sci. USA 84:3439, Larrick et al., 1989, Bio/Technology 7:934, and Winter et al., 1993, TIPS 14:139. In one embodiment, the chimeric antibody is a CDR grafted antibody. Techniques for humanizing antibodies are discussed in, e.g., U.S. Pat. Nos. 5,869,619, 5,225,539, 5,821,337, 5,859,205, 6,881,557, Padlan et al., 1995, FASEB J. 9:133-39, and Tamura et al., 2000, J. Immunol. 164:1432-41.

Procedures have been developed for generating human or partially human antibodies in non-human animals. For example, mice in which one or more endogenous immunoglobulin genes have been inactivated by various means have been prepared. Human immunoglobulin genes have been introduced into the mice to replace the inactivated mouse genes. Antibodies produced in the animal incorporate human immunoglobulin polypeptide chains encoded by the human genetic material introduced into the animal. In one embodiment, a non-human animal, such as a transgenic mouse, is immunized with a vaccine, such that antibodies directed against the vaccine antigen pare generated in the animal.

Examples of techniques for production and use of transgenic animals for the production of human or partially human antibodies are described in U.S. Pat. Nos. 5,814,318, 5,569,825, and 5,545,806, Davis et al., 2003, Production of human antibodies from transgenic mice in Lo, ed. Antibody Engineering: Methods and Protocols, Humana Press, NJ:191-200, Kellermann et al., 2002, Curr Opin Biotechnol. 13:593-97, Russel et al., 2000, Infect Immun. 68:1820-26, Gallo et al., 2000, Eur J Immun. 30:534-40, Davis et al., 1999, Cancer Metastasis Rev. 18:421-25, Green, 1999, J Immunol Methods. 231:11-23, Jakobovits, 1998, Advanced Drug Delivery Reviews 31:33-42, Green et al., 1998, J Exp Med. 188:483-95, Jakobovits A, 1998, Exp. Opin. Invest. Drugs. 7:607-14, Tsuda et al., 1997, Genomics. 42:413-21, Mendez et al., 1997, Nat Genet. 15:146-56, Jakobovits, 1994, Curr Biol. 4:761-63, Arbones et al., 1994, Immunity. 1:247-60, Green et al., 1994, Nat Genet. 7:13-21, Jakobovits et al., 1993, Nature. 362:255-58, Jakobovits et al., 1993, Proc Natl Acad Sci USA. 90:2551-55. Chen, J., M. Trounstine, F. W. Alt, F. Young, C. Kurahara, J. Loring, D. Huszar. Inter'l Immunol. 5 (1993): 647-656, Choi et al., 1993, Nature Genetics 4: 117-23, Fishwild et al., 1996, Nature Biotech. 14: 845-51, Harding et al., 1995, Annals of the New York Academy of Sciences, Lonberg et al., 1994, Nature 368: 856-59, Lonberg, 1994, Transgenic Approaches to Human Monoclonal Antibodies in Handbook of Experimental Pharmacology 113: 49-101, Lonberg et al., 1995, Internal Review of Immunology 13: 65-93, Neuberger, 1996, Nature Biotechnology 14: 826, Taylor et al., 1992, Nucleic Acids Res. 20: 6287-95, Taylor et al., 1994, Inter'l Immunol. 6: 579-91, Tomizuka et al., 1997, Nature Genetics 16: 133-43, Tomizuka et al., 2000, Pro. Nat'l Acad. Sci. USA 97: 722-27, Tuaillon et al., 1993, Pro. Nat'l Acad. Sci. USA 90: 3720-24, and Tuaillon et al., 1994, J. Immunol. 152: 2912-20.

RPPs (e.g., antibodies, antibody fragments, and antibody derivatives) of the invention can comprise any constant region known in the art. The light chain constant region can be, for example, a kappa- or lambda-type light chain constant region, e.g., a human kappa- or lambda-type light chain constant region. The heavy chain constant region can be, for example, an alpha-, delta-, epsilon-, gamma-, or mu-type heavy chain constant regions, e.g., a human alpha-, delta-, epsilon-, gamma-, or mu-type heavy chain constant region. In one embodiment, the light or heavy chain constant region is a fragment, derivative, variant, or mutein of a naturally occurring constant region.

Techniques are known for deriving an antibody of a different subclass or isotype from an antibody of interest, i.e., subclass switching. Thus, IgG antibodies may be derived from an IgM antibody, for example, and vice versa. Such techniques allow the preparation of new antibodies that possess the antigen-binding properties of a given antibody (the parent antibody), but also exhibit biological properties associated with an antibody isotype or subclass different from that of the parent antibody. Recombinant DNA techniques may be employed. Cloned DNA encoding particular antibody polypeptides may be employed in such procedures, e.g., DNA encoding the constant domain of an antibody of the desired isotype. See also Lantto et al., 2002, Methods Mol. Biol. 178:303-16.

Single chain antibodies (scFv) may be formed by linking heavy and light chain variable domain (Fv region) fragments via an amino acid bridge (short peptide linker, e.g., a synthetic sequence of amino acid residues), resulting in a single polypeptide chain. Such single-chain Fvs (scFvs) have been prepared by fusing DNA encoding a peptide linker between DNAs encoding the two variable domain polypeptides ($V_L$ and $V_H$). The resulting polypeptides can fold back on themselves to form antigen-binding monomers, or they can form multimers (e.g., dimers, trimers, or tetramers), depending on the length of a flexible linker between the

| two variable domains (Kortt et al., 1997, *Prot. Eng.* 10:423; Kortt et al., 2001, *Biomol. Eng.* 18:95-108, Bird et al., 1988, *Science* 242:423-26 and Huston et al., 1988, *Proc. Natl. Acad. Sci. USA* 85:5879-83). By combining different $V_L$ and $V_H$-comprising polypeptides, one can form multimeric scFvs that bind to different epitopes (Kriangkum et al., 2001, *Biomol. Eng.* 18:31-40). Techniques developed for the production of single chain antibodies include those described in U.S. Pat. No. 4,946,778; Bird, 1988, *Science* 242:423; Huston et al., 1988, *Proc. Natl. Acad. Sci.* USA 85:5879; Ward et al., 1989, *Nature* 334:544, de Graaf et al., 2002, *Methods Mol Biol.* 178:379-87.

In certain aspects, the invention includes RPPs generated from libraries of antibody-encoding expression vectors. RPPs comprise 10, 100, 1,000, 10,000 or more than 100,000 distinct antibody sequences. In certain aspects, the RPPs are generated from mammalian cells engineered recombinantly with antibody sequences encoded by single plasma cells or plasmablasts. In certain aspects, the RPPs are polyvalent, in that they comprise antibodies that have different antigen-binding properties. In some embodiments, the RPPs bind to multiple epitopes on a target antigen. In some embodiments, the RPPs bind to multiple antigens.

7.4. CDR3 Sequences of RPPs

CDR3H (heavy chain immunoglobulin) and CDR3L (light chain immunoglobulin) polypeptide sequences comprising each member of twelve RPPs generated using the methods described herein are provided in the sequence listing. A summary of the sequences is provided in TABLE 5. The sequences are found in the sequence listing submitted with this application. RPPs provided herein using human thymocytes or human T cells as immunogens are generated from humanized mice that express fully human V(D)J antibody sequences. RPPs provided herein using pneumococcus polysaccharide, influenza A virus antigen, hepatitis B virus antigen, or *Haemophilus influenzae* B polysaccharide were generated from vaccinated human donors. The RPPs comprise between 1,141 and 10,537 unique antibodies.

75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identical to least one of the CDRs provided herein.

7.5. Nucleic Acids

In one aspect, the present invention provides isolated nucleic acid molecules. The nucleic acids comprise, for example, polynucleotides that encode all or part of an RPP, for example, one or both chains of an antibody of the invention, or a fragment, derivative, mutein, or variant thereof, polynucleotides sufficient for use as hybridization probes, PCR primers or sequencing primers for identifying, analyzing, mutating or amplifying a polynucleotide encoding a polypeptide, anti-sense nucleic acids for inhibiting expression of a polynucleotide, and complementary sequences of the foregoing. The nucleic acids can be any length. They can be, for example, 5, 10, 15, 20, 25, 30, 35, 40, 45, 50, 75, 100, 125, 150, 175, 200, 250, 300, 350, 400, 450, 500, 750, 1,000, 1,500, 3,000, 5,000 or more nucleotides in length, and/or can comprise one or more additional sequences, for example, regulatory sequences, and/or be part of a larger nucleic acid, for example, a vector. The nucleic acids can be single-stranded or double-stranded and can comprise RNA and/or DNA nucleotides, and artificial variants thereof (e.g., peptide nucleic acids).

Nucleic acids encoding antibody polypeptides (e.g., heavy or light chain, variable domain only, CDRs only, or full length) can be isolated from B-cells of mice that have been immunized with a vaccine. The nucleic acid can be isolated by conventional procedures such as polymerase chain reaction (PCR).

Polypeptide sequences of the CDR3 from the variable regions of the heavy and light chain variable regions are shown herein. The skilled artisan will appreciate that, due to the degeneracy of the genetic code, each of the polypeptide sequences disclosed herein is encoded by a large number of other nucleic acid sequences. The present invention provides each degenerate nucleotide sequence encoding each RPP of the invention.

TABLE 5

| CDR3 heavy and CDR3 light chain sequences | | | |
|---|---|---|---|
| RPP ID | Immunogen | SEQ ID NOS: | Number of antibodies |
| RPP1 | Pneumococcus polysaccharide (Pneumovax23, Merck) | 1-21074 | 10537 |
| RPP2 | Influenza A antigen (Seqirus, CSL) | 21075-33980 | 6453 |
| RPP3 | Haemophilius influenzae b polysaccharide (PedvaxHIB, Merck) | 33981-47174 | 6597 |
| RPP4 | Haemophilius influenzae b polysaccharide (PedvaxHIB, Merck) | 47175-64340 | 8583 |
| RPP5 | Haemophilius influenzae b polysaccharide (PedvaxHIB, Merck) | 64341-80252 | 7956 |
| RPP6 | Haemophilius influenzae b polysaccharide (PedvaxHIB, Merck) | 80253-100626 | 10187 |
| RPP8 | Hepatitis B virus antigen (Engerix, GSK) | 100627-103860 | 1617 |
| RPP9 | Hepatitis B virus antigen (Engerix, GSK) | 103861-106380 | 1260 |
| RPP10 | Human thymocytes (thymocyte globulin) | 106381-110130 | 1875 |
| RPP11 | Human thymocytes (thymocyte globulin) | 110131-114096 | 1983 |
| RPP12 | Human T cells (thymocyte globulin) | 114097-117876 | 1890 |
| RPP13 | Human T cells (thymocyte globulin) | 117877-120158 | 1141 |

An oligopeptide or polypeptide is within the scope of the invention if it has an amino acid sequence that is at least Methods for hybridizing nucleic acids are well-known in the art. See, e.g., Curr. Prot. in Mol. Biol., John Wiley &

Sons, N.Y. (1989), 6.3.1-6.3.6. As defined herein, a moderately stringent hybridization condition uses a prewashing solution containing 5× sodium chloride/sodium citrate (SSC), 0.5% SDS, 1.0 mM EDTA (pH 8.0), hybridization buffer of about 50% formamide, 6×SSC, and a hybridization temperature of 55° C. (or other similar hybridization solutions, such as one containing about 50% formamide, with a hybridization temperature of 42° C.), and washing conditions of 60° C., in 0.5×SSC, 0.1% SDS. A stringent hybridization condition hybridizes in 6×SSC at 450 C, followed by one or more washes in 0.1×SSC, 0.2% SDS at 68° C. Furthermore, one of skill in the art can manipulate the hybridization and/or washing conditions to increase or decrease the stringency of hybridization such that nucleic acids comprising nucleotide sequences that are at least 65, 70, 75, 80, 85, 90, 95, 98, or 99% identical to each other typically remain hybridized to each other. The basic parameters affecting the choice of hybridization conditions and guidance for devising suitable conditions are set forth by, for example, Sambrook, Fritsch, and Maniatis (1989, Molecular Cloning: A Laboratory Manual, Cold Spring Harbor Laboratory Press, Cold Spring Harbor, N.Y., chapters 9 and 11; and Curr. Prot. in Mol. Biol. 1995, Ausubel et al., eds., John Wiley & Sons, Inc., sections 2.10 and 6.3-6.4), and can be readily determined by those having ordinary skill in the art based on, for example, the length and/or base composition of the DNA.

Changes can be introduced by mutation into a nucleic acid, thereby leading to changes in the amino acid sequence of a polypeptide (e.g., an RPP) that it encodes. Mutations can be introduced using any technique known in the art. In one embodiment, one or more particular amino acid residues are changed using, for example, a site-directed mutagenesis protocol. In another embodiment, one or more randomly selected residues are changed using, for example, a random mutagenesis protocol. However, it is made, a mutant polypeptide can be expressed and screened for a desired property (e.g., binding to a virus).

In another aspect, the present invention provides nucleic acid molecules that are suitable for use as primers or hybridization probes for the detection of nucleic acid sequences of the invention. A nucleic acid molecule of the invention can comprise only a portion of a nucleic acid sequence encoding a full-length polypeptide of the invention, for example, a fragment that can be used as a probe or primer or a fragment encoding an active portion (e.g., a virus binding portion) of a polypeptide of the invention.

Probes based on the sequence of a nucleic acid of the invention can be used to detect the nucleic acid or similar nucleic acids, for example, transcripts encoding a polypeptide of the invention. The probe can comprise a label group, e.g., a radioisotope, a fluorescent compound, an enzyme, or an enzyme co-factor. Such probes can be used to identify a cell that expresses the polypeptide In another aspect, the present invention provides libraries of nucleic acids that encode for libraries of antibody proteins, derived from plasmablasts and plasma cells. These libraries of nucleic acids are generated by isolating plasmablasts and plasma cells into single-cell reaction containers, wherein they are lysed and antibody-specific nucleic acids are purified or captured, for example on solid supports such as beads. The present invention provides methods for performing capture of transcripts from millions of single cells in parallel. Capture of transcripts is followed by amplification of nucleic acids that encode heavy and light chain immunoglobulins, and subsequent linkage of said nucleic acids into libraries of fused constructs that encode both heavy and light chain immunoglobulins. In such libraries the native pairing of heavy and light chain immunoglobulins, as originally found in the input plasmablasts and plasma cells, is maintained. Such methods are performed in parallel on millions of single cells, such that the resulting library of fused heavy and light chain immunoglobulin nucleic acids comprises natively paired sequences for millions of single cells. Such methods are described elsewhere (Adler et al., *Mabs* 9, 1282-1996, 2017).

7.6. Vectors and Expression Vectors

The present invention provides vectors comprising a nucleic acid encoding a polypeptide of the invention or a portion thereof. Examples of vectors include, but are not limited to, plasmids, viral vectors, non-episomal mammalian vectors and expression vectors, for example, recombinant expression vectors.

In another aspect of the present invention, expression vectors containing the nucleic acid molecules and polynucleotides of the present invention are also provided, and host cells transformed with such vectors, and methods of producing the polypeptides are also provided. The term "expression vector" refers to a plasmid, phage, virus or vector for expressing a polypeptide from a polynucleotide sequence. Vectors for the expression of the polypeptides contain at a minimum sequences required for vector propagation and for expression of the cloned insert. An expression vector comprises a transcriptional unit comprising an assembly of (1) a genetic element or elements having a regulatory role in gene expression, for example, promoters or enhancers, (2) a sequence that encodes polypeptides and proteins to be transcribed into mRNA and translated into protein, and (3) appropriate transcription initiation and termination sequences. These sequences may further include a selection marker. Vectors suitable for expression in host cells are readily available and the nucleic acid molecules are inserted into the vectors using standard recombinant DNA techniques. Such vectors can include promoters which function in specific tissues, and viral vectors for the expression of polypeptides in targeted human or animal cells.

The recombinant expression vectors of the invention can comprise a nucleic acid of the invention in a form suitable for expression of the nucleic acid in a host cell. The recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells (e.g., SV40 early gene enhancer, Rous sarcoma virus promoter and cytomegalovirus promoter), those that direct expression of the nucleotide sequence only in certain host cells (e.g., tissue-specific regulatory sequences, see Voss et al., 1986, Trends Biochem. Sci. 11:287, Maniatis et al., 1987, Science 236:1237, incorporated by reference herein in their entireties), and those that direct inducible expression of a nucleotide sequence in response to particular treatment or condition (e.g., the metallothionin promoter in mammalian cells and the tet-responsive and/or streptomycin responsive promoter in both prokaryotic and eukaryotic systems (see id.). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein.

The invention further provides methods of making polypeptides, e.g., RPPs. A variety of other expression/host systems may be utilized. Vector DNA can be introduced into prokaryotic or eukaryotic systems via conventional transformation or transfection techniques. These systems include but are not limited to microorganisms such as bacteria (for example, *E. coli*) transformed with recombinant bacteriophage, plasmid or cosmid DNA expression vectors; yeast transformed with yeast expression vectors; insect cell systems infected with virus expression vectors (e.g., baculovirus); plant cell systems transfected with virus expression vectors (e.g., cauliflower mosaic virus, CaMV; tobacco mosaic virus, TMV) or transformed with bacterial expression vectors (e.g., Ti or pBR322 plasmid); or animal cell systems. Mammalian cells useful in recombinant protein production include but are not limited to VERO cells, HeLa cells, Chinese hamster ovary (CHO) cell lines, or their derivatives such as Veggie CHO and related cell lines which grow in serum-free media (see Rasmussen et al., 1998, Cytotechnology 28:31) or CHO strain DX-B 11, which is deficient in DHFR (see Urlaub et al., 1980, Proc. Natl. Acad. Sci. USA 77:4216-20) COS cells such as the COS-7 line of monkey kidney cells (ATCC CRL 1651) (see Gluzman et al., 1981, Cell 23:175), W138, BHK, HepG2, 3T3 (ATCC CCL 163), RIN, MDCK, A549, PC12, K562, L cells, C127 cells, BHK (ATCC CRL 10) cell lines, the CV1/EBNA cell line derived from the African green monkey kidney cell line CV1 (ATCC CCL 70) (see McMahan et al., 1991, EMBO J. 10:2821), human embryonic kidney cells such as 293, 293 EBNA or MSR 293, human epidermal A431 cells, human Colo205 cells, other transformed primate cell lines, normal diploid cells, cell strains derived from in vitro culture of primary tissue, primary explants, HL-60, U937, HaK or Jurkat cells. Mammalian expression allows for the production of secreted or soluble polypeptides which may be recovered from the growth medium.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Once such cells are transformed with vectors that contain selectable markers as well as the desired expression cassette, the cells can be allowed to grow in an enriched media before they are switched to selective media, for example. The selectable marker is designed to allow growth and recovery of cells that successfully express the introduced sequences. Resistant clumps of stably transformed cells can be proliferated using tissue culture techniques appropriate to the cell line employed. An overview of expression of recombinant proteins is found in Methods of Enzymology, v. 185, Goeddell, D. V., ed., Academic Press (1990). Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die), among other methods.

The transformed cells can be cultured under conditions that promote expression of the polypeptide, and the polypeptide recovered by conventional protein purification procedures (as defined above).

In some cases, such as in expression using prokaryotic systems, the expressed polypeptides of this invention may need to be "refolded" and oxidized into a proper tertiary structure and disulfide linkages generated in order to be biologically active. Refolding can be accomplished using a number of procedures well known in the art. Such methods include, for example, exposing the solubilized polypeptide to a pH usually above 7 in the presence of a chaotropic agent. The selection of chaotrope is similar to the choices used for inclusion body solubilization; however, a chaotrope is typically used at a lower concentration. Exemplary chaotropic agents are guanidine and urea. In most cases, the refolding/oxidation solution will also contain a reducing agent plus its oxidized form in a specific ratio to generate a particular redox potential which allows for disulfide shuffling to occur for the formation of cysteine bridges. Some commonly used redox couples include cysteine/cystamine, glutathione/dithiobisGSH, cupric chloride, dithiothreitol DTT/dithiane DTT, and 2-mercaptoethanol (bME)/dithiobME. In many instances, a co-solvent may be used to increase the efficiency of the refolding. Commonly used cosolvents include glycerol, polyethylene glycol of various molecular weights, and arginine.

In addition, the polypeptides can be synthesized in solution or on a solid support in accordance with conventional techniques. Various automatic synthesizers are commercially available and can be used in accordance with known protocols. See, for example, Stewart and Young, Solid Phase Peptide Synthesis, 2d. Ed., Pierce Chemical Co. (1984); Tam et al., J Am Chem Soc, 105:6442, (1983); Merrifield, Science 232:341-347 (1986); Barany and Merrifield, The Peptides, Gross and Meienhofer, eds, Academic Press, New York, 1-284; Barany et al., Int J Pep Protein Res, 30:705-739 (1987).

The polypeptides and proteins of the present invention can be purified according to protein purification techniques well known to those of skill in the art. These techniques involve, at one level, the crude fractionation of the proteinaceous and non-proteinaceous fractions. Having separated the peptide polypeptides from other proteins, the peptide or polypeptide of interest can be further purified using chromatographic and electrophoretic techniques to achieve partial or complete purification (or purification to homogeneity). The term "purified polypeptide" as used herein, is intended to refer to a composition, isolatable from other components, wherein the polypeptide is purified to any degree relative to its naturally-obtainable state. A purified polypeptide therefore also refers to a polypeptide that is free from the environment in which it may naturally occur. Generally, "purified" will refer to a polypeptide composition that has been subjected to fractionation to remove various other components, and which composition substantially retains its expressed biological activity. Where the term "substantially purified" is used, this designation will refer to a peptide or polypeptide composition in which the polypeptide or peptide forms the major component of the composition, such as constituting about 50%, about 60%, about 70%, about 80%, about 85%, or about 90% or more of the proteins in the composition.

Various techniques suitable for use in purification will be well known to those of skill in the art. These include, for example, precipitation with ammonium sulphate, PEG, antibodies (immunoprecipitation) and the like or by heat denaturation, followed by centrifugation; chromatography such as affinity chromatography (Protein-A columns), ion exchange, gel filtration, reverse phase, hydroxylapatite, hydrophobic interaction chromatography, isoelectric focusing, gel electrophoresis, and combinations of these techniques. As is generally known in the art, it is believed that the order of conducting the various purification steps may be changed, or that certain steps may be omitted, and still result in a suitable method for the preparation of a substantially purified polypeptide. Exemplary purification steps are provided in the Examples below.

Various methods for quantifying the degree of purification of polypeptide will be known to those of skill in the art in light of the present disclosure. These include, for example, determining the specific binding activity of an active fraction, or assessing the amount of peptide or polypeptide within a fraction by SDS/PAGE analysis. A preferred method for assessing the purity of a polypeptide fraction is to calculate the binding activity of the fraction, to compare it to the binding activity of the initial extract, and to thus calculate the degree of purification, herein assessed by a "-fold purification number." The actual units used to represent the amount of binding activity will, of course, be dependent upon the particular assay technique chosen to follow the purification and whether or not the polypeptide or peptide exhibits a detectable binding activity.

In some aspects, the present invention includes libraries of antibody-encoding nucleic acid vectors for site-directed integration into mammalian genomes. Such vectors include plasmids, retroviruses, and lentivirus. These libraries of vectors encode libraries of antibody sequences, which are then be used to engineer mammalian cells for production of RPPs. The libraries of nucleic acid vectors may include 10, 100, 1,000, 10,000, or more than 100,000 different antibody-encoding sequences. The sequences are derived from plasmablasts and plasma cells. These libraries of nucleic acids are generated by isolating plasmablasts and plasma cells into single-cell reaction containers, wherein they are lysed and antibody-specific nucleic acids are purified or captured, for example on solid supports such as beads. The present invention provides methods for performing capture of transcripts from millions of single cells in parallel. Capture of transcripts is followed by amplification of nucleic acids that encode heavy and light chain immunoglobulins, and subsequent linkage of said nucleic acids into libraries of fused constructs that encode both heavy and light chain immunoglobulins. In such libraries the native pairing of heavy and light chain immunoglobulins, as originally found in the input plasmablasts and plasma cells, is maintained. Such methods are performed in parallel on millions of single cells, such that the resulting library of fused heavy and light chain immunoglobulin nucleic acids comprises natively paired sequences for millions of single cells. These paired fused amplicons are then engineered into full-length antibody constructs using Gibson Assembly, restriction endonucleases, or other recombinant DNA techniques.

Engineering into full-length antibody constructs is performed on the full library en masse, such that the antibody sequence content and antibody sequence counts of the library are essentially maintained throughout the process. In some aspects, the library of expression vectors is engineered in two steps, such that the scFv amplicon is subcloned into an intermediate vector, and then a second round of Gibson Assembly, restriction digestion, or other recombinant technique is used to engineer additional domains of the antibody into the linker of the scFv (U.S. patent Ser. No. 14/734,953). The native pairing of heavy and light chain immunoglobulins is essentially maintained throughout the process of engineering into full-length expression vector libraries. The vectors are designed in various orientations, for example, two separate promoters drive expression of heavy and light chain immunoglobulins, or one promoter drives expression of both heavy and light chain immunoglobulins, and a translational skip motif is used to separately translate the heavy and light chain immunoglobulins into separate polypeptides. In some embodiments, the expression vectors comprise sequences for site-directed integration into mammalian production cells, for example, CRISPR-Cas9, Flp-In, Cre/Lox, or zinc finger recombination methods. Site-directed integration ensures that each mammalian production cell encodes a single antibody sequence, and decreases variability in expression levels between single production cells.

7.7. Methods of Producing RPPs, e.g., Antibodies

RPPs can be purified from host cells that have been transfected by a gene encoding the antibodies by elution of filtered supernatant of host cell culture fluid using a Heparin HP column, using a salt gradient, or with protein A resin.

Fully human monoclonal antibodies may be generated by any number of techniques with which those having ordinary skill in the art will be familiar. Such methods include, but are not limited to, Epstein Barr Virus (EBV) transformation of human peripheral blood cells (e.g., containing B lymphocytes), in vitro immunization of human B-cells, fusion of spleen cells from immunized transgenic mice carrying inserted human immunoglobulin genes, isolation from human immunoglobulin V region phage libraries, or other procedures as known in the art and based on the disclosure herein. For example, fully human monoclonal antibodies may be obtained from transgenic mice that have been engineered to produce specific human antibodies in response to antigenic challenge. Methods for obtaining fully human antibodies from transgenic mice are described, for example, by Green et al., *Nature Genet.* 7:13, 1994; Lonberg et al., *Nature* 368:856, 1994; Taylor et al., *Int. Immun.* 6:579, 1994; U.S. Pat. No. 5,877,397; Bruggemann et al., 1997 *Curr. Opin. Biotechnol.* 8:455-58; Jakobovits et al., 1995 *Ann. N. Y. Acad. Sci.* 764:525-35. In this technique, elements of the human heavy and light chain locus are introduced into strains of mice derived from embryonic stem cell lines that contain targeted disruptions of the endogenous heavy chain and light chain loci (see also Bruggemann et al., *Curr. Opin. Biotechnol.* 8:455-58 (1997)). For example, human immunoglobulin transgenes may be mini-gene constructs, or transloci on yeast artificial chromosomes, which undergo B-cell-specific DNA rearrangement and hypermutation in the mouse lymphoid tissue. Fully human monoclonal antibodies may be obtained by immunizing the transgenic mice, which may then produce human antibodies specific for the antigen target or targets. Lymphoid cells of the immunized transgenic mice can be used to produce human antibody-secreting hybridomas according to the methods described herein.

Another method for generating human antibodies of the invention includes immortalizing human peripheral blood cells by EBV transformation. See, e.g., U.S. Pat. No. 4,464, 456. Such an immortalized B-cell line (or lymphoblastoid cell line) producing an RPP that specifically binds to target or targets can be identified by immunodetection methods as provided herein, for example, an ELISA, and then isolated by standard cloning techniques. The stability of the lymphoblastoid cell line producing an RPP may be improved by fusing the transformed cell lines with a murine myeloma to produce a mouse-human hybrid cell line according to methods known in the art (see, e.g., Glasky et al., *Hybridoma* 8:377-89 (1989)). Still another method to generate human RPPs is in vitro immunization, which includes priming human splenic B-cells with antigen targets, followed by fusion of primed with a heterohybrid fusion partner. See, e.g., Boerner et al., 1991 *J. Immunol.* 147:86-95.

In certain embodiments, B-cells that are producing an RPP are selected and the light chain and heavy chain variable regions are cloned from the B-cell according to molecular biology techniques known in the art (WO 92/02551; U.S. Pat. No. 5,627,052; Babcook et al., *Proc. Natl. Acad. Sci. USA* 93:7843-48 (1996)) and described herein. B-cells from an immunized animal may be isolated from the spleen, lymph node, or peripheral blood sample by selecting a cell that is producing an antibody that specifically binds to to the antigen target. B-cells may also be isolated from humans, for example, from a peripheral blood sample.

Methods for detecting single B-cells that are producing an antibody with the desired specificity are well known in the art, for example, by plaque formation, fluorescence-activated cell sorting, in vitro stimulation followed by detection of specific antibody, and the like. Methods for selection of specific antibody-producing B-cells include, for example, preparing a single cell suspension of B-cells in soft agar that contains the antigen target. Binding of the specific antibodies produced by the B-cell to the antigen results in the formation of a complex, which may be visible as an immunoprecipitate.

In some embodiments, specific antibody-producing B-cells are selected by using a method that allows identification natively paired antibodies. For example, a method described in Adler et al., A natively paired antibody library yields drug leads with higher sensitivity and specificity than a randomly paired antibody library, MAbs (2018), which is incorporated by reference in its entirety herein, can be employed. The method combines microfluidic technology, molecular genomics, yeast single-chain variable fragment (scFv) display, fluorescence-activated cell sorting (FACS) and deep sequencing. In short, B cells can be isolated from immunized animals and then pooled. The B cells are encapsulated into droplets with oligo-dT beads and a lysis solution, and mRNA-bound beads are purified from the droplets, and then injected into a second emulsion with an OE-RT-PCR amplification mix that generates DNA amplicons that encode scFv with native pairing of heavy and light chain Ig. Libraries of natively paired amplicons are then electroporated into yeast for scFv display. FACS is used to identify high affinity scFv. Finally, deep antibody sequencing can be used to identify all clones in the pre- and post-sort scFv libraries.

After the B-cells producing the desired antibody are selected, the specific antibody genes may be cloned by isolating and amplifying DNA or mRNA according to methods known in the art and described herein.

The methods for obtaining antibodies of the invention can also adopt various phage display technologies known in the art. See, e.g., Winter et al., 1994 *Annu. Rev. Immunol.* 12:433-55; Burton et al., 1994 *Adv. Immunol.* 57:191-280. Human or murine immunoglobulin variable region gene combinatorial libraries may be created in phage vectors that can be screened to select Ig fragments (Fab, Fv, sFv, or multimers thereof) that bind specifically to the RPP or variant or fragment thereof. See, e.g., U.S. Pat. No. 5,223,409; Huse et al., 1989 *Science* 246:1275-81; Sastry et al., *Proc. Natl. Acad. Sci. USA* 86:5728-32 (1989); Alting-Mees et al., *Strategies in Molecular Biology* 3:1-9 (1990); Kang et al., 1991 *Proc. Natl. Acad. Sci. USA* 88:4363-66; Hoogenboom et al., 1992 *J. Molec. Biol.* 227:381-388; Schlebusch et al., 1997 *Hybridoma* 16:47-52 and references cited therein. For example, a library containing a plurality of polynucleotide sequences encoding Ig variable region fragments may be inserted into the genome of a filamentous bacteriophage, such as M13 or a variant thereof, in frame with the sequence encoding a phage coat protein. A fusion protein may be a fusion of the coat protein with the light chain variable region domain and/or with the heavy chain variable region domain. According to certain embodiments, immunoglobulin Fab fragments may also be displayed on a phage particle (see, e.g., U.S. Pat. No. 5,698,426).

In one embodiment, in a hybridoma the variable regions of a gene expressing a monoclonal antibody of interest are amplified using nucleotide primers. These primers may be synthesized by one of ordinary skill in the art, or may be purchased from commercially available sources. (See, e.g., Stratagene (La Jolla, California), which sells primers for mouse and human variable regions including, among others, primers for $V_{Ha}$, $V_{Hb}$, $V_{Hc}$, $V_{Hd}$, $C_{H1}$, $V_L$ and $C_L$ regions.) These primers may be used to amplify heavy or light chain variable regions, which may then be inserted into vectors such as ImmunoZAP™H or ImmunoZAP™L (Stratagene), respectively. These vectors may then be introduced into *E. coli*, yeast, or mammalian-based systems for expression. Large amounts of a single-chain protein containing a fusion of the $V_H$ and $V_L$ domains may be produced using these methods (see Bird et al., *Science* 242:423-426, 1988).

Once cells producing antibodies according to the invention have been obtained using any of the above-described immunization and other techniques, the specific antibody genes may be cloned by isolating and amplifying DNA or mRNA therefrom according to standard procedures as described herein. The antibodies produced therefrom may be sequenced and the CDRs identified and the DNA coding for the CDRs may be manipulated as described previously to generate other antibodies according to the invention.

RPPs of the present invention preferably have activity in the cell-based assays described herein and/or the in vivo assay described herein and/or bind to one or more of the domains described herein. Accordingly, such binding agents can be identified using the assays described herein.

Other antibodies according to the invention may be obtained by conventional immunization and cell fusion procedures as described herein and known in the art.

Molecular evolution of the complementarity determining regions (CDRs) in the center of the antibody binding site also has been used to isolate antibodies with increased affinity, for example, antibodies having increased affinity for c-erbB-2, as described by Schier et al., 1996, *J. Mol. Biol.* 263:551.

Although human, partially human, or humanized antibodies will be suitable for many applications, particularly those involving administration of the antibody to a human subject, other types of antigen binding proteins will be suitable for certain applications. The non-human antibodies of the invention can be, for example, derived from any antibody-producing animal, such as mouse, rat, rabbit, goat, donkey, or non-human primate (such as monkey (e.g., cynomologous or rhesus monkey) or ape (e.g., chimpanzee)). Non-human antibodies of the invention can be used, for example, in in vitro and cell-culture based applications, or any other application where an immune response to the antibody of the invention does not occur, is insignificant, can be prevented, is not a concern, or is desired. In one embodiment, a non-human antibody of the invention is administered to a non-human subject. In another embodiment, the non-human antibody does not elicit an immune response in the non-human subject. In another embodiment, the non-human antibody is from the same species as the non-human subject, e.g., a mouse antibody of the invention is administered to a mouse. An antibody from a particular species can be made by, for example, immunizing an animal of that species with the desired immunogen or using an artificial system for generating antibodies of that species (e.g., a bacterial or phage display-based system for generating antibodies of a particular species), or by converting an antibody from one species into an antibody from another species by replacing, e.g., the constant region of the antibody with a constant region from the other species, or by replacing one or more amino acid residues of the antibody so that it more closely resembles the sequence of an antibody from the other species. In one embodiment, the antibody is a chimeric antibody comprising amino acid sequences derived from antibodies from two or more different species.

Antigen binding proteins may be prepared, and screened for desired properties, by any of a number of conventional techniques. Certain of the techniques involve isolating a nucleic acid encoding a polypeptide chain (or portion thereof) of an RPP of interest, and manipulating the nucleic acid through recombinant DNA technology. The nucleic acid may be fused to another nucleic acid of interest, or altered (e.g., by mutagenesis or other conventional techniques) to add, delete, or substitute one or more amino acid residues, for example. Furthermore, the antigen binding proteins may be purified from cells that naturally express them (e.g., an antibody can be purified from a hybridoma that produces it), or produced in recombinant expression systems, using any technique known in the art. See, for example, *Monoclonal Antibodies, Hybridomas: A New Dimension in Biological Analyses*, Kennet et al. (eds.), Plenum Press, New York (1980); and *Antibodies: A Laboratory Manual*, Harlow and Land (eds.), Cold Spring Harbor Laboratory Press, Cold Spring Harbor, NY, (1988).

Any expression system known in the art can be used to make the recombinant polypeptides of the invention. Expression systems are detailed comprehensively above. In general, host cells are transformed with a recombinant expression vector that comprises DNA encoding a desired polypeptide. Among the host cells that may be employed are prokaryotes, yeast or higher eukaryotic cells. Prokaryotes include gram negative or gram-positive organisms, for example *E. coli* or Bacilli. Higher eukaryotic cells include insect cells and established cell lines of mammalian origin. Examples of suitable mammalian host cell lines include the COS-7 line of monkey kidney cells (ATCC CRL 1651) (Gluzman et al., 1981, *Cell* 23:175), L cells, 293 cells, C127 cells, 3T3 cells (ATCC CCL 163), Chinese hamster ovary (CHO) cells, HeLa cells, BHK (ATCC CRL 10) cell lines, and the CVI/EBNA cell line derived from the African green monkey kidney cell line CVI (ATCC CCL 70) as described by McMahan et al., 1991, *EMBO J*. 10: 2821. Appropriate cloning and expression vectors for use with bacterial, fungal, yeast, and mammalian cellular hosts are described by Pouwels et al. (*Cloning Vectors: A Laboratory Manual*, Elsevier, New York, 1985).

Production cell lines for monoclonal antibodies (mAbs) are typically produced by randomly inserting expression constructs into a mammalian production cell genome, for example, a CHO genome (Rita Costa et al., 2010). However, this canonical method produces cell lines with multiple copies of mAb inserted into the CHO genome. If we randomly inserted our polyclonal antibody construct libraries into the CHO genome, many clones would express multiple antibodies, which would result in frequent non-native pairing between heavy and light chain Ig. Additionally, different genome locations have different transcriptional activity levels (Kito et al., 2002), which could result in heterogeneous, inconsistent and/or unstable bioproduction. Thus, in some aspects the current invention provides a CHO cell line with a Flp recombinase recognition target (FRT) landing pad stably engineered into the genome. Such site-directed genome integration cell lines are then used for stable expression of RPPs.

It will be appreciated that an antibody of the present invention may have at least one amino acid substitution, providing that the antibody retains binding specificity. Therefore, modifications to the antibody structures are encompassed within the scope of the invention. These may include amino acid substitutions, which may be conservative or non-conservative that do not destroy the binding capability of an antibody comprising the RPP. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties. A conservative amino acid substitution may also involve a substitution of a native amino acid residue with a normative residue such that there is little or no effect on the polarity or charge of the amino acid residue at that position.

Non-conservative substitutions may involve the exchange of a member of one class of amino acids or amino acid mimetics for a member from another class with different physical properties (e.g. size, polarity, hydrophobicity, charge). Such substituted residues may be introduced into regions of the human antibody that are homologous with non-human antibodies, or into the non-homologous regions of the molecule.

Moreover, one skilled in the art may generate test variants containing a single amino acid substitution at each desired amino acid residue. The variants can then be screened using activity assays known to those skilled in the art. Such variants could be used to gather information about suitable variants. For example, if one discovered that a change to a particular amino acid residue resulted in destroyed, undesirably reduced, or unsuitable activity, variants with such a change may be avoided. In other words, based on information gathered from such routine experiments, one skilled in the art can readily determine the amino acids where further substitutions should be avoided either alone or in combination with other mutations.

A skilled artisan will be able to determine suitable variants of the polypeptide as set forth herein using well-known techniques. In certain embodiments, one skilled in the art may identify suitable areas of the molecule that may be changed without destroying activity by targeting regions not believed to be important for activity. In certain embodiments, one can identify residues and portions of the molecules that are conserved among similar polypeptides. In certain embodiments, even areas that may be important for biological activity or for structure may be subject to conservative amino acid substitutions without destroying the biological activity or without adversely affecting the polypeptide structure.

Additionally, one skilled in the art can review structure-function studies identifying residues in similar polypeptides that are important for activity or structure. In view of such a comparison, one can predict the importance of amino acid residues in a protein that correspond to amino acid residues which are important for activity or structure in similar proteins. One skilled in the art may opt for chemically similar amino acid substitutions for such predicted important amino acid residues.

One skilled in the art can also analyze the three-dimensional structure and amino acid sequence in relation to that structure in similar polypeptides. In view of such information, one skilled in the art may predict the alignment of amino acid residues of an antibody with respect to its three-dimensional structure. In certain embodiments, one skilled in the art may choose not to make radical changes to amino acid residues predicted to be on the surface of the protein, since such residues may be involved in important interactions with other molecules.

A number of scientific publications have been devoted to the prediction of secondary structure. See Moult *J., Curr. Op. in Biotech.,* 7(4):422-427 (1996), Chou et al., *Biochem.,* 13(2):222-245 (1974); Chou et al., *Biochem.,* 113(2):211-222 (1974); Chou et al., *Adv. Enzymol. Relat. Areas Mol. Biol.,* 47:45-148 (1978); Chou et al., *Ann. Rev. Biochem.,* 47:251-276 and Chou et al., *Biophys. J.,* 26:367-384 (1979). Moreover, computer programs are currently available to assist with predicting secondary structure. One method of predicting secondary structure is based upon homology modeling. For example, two polypeptides or proteins which have a sequence identity of greater than 30%, or similarity greater than 40% often have similar structural topologies. The recent growth of the protein structural database (PDB) has provided enhanced predictability of secondary structure, including the potential number of folds within a polypeptide's or protein's structure. See Holm et al., *Nucl. Acid. Res.,* 27(1):244-247 (1999). It has been suggested (Brenner et al., *Curr. Op. Struct. Biol.,* 7(3):369-376 (1997)) that there are a limited number of folds in a given polypeptide or protein and that once a critical number of structures have been resolved, structural prediction will become dramatically more accurate.

Additional methods of predicting secondary structure include "threading" (Jones, D., *Curr. Opin. Struct. Biol.,* 7(3):377-87 (1997); Sippl et al., *Structure,* 4(1):15-19 (1996)), "profile analysis" (Bowie et al., *Science,* 253:164-170 (1991); Gribskov et al., *Meth. Enzym.,* 183:146-159 (1990); Gribskov et al., *Proc. Nat. Acad. Sci.,* 84(13):4355-4358 (1987)), and "evolutionary linkage" (See Holm, supra (1999), and Brenner, supra (1997)).

In certain embodiments, variants of antibodies include glycosylation variants wherein the number and/or type of glycosylation site has been altered compared to the amino acid sequences of a parent polypeptide. In certain embodiments, variants comprise a greater or a lesser number of N-linked glycosylation sites than the native protein. An N-linked glycosylation site is characterized by the sequence: Asn-X-Ser or Asn-X-Thr, wherein the amino acid residue designated as X can be any amino acid residue except proline. The substitution of amino acid residues to create this sequence provides a potential new site for the addition of an N-linked carbohydrate chain. Alternatively, substitutions which eliminate this sequence will remove an existing N-linked carbohydrate chain. Also provided is a rearrangement of N-linked carbohydrate chains wherein one or more N-linked glycosylation sites (typically those that are naturally occurring) are eliminated and one or more new N-linked sites are created. Additional preferred antibody variants include cysteine variants wherein one or more cysteine residues are deleted from or substituted for another amino acid (e.g., serine) as compared to the parent amino acid sequence. Cysteine variants can be useful when antibodies must be refolded into a biologically active conformation such as after the isolation of insoluble inclusion bodies. Cysteine variants generally have fewer cysteine residues than the native protein, and typically have an even number to minimize interactions resulting from unpaired cysteines.

According to certain embodiments, preferred amino acid substitutions are those which: (1) reduce susceptibility to proteolysis, (2) reduce susceptibility to oxidation, (3) alter binding affinity for forming protein complexes, (4) alter binding affinities, and/or (4) confer or modify other physiochemical or functional properties on such polypeptides. According to certain embodiments, single or multiple amino acid substitutions (in certain embodiments, conservative amino acid substitutions) may be made in the naturally-occurring sequence (in certain embodiments, in the portion of the polypeptide outside the domain(s) forming intermolecular contacts). In certain embodiments, a conservative amino acid substitution typically may not substantially change the structural characteristics of the parent sequence (e.g., a replacement amino acid should not tend to break a helix that occurs in the parent sequence, or disrupt other types of secondary structure that characterizes the parent sequence). Examples of art-recognized polypeptide secondary and tertiary structures are described in Proteins, Structures and Molecular Principles (Creighton, Ed., W. H. Freeman and Company, New York (1984)); Introduction to Protein Structure (C. Branden and J. Tooze, eds., Garland Publishing, New York, N.Y. (1991)); and Thornton et al. *Nature* 354:105 (1991), which are each incorporated herein by reference.

In certain embodiments, antibodies of the invention may be chemically bonded with polymers, lipids, or other moieties.

The binding agents may comprise at least one of the CDRs described herein incorporated into a biocompatible framework structure. In one example, the biocompatible framework structure comprises a polypeptide or portion thereof that is sufficient to form a conformationally stable structural support, or framework, or scaffold, which is able to display one or more sequences of amino acids that bind to an antigen (e.g., CDRs, a variable region, etc.) in a localized surface region. Such structures can be a naturally occurring polypeptide or polypeptide "fold" (a structural motif), or can have one or more modifications, such as additions, deletions or substitutions of amino acids, relative to a naturally occurring polypeptide or fold. These scaffolds can be derived from a polypeptide of any species (or of more than one species), such as a human, other mammal, other vertebrate, invertebrate, plant, bacteria or virus.

Typically, the biocompatible framework structures are based on protein scaffolds or skeletons other than immunoglobulin domains. For example, those based on fibronectin, ankyrin, lipocalin, neocarzinostain, cytochrome b, CP1 zinc finger, PST1, coiled coil, LACI-D1, Z domain and tendamistat domains may be used (See e.g., Nygren and Uhlen, 1997, *Curr. Opin. in Struct. Biol.,* 7, 463-469).

It will be appreciated that the antibodies of the invention include the humanized antibodies described herein. Humanized antibodies such as those described herein can be produced using techniques known to those skilled in the art (Zhang, W., et al., *Molecular Immunology.* 42(12):1445-1451, 2005; Hwang W. et al., *Methods.* 36(1):35-42, 2005; Dall'AcquaWF, et al., *Methods* 36(1):43-60, 2005; and Clark, M., *Immunology Today.* 21(8):397-402, 2000).

Where an antibody comprises one or more of CDR1-H, CDR2-H, CDR3-H, CDR1-L, CDR2-L and CDR3-L as described above, it may be obtained by expression from a host cell containing DNA coding for these sequences. A DNA coding for each CDR sequence may be determined on the basis of the amino acid sequence of the CDR and synthesized together with any desired antibody variable region framework and constant region DNA sequences using oligonucleotide synthesis techniques, site-directed mutagenesis and polymerase chain reaction (PCR) techniques as appropriate. DNA coding for variable region frameworks and constant regions is widely available to those skilled in the art from genetic sequences databases such as Gen-Bank®.

Once synthesized, the DNA encoding an antibody of the invention or fragment thereof may be propagated and expressed according to any of a variety of well-known procedures for nucleic acid excision, ligation, transformation, and transfection using any number of known expression vectors. Thus, in certain embodiments expression of an antibody fragment may be preferred in a prokaryotic host, such as *Escherichia coli* (see, e.g., Pluckthun et al., 1989 *Methods Enzymol.* 178:497-515). In certain other embodiments, expression of the antibody or a fragment thereof may be preferred in a eukaryotic host cell, including yeast (e.g., *Saccharomyces cerevisiae, Schizosaccharomyces pombe*, and *Pichia pastoris*), animal cells (including mammalian cells) or plant cells. Examples of suitable animal cells include, but are not limited to, myeloma (such as a mouse NSO line), COS, CHO, or hybridoma cells. Examples of plant cells include tobacco, corn, soybean, and rice cells.

Replicable expression vectors containing DNA encoding an antibody variable and/or constant region may be prepared and used to transform an appropriate cell line, for example, a non-producing myeloma cell line, such as a mouse NSO line or a bacteria, such as *E. coli*, in which production of the antibody will occur. In order to obtain efficient transcription and translation, the DNA sequence in each vector should include appropriate regulatory sequences, particularly a promoter and leader sequence operatively linked to the variable domain sequence. Particular methods for producing antibodies in this way are generally well-known and routinely used. For example, basic molecular biology procedures are described by Maniatis et al. (*Molecular Cloning, A Laboratory Manual, 2nd ed.*, Cold Spring Harbor Laboratory, New York, 1989; see also Maniatis et al, 3rd ed., Cold Spring Harbor Laboratory, New York, (2001)). DNA sequencing can be performed as described in Sanger et al. (*PNAS* 74:5463, (1977)) and the Amersham International plc sequencing handbook, and site directed mutagenesis can be carried out according to methods known in the art (Kramer et al., *Nucleic Acids Res.* 12:9441, (1984); Kunkel *Proc. Natl. Acad. Sci. USA* 82:488-92 (1985); Kunkel et al., *Methods in Enzymol.* 154:367-82 (1987); the Anglian Biotechnology Ltd. handbook). Additionally, numerous publications describe techniques suitable for the preparation of antibodies by manipulation of DNA, creation of expression vectors, and transformation and culture of appropriate cells (Mountain A and Adair, J R in *Biotechnology and Genetic Engineering Reviews* (ed. Tombs, M P, 10, Chapter 1, 1992, Intercept, Andover, UK); "Current Protocols in Molecular Biology", 1999, F. M. Ausubel (ed.), Wiley Interscience, New York).

Where it is desired to improve the affinity of antibodies according to the invention containing one or more of the above-mentioned CDRs can be obtained by a number of affinity maturation protocols including maintaining the CDRs (Yang et al., *J. Mol. Biol.*, 254, 392-403, 1995), chain shuffling (Marks et al., *Bio Technology*, 10, 779-783, 1992), use of mutation strains of *E. coli*. (Low et al., *J. Mol. Biol.*, 250, 350-368, 1996), DNA shuffling (Patten et al., *Curr. Opin. Biotechnol.*, 8, 724-733, 1997), phage display (Thompson et al., *J. Mol. Biol.*, 256, 7-88, 1996) and sexual PCR (Crameri, et al., *Nature*, 391, 288-291, 1998). All of these methods of affinity maturation are discussed by Vaughan et al. (*Nature Biotech.*, 16, 535-539, 1998).

It will be understood by one skilled in the art that some proteins, such as antibodies, may undergo a variety of posttranslational modifications. The type and extent of these modifications often depends on the host cell line used to express the protein as well as the culture conditions. Such modifications may include variations in glycosylation, methionine oxidation, diketopiperizine formation, aspartate isomerization and asparagine deamidation. A frequent modification is the loss of a carboxy-terminal basic residue (such as lysine or arginine) due to the action of carboxypeptidases (as described in Harris, R. J. *Journal of Chromatography* 705:129-134, 1995).

7.8. Pharmaceutical Compositions

Pharmaceutical compositions containing the RPPs of the present invention are also provided. Such compositions comprise a therapeutically or prophylactically effective amount of the polypeptide or protein in a mixture with pharmaceutically acceptable materials, and physiologically acceptable formulation materials.

The pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition.

Suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates, other organic acids); bulking agents (such as mannitol or glycine), chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides and other carbohydrates (such as glucose, mannose, or dextrins); proteins (such as serum albumin, gelatin or immunoglobulins); coloring; flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate 80, triton, tromethamine, lecithin, cholesterol, tyloxapal); stability enhancing agents (sucrose or sorbitol); tonicity enhancing agents (such as alkali metal halides (preferably sodium or potassium chloride, mannitol sorbitol); delivery vehicles; diluents; excipients and/or pharmaceutical adjuvants. Neutral buffered saline or saline mixed with conspecific serum albumin are examples of appropriate diluents. In accordance with appropriate industry standards, preservatives such as benzyl alcohol may also be added. The composition may be formulated as a lyophilizate using appropriate excipient solutions (e.g., sucrose) as diluents. Suitable components are nontoxic to recipients at the dosages and concentrations employed. Further examples of components that may be employed in pharmaceutical formulations are presented in Remington's Pharmaceutical Sciences, 16th Ed. (1980) and 20th Ed. (2000), Mack Publishing Company, Easton, PA.

Optionally, the composition additionally comprises one or more physiologically active agents, for example, an anti-angiogenic substance, a chemotherapeutic substance (such as capecitabine, 5-fluorouracil, or doxorubicin), an analgesic substance, etc., non-exclusive examples of which are provided herein. In various particular embodiments, the composition comprises one, two, three, four, five, or six physiologically active agents in addition to an RPP.

In another embodiment of the invention, the compositions disclosed herein may be formulated in a neutral or salt form. Illustrative pharmaceutically-acceptable salts include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective.

The carriers can further comprise any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Except insofar as any conventional media or agent is incompatible with the active ingredient, its use in the therapeutic compositions is contemplated. Supplementary active ingredients can also be incorporated into the compositions. The phrase "pharmaceutically-acceptable" refers to molecular entities and compositions that do not produce an allergic or similar untoward reaction when administered to a human.

The optimal pharmaceutical composition will be determined by one skilled in the art depending upon, for example, the intended route of administration, delivery format, and desired dosage. See for example, Remington's Pharmaceutical Sciences, supra. Such compositions may influence the physical state, stability, rate of in vivo release, and rate of in vivo clearance of the polypeptide. For example, suitable compositions may be water for injection, physiological saline solution for parenteral administration.

7.8.1. Content of Pharmaceutically Active Ingredient

In typical embodiments, the active ingredient (i.e., the proteins and polypeptides of the present invention) is present in the pharmaceutical composition at a concentration of at least 0.01 mg/ml, at least 0.1 mg/ml, at least 0.5 mg/ml, or at least 1 mg/ml. In certain embodiments, the active ingredient is present in the pharmaceutical composition at a concentration of at least 1 mg/ml, 2 mg/ml, 3 mg/ml, 4 mg/ml, 5 mg/ml, 10 mg/ml, 15 mg/ml, 20 mg/ml, or 25 mg/ml. In certain embodiments, the active ingredient is present in the pharmaceutical composition at a concentration of at least 30 mg/ml, 35 mg/ml, 40 mg/ml, 45 mg/ml or 50 mg/ml.

7.8.2. Formulation Generally

The pharmaceutical composition can be in any form appropriate for human or veterinary medicine, including a liquid, an oil, an emulsion, a gel, a colloid, an aerosol or a solid.

The pharmaceutical composition can be formulated for administration by any route of administration appropriate for human or veterinary medicine, including enteral and parenteral routes of administration.

In various embodiments, the pharmaceutical composition is formulated for administration by inhalation. In certain of these embodiments, the pharmaceutical composition is formulated for administration by a vaporizer. In certain of these embodiments, the pharmaceutical composition is formulated for administration by a nebulizer. In certain of these embodiments, the pharmaceutical composition is formulated for administration by an aerosolizer.

In various embodiments, the pharmaceutical composition is formulated for oral administration, for buccal administration, or for sublingual administration.

In some embodiments, the pharmaceutical composition is formulated for intravenous, intramuscular, or subcutaneous administration.

In some embodiments, the pharmaceutical composition is formulated for intrathecal or intracerebroventricular administration.

In some embodiments, the pharmaceutical composition is formulated for topical administration.

7.8.3. Pharmacological Compositions Adapted for Injection

For intravenous, cutaneous or subcutaneous injection, or injection at the site of affliction, the active ingredient will be in the form of a parenterally acceptable aqueous solution which is pyrogen-free and has suitable pH, isotonicity and stability. Those of relevant skill in the art are well able to prepare suitable solutions using, for example, isotonic vehicles such as Sodium Chloride Injection, Ringer's Injection, Lactated Ringer's Injection. Preservatives, stabilisers, buffers, antioxidants and/or other additives can be included, as required.

In various embodiments, the unit dosage form is a vial, ampule, bottle, or pre-filled syringe. In some embodiments, the unit dosage form contains 0.01 mg, 0.1 mg, 0.5 mg, 1 mg, 2.5 mg, 5 mg, 10 mg, 12.5 mg, 25 mg, 50 mg, 75 mg, or 100 mg of the pharmaceutical composition. In some embodiments, the unit dosage form contains 125 mg, 150 mg, 175 mg, or 200 mg of the pharmaceutical composition. In some embodiments, the unit dosage form contains 250 mg of the pharmaceutical composition.

In typical embodiments, the pharmaceutical composition in the unit dosage form is in liquid form. In various embodiments, the unit dosage form contains between 0.1 mL and 50 ml of the pharmaceutical composition. In some embodiments, the unit dosage form contains 1 ml, 2.5 ml, 5 ml, 7.5 ml, 10 ml, 25 ml, or 50 ml of pharmaceutical composition.

In particular embodiments, the unit dosage form is a vial containing 1 ml of the pharmaceutical composition at a concentration of 0.01 mg/ml, 0.1 mg/ml, 0.5 mg/ml, or 1 mg/ml. In some embodiments, the unit dosage form is a vial containing 2 ml of the pharmaceutical composition at a concentration of 0.01 mg/ml, 0.1 mg/ml, 0.5 mg/ml, or 1 mg/ml.

In some embodiments, the pharmaceutical composition in the unit dosage form is in solid form, such as a lyophilate, suitable for solubilization.

Unit dosage form embodiments suitable for subcutaneous, intradermal, or intramuscular administration include pre-loaded syringes, auto-injectors, and autoinject pens, each containing a predetermined amount of the pharmaceutical composition described hereinabove.

In various embodiments, the unit dosage form is a pre-loaded syringe, comprising a syringe and a predetermined amount of the pharmaceutical composition. In certain pre-loaded syringe embodiments, the syringe is adapted for subcutaneous administration. In certain embodiments, the syringe is suitable for self-administration. In particular embodiments, the preloaded syringe is a single use syringe.

In various embodiments, the preloaded syringe contains about 0.1 mL to about 0.5 mL of the pharmaceutical composition. In certain embodiments, the syringe contains about 0.5 mL of the pharmaceutical composition. In specific embodiments, the syringe contains about 1.0 mL of the pharmaceutical composition. In particular embodiments, the syringe contains about 2.0 mL of the pharmaceutical composition.

In certain embodiments, the unit dosage form is an autoinject pen. The autoinject pen comprises an autoinject pen containing a pharmaceutical composition as described herein. In some embodiments, the autoinject pen delivers a predetermined volume of pharmaceutical composition. In other embodiments, the autoinject pen is configured to deliver a volume of pharmaceutical composition set by the user.

In various embodiments, the autoinject pen contains about 0.1 mL to about 5.0 mL of the pharmaceutical composition. In specific embodiments, the autoinject pen contains about 0.5 mL of the pharmaceutical composition. In particular embodiments, the autoinject pen contains about 1.0 mL of the pharmaceutical composition. In other embodiments, the autoinject pen contains about 5.0 mL of the pharmaceutical composition.

7.8.4. Mixtures of Plasma IVIg with Recombinant Hyperimmunes

In some embodiments, a recombinant hyperimmune is spiked into conventional plasma IVIg to increase the anti-pathogen titer of IVIg. In some embodiments, several anti-pathogen recombinant hyperimmunes are spiked into conventional plasma IVIg, for example, hyperimmunes directed against Hib, pneumococcus, influenza A virus, and tetanus are concurrently spiked into plasma IVIg to treat patients with primary immune deficiency. The spike in hyperimmunes increase the titer of antibodies directed against pathogens to which primary immune deficiency patients are particularly susceptible. Any number of spike-ins can be mixed with plasma IVIg to generate increased titers against any number of pathogens.

In some embodiments, the spike-in recombinant hyperimmunes are mixed with plasma IVIg by the pharmacist. In some embodiments, the spike-in recombinant hyperimmunes are mixed with plasma IVIg by the manufacturer.

7.9. Unit Dosage Forms

The pharmaceutical compositions may conveniently be presented in unit dosage form.

The unit dosage form will typically be adapted to one or more specific routes of administration of the pharmaceutical composition.

In various embodiments, the unit dosage form is adapted for administration by inhalation. In certain of these embodiments, the unit dosage form is adapted for administration by a vaporizer. In certain of these embodiments, the unit dosage form is adapted for administration by a nebulizer. In certain of these embodiments, the unit dosage form is adapted for administration by an aerosolizer.

In various embodiments, the unit dosage form is adapted for oral administration, for buccal administration, or for sublingual administration.

In some embodiments, the unit dosage form is adapted for intravenous, intramuscular, or subcutaneous administration.

In some embodiments, the unit dosage form is adapted for intrathecal or intracerebroventricular administration.

In some embodiments, the pharmaceutical composition is formulated for topical administration.

The amount of active ingredient which can be combined with a carrier material to produce a single dosage form will generally be that amount of the compound which produces a therapeutic effect.

7.10. RPP Activity

RPPs, e.g., antibodies according to the invention may have a binding affinity for antigen target of less than or equal to $5 \times 10^{-7}$M, less than or equal to $1 \times 10^{-7}$M, less than or equal to $0.5 \times 10^{-7}$M, less than or equal to $1 \times 10^{-8}$M, less than or equal to $1 \times 10^{-9}$M, less than or equal to $1 \times 10^{-10}$M, less than or equal to $1 \times 10^{-11}$M, or less than or equal to $1 \times 10^{-12}$ M.

The affinity of an RPP, as well as the extent to which an antibody inhibits binding, can be determined by one of ordinary skill in the art using conventional techniques, for example those described by Scatchard et al. (*Ann. N.Y. Acad. Sci.* 51:660-672 (1949)) or by surface plasmon resonance (SPR; BIAcore, Biosensor, Piscataway, NJ). For surface plasmon resonance, target molecules are immobilized on a solid phase and exposed to ligands in a mobile phase running along a flow cell. If ligand binding to the immobilized target occurs, the local refractive index changes, leading to a change in SPR angle, which can be monitored in real time by detecting changes in the intensity of the reflected light. The rates of change of the SPR signal can be analyzed to yield apparent rate constants for the association and disso-ciation phases of the binding reaction. The ratio of these values gives the apparent equilibrium constant (affinity) (see, e.g., Wolff et al., *Cancer Res.* 53:2560-65 (1993)).

7.11. Methods of Treating a Disease Responsive to an RPP

In another aspect, methods are presented for treating a subject having a disease responsive to an RPP. The disease can be cancer, AIDS, Alzheimer's disease or viral or bac-terial infection. In certain aspects, the RPP is used to induce tolerance during transplantation of an organ, tissue, or population of cells from a donor to a host.

The terms "treatment," "treating," and the like are used herein to generally mean obtaining a desired pharmacologic and/or physiologic effect. The effect may be prophylactic, in terms of completely or partially preventing a disease, con-dition, or symptoms thereof, and/or may be therapeutic in terms of a partial or complete cure for a disease or condition and/or adverse effect, such as a symptom, attributable to the disease or condition. "Treatment" as used herein covers any treatment of a disease or condition of a mammal, particularly a human, and includes: (a) preventing the disease or condition from occurring in a subject which may be predisposed to the disease or condition but has not yet been diagnosed as having it; (b) inhibiting the disease or condition (e.g., arresting its development); or (c) relieving the disease or condition (e.g., causing regression of the disease or condition, providing improvement in one or more symptoms). Improvements in any conditions can be readily assessed according to standard methods and techniques known in the art. The population of subjects treated by the method of the disease includes subjects suffering from the undesirable condition or disease, as well as subjects at risk for development of the condition or disease.

By the term "therapeutically effective dose" or "effective amount" is meant a dose or amount that produces the desired effect for which it is administered. The exact dose or amount will depend on the purpose of the treatment, and will be ascertainable by one skilled in the art using known techniques (see, e.g., Lloyd (1999) The Art, Science and Technology of Pharmaceutical Compounding).

The term "sufficient amount" means an amount sufficient to produce a desired effect.

The term "therapeutically effective amount" is an amount that is effective to ameliorate a symptom of a disease. A therapeutically effective amount can be a "prophylactically effective amount" as prophylaxis can be considered therapy.

The term "ameliorating" refers to any therapeutically beneficial result in the treatment of a disease state, e.g., a neurodegenerative disease state, including prophylaxis, lessening in the severity or progression, remission, or cure thereof.

In vivo and/or in vitro assays may optionally be employed to help identify optimal dosage ranges. The precise dose to be employed in the formulation will also depend on the route of administration, and the seriousness of the condition, and should be decided according to the judgment of the practitioner and each subject's circumstances. Effective doses may be extrapolated from dose-response curves derived from in vitro or animal model test systems.

The actual amount administered, and rate and time-course of administration, will depend on the nature and severity of protein aggregation disease being treated. Prescription of treatment, e.g. decisions on dosage etc., is within the responsibility of general practitioners and other medical doctors, and typically takes account of the disorder to be treated, the condition of the individual patient, the site of delivery, the method of administration and other factors known to practitioners. Examples of the techniques and protocols mentioned above can be found in Remington's Pharmaceutical Sciences, 16th edition, Osol, A. (ed), 1980.

In some embodiments, the pharmaceutical composition is administered by inhalation, orally, by buccal administration, by sublingual administration, by injection or by topical application.

In some embodiments, the pharmaceutical composition is administered in an amount sufficient to modulate survival of neurons or dopamine release. In some embodiments, the major cannabinoid is administered in an amount less than 1 g, less than 500 mg, less than 100 mg, less than 10 mg per dose.

In some embodiments, the pharmaceutical composition is administered once a day, 2-4 times a day, 2-4 times a week, once a week, or once every two weeks.

8. EXAMPLES

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for.

The practice of the present invention will employ, unless otherwise indicated, conventional methods of protein chemistry, biochemistry, recombinant DNA techniques and pharmacology, within the skill of the art. Such techniques are explained fully in the literature. See, e.g., T. E. Creighton, *Proteins: Structures and Molecular Properties* (W.H. Freeman and Company, 1993); A. L. Lehninger, *Biochemistry* (Worth Publishers, Inc., current addition); Sambrook, et al., *Molecular Cloning: A Laboratory Manual* (2nd Edition, 1989); *Methods In Enzymology* (S. Colowick and N. Kaplan eds., Academic Press, Inc.); *Remington's Pharmaceutical Sciences,* 18th Edition (Easton, Pennsylvania: Mack Publishing Company, 1990); Carey and Sundberg *Advanced Organic Chemistry* $3^{rd}$ *Ed.* (Plenum Press) Vols A and B(1992).

8.1. Example 1: Generation of a Library of RPPs with Activity Against Human Thymocytes or T Cells Four libraries of RPPs targeting human thymocytes or T cells, i.e., recombinant human anti-thymocyte globulin (rhATG) were produced. Both in vitro and in vivo studies were used to demonstrate functional similarity between this rhATG and the commercially available rabbit-ATG (Thymoglobulin, Sanofi). The heavy and light chain CDR3 sequences are provided in Table 5 above in RPPs 10-13.

Commercial anti-thymocyte globulin (ATG, (Thymoglobulin, Sanofi)) is useful for inducing transplant tolerance and is manufactured by immunizing New Zealand rabbits with human thymocytes; the blood is harvested from thousands of animals and antibodies are purified from the plasma. The library of RPPs, .i.e., rhATG, disclosed herein combines the efficacy advantages of a polyclonal ATG with the safety advantages of a fully human, recombinant RPP library.

First, transgenic mice carrying inserted human immunoglobulin genes were immunized with human thymocytes or human T cells. Footpad injections were performed on two Trianni Mice twice weekly for three weeks, followed by boosts the following two weeks. One to two million thymocytes were injected into each mouse at each timepoint. Before the final boosts, the serum titer of thymocyte antibodies was assessed by flow cytometry, using a dilution series of each animal's serum, starting at 1:200 and ending at 1:145,000. We observed a strong serum response in both animals, with one animal showing a slightly stronger response. Lymph nodes (popliteal, inguinal, axillary, and mesenteric) were surgically removed after sacrifice. Single cell suspensions for each animal were made by manual disruption followed by passage through a 70 μm filter. Next, we used the EasySep™ Mouse Pan-B Cell Isolation Kit (Stemcell Technologies) negative selection kit to isolate B cells from each sample. The lymph node B cell populations were quantified by counting on a C-Chip hemocytometer (Incyto) and assessed for viability using Trypan blue. The cells were then diluted to 5,000-6,000 cells/mL in phosphate-buffered saline (PBS) with 12% OptiPrep™ Density Gradient Medium (Sigma). This cell mixture was used for microfluidic encapsulation. We ran approximately one million B cells from each of the six animals through our emulsion droplet microfluidics platform.

A DNA library encoding scFv from RNA of single cells, with native heavy-light Ig pairing intact, was generated using the emulsion droplet microfluidics platform or vortex emulsions. The method for generating the DNA library was divided into 1) poly(A)+mRNA capture, 2) multiplexed overlap extension reverse transcriptase polymerase chain reaction (OE-RT-PCR), and 3) nested PCR to remove artifacts and add adapters for deep sequencing or yeast display libraries. The scFv libraries are generated from approximately one million B cells from each animal that achieved a positive titer.

For poly(A)+mRNA capture, a custom designed co-flow emulsion droplet microfluidic chip fabricated from glass (Dolomite) was used. The microfluidic chip has two input channels for fluorocarbon oil (Dolomite), one input channel for the cell suspension mix described above, and one input channel for oligo-dT beads (NEB) at 1.25 mg/ml in cell lysis buffer (20 mM Tris pH 7.5, 0.5 M NaCl, 1 mM ethylene-diaminetetraacetic acid (EDTA), 0.5% Tween-20, and 20 mM dithiothreitol). The input channels are etched to 50 μm by 150 μm for most of the chip's length, narrow to 55 μm at the droplet junction, and were coated with hydrophobic Pico-Glide (Dolomite). Three Mitos P-Pump pressure pumps (Dolomite) were used to pump the liquids through the chip. Droplet size depends on pressure, but typically droplets of ~45 μm diameter were optimally stable. Emulsions were collected into chilled 2 ml microcentrifuge tubes and incubated at 40° C. for 15 minutes for mRNA capture. The beads were extracted from the droplets using Pico-Break (Dolomite). In some embodiments, similar single cell partitioning emulsions are made using a vortex.

For multiplex OE-RT-PCR, glass Telos droplet emulsion microfluidic chips were used (Dolomite). mRNA-bound beads were re-suspended into OE-RT-PCR mix and injected into the microfluidic chips with a mineral oil-based surfactant mix (available commercially from GigaGen) at pressures that generate 27 μm droplets. The OE-RT-PCR mix contains 2× one-step RT-PCR buffer, 2.0 mM MgSO$_4$, SuperScript III reverse transcriptase, and Platinum Taq (Thermo Fisher Scientific), plus a mixture of primers directed against the IgK C region, the IgG C region, and all V regions. The overlap region is a DNA sequence that encodes a Gly-Ser rich scFv linker sequence. The DNA fragments were recovered from the droplets using a droplet breaking solution (available commercially from GigaGen) and then purified using QIAquick PCR Purification Kit (Qiagen). In some embodiments, similar OE-RT-PCR emulsions were made using a vortex.

For nested PCR, the purified OE-RT-PCR product was first run on a 1.7% agarose gel for 80 minutes at 150 V. A band at 1200-1500 base pair (bp) corresponding to the linked product was excised and purified using NucleoSpin Gel and PCR Clean-up Kit (Macherey Nagel). PCR was then performed to add adapters for Illumina sequencing or yeast display; for sequencing, a randomer of seven nucleotides is added to increase base calling accuracy in subsequent next generation sequencing steps. Nested PCR was performed with 2×NEBNext High-Fidelity amplification mix (NEB) with either Illumina adapter containing primers or primers for cloning into the yeast expression vector. The nested PCR product was run on a 1.2% agarose gel for 50 minutes at 150V. A band at 800-1100 bp was excised and purified using NucleoSpin Gel and PCR Clean-up Kit (Macherey Nagel).

To convert the GigaLink™ scFv libraries into full-length CHO expression libraries, nested outer PCR primers were used to add adapters with overhangs for Gibson assembly to the 5' and 3' ends of the scFv library. Then NEBuilder HiFi DNA Assembly Master Mix (NEB, Ipswich, MA, USA) was used to insert the scFv library into a vector containing a single promoter, a secretory leader sequence for light chain Ig and the remainder of the IgG1 constant region, creating a cloned scFv library. This intermediate library was transformed into E. coli, spread onto LB-ampicillin plates, 0.5-1 million colonies were scraped and pooled for a plasmid purification using ZymoPURE II Plasmid Maxiprep Kits (Zymo Research, Irvine, CA, USA). To create the full-length antibody library, a second Gibson assembly was performed by linearizing the product of GA1 with BamHI-HF (NEB, Ipswich, MA, USA) and using it as a vector to insert a synthetic amplicon containing a portion of the light chain Ig constant region, a poly(A) signal for light chain Ig, a promoter for the IgG gene and a secretory leader sequence for the IgG gene. The full-length library was then transformed into E. coli and spread on LB-ampicillin plates Over 0.5 million colonies are scraped and plasmid is purified with a ZymoPURE II Plasmid Maxiprep Kits (Zymo Research) to make the full-length recombinant hyperimmune maxiprep library for transfection.

The adherent Flp-In™-CHO cell line was adapted with a genomically integrated FRT site (Thermo Fisher Scientific, Waltham, MA, USA) to suspension culture. For all steps in the adaptation process, "Ham's F-12" refers to Ham's F-12 (with L-glutamine, Thermo Fisher Scientific, Waltham, MA, USA) plus 10% FBS (Thermo Fisher Scientific, Waltham, MA, USA) and "BalanCD" refers to BalanCD CHO Growth A (Irvine Scientific) with 4 mM Glutamax (Thermo Fisher Scientific, Waltham, MA, USA). To adapt this cell line to suspension, the cells were first passaged into a mixture of 50% Ham's F-12 plus 50% BalanCD in T-flasks. Cells were next passaged into 25% Ham's F-12 plus 75% BalanCD and switched to shaking Erlenmeyer flasks. Cells were then passaged into 10% Ham's F-12, 90% BalanCD+0.2% anti-clumping agent (Irvine Scientific, Santa Ana, CA, USA) and banked for future use.

100 million of the adapted Flp-In CHO cells were transfected per recombinant hyperimmune library using an Amaxa Nucleofector 4D (SG buffer, pulse DU133; Lonza, Basel, Switzerland). These cells were plated into shaking Erlenmeyer flasks and recovered in an incubator at 37° C. and 125 rpm for 48 hours. After 48 hours, the cells were counted to determine viability, cells were seeded at 1 million cells/mL, and selection was started using 600 g/mL Hygromycin-B (Gemini Bio, West Sacramento, CA, USA) in fresh media. Cells were counted and media was changed every 2-3 days during the 7-day selection. The libraries were kept on 600 g/mL Hygromycin-B (Gemini Bio, West Sacramento, CA, USA) during expansion until viability exceeded 95%. When cells were >95% viable and doubling every 24 hours, the cell line was banked for liquid nitrogen storage.

CHO cells stably expressing antibody libraries were grown in media consisting of 90% BalanCD CHO Growth A Medium (Irvine Scientific, Santa Ana, CA), 9% Ham's F-12 (Thermo Fisher Scientific, Waltham, MA, USA), 1% FBS (ThermoFisher Scientific), 4 mM Glutamax (Thermo Fisher Scientific, Waltham, MA, USA), 0.2% anti-clumping agent (Irvine Scientific, Santa Ana, CA, USA). For small-scale production, cells were seeded at $1\times10^6$ cells/mL into 50 mL media in a 250 mL Erlenmeyer flask and grown at 37° C., 5% CO$_2$, 125 rpm. Cells were continually grown under these conditions and supplemented with 7.5 mL CHO Feed 1 (Irvine Scientific, Santa Ana, CA, USA) on days 2, 4 and 7 of the production run. Supernatant was harvested on Day 8 by centrifugation followed by filtration through a 0.22 m 250 mL filter bottle (EMD Millipore, Burlington, MA, USA)

with 1 m pre-filter (EMD Millipore, Burlington, MA, USA). Harvested cell culture fluid (HCCF) was stored at 4° C. until Protein A purification. For large-scale production of the plasma cell recombinant hyperimmune, cells were grown in the same media but with some modifications to the production conditions. A seed train was used to scale the cultures from $2 \times 10^7$ cells to $1.2 \times 10^{10}$ cells at 37° C. Cells were then seeded at $1 \times 10^6$ cells/mL in 2 L in a 5 L flask (in triplicate; Day 0). On Day 2 the temperature was shifted from 37° C. to 33° C. Each flask was fed with 300 mL CHO Feed 1 (Irvine Scientific, Santa Ana, CA, USA) on days 2, 4, 6, 8, 10, and 13 of the culture. Supernatant was harvested on Day 14.

After harvest, HCCF was purified with MabSelect SuRe Protein A resin (GE Life Sciences, Marlborough, MA, USA) using the following buffers: Equilibration, Chase, Wash 2 (25 mM Tris, 150 mM NaCl, pH 7.4), Wash 1 (25 mM Tris, 1 M NaCl, pH 7.4), Elution (20 mM citric acid, pH 3.0), Neutralization (100 mM Tris, pH 8.0 for small scale, 1 M Tris, pH 9.0 for large scale). The column was sanitized before and after use with 0.1 N NaOH. For the large-scale production of the plasma cell recombinant hyperimmune, an additional Wash 3 consisting of 0.5 M arginine, pH 7.4 was used, followed by an additional wash with Wash 2 before elution. The order of purification steps was: Equilibration, Load, Chase, Wash 1, Wash 2, (large scale: Wash 3, Wash 2), Elution, Neutralization (added manually into tubes used for collection of eluate fractions). The recombinant hyperimmunes (RPPs) were concentrated using Vivaspin 20, 30 kDa molecular weight cut off spin concentrators (Sartorius, Gottingen, Germany) and formulated in PBS (small-scale productions) or 0.2 M glycine, pH 4.5 (large scale production), followed by 0.22 m filtration.

ELISA was used to test binding of the rhATG, i.e., anti-T cell and anti-thymocyte RPPs against antigens known to be expressed on the surface of T cells and thymocytes. ELISA showed binding to CD4, CD45, and CD81. Antigens were coated on an ELISA plate at 1 μg/mL. Titration curves were performed starting at 100 ug/mL of each antibody with a 1/3 stepwise dilution to determine the EC50. Because different secondary detection antibodies were used, the EC50 values cannot be directly compared between rabbit-ATG and rhATG. However, it was determined that within each library the antigens that had stronger binding than their respective background. Antibody responses were broadly reactive against many T cell antigens for both rhATG and rabbit-ATG, with both binding very strongly to CD45 and CD5, and binding weaker to CD4, CD11, and CD81 (data not shown).

An in vivo validation study was performed. An in vivo model of GvHD (graft-versus-host-disease) was used to demonstrate the functional efficacy of ATG treatment-induced delay to GvHD. $1 \times 10^7$ human PBMCs from a single donor were engrafted into NSG mice. The study used 6 mice per group with an IV infusion of the drugs tested: rhATG (RPPs), commercial rabbit-ATG, and a vehicle control. Animals were treated (6 mg/kg) at a single timepoint 7 days after engraftment. Additionally, a positive control group (8 mice) received Abatacept, a drug commonly used to prevent GvHD, and this was dosed intraperitoneally (IP) every other day from day 5 to the end of study. Immune cells were measured by flow cytometry for expansion, denoting progression to GvHD, and animals were monitored for weight loss and clinical presentation of GvHD leading to death.

Forty-two days after PBMC engraftment, any animals that were still alive were taken down and a survival analysis was completed for each of the treatment groups. There was no significant delay with rhATG (p=0.2, Mantel-Cox) and only a minor delay to GvHD was observed with rabbit-ATG (p=0.01, Mantel-Cox) (data not shown). Flow cytometry was used to measure engrafted PBMCs before treatment, 2 days after treatment, and 9 days after treatment. rhATG and rabbit-ATG depleted CD45+ cells, as seen 2 days after treatment, leading to a delay in the full engraftment of CD45+ cells, however by day 9 there with no significant difference between any groups (data not shown).

The results demonstrate that the rhATG (library of RPPs) has a similar antigen-specific antibody binding profile as the currently available commercial rabbit-ATG, though some differences were observed. In addition, rhATG also performs similarly to commercial rabbit-ATG in delaying progression to GvHD in mice using different dosing regimens.

8.2. Example 2: Generation of a Library of RPPs with Activity Against *Haemophilus influenzae* Type b (Hib) from Human Donors Both in vitro and in vivo studies pere performed, testing polyclonal antibody pools, (pAb), i.e., libraries of RPPs, with activity against *Haemophilus influenzae* type b (Hib). Tested were anti-Hib pAbs made from four different B cell subtypes collected from donors vaccinated with the Pedvax-HIB conjugate vaccine. The four subtypes tested were CD43+ plasmablasts, CD27+ memory B cells, peripheral CD138+ plasma cells, and pan-B cells (all B cells). All four pAbs were first tested in vitro. The pAb made from CD138+ plasma cells was the most potent in vitro, so this product was then tested relative to IVIG in an in vivo challenge model.

The SEQ ID NOS of the heavy and light chain CDR3 sequences of the RPPs are provided in Table 5 above in RPPs 3-6.

A CRO (BloodCenter Wisconsin, Milwaukee, WI, USA) was used to vaccinate two donors (Donor 1, a 26-year-old Caucasian female, and Donor 2, a 21-year-old Asian male) with PedvaxHIB vaccine (Merck, Kenilworth, NJ, USA). Leukapheresis was performed eight or nine days later to obtain PBMCs. In parallel, plasma was isolated from separate blood draws on the day of leukapheresis and prior to vaccination. ELISA against Hib (Alpha Diagnostics, San Antonio, TX, USA; see methods below) on the plasma samples confirmed a response to the vaccine as compared to plasma from the same donors prior to vaccination. Sample collection protocols were approved by Institutional Review Board (IRB) protocol #PRO00028063 (Medical College of Wisconsin/Froedtert Hospital IRB) to GigaGen. Informed consent was obtained from all participants and samples were shipped to GigaGen de-identified.

To isolate pan-B cells, we used the Human EasySep Pan-B Cell Enrichment Kit (Stemcell #19554, Vancouver, BC, Canada). To isolate CD43+ cells, we used the pan-B cells and positive selection beads for CD43 (Miltenyi #130-091-333, Bergisch Gladbach, Germany). To isolate CD27+ cells, we applied CD27 positive selection beads (Miltenyi #130-051-601, Bergisch Gladbach, Germany) to the negative fraction from the CD43+ selection. For plasma cells, we applied the EasySep Human CD138 Positive Selection Kit (Stemcell #18357, Vancouver, BC, Canada) to PBMCs. After isolation, the antibody-producing cells were cryopreserved using CryoStor® CS10 (Stemcell Technologies, Vancouver, BC, Canada). Immediately prior to generating paired heavy and light chain libraries, cells were thawed, washed in cold DPBS+0.5% BSA, assessed for viability with Trypan blue on a Countess™ cell counter (Thermo Fisher Scientific, Waltham, MA, USA), and then re-suspended in 12%

OptiPrep™ Density Gradient Medium (Sigma, St. Louis, MO, USA) at 5,000-6,000 cells per µl. This cell mixture was used for microfluidic encapslation as described in the next section.

Generation of scFv libraries from antibody-producing cells (Adler et al., *Mabs* 9, 1282-1996, 2017) comprises three steps: (i) poly(A)+ mRNA capture, (ii) multiplexed overlap extension reverse transcriptase polymerase chain reaction (OE-RT-PCR), and (iii) nested PCR to remove artifacts and add adapter sequences for deep sequencing or yeast display libraries.

To convert the GigaLink™ scFv libraries into full-length CHO expression libraries, we first used nested outer PCR primers to add adapters with overhangs for Gibson assembly to the 5' and 3' ends of the scFv library. Then NEBuilder HiFi DNA Assembly Master Mix (NEB, Ipswich, MA, USA) was used to insert the scFv library into a vector containing a single promoter, a secretory leader sequence for light chain Ig and the remainder of the IgG1 constant region, creating a cloned scFv library. This intermediate library was transformed into *E. coli*, spread onto LB-ampicillin plates, 0.5-1 million colonies were scraped and pooled for a plasmid purification using ZymoPURE II Plasmid Maxiprep Kits (Zymo Research, Irvine, CA, USA). To create the full-length antibody library, we performed a second Gibson assembly by linearizing the product of GA1 with BamHI-HF (NEB, Ipswich, MA, USA) and using it as a vector to insert a synthetic amplicon containing a portion of the light chain Ig constant region, a poly(A) signal for light chain Ig, a promoter for the IgG gene and a secretory leader sequence for the IgG gene. The full-length library was then transformed into *E. coli* and spread on LB-ampicillin plates. We typically scrape >0.5 million colonies and purify plasmid with a ZymoPURE II Plasmid Maxiprep Kits (Zymo Research) to make the full-length recombinant hyperimmune maxiprep library for transfection.

We adapted the adherent Flp-In™-CHO cell line with a genomically integrated FRT site (Thermo Fisher Scientific, Waltham, MA, USA) to suspension culture. For all steps in the adaptation process, "Ham's F-12" refers to Ham's F-12 (with L-glutamine, Thermo Fisher Scientific, Waltham, MA, USA) plus 10% FBS (Thermo Fisher Scientific, Waltham, MA, USA) and "BalanCD" refers to BalanCD CHO Growth A (Irvine Scientific) with 4 mM Glutamax (Thermo Fisher Scientific, Waltham, MA, USA). To adapt this cell line to suspension, we first passaged the cells into a mixture of 50% Ham's F-12 plus 50% BalanCD in T-flasks. Cells were next passaged into 25% Ham's F-12 plus 75% BalanCD and switched to shaking Erlenmeyer flasks. Cells were then passaged into 10% Ham's F-12, 90% BalanCD+0.2% anti-clumping agent (Irvine Scientific, Santa Ana, CA, USA) and banked for future use.

100 million of the adapted Flp-In CHO cells were transfected per recombinant hyperimmune library using an Amaxa Nucleofector 4D (SG buffer, pulse DU133; Lonza, Basel, Switzerland). These cells were plated into shaking Erlenmeyer flasks and recovered in an incubator at 37° C. and 125 rpm for 48 hours. After 48 hours, the cells were counted to determine viability, cells were seeded at 1 million cells/mL, and selection was started using 600 g/mL Hygro-mycin-B (Gemini Bio, West Sacramento, CA, USA) in fresh media. Cells were counted and media was changed every 2-3 days during the 7-day selection. The libraries were kept on 600 g/mL Hygromycin-B (Gemini Bio, West Sacramento, CA, USA) during expansion until viability exceeded 95%. When cells were >95% viable and doubling every 24 hours, the cell line was banked for liquid nitrogen storage.

CHO cells stably expressing antibody libraries were grown in media consisting of 90% BalanCD CHO Growth A Medium (Irvine Scientific, Santa Ana, CA), 9% Ham's F-12 (Thermo Fisher Scientific, Waltham, MA, USA), 1% FBS (ThermoFisher Scientific), 4 mM Glutamax (Thermo Fisher Scientific, Waltham, MA, USA), 0.2% anti-clumping agent (Irvine Scientific, Santa Ana, CA, USA). For small-scale production, cells were seeded at $1 \times 10^6$ cells/mL into 50 mL media in a 250 mL Erlenmeyer flask and grown at 37° C., 5% $CO_2$, 125 rpm. Cells were continually grown under these conditions and supplemented with 7.5 mL CHO Feed 1 (Irvine Scientific, Santa Ana, CA, USA) on days 2, 4 and 7 of the production run. Supernatant was harvested on Day 8 by centrifugation followed by filtration through a 0.22 m 250 mL filter bottle (EMD Millipore, Burlington, MA, USA) with 1 m pre-filter (EMD Millipore, Burlington, MA, USA). Harvested cell culture fluid (HCCF) was stored at 4° C. until Protein A purification. For large-scale production of the plasma cell recombinant hyperimmune, cells were grown in the same media but with some modifications to the production conditions. A seed train was used to scale the cultures from $2 \times 10^7$ cells to $1.2 \times 10^{10}$ cells at 37° C. Cells were then seeded at $1 \times 10^6$ cells/mL in 2 L in a 5 L flask (in triplicate; Day 0). On Day 2 the temperature was shifted from 37° C. to 33° C. Each flask was fed with 300 mL CHO Feed 1 (Irvine Scientific, Santa Ana, CA, USA) on days 2, 4, 6, 8, 10, and 13 of the culture. Supernatant was harvested on Day 14.

After harvest, HCCF was purified with MabSelect SuRe Protein A resin (GE Life Sciences, Marlborough, MA, USA) using the following buffers: Equilibration, Chase, Wash 2 (25 mM Tris, 150 mM NaCl, pH 7.4), Wash 1 (25 mM Tris, 1 M NaCl, pH 7.4), Elution (20 mM citric acid, pH 3.0), Neutralization (100 mM Tris, pH 8.0 for small scale, 1 M Tris, pH 9.0 for large scale). The column was sanitized before and after use with 0.1 N NaOH. For the large-scale production of the plasma cell recombinant hyperimmune, we used an additional Wash 3 consisting of 0.5 M arginine, pH 7.4, followed by an additional wash with Wash 2 before elution. The order of purification steps was: Equilibration, Load, Chase, Wash 1, Wash 2, (large scale: Wash 3, Wash 2), Elution, Neutralization (added manually into tubes used for collection of eluate fractions). The recombinant hyperimmunes were concentrated using Vivaspin 20, 30 kDa molecular weight cut off spin concentrators (Sartorius, Gottingen, Germany) and formulated in PBS (small-scale productions) or 0.2 M glycine, pH 4.5 (large scale production), followed by 0.22 m filtration.

Imaged capillary isoelectric focusing (iCIEF) was performed using a Maurice imaging cIEF analyzer (Protein Simple, San Jose, CA, USA). Capillary electrophoresis sodium dodecyl sulfate (CE-SDS) was performed under reducing and non-reducing conditions using LabChip GX II Touch HT (Perkin Elmer, Waltham, MA, USA). Endotoxin levels were measured using Endosafe nexgen-PTS (Charles River, Wilmington, MA, USA).

We observed an HBV RPP yield of 92.2% in our Protein A step. Under non-reducing conditions, we observed a single peak (>99%) at 166.2 kDa with CE-SDS. Under reducing conditions, the RPP showed >99% pure IgG monomer and <1% other proteins, whereas plasma IVIg showed approximately 3.1% unknown protein, suggesting that recombinant hyperimmunes could be produced at higher purity of IgG than plasma IVIg. Analysis of the purified recombinant hyperimmune by iCIEF revealed a broad spectrum of isoelectric species, though plasma IVIg showed a considerably broader range of isoelectric species. We speculate that plasma IVIg has a broader variety of isolectric species because it comprises a broader diversity of antibodies, and also includes different IgG isotypes (the recombinant hyperimmune is only IgG1), as well as IgL. Finally, the endotoxin level was <0.5 endotoxin units (EU)/mg, which is the typical benchmark for recombinant mAb therapeutics.

Deep antibody sequencing libraries were quantified using a quantitative PCR Illumina Library Quantification Kit (KAPA, Wilmington, MA, USA) and diluted to 17.5 pM. Libraries were sequenced on a MiSeq (Illumina, San Diego, CA, USA) using a 500 cycle MiSeq Reagent Kit v2, according to the manufacturer's instructions. To make sequencing libraries, we used tailed-end PCR to add Illumina sequencing adapters to the 5' and 3' ends of the constructs of interest. Then, we obtained forward reads of 340 cycles and reverse reads of 162 cycles. This produced forward and reverse reads that overlap at the CDR3-H and part of the $V_H$-gene, which increased confidence in nucleotide calls. Sequence analysis was performed using our previously reported bioinformatics pipeline (Adler et al., Mabs 9, 1282-1996, 2017). Pearson correlation was performed using the cor function in R version 3.4.2.

Each of four HBV RPPs were derived from 1.12-1.39 million input cells. After the repertoires were subjected to our library generation pipeline, the clonal diversity of the recombinant hyperimmunes were all less than 2,000 antibody clones (range: 880 to 1,659), capturing a considerable fraction of the input antibody diversity. All four recombinant hyperimmunes had a median germline IgHV identity of 93%, suggesting that no cell type yielded antibodies with significantly higher affinity, consistent with prior analysis of Hib-vaccinated individuals (Truck et al., 2015). Clonal diversity was not strongly biased toward the most frequent antibodies in any of the mixtures. The most common antibody was present at a frequency of 3.5% (plasma cell hyperimmune). The pan-B recombinant hyperimmune had the least skewed clonal diversity (the top 20 antibodies were 12.7% of all antibodies), and the plasma cell recombinant hyperimmune had the most skewed clonal diversity (the top 20 antibodies were 26.6% of all antibodies).

We examined the genetic diversity of the four recombinant hyperimmune libraries. An overlap analysis revealed that no more than 11.8% of clones were shared between any given two recombinant hyperimmune libraries. Pearson correlation analysis was not significant between any two pairwise comparisons (p<0.01). All four recombinant hyperimmune libraries contained a variety of IgGV-J gene pairings, including high frequencies of antibodies with IgHV3-23 and IgHJ4 genes, which has been seen elsewhere in anti-Hib repertoires (Silverman & Lucas, 1991; Adderson et al., 1993; Lucas et al., 2003; Truck et al., 2015). Other common IgHV genes included IgHV3-30, IgHV1-69, and IgHV3-7. All libraries also included complementarity-determining region (CDR)3 sequences containing either of the peptides GYGFD or GYGMD, previously observed in anti-Hib repertoires (Lucas et al., 2003; Truck et al., 2015). We conclude that all four libraries contain canonical anti-Hib sequences and similar levels of divergence from germline and genetic diversity. However, the four libraries do comprise distinct antibody mixtures, which may have different functional characteristics.

The Human Anti-Hib-PRP IgG ELISA kit (Alpha Diagnostics #980-100-PHG, San Antonio, TX, USA) was used for anti-Hib ELISA titers. Serial dilutions of antibody preparations were performed in Low NSB (non-specific binding) sample diluent. Quantitative measurements were performed on a plate reader (Molecular Devices, Fremont, CA, USA)

at 450 nm. EC50 values were calculated using SoftMax Pro® (Molecular Devices, Fremont, CA, USA). We also determined the anti-Hib PRP antibody titer for a pool of plasma from both donors before and after vaccination with the Hib active vaccine, as well as IVIg. The plasma cell, pan-B, and plasmablast recombinant hyperimmunes yielded considerably higher Hib-binding titers than IVIg (range: 160× to 2,323×), with the plasma cell hyperimmune yielding the highest titer. The post-vaccination plasma was only 3.7× the anti-Hib titer of IVIg, and no anti-Hib titer was detected in the memory B cell recombinant hyperimmune under the conditions tested. Taken together, these data indicate that our manufacturing process can considerably increase anti-Hib titers simply by selecting appropriate cell types from vaccinated donors.

In vitro neutralization studies were performed at a CRO (ImQuest Frederick, MD, USA). The Haemophilus influenzae type b Eagan strain was obtained from Zeptometrix (#0801679, Buffalo, NY, USA) as a frozen glycerol stock and stored at −80° C. The Haemophilus influenzae strain ATCC 10211 was obtained from the American Type Culture Collection (ATCC, Frederick, MD, USA) as a lyophilized stock and was propagated as recommended by the supplier. Colonies from an overnight incubation on chocolate agar plates were inoculated into growth media (Brain Heart Infusion, or BHI broth, BD BBL 299070, San Jose, CA, USA, with 2% Fildes enrichment, Remel #R45037, San Diego, CA, USA) and allowed to achieve an optical density of 625 nm (OD625) of approximately 0.4. The culture was adjusted to an OD625 of 0.15, which is equivalent to approximately $5\times10^8$ colony forming units (CFU)/mL. The culture was further diluted to $5\times10^4$ CFU/mL in dilution buffer (Hanks Balanced Salt Solution, Gibco, Waltham, MA, USA #14025-092, with 2% Fildes enrichment). The density of the bacterial culture used in the assay was confirmed by plating 50 µL of the $5\times10^3$ and $5\times10^2$ dilutions in duplicate on chocolate agar and enumerating the colonies following incubation at 37° C./5% $CO_2$ for 24 hours.

Test articles were diluted three-fold in dilution buffer, starting at 200 g/mL such that ten total dilutions were evaluated. 10 µL of each dilution of test article were added in duplicate to a 96-well microtiter plate. Eagan or ATCC 10211 bacteria at a concentration of approximately $5\times10^4$ CFU/mL were then added to the plate in a volume of 20 µL, such that the total in-well bacterial density would be $1\times10^4$ CFU/20 µL. Following an incubation of 15 minutes at 37° C./5% $CO_2$, 25 µL of baby rabbit complement (Pel-Freez #31061-1, Rogers, A R, USA) and 25 µL of dilution buffer was added to each well. The plate was incubated at 37° C./5% $CO_2$ for 60 minutes. Following the incubation, 5 µL of each reaction mixture was diluted in 45 µL of dilution buffer and the entire 50 µL was plated on chocolate agar plates. The plates were incubated for approximately 16 hours at 37° C./5% $CO_2$. Following incubation, bacterial colonies were enumerated. The test article concentration that killed >50% of the bacteria is the SBI.

As expected from the ELISA data, the memory B cell recombinant hyperimmune was not able to neutralize either Hib strain at any of the concentrations tested. The plasma cell recombinant hyperimmune again yielded the highest titer, with SBIs of 81 and 243 for the Eagan and ATCC10211 strains, respectively. The pan-B and plasmablast recombinant hyperimmunes were ⅓ah as potent as the plasma cell recombinant hyperimmune. Neutralization was not detected for IVIg at any of the tested concentrations. We conclude that the plasma cell recombinant hyperimmune is the highest potency among the four cell types tested.

All vertebrate experiments were conducted under supervision and approval of either the Institutional Animal Care and Use Committee of Sinclair Research Center, LLC, Missouri (USA) in accordance with the Animal Welfare Act and standards incorporated in the Guide for the Care and Use of Laboratory Animals (National Research Council of the National Academies, Eighth Edition) or the National Committee of Animal Ethics, Denmark, in accordance with the standards of EU Directive 2010/63/EU (permission number: 2014-15-0201-00171).

For acute toxicity, Balb/cJ mice (Charles River, Wilmington, MA, USA) were divided randomly by a CRO (Sinclair Research, Auxvasse, MO, USA) into seven groups of six animals per group. Three of the groups were administered the recombinant hyperimmune at a single dose of 30 mg/kg, 100 mg/kg, or 300 mg/kg. A negative control group was administered a single dose of saline vehicle. The three remaining groups were administered a single dose of plasma IVIg (Gammagard; Grifols, Sant Cugat, Catalonia) at 30 mg/kg, 100 mg/kg, or 300 mg/kg. Test article samples were diluted in 0.2 M Glycine, pH 4.5. Test article administration was performed intravenously through a tail vein. Dose volumes were calculated based on each individual animal's most recent body weight. The mice were then observed twice daily for 8 days for general health, reaction at the site of test article administration, morbidity and mortality, body weight, and gross physical examination (skin, mucous membranes, eyes, ears, nose, and respiration). Animals were euthanized with $CO_2$ gas after 3 days, and terminal serum chemistry was performed, including albumin, globulin, glucose, total protein, blood urea nitrogen, and several other metrics.

We observed no test article-related findings for any of the test groups. We conclude that the no-observed-adverse-effect level (NOAEL) for a single intravenous dose of the plasma cell recombinant hyperimmune is 300 mg/kg. IVIg is typically dosed in immunodeficient patients at around 300 mg/kg for protection against Hib and other pathogens, and the Hib hyperimmune product is thousands-fold more potent, so we conclude that the plasma cell recombinant hyperimmune would have no observable toxicity for a minimally efficacious dose.

For pharmacokinetics, a CRO (Sinclair Research, Auxvasse, MO, USA) administered twenty male Balb/cJ mice (Charles River, Wilmington, MA, USA) one 100 mg/kg intravenous tail vein dose of the plasma cell recombinant hyperimmune. A sparse blood sampling procedure was followed such that no mice received more than two of the scheduled seven PK blood samplings. We then used a sandwich ligand-binding assay (LBA) and Meso Scale Discovery (MSD; Rockville, MD, USA) electrochemiluminescence (ECL) technology to measure serum human IgG. Capture antibody (SouthernBiotech #2049-01, Birmingham, AL, USA) was coated onto 96-well plates (MSD, Rockville, MD, USA). Serum samples were diluted to the minimum required dilution (MRD) of 1:100 in PBS/T containing 1% BSA (PBS/T/BSA). Next, the diluted samples were added to the designated wells. After another wash step, wells were inoculated with PBS/T/BSA containing 1 mg/mL of biotinylated-goat anti-human IgG (SouthernBiotech #2049-08, Birmingham, AL, USA). After incubation, streptavidin-SULFO-TAG was added, followed by 2× read buffer T (MSD, Rockville, MD, USA). ECL units were measured using an MSD QuickPlex SQ 120 instrument. A standard curve was additionally generated for each run using plasma cell-based recombinant hyperimmune. The Discovery Workbench software (MSD, Rockville, MD, USA) was used to fit the data using a four-parameter logistic (4-PL) curve-fit of mean ECL units versus nominal IgG standard values. We removed from further analysis two animals with 1100 ng/mL or lower readings at the 1-hour timepoint, under the assumption that intravenous administration failed. We then used the PKNCA package in R (Denney et al., 2015) to apply non-compartmental analysis to the concentration-time data to estimate maximum observed plasma concentration ($C_{max}$), time of maximum observed plasma concentration ($T_{max}$), and half-life ($t_{1/2}$).

The maximum observed plasma concentration was 12,360 ng/mL ($C_{max}$), observed one hour post-dose ($T_{max}$). The half-life ($t_{1/2}$) of the recombinant hyperimmune was approximately 34.5 hours. Combining these data with the ELISA titer data, we estimate that the maximum anti-Hib trough level was 861 IU/mL for a single 100 mg/kg intravenous dose.

The *Haemophilus influenza* strain ATCC10211 was grown on chocolate agar plates overnight at 35° C. and 5% $CO_2$. Single overnight colonies were resuspended in sterile saline to $1.5 \times 10^8$ CFU/mL. This suspension was diluted in BHI broth with 5% mucin and 2% hemoglobin to approximately $1 \times 10^6$ CFU/mL and further 10-fold diluted to 10 CFU/mL.

Balb/cJ mice (Taconic, Denmark; n=6 per group) were inoculated with single 0.5 mL intraperitoneal doses of $10^4$, $10^5$, or $10^6$ CFU/mL Hib bacteria (strain ATCC10211). Approximately 1 hour before inoculation, mice were treated orally with 45 μL Nurofen (20 mg ibuprofen/mL corresponding to approximately 30 mg/kg) as pain relief. Twenty-four hours prior to inoculation, mice were administered 300 mg/kg recombinant Hib hyperimmune, 300 mg/kg plasma IVIg or saline. One hour after inoculation mice were dosed with 20 mg/kg ciproflaxin antibiotic as positive control treatment. Mice were scored for clinical signs of infection every 2-6th hour and were terminated when severely affected by the infection. After another 72 hours, any living animals were anesthetized with Zoletil mix and blood was collected by axillary cut down. Mice were sacrificed by cervical dislocation, 2 mL sterile saline was injected intraperitoneally, and the abdomen gently massaged before it was opened and fluid sampled with a pipette. Each sample was 10-fold diluted in saline and 20 μL spots were applied on chocolate agar plates. All agar plates were incubated 18-22 hours at 35° C. at ambient air.

The Hib infection was lethal to all but one mouse at all inoculation doses in the vehicle control group. In contrast, only one out of 18 mice was severely affected in the recombinant hyperimmune treatment groups (in the $10^6$ CFU inoculation group). IVIg was much less protective than the recombinant hyperimmune, with 5/6 mice in the $10^5$ CFU and $10^6$ CFU inoculation groups, and 2/6 mice in the $10^4$ CFU inoculation group being severely affected by the infection. Analysis of bacterial loads in blood demonstrated that the recombinant hyperimmune eliminated Hib from the bloodstream of all animals, whereas IVIg treatment resulted in significantly lower bacterial loads than the vehicle control in only one of the inoculation groups and no significant reduction in two inoculation groups (Dunnett's multiple comparisons test, p<0.05). In peritoneal lavage, the recombinant hyperimmune again significantly reduced the bacterial loads compared to the vehicle control group (Dunnett's multiple comparisons test, p<0.05). However, whereas Hib bacteria were not detectable in the peritoneal lavage of surviving animals treated with ciproflaxin, Hib bacteria were detectable in the peritoneal lavage of 6/17 surviving animals treated with recombinant hyperimmune (range: 23-77 CFU/ mL). This suggests differences in the efficacy of the recombinant hyperimmune between the peritoneum and blood, perhaps due to bioavailability of drug or complement in the peritoneum.

In some embodiments, the Hib hyperimmune is spiked into conventional plasma IVIg to increase the anti-Hib titer of IVIg. In some embodiments, several anti-pathogen hyperimmunes are spiked into conventional plasma IVIg, for example, hyperimmunes directed against Hib, pneumococcus, influenza A virus, and tetanus are spiked into plasma IVIg to treat patients with primary immune deficiency. The spike in hyperimmunes increase the titer of antibodies directed against pathogens to which primary immune deficiency patients are particularly susceptible. Any number of spike-ins can be mixed with plasma IVIg to generate increased titers against any number of pathogens.

Using a series of in vitro and in vivo experiments, the following was determined. For Hib, plasma cells following vaccination produce the most potent RPP. The plasma cell Hib RPP was >2,300× more potent (by ELISA) than plasma IVIG. The plasma cell Hib RPP strongly protected against Hib infection in an in vivo challenge model. Use of plasmablasts and pan-B cells also led to a potent RPP in vitro, albeit less potent than plasma cells. For this antigen, the RPP made from memory B cells had undetectable levels of potency in the in vitro assays.

8.3. Example 3: Generation of a Library of RPPs with Activity Against *Streptococcus pneumoniae* Capsular Polysaccharides

*Streptococcus pneumoniae* causes pneumococcal pneumonia. A recombinant polyclonal antibody (pAb), i.e., library of RPPs, with activity towards *Streptococcus pneumoniae* was generated, "GG-Pnc." GG-Pnc tested in vitro. The results demonstrate the in vitro functional efficacy and potency of GG-Pnc with activity against *Streptococcus pneumoniae* capsular polysaccharides. The library was analyzed by bulk pneumococcal polysaccharide ELISA, serotype-specific ELISA, and serotype-specific opsonophagocytic assays.

The SEQ ID NOS of the heavy and light chain CDR3 sequences of the GG-Pnc are provided in Table 5 above (RPP1).

Using the recombinant techniques described in examples 1 and 2, GG-Pnc, i.e., a library of RPPs was prepared. This library was prepared from three donors vaccinated with the Pneumovax-23 vaccine. Pneumovax-23 consists of capsular polysaccharides from 23 pneumococcal serotypes. All three donors showed an increase in titer against pneumococcal capsular polysaccharides after vaccination, as measured by ELISA. The rpAb was made from a mixture of all B cell subtypes isolated from the donors.

The Alpha Diagnostics ELISA measures bulk polysaccharide-specific antibody responses to the 23 pneumococcal polysaccharides found in the Pneumovax-23 vaccine and was used to measure an EC50 of the RPP library. An 8-step, 3-fold dilution series was performed, and a 4-point logistic analysis was performed to calculate the EC50. The RPP library GG-Pnc was ~100 times more potent than IVIG.

A serotype multiplex ELISA was performed to assess antibody diversity of the GG-Pnc RPP library compared to IVIG. Twenty pneumococcal serotypes were measured by ELISA. Using an international standard for pneumococcal-specific responses, antibody-specific responses in GG-Pnc and IVIG (Gamunex) were measured. GG-Pnc had a similar or higher concentration than IVIG against all serotypes except for serotype 6A.

Serotype-specific opsonophagocytosis assays were performed to assess antibody-induced killing function. Fourteen pneumococcal serotypes were measured by opsonophagocytosis responses using GG-Pnc and IVIG (Gamunex). Consistent with the multiplex-ELISA, GG-Pnc was similar to or more effective than IVIG for all serotypes except for 6A.

A serotype 2-specific ELISA was performed to determine the ability of GG-Pnc to bind to this serotype, since it was not included in the prior analysis, but it is an available option for an in vivo mouse model. An 8-step, 3-fold dilution series was performed, and a 4-point logistic analysis was used to calculate the EC50; only GG-Pnc had a value since IVIG had minimal binding to serotype 2, even at very high concentrations.

The GG-Pnc RPP library strongly bound a diverse set of pneumococcal serotypes and was able to neutralize all serotypes tested based on in vitro opsonophagocytosis assays. GG-Pnc was similar to or more potent than IVIG for all but one serotype (for both binding and killing), with no serotype-specific enrichment procedures performed and using all B cells isolated from the vaccinated donors. GG-Pnc also strongly bound to serotype 2.

8.4. Example 4: Generation of a Library of RPPs with Activity Against Influenza A Antigen A library of RPPs with activity towards Influenza A antigen (RPP1) was generated using the recombinant methods described herein.

The SEQ ID NOS of the heavy and light chain CDR3 sequences of RPP1 are provided in Table 5 above (RPP1).

8.5. Example 5: Generation of a Library of RPPs with Activity Against Hepatitis B Virus Antigen (Engerix, GSK)

Two libraries of RPPs with activity against Hepatitis B virus antigen (RPP8 and RPP9) was generated using the recombinant methods described herein.

The SEQ ID NOS of the heavy and light chain CDR3 sequences of RPP9 and RPP9 are provided in Table 5 above (RPP1).

9. INCORPORATION BY REFERENCE

All publications, patents, patent applications and other documents cited in this application are hereby incorporated by reference in their entireties for all purposes to the same extent as if each individual publication, patent, patent application or other document were individually indicated to be incorporated by reference for all purposes.

10. EQUIVALENTS

Whereas various specific embodiments have been illustrated and described, the above specification is not restrictive. It will be appreciated that various changes can be made without departing from the spirit and scope of the invention(s). Many variations will become apparent to those skilled in the art upon review of this specification.

SEQUENCE LISTING (120158 sequences)

SEQ ID NO: 1 - protein, 9 aa, Homo sapiens
  light chain complementarity determining region 3 for antibody 1
MQTLQTPWT

SEQ ID NO: 2 - protein, 12 aa, Homo sapiens
  heavy chain complementarity determining region 3 for antibody 1
ARLDWNYRAFDI

SEQ ID NO: 3 - protein, 9 aa, Homo sapiens
  light chain complementarity determining region 3 for antibody 2
LQHNSYPLT

SEQ ID NO: 4 - protein, 11 aa, Homo sapiens
  heavy chain complementarity determining region 3 for antibody 2
VRVSTGWNFDY

SEQ ID NO: 5 - protein, 7 aa, Homo sapiens
  light chain complementarity determining region 3 for antibody 3
QQYNTWT

SEQ ID NO: 6 - protein, 12 aa, Homo sapiens
  heavy chain complementarity determining region 3 for antibody 3
ARDKGGRNGMDV

SEQ ID NO: 7 - protein, 9 aa, Homo sapiens
  light chain complementarity determining region 3 for antibody 4
AQGSYWPAS

SEQ ID NO: 8 - protein, 10 aa, Homo sapiens
  heavy chain complementarity determining region 3 for antibody 4
CRDREGFGDV

SEQ ID NO: 9 - protein, 9 aa, Homo sapiens
  light chain complementarity determining region 3 for antibody 5
MQFLQTPLT

SEQ ID NO: 10 - protein, 10 aa, Homo sapiens
  heavy chain complementarity determining region 3 for antibody 5
ARERSGSYDI

SEQ ID NO: 11 - protein, 9 aa, Homo sapiens
  light chain complementarity determining region 3 for antibody 6
QQTYSSPWT

SEQ ID NO: 12 - protein, 15 aa, Homo sapiens
  heavy chain complementarity determining region 3 for antibody 6
ARIWTSSTNCRYMDV

SEQ ID NO: 13 - protein, 9 aa, Homo sapiens
  light chain complementarity determining region 3 for antibody 7
MQGTHWPHT

SEQ ID NO: 14 - protein, 11 aa, Homo sapiens
  heavy chain complementarity determining region 3 for antibody 7
ATFGQQWRLAH

SEQ ID NO: 15 - protein, 10 aa, Homo sapiens
  light chain complementarity determining region 3 for antibody 8
QQYDNLASLT

SEQ ID NO: 16 - protein, 13 aa, Homo sapiens
  heavy chain complementarity determining region 3 for antibody 8
AKEGSSPGPDFEY

SEQ ID NO: 17 - protein, 9 aa, Homo sapiens
  light chain complementarity determining region 3 for antibody 9
QLSGSSLLT

SEQ ID NO: 18 - protein, 12 aa, Homo sapiens
  heavy chain complementarity determining region 3 for antibody 9
ALDEWHPSWYKY

SEQ ID NO: 19 - protein, 9 aa, Homo sapiens
  light chain complementarity determining region 3 for antibody 10
QQYNSYPWT

SEQ ID NO: 20 - protein, 15 aa, Homo sapiens
  heavy chain complementarity determining region 3 for antibody 10
GKEGPGSSGWLTGHY

SEQ ID NO: 21 - protein, 9 aa, Homo sapiens
  light chain complementarity determining region 3 for antibody 11
QQLSNAPLT

SEQ ID NO: 22 - protein, 17 aa, Homo sapiens
  heavy chain complementarity determining region 3 for antibody 11
AKRLPDLLGGGHHYIDV

SEQ ID NO: 23 - protein, 9 aa, Homo sapiens
  light chain complementarity determining region 3 for antibody 12
QQTYRTPYT

SEQ ID NO: 24 - protein, 14 aa, Homo sapiens
  heavy chain complementarity determining region 3 for antibody 12
ARLHGSGLGRWLDP

SEQ ID NO: 25 - protein, 9 aa, Homo sapiens
  light chain complementarity determining region 3 for antibody 13
QQYNSYSRT

SEQ ID NO: 26 - protein, 16 aa, Homo sapiens
  heavy chain complementarity determining region 3 for antibody 13
VGPHLTYNSGWRYFDY

SEQ ID NO: 27 - protein, 9 aa, Homo sapiens
  light chain complementarity determining region 3 for antibody 14
QQSSNTPLT

SEQ ID NO: 28 - protein, 16 aa, Homo sapiens
  heavy chain complementarity determining region 3 for antibody 14
VRDLAGFTRGGSTFDY

SEQ ID NO: 29 - protein, 9 aa, Homo sapiens
  light chain complementarity determining region 3 for antibody 15
LQFAHWPHT

SEQ ID NO: 30 - protein, 9 aa, Homo sapiens
  heavy chain complementarity determining region 3 for antibody 15
AGWGGLSNY

SEQ ID NO: 31 - protein, 9 aa, Homo sapiens
  light chain complementarity determining region 3 for antibody 16
QQLNSYPYT

SEQ ID NO: 32 - protein, 14 aa, Homo sapiens
  heavy chain complementarity determining region 3 for antibody 16
ARGHFDSTGFRLDY

SEQ ID NO: 33 - protein, 9 aa, Homo sapiens
  light chain complementarity determining region 3 for antibody 17
QQFSNLPRT

SEQ ID NO: 34 - protein, 13 aa, Homo sapiens
  heavy chain complementarity determining region 3 for antibody 17
AKEGSSPGPDFDS

SEQ ID NO: 35 - protein, 9 aa, Homo sapiens
  light chain complementarity determining region 3 for antibody 18
QKYGSSPVP

SEQ ID NO: 36 - protein, 18 aa, Homo sapiens
  heavy chain complementarity determining region 3 for antibody 18
ARGDYPEARTGYFLDFDY

SEQ ID NO: 37 - protein, 9 aa, Homo sapiens
  light chain complementarity determining region 3 for antibody 19
QQSYSTPST

SEQ ID NO: 38 - protein, 16 aa, Homo sapiens
  heavy chain complementarity determining region 3 for antibody 19
ARWFSRSSTGVSYMDV

SEQ ID NO: 39 - protein, 9 aa, Homo sapiens
  light chain complementarity determining region 3 for antibody 20
LQDYNHVGT

SEQ ID NO: 40 - protein, 9 aa, Homo sapiens
  heavy chain complementarity determining region 3 for antibody 20
GSRRPYFDS

SEQ ID NO: 41 - protein, 9 aa, Homo sapiens
  light chain complementarity determining region 3 for antibody 21
LQYAHWPHT

SEQ ID NO: 42 - protein, 15 aa, Homo sapiens
  heavy chain complementarity determining region 3 for antibody 21
ARVGRPYHNAWYFDN

SEQ ID NO: 43 - protein, 9 aa, Homo sapiens
  light chain complementarity determining region 3 for antibody 22
QQLNSSPYT

SEQ ID NO: 44 - protein, 14 aa, Homo sapiens
  heavy chain complementarity determining region 3 for antibody 22
ARGHFDSTGFRLDY

SEQ ID NO: 45 - protein, 9 aa, Homo sapiens
  light chain complementarity determining region 3 for antibody 23
QQDYYTPRT

SEQ ID NO: 46 - protein, 11 aa, Homo sapiens
  heavy chain complementarity determining region 3 for antibody 23
ARRSLGGAFDY

SEQ ID NO: 47 - protein, 9 aa, Homo sapiens
  light chain complementarity determining region 3 for antibody 24
QERSTWPGS

SEQ ID NO: 48 - protein, 13 aa, Homo sapiens
  heavy chain complementarity determining region 3 for antibody 24
ATGAWGSSWWGDY

SEQ ID NO: 49 - protein, 10 aa, Homo sapiens
  light chain complementarity determining region 3 for antibody 25
QQSYSTPLFT

SEQ ID NO: 50 - protein, 15 aa, Homo sapiens
  heavy chain complementarity determining region 3 for antibody 25
ARVGRPYHNAWYFDN

SEQ ID NO: 51 - protein, 8 aa, Homo sapiens
  light chain complementarity determining region 3 for antibody 26
QQYKSYWT

SEQ ID NO: 52 - protein, 10 aa, Homo sapiens
  heavy chain complementarity determining region 3 for antibody 26
ARERSGSYDI

SEQ ID NO: 53 - protein, 9 aa, Homo sapiens
  light chain complementarity determining region 3 for antibody 27
LQHNSYPLT

SEQ ID NO: 54 - protein, 10 aa, Homo sapiens
  heavy chain complementarity determining region 3 for antibody 27
CRDRWGFGDV

SEQ ID NO: 55 - protein, 9 aa, Homo sapiens
  light chain complementarity determining region 3 for antibody 28
QQLNSYPYT

SEQ ID NO: 56 - protein, 10 aa, Homo sapiens
  heavy chain complementarity determining region 3 for antibody 28
ARETSGAYDI

SEQ ID NO: 57 - protein, 9 aa, Homo sapiens
  light chain complementarity determining region 3 for antibody 29
MQTVQTPWT

SEQ ID NO: 58 - protein, 12 aa, Homo sapiens
  heavy chain complementarity determining region 3 for antibody 29
ARLDWNYRAFDI

SEQ ID NO: 59 - protein, 9 aa, Homo sapiens
  light chain complementarity determining region 3 for antibody 30
QQYGSSTWT

SEQ ID NO: 60 - protein, 17 aa, Homo sapiens
  heavy chain complementarity determining region 3 for antibody 30
AKGRGSVAMALIYYLDL

SEQ ID NO: 61 - protein, 9 aa, Homo sapiens
  light chain complementarity determining region 3 for antibody 31
HHFGSATGT

SEQ ID NO: 62 - protein, 13 aa, Homo sapiens
  heavy chain complementarity determining region 3 for antibody 31
AKEGSSPGPDFEY

SEQ ID NO: 63 - protein, 9 aa, Homo sapiens
  light chain complementarity determining region 3 for antibody 32
QQSYTMPRT

SEQ ID NO: 64 - protein, 18 aa, Homo sapiens
  heavy chain complementarity determining region 3 for antibody 32
TTVLSQLLAGDWHLYFQH

SEQ ID NO: 65 - protein, 10 aa, Homo sapiens
  light chain complementarity determining region 3 for antibody 33
QQYDISPPWT

SEQ ID NO: 66 - protein, 16 aa, Homo sapiens
  heavy chain complementarity determining region 3 for antibody 33
ASPNTLGRLVGVAFDY

SEQ ID NO: 67 - protein, 10 aa, Homo sapiens
  light chain complementarity determining region 3 for antibody 34
QQSYSTPLFT

SEQ ID NO: 68 - protein, 23 aa, Homo sapiens
  heavy chain complementarity determining region 3 for antibody 34
ARHFPMGGSTVTGTQSLLYYMDV

SEQ ID NO: 69 - protein, 9 aa, Homo sapiens
  light chain complementarity determining region 3 for antibody 35
QQLMVYPYT

SEQ ID NO: 70 - protein, 14 aa, Homo sapiens
  heavy chain complementarity determining region 3 for antibody 35
TRGHFDSTGFRLDY

SEQ ID NO: 71 - protein, 9 aa, Homo sapiens
  light chain complementarity determining region 3 for antibody 36
QQFSSFPRT

SEQ ID NO: 72 - protein, 9 aa, Homo sapiens
  heavy chain complementarity determining region 3 for antibody 36
ARGRNNFRY

SEQ ID NO: 73 - protein, 9 aa, Homo sapiens
  light chain complementarity determining region 3 for antibody 37
MQYAHGPHT

SEQ ID NO: 74 - protein, 8 aa, Homo sapiens
  heavy chain complementarity determining region 3 for antibody 37
AGWGYGNY

SEQ ID NO: 75 - protein, 9 aa, Homo sapiens
  light chain complementarity determining region 3 for antibody 38
AQGSFWPAS

SEQ ID NO: 76 - protein, 10 aa, Homo sapiens
  heavy chain complementarity determining region 3 for antibody 38
CRDREGFGDV

SEQ ID NO: 77 - protein, 9 aa, Homo sapiens
  light chain complementarity determining region 3 for antibody 39
QQYNSYSLT

SEQ ID NO: 78 - protein, 15 aa, Homo sapiens
  heavy chain complementarity determining region 3 for antibody 39
ARSMVSGTTDDAFDI

SEQ ID NO: 79 - protein, 9 aa, Homo sapiens
  light chain complementarity determining region 3 for antibody 40
QVYKSAPHT

SEQ ID NO: 80 - protein, 14 aa, Homo sapiens
  heavy chain complementarity determining region 3 for antibody 40
CRGWLDPATPHYDF

SEQ ID NO: 81 - protein, 9 aa, Homo sapiens
  light chain complementarity determining region 3 for antibody 41
QQYHNWPGT

SEQ ID NO: 82 - protein, 11 aa, Homo sapiens
  heavy chain complementarity determining region 3 for antibody 41
AKGGFYFLTGD

SEQ ID NO: 83 - protein, 9 aa, Homo sapiens
  light chain complementarity determining region 3 for antibody 42
QQYDNLPPA

SEQ ID NO: 84 - protein, 13 aa, Homo sapiens
  heavy chain complementarity determining region 3 for antibody 42
TKEGSSAGPDFVY

SEQ ID NO: 85 - protein, 9 aa, Homo sapiens
  light chain complementarity determining region 3 for antibody 43
MQGTHWPWT

SEQ ID NO: 86 - protein, 16 aa, Homo sapiens
  heavy chain complementarity determining region 3 for antibody 43
ARGHTNPGERRGGSDF

SEQ ID NO: 87 - protein, 9 aa, Homo sapiens
  light chain complementarity determining region 3 for antibody 44
LQYDSYPWT

SEQ ID NO: 88 - protein, 9 aa, Homo sapiens
  heavy chain complementarity determining region 3 for antibody 44
ARGHYGPDY

SEQ ID NO: 89 - protein, 9 aa, Homo sapiens
  light chain complementarity determining region 3 for antibody 45
QQFNSYPRT

SEQ ID NO: 90 - protein, 13 aa, Homo sapiens
  heavy chain complementarity determining region 3 for antibody 45
AADGPYGSSAFDY

SEQ ID NO: 91 - protein, 9 aa, Homo sapiens
  light chain complementarity determining region 3 for antibody 46
QQYNSYPWT

SEQ ID NO: 92 - protein, 11 aa, Homo sapiens
  heavy chain complementarity determining region 3 for antibody 46
ARIVARKPDDY

SEQ ID NO: 93 - protein, 9 aa, Homo sapiens
  light chain complementarity determining region 3 for antibody 47
QQYNSYSHT

SEQ ID NO: 94 - protein, 14 aa, Homo sapiens
  heavy chain complementarity determining region 3 for antibody 47
ARDVHTTGWTLGGY

SEQ ID NO: 95 - protein, 9 aa, Homo sapiens
  light chain complementarity determining region 3 for antibody 48
QQFSDFPRT

SEQ ID NO: 96 - protein, 9 aa, Homo sapiens
  heavy chain complementarity determining region 3 for antibody 48
VRGRNNFRY

SEQ ID NO: 97 - protein, 9 aa, Homo sapiens
  light chain complementarity determining region 3 for antibody 49
QQYGNSPVP

SEQ ID NO: 98 - protein, 18 aa, Homo sapiens
  heavy chain complementarity determining region 3 for antibody 49
ARGDYPEARTGYFLDFDY

SEQ ID NO: 99 - protein, 9 aa, Homo sapiens
  light chain complementarity determining region 3 for antibody 50
HQHGTTPGT

SEQ ID NO: 100 - protein, 18 aa, Homo sapiens
  heavy chain complementarity determining region 3 for antibody 50
ASWAGYCGGDCSSVSLDY

SEQ ID NO: 101 - protein, 10 aa, Homo sapiens
  light chain complementarity determining region 3 for antibody 51
QHYGSSQGIT

SEQ ID NO: 102 - protein, 17 aa, Homo sapiens
  heavy chain complementarity determining region 3 for antibody 51
ARGTGIGSGSYYADFDY

SEQ ID NO: 103 - protein, 7 aa, Homo sapiens
  light chain complementarity determining region 3 for antibody 52
QQYGSYT

SEQ ID NO: 104 - protein, 10 aa, Homo sapiens
  heavy chain complementarity determining region 3 for antibody 52
ARRWERYFDY

SEQ ID NO: 105 - protein, 9 aa, Homo sapiens
  light chain complementarity determining region 3 for antibody 53
QKYKSAPFT

SEQ ID NO: 106 - protein, 13 aa, Homo sapiens
  heavy chain complementarity determining region 3 for antibody 53
AKEGSSPGPDFEY

SEQ ID NO: 107 - protein, 9 aa, Homo sapiens
  light chain complementarity determining region 3 for antibody 54
QQYDNWPWT

SEQ ID NO: 108 - protein, 17 aa, Homo sapiens
  heavy chain complementarity determining region 3 for antibody 54
VTHYYHDSGIYHDFFNY

SEQ ID NO: 109 - protein, 10 aa, Homo sapiens
  light chain complementarity determining region 3 for antibody 55
QQYYSSPPWA

SEQ ID NO: 110 - protein, 16 aa, Homo sapiens
  heavy chain complementarity determining region 3 for antibody 55
ASLNRGDKEFGVPPAL

SEQ ID NO: 111 - protein, 9 aa, Homo sapiens
  light chain complementarity determining region 3 for antibody 56
MQALQTPYT

SEQ ID NO: 112 - protein, 10 aa, Homo sapiens
  heavy chain complementarity determining region 3 for antibody 56
AKDLSGGGGY

SEQ ID NO: 113 - protein, 9 aa, Homo sapiens
  light chain complementarity determining region 3 for antibody 57
LQDHKYPFT

SEQ ID NO: 114 - protein, 16 aa, Homo sapiens
  heavy chain complementarity determining region 3 for antibody 57
AADLGDHTDAYATLDN

SEQ ID NO: 115 - protein, 9 aa, Homo sapiens
  light chain complementarity determining region 3 for antibody 58
QQYNSYPPT

SEQ ID NO: 116 - protein, 13 aa, Homo sapiens
  heavy chain complementarity determining region 3 for antibody 58
AKEGSSPGPDFEY

SEQ ID NO: 117 - protein, 9 aa, Homo sapiens
  light chain complementarity determining region 3 for antibody 59
QQRSNWPIT

SEQ ID NO: 118 - protein, 12 aa, Homo sapiens
  heavy chain complementarity determining region 3 for antibody 59
NADHGYVDGFDI

SEQ ID NO: 119 - protein, 8 aa, Homo sapiens
  light chain complementarity determining region 3 for antibody 60
QHYGGSPT

SEQ ID NO: 120 - protein, 23 aa, Homo sapiens
  heavy chain complementarity determining region 3 for antibody 60
ARHFPKGGSGVTGTQSLLYYMDV

SEQ ID NO: 121 - protein, 9 aa, Homo sapiens
  light chain complementarity determining region 3 for antibody 61
AQGSYWPAS

SEQ ID NO: 122 - protein, 10 aa, Homo sapiens
  heavy chain complementarity determining region 3 for antibody 61
CRDRWGFGDV

SEQ ID NO: 123 - protein, 9 aa, Homo sapiens
  light chain complementarity determining region 3 for antibody 62
QQYGTSPVT

SEQ ID NO: 124 - protein, 13 aa, Homo sapiens
  heavy chain complementarity determining region 3 for antibody 62
AKDRGSGWFAWGY

SEQ ID NO: 125 - protein, 9 aa, Homo sapiens
  light chain complementarity determining region 3 for antibody 63
QQSYSTPRT

SEQ ID NO: 126 - protein, 11 aa, Homo sapiens
  heavy chain complementarity determining region 3 for antibody 63
AREQHGQAPDY

SEQ ID NO: 127 - protein, 6 aa, Homo sapiens
  light chain complementarity determining region 3 for antibody 64
MQSTNW

SEQ ID NO: 128 - protein, 19 aa, Homo sapiens
  heavy chain complementarity determining region 3 for antibody 64
ARERVRCRSGICYDATFDI

SEQ ID NO: 129 - protein, 8 aa, Homo sapiens
  light chain complementarity determining region 3 for antibody 65
QQYGYSHT

SEQ ID NO: 130 - protein, 15 aa, Homo sapiens
  heavy chain complementarity determining region 3 for antibody 65
ARGLLATGGWYYFDY

SEQ ID NO: 131 - protein, 9 aa, Homo sapiens
  light chain complementarity determining region 3 for antibody 66
QQSYSTPRT

SEQ ID NO: 132 - protein, 16 aa, Homo sapiens
  heavy chain complementarity determining region 3 for antibody 66
ARSYDRSNTKVWYFDL

SEQ ID NO: 133 - protein, 9 aa, Homo sapiens
  light chain complementarity determining region 3 for antibody 67
QQYHGYPWT

SEQ ID NO: 134 - protein, 9 aa, Homo sapiens
  heavy chain complementarity determining region 3 for antibody 67
AGWGGLSNY

SEQ ID NO: 135 - protein, 9 aa, Homo sapiens
  light chain complementarity determining region 3 for antibody 68
QQLYRYPIT

SEQ ID NO: 136 - protein, 14 aa, Homo sapiens
  heavy chain complementarity determining region 3 for antibody 68
GRDTTHDWSDGGIY

SEQ ID NO: 137 - protein, 9 aa, Homo sapiens
  light chain complementarity determining region 3 for antibody 69
QQFANLPRT

SEQ ID NO: 138 - protein, 9 aa, Homo sapiens
  heavy chain complementarity determining region 3 for antibody 69
VRGRSNFRY

SEQ ID NO: 139 - protein, 9 aa, Homo sapiens
  light chain complementarity determining region 3 for antibody 70
QQYDNLPLT

SEQ ID NO: 140 - protein, 12 aa, Homo sapiens
  heavy chain complementarity determining region 3 for antibody 70
AIVVPGRWDLDD

SEQ ID NO: 141 - protein, 7 aa, Homo sapiens
  light chain complementarity determining region 3 for antibody 71
QQYNSWT

SEQ ID NO: 142 - protein, 12 aa, Homo sapiens
  heavy chain complementarity determining region 3 for antibody 71
AKDKGGRSGMDV

SEQ ID NO: 143 - protein, 9 aa, Homo sapiens
  light chain complementarity determining region 3 for antibody 72
QQYDNLPYT

SEQ ID NO: 144 - protein, 13 aa, Homo sapiens
  heavy chain complementarity determining region 3 for antibody 72
AKEGSAPGPDFEY

SEQ ID NO: 145 - protein, 9 aa, Homo sapiens
  light chain complementarity determining region 3 for antibody 73
LQYAHWPHT

SEQ ID NO: 146 - protein, 9 aa, Homo sapiens
  heavy chain complementarity determining region 3 for antibody 73
AGWGGTSNY

SEQ ID NO: 147 - protein, 9 aa, Homo sapiens
  light chain complementarity determining region 3 for antibody 74
MQGTHWPPS

SEQ ID NO: 148 - protein, 13 aa, Homo sapiens
  heavy chain complementarity determining region 3 for antibody 74
ARDTVTNKMGSDY

SEQ ID NO: 149 - protein, 9 aa, Homo sapiens
  light chain complementarity determining region 3 for antibody 75
MQGTHWPWT

SEQ ID NO: 150 - protein, 12 aa, Homo sapiens
  heavy chain complementarity determining region 3 for antibody 75
AIVVPGRWDLDD

SEQ ID NO: 151 - protein, 9 aa, Homo sapiens
  light chain complementarity determining region 3 for antibody 76
MQYTHRPHT

SEQ ID NO: 152 - protein, 8 aa, Homo sapiens
  heavy chain complementarity determining region 3 for antibody 76
AGWGYANY

SEQ ID NO: 153 - protein, 9 aa, Homo sapiens
  light chain complementarity determining region 3 for antibody 77
MQATHWPRT

SEQ ID NO: 154 - protein, 12 aa, Homo sapiens
  heavy chain complementarity determining region 3 for antibody 77
STDVETTFPSVS

SEQ ID NO: 155 - protein, 9 aa, Homo sapiens
  light chain complementarity determining region 3 for antibody 78
QQYHGYPWT

SEQ ID NO: 156 - protein, 11 aa, Homo sapiens
  heavy chain complementarity determining region 3 for antibody 78
ARIVARKPDDY

SEQ ID NO: 157 - protein, 10 aa, Homo sapiens
  light chain complementarity determining region 3 for antibody 79
QQYNSYSPRP

SEQ ID NO: 158 - protein, 15 aa, Homo sapiens
  heavy chain complementarity determining region 3 for antibody 79
ARVGRPYHNAWYFDN

SEQ ID NO: 159 - protein, 8 aa, Homo sapiens
  light chain complementarity determining region 3 for antibody 80
QQYDNLLT

SEQ ID NO: 160 - protein, 13 aa, Homo sapiens
  heavy chain complementarity determining region 3 for antibody 80
ARPYGDYGWAFNI

SEQ ID NO: 161 - protein, 9 aa, Homo sapiens
  light chain complementarity determining region 3 for antibody 81
QQYHRYSHT

SEQ ID NO: 162 - protein, 14 aa, Homo sapiens
  heavy chain complementarity determining region 3 for antibody 81
GRDVHTTGWTLGGY

SEQ ID NO: 163 - protein, 9 aa, Homo sapiens
  light chain complementarity determining region 3 for antibody 82
QQLYNYPIT

SEQ ID NO: 164 - protein, 14 aa, Homo sapiens
  heavy chain complementarity determining region 3 for antibody 82
ARDTTYNWNDGGIS

SEQ ID NO: 165 - protein, 9 aa, Homo sapiens
  light chain complementarity determining region 3 for antibody 83
QQYNSYPWT

SEQ ID NO: 166 - protein, 14 aa, Homo sapiens
  heavy chain complementarity determining region 3 for antibody 83
VREEGSGYYRTADY

SEQ ID NO: 167 - protein, 9 aa, Homo sapiens
  light chain complementarity determining region 3 for antibody 84
QQSYSSPRT

SEQ ID NO: 168 - protein, 12 aa, Homo sapiens
  heavy chain complementarity determining region 3 for antibody 84
NADHGYVDGFDI

SEQ ID NO: 169 - protein, 9 aa, Homo sapiens
  light chain complementarity determining region 3 for antibody 85
QQTYSSPWT

SEQ ID NO: 170 - protein, 11 aa, Homo sapiens
  heavy chain complementarity determining region 3 for antibody 85
TRGGYSVGYDY

SEQ ID NO: 171 - protein, 10 aa, Homo sapiens
  light chain complementarity determining region 3 for antibody 86
QQYNFYSTLT

SEQ ID NO: 172 - protein, 16 aa, Homo sapiens
  heavy chain complementarity determining region 3 for antibody 86
GRQVISATKWPNRLDY

SEQ ID NO: 173 - protein, 9 aa, Homo sapiens
  light chain complementarity determining region 3 for antibody 87
QQLMSYPYT

SEQ ID NO: 174 - protein, 17 aa, Homo sapiens
  heavy chain complementarity determining region 3 for antibody 87
ARNTMVHGWQRQGSVDH

SEQ ID NO: 175 - protein, 9 aa, Homo sapiens
  light chain complementarity determining region 3 for antibody 88
QQANSLPLT

SEQ ID NO: 176 - protein, 17 aa, Homo sapiens
  heavy chain complementarity determining region 3 for antibody 88
ARGTGIGSGSYYADFDY

SEQ ID NO: 177 - protein, 9 aa, Homo sapiens
  light chain complementarity determining region 3 for antibody 89
QKYKHVPWT

SEQ ID NO: 178 - protein, 10 aa, Homo sapiens
  heavy chain complementarity determining region 3 for antibody 89
ARERSGSYDI

SEQ ID NO: 179 - protein, 9 aa, Homo sapiens
  light chain complementarity determining region 3 for antibody 90
LQDYNHVGT

SEQ ID NO: 180 - protein, 9 aa, Homo sapiens
  heavy chain complementarity determining region 3 for antibody 90
GSRRPYFDY

SEQ ID NO: 181 - protein, 9 aa, Homo sapiens
  light chain complementarity determining region 3 for antibody 91
QRYNSYSYT

SEQ ID NO: 182 - protein, 10 aa, Homo sapiens
  heavy chain complementarity determining region 3 for antibody 91
ARTRGFLFDY

SEQ ID NO: 183 - protein, 9 aa, Homo sapiens
  light chain complementarity determining region 3 for antibody 92
QEYSTYSRT

SEQ ID NO: 184 - protein, 15 aa, Homo sapiens
  heavy chain complementarity determining region 3 for antibody 92
ARDCISTNCYLIFDN

SEQ ID NO: 185 - protein, 8 aa, Homo sapiens
  light chain complementarity determining region 3 for antibody 93
QQYGYSHT

SEQ ID NO: 186 - protein, 15 aa, Homo sapiens
  heavy chain complementarity determining region 3 for antibody 93
ARGLLAAGGWYYFDY

SEQ ID NO: 187 - protein, 8 aa, Homo sapiens
  light chain complementarity determining region 3 for antibody 94
QEYGDSFP

SEQ ID NO: 188 - protein, 16 aa, Homo sapiens
  heavy chain complementarity determining region 3 for antibody 94
AIWAAVSSGWSGPFDF

SEQ ID NO: 189 - protein, 9 aa, Homo sapiens
  light chain complementarity determining region 3 for antibody 95
QQSYTTPYT

SEQ ID NO: 190 - protein, 13 aa, Homo sapiens
  heavy chain complementarity determining region 3 for antibody 95
AKEGSAPGPDFEY

SEQ ID NO: 191 - protein, 8 aa, Homo sapiens
  light chain complementarity determining region 3 for antibody 96
QQSYSSPT

SEQ ID NO: 192 - protein, 17 aa, Homo sapiens
  heavy chain complementarity determining region 3 for antibody 96
AKGRGSVAMALIYYLDL

SEQ ID NO: 193 - protein, 9 aa, Homo sapiens
  light chain complementarity determining region 3 for antibody 97
QQYNSYSHT

SEQ ID NO: 194 - protein, 14 aa, Homo sapiens
  heavy chain complementarity determining region 3 for antibody 97
GRDVHTTGWTLGGY

SEQ ID NO: 195 - protein, 9 aa, Homo sapiens
  light chain complementarity determining region 3 for antibody 98
QQYGSSPWT

SEQ ID NO: 196 - protein, 10 aa, Homo sapiens
  heavy chain complementarity determining region 3 for antibody 98
ARERSGSYDI

SEQ ID NO: 197 - protein, 9 aa, Homo sapiens
  light chain complementarity determining region 3 for antibody 99
QQYGNPVYT

SEQ ID NO: 198 - protein, 11 aa, Homo sapiens
  heavy chain complementarity determining region 3 for antibody 99
AAVDSWGTLVY

SEQ ID NO: 199 - protein, 9 aa, Homo sapiens
  light chain complementarity determining region 3 for antibody 100
QQSYSTPIT

SEQ ID NO: 200 - protein, 17 aa, Homo sapiens
  heavy chain complementarity determining region 3 for antibody 100
ARNTMVGTWQRQGNLDH

SEQ ID NO: 201 - protein, 9 aa, Homo sapiens
  light chain complementarity determining region 3 for antibody 101
MQTLQTPGT

SEQ ID NO: 202 - protein, 12 aa, Homo sapiens
  heavy chain complementarity determining region 3 for antibody 101
ARLDWNYRAFDI

SEQ ID NO: 203 - protein, 9 aa, Homo sapiens
  light chain complementarity determining region 3 for antibody 102
QQLMSYPYT

SEQ ID NO: 204 - protein, 14 aa, Homo sapiens
  heavy chain complementarity determining region 3 for antibody 102
ARGHFDSTGFRLDY

SEQ ID NO: 205 - protein, 9 aa, Homo sapiens
  light chain complementarity determining region 3 for antibody 103
QQYNNWPFT

SEQ ID NO: 206 - protein, 10 aa, Homo sapiens
  heavy chain complementarity determining region 3 for antibody 103
VRSDSPGDDS

SEQ ID NO: 207 - protein, 8 aa, Homo sapiens
  light chain complementarity determining region 3 for antibody 104
QHYSGFPA

SEQ ID NO: 208 - protein, 15 aa, Homo sapiens
  heavy chain complementarity determining region 3 for antibody 104
GRHVFSGSYPDYCDY

SEQ ID NO: 209 - protein, 9 aa, Homo sapiens
  light chain complementarity determining region 3 for antibody 105
QKYGDSPVP

SEQ ID NO: 210 - protein, 18 aa, Homo sapiens
  heavy chain complementarity determining region 3 for antibody 105
ARGDYPEGRTGYFLDFDY

SEQ ID NO: 211 - protein, 9 aa, Homo sapiens
  light chain complementarity determining region 3 for antibody 106
LQHNNYPLS

SEQ ID NO: 212 - protein, 11 aa, Homo sapiens
  heavy chain complementarity determining region 3 for antibody 106
VRVSTGWYFDY

SEQ ID NO: 213 - protein, 11 aa, Homo sapiens
  light chain complementarity determining region 3 for antibody 107
LQHNSYPPMYT

SEQ ID NO: 214 - protein, 13 aa, Homo sapiens
  heavy chain complementarity determining region 3 for antibody 107
AKEGSSPGPDFEY

SEQ ID NO: 215 - protein, 9 aa, Homo sapiens
  light chain complementarity determining region 3 for antibody 108
LQHNSYPWT

SEQ ID NO: 216 - protein, 17 aa, Homo sapiens
  heavy chain complementarity determining region 3 for antibody 108
ARNTMVGTWQRQGNLDH

SEQ ID NO: 217 - protein, 10 aa, Homo sapiens
  light chain complementarity determining region 3 for antibody 109
QQSYSTPLFT

SEQ ID NO: 218 - protein, 23 aa, Homo sapiens
  heavy chain complementarity determining region 3 for antibody 109
ARHFPKGGSGVTGTQSLLYYMDV

SEQ ID NO: 219 - protein, 9 aa, Homo sapiens
  light chain complementarity determining region 3 for antibody 110
QQLNSFPYT

SEQ ID NO: 220 - protein, 21 aa, Homo sapiens
  heavy chain complementarity determining region 3 for antibody 110
ARGSRTDCRSDDTGCRPMFDS

SEQ ID NO: 221 - protein, 9 aa, Homo sapiens
  light chain complementarity determining region 3 for antibody 111
QQLHSSPYT

SEQ ID NO: 222 - protein, 14 aa, Homo sapiens
  heavy chain complementarity determining region 3 for antibody 111
ARGHFDSTGFRLDY

SEQ ID NO: 223 - protein, 9 aa, Homo sapiens
  light chain complementarity determining region 3 for antibody 112
LQGLQAPFT

SEQ ID NO: 224 - protein, 11 aa, Homo sapiens
  heavy chain complementarity determining region 3 for antibody 112
GRDVDYSTPGF

SEQ ID NO: 225 - protein, 9 aa, Homo sapiens
  light chain complementarity determining region 3 for antibody 113
LQDYKYPFS

SEQ ID NO: 226 - protein, 16 aa, Homo sapiens
  heavy chain complementarity determining region 3 for antibody 113
AADLGDHADAYATLDS

SEQ ID NO: 227 - protein, 10 aa, Homo sapiens
  light chain complementarity determining region 3 for antibody 114
MQGTHWPAWT

SEQ ID NO: 228 - protein, 12 aa, Homo sapiens
  heavy chain complementarity determining region 3 for antibody 114
TTWIKTSVWLDY

SEQ ID NO: 229 - protein, 9 aa, Homo sapiens
  light chain complementarity determining region 3 for antibody 115
QQLNTYPLT

SEQ ID NO: 230 - protein, 13 aa, Homo sapiens
  heavy chain complementarity determining region 3 for antibody 115
TREGDSSGPDFHL

SEQ ID NO: 231 - protein, 7 aa, Homo sapiens
  light chain complementarity determining region 3 for antibody 116
QQYSSWT

SEQ ID NO: 232 - protein, 12 aa, Homo sapiens
  heavy chain complementarity determining region 3 for antibody 116
AIVVPGRWDLDD

SEQ ID NO: 233 - protein, 9 aa, Homo sapiens
  light chain complementarity determining region 3 for antibody 117
HQSANSPRT

SEQ ID NO: 234 - protein, 13 aa, Homo sapiens
  heavy chain complementarity determining region 3 for antibody 117
ARGATATSWNIDY

SEQ ID NO: 235 - protein, 9 aa, Homo sapiens
  light chain complementarity determining region 3 for antibody 118
QQRSNQRFT

SEQ ID NO: 236 - protein, 7 aa, Homo sapiens
  heavy chain complementarity determining region 3 for antibody 118
TTEDGRN

SEQ ID NO: 237 - protein, 8 aa, Homo sapiens
  light chain complementarity determining region 3 for antibody 119
QQSYTKAT

SEQ ID NO: 238 - protein, 12 aa, Homo sapiens
  heavy chain complementarity determining region 3 for antibody 119
AIVVPGRWDLDD

SEQ ID NO: 239 - protein, 9 aa, Homo sapiens
  light chain complementarity determining region 3 for antibody 120
HQYYTSPLT

SEQ ID NO: 240 - protein, 10 aa, Homo sapiens
  heavy chain complementarity determining region 3 for antibody 120
VGGEGWLTDF

SEQ ID NO: 241 - protein, 9 aa, Homo sapiens
  light chain complementarity determining region 3 for antibody 121
QQYATSPLT

SEQ ID NO: 242 - protein, 14 aa, Homo sapiens
  heavy chain complementarity determining region 3 for antibody 121
ARASGGDTDFLIDF

SEQ ID NO: 243 - protein, 9 aa, Homo sapiens
  light chain complementarity determining region 3 for antibody 122
AQGSYWPAS

SEQ ID NO: 244 - protein, 10 aa, Homo sapiens
  heavy chain complementarity determining region 3 for antibody 122
CRDRRGFGDV

SEQ ID NO: 245 - protein, 9 aa, Homo sapiens
  light chain complementarity determining region 3 for antibody 123
MQGTYWPYT

SEQ ID NO: 246 - protein, 11 aa, Homo sapiens
  heavy chain complementarity determining region 3 for antibody 123
AREGWGSLLDY

SEQ ID NO: 247 - protein, 9 aa, Homo sapiens
  light chain complementarity determining region 3 for antibody 124
LQDYSYPLS

SEQ ID NO: 248 - protein, 16 aa, Homo sapiens
  heavy chain complementarity determining region 3 for antibody 124
TADVGDHRDRYVTLDH

SEQ ID NO: 249 - protein, 9 aa, Homo sapiens
  light chain complementarity determining region 3 for antibody 125
QQYASDSYT

SEQ ID NO: 250 - protein, 16 aa, Homo sapiens
  heavy chain complementarity determining region 3 for antibody 125
ARDHCTTIKCPDAFDI

SEQ ID NO: 251 - protein, 9 aa, Homo sapiens
  light chain complementarity determining region 3 for antibody 126
LQDHKYPFT

SEQ ID NO: 252 - protein, 13 aa, Homo sapiens
  heavy chain complementarity determining region 3 for antibody 126
AGEGPAPGPDFDY

SEQ ID NO: 253 - protein, 9 aa, Homo sapiens
  light chain complementarity determining region 3 for antibody 127
LQDYNHSAV

SEQ ID NO: 254 - protein, 12 aa, Homo sapiens
  heavy chain complementarity determining region 3 for antibody 127
ARGHITGYKGDY

SEQ ID NO: 255 - protein, 9 aa, Homo sapiens
  light chain complementarity determining region 3 for antibody 128
QQLNSDPYT

SEQ ID NO: 256 - protein, 14 aa, Homo sapiens
  heavy chain complementarity determining region 3 for antibody 128
ARGHFDSTGFRLDY

SEQ ID NO: 257 - protein, 9 aa, Homo sapiens
  light chain complementarity determining region 3 for antibody 129
MQATHWPWT

SEQ ID NO: 258 - protein, 12 aa, Homo sapiens
  heavy chain complementarity determining region 3 for antibody 129
ARGPLKMAGGSS

SEQ ID NO: 259 - protein, 11 aa, Homo sapiens
  light chain complementarity determining region 3 for antibody 130
QQYGSSPPMYT

SEQ ID NO: 260 - protein, 13 aa, Homo sapiens
  heavy chain complementarity determining region 3 for antibody 130
AKEGSAPGPDFEY

SEQ ID NO: 261 - protein, 11 aa, Homo sapiens
  light chain complementarity determining region 3 for antibody 131
QQYGGSPPEGT

SEQ ID NO: 262 - protein, 18 aa, Homo sapiens
  heavy chain complementarity determining region 3 for antibody 131
AKDNRWYCSTTNCYLFDS

SEQ ID NO: 263 - protein, 8 aa, Homo sapiens
  light chain complementarity determining region 3 for antibody 132
MQGTHWPA

SEQ ID NO: 264 - protein, 12 aa, Homo sapiens
  heavy chain complementarity determining region 3 for antibody 132
AIVVPGRWDLDD

SEQ ID NO: 265 - protein, 9 aa, Homo sapiens
  light chain complementarity determining region 3 for antibody 133
MQGTHWPIT

SEQ ID NO: 266 - protein, 17 aa, Homo sapiens
  heavy chain complementarity determining region 3 for antibody 133
ARNTMVGTWQRQGNLDH

SEQ ID NO: 267 - protein, 9 aa, Homo sapiens
  light chain complementarity determining region 3 for antibody 134
QQYGGSLLT

SEQ ID NO: 268 - protein, 10 aa, Homo sapiens
  heavy chain complementarity determining region 3 for antibody 134
CRDRWGFGDV

SEQ ID NO: 269 - protein, 9 aa, Homo sapiens
  light chain complementarity determining region 3 for antibody 135
LQDYTYPFS

SEQ ID NO: 270 - protein, 16 aa, Homo sapiens
  heavy chain complementarity determining region 3 for antibody 135
ATDVGDHSDRFTTLDY

SEQ ID NO: 271 - protein, 9 aa, Homo sapiens
  light chain complementarity determining region 3 for antibody 136
QQYKIYPWT

SEQ ID NO: 272 - protein, 13 aa, Homo sapiens
  heavy chain complementarity determining region 3 for antibody 136
AKEGSSPGPDFDY

SEQ ID NO: 273 - protein, 9 aa, Homo sapiens
  light chain complementarity determining region 3 for antibody 137
QQLHSYPYT

SEQ ID NO: 274 - protein, 14 aa, Homo sapiens
  heavy chain complementarity determining region 3 for antibody 137
ARGHFDSTGFRLDY

SEQ ID NO: 275 - protein, 9 aa, Homo sapiens
  light chain complementarity determining region 3 for antibody 138
QVYGTSRGT

SEQ ID NO: 276 - protein, 15 aa, Homo sapiens
  heavy chain complementarity determining region 3 for antibody 138
AKPRSNMFAHDAFDI

SEQ ID NO: 277 - protein, 9 aa, Homo sapiens
  light chain complementarity determining region 3 for antibody 139
QQYSVSPIT

SEQ ID NO: 278 - protein, 8 aa, Homo sapiens
  heavy chain complementarity determining region 3 for antibody 139
ARRNDFDY

SEQ ID NO: 279 - protein, 9 aa, Homo sapiens
  light chain complementarity determining region 3 for antibody 140
QEYKTVPWT

SEQ ID NO: 280 - protein, 20 aa, Homo sapiens
  heavy chain complementarity determining region 3 for antibody 140
AKDGRGTANYHSAGGGGLDV

SEQ ID NO: 281 - protein, 9 aa, Homo sapiens
  light chain complementarity determining region 3 for antibody 141
LQGTYWPKT

SEQ ID NO: 282 - protein, 10 aa, Homo sapiens
  heavy chain complementarity determining region 3 for antibody 141
ARDFREGEVY

SEQ ID NO: 283 - protein, 9 aa, Homo sapiens
  light chain complementarity determining region 3 for antibody 142
QQYGSSALT

SEQ ID NO: 284 - protein, 16 aa, Homo sapiens
  heavy chain complementarity determining region 3 for antibody 142
ARHGVLPAAIHDAFDI

SEQ ID NO: 285 - protein, 8 aa, Homo sapiens
  light chain complementarity determining region 3 for antibody 143
QQSYTTPT

SEQ ID NO: 286 - protein, 12 aa, Homo sapiens
  heavy chain complementarity determining region 3 for antibody 143
ARLDWNYRAFDI

SEQ ID NO: 287 - protein, 9 aa, Homo sapiens
  light chain complementarity determining region 3 for antibody 144
QQTYRTPYT

SEQ ID NO: 288 - protein, 10 aa, Homo sapiens
  heavy chain complementarity determining region 3 for antibody 144
AHRINRAFDI

SEQ ID NO: 289 - protein, 10 aa, Homo sapiens
  light chain complementarity determining region 3 for antibody 145
QQLNGYAPNT

SEQ ID NO: 290 - protein, 18 aa, Homo sapiens
  heavy chain complementarity determining region 3 for antibody 145
ATPAARASCYSDGCYFDF

SEQ ID NO: 291 - protein, 9 aa, Homo sapiens
  light chain complementarity determining region 3 for antibody 146
QQYYNIPFT

SEQ ID NO: 292 - protein, 14 aa, Homo sapiens
  heavy chain complementarity determining region 3 for antibody 146
AKGRIASCYDASDI

SEQ ID NO: 293 - protein, 9 aa, Homo sapiens
  light chain complementarity determining region 3 for antibody 147
MQGTHWPNT

SEQ ID NO: 294 - protein, 11 aa, Homo sapiens
  heavy chain complementarity determining region 3 for antibody 147
ARGDGWYGLDY

SEQ ID NO: 295 - protein, 9 aa, Homo sapiens
  light chain complementarity determining region 3 for antibody 148
QQYKTAPWT

SEQ ID NO: 296 - protein, 20 aa, Homo sapiens
  heavy chain complementarity determining region 3 for antibody 148
TRDARGSISYAYGGGGGLDV

SEQ ID NO: 297 - protein, 9 aa, Homo sapiens
  light chain complementarity determining region 3 for antibody 149
QQYYSSPFT

SEQ ID NO: 298 - protein, 14 aa, Homo sapiens
  heavy chain complementarity determining region 3 for antibody 149
AASYSSGWLEYFQY

SEQ ID NO: 299 - protein, 9 aa, Homo sapiens
  light chain complementarity determining region 3 for antibody 150
MQGTHWPIN

SEQ ID NO: 300 - protein, 13 aa, Homo sapiens
  heavy chain complementarity determining region 3 for antibody 150
AKEGSSAGPDFDY

SEQ ID NO: 301 - protein, 9 aa, Homo sapiens
  light chain complementarity determining region 3 for antibody 151
LQDHNYPFS

SEQ ID NO: 302 - protein, 16 aa, Homo sapiens
  heavy chain complementarity determining region 3 for antibody 151
AADLDDHTDAYATLDS

SEQ ID NO: 303 - protein, 9 aa, Homo sapiens
  light chain complementarity determining region 3 for antibody 152
LQFYTAPWA

SEQ ID NO: 304 - protein, 17 aa, Homo sapiens
  heavy chain complementarity determining region 3 for antibody 152
TRDGRIIWPGSQGSLDS

SEQ ID NO: 305 - protein, 9 aa, Homo sapiens
  light chain complementarity determining region 3 for antibody 153
QQYLTYPLT

SEQ ID NO: 306 - protein, 18 aa, Homo sapiens
  heavy chain complementarity determining region 3 for antibody 153
ARGSYCDSSSWCPYGFDI

SEQ ID NO: 307 - protein, 9 aa, Homo sapiens
  light chain complementarity determining region 3 for antibody 154
MQATHWPWT

SEQ ID NO: 308 - protein, 14 aa, Homo sapiens
  heavy chain complementarity determining region 3 for antibody 154
VRDYCSGGTCYSGS

SEQ ID NO: 309 - protein, 9 aa, Homo sapiens
  light chain complementarity determining region 3 for antibody 155
QQYNYYPLT

SEQ ID NO: 310 - protein, 15 aa, Homo sapiens
  heavy chain complementarity determining region 3 for antibody 155
ARGDYGDYKGVPFDY

SEQ ID NO: 311 - protein, 7 aa, Homo sapiens
  light chain complementarity determining region 3 for antibody 156
QQYNTWT

SEQ ID NO: 312 - protein, 12 aa, Homo sapiens
  heavy chain complementarity determining region 3 for antibody 156
SRDKGGRNGMDV

SEQ ID NO: 313 - protein, 9 aa, Homo sapiens
  light chain complementarity determining region 3 for antibody 157
HQYGSLPLT

SEQ ID NO: 314 - protein, 13 aa, Homo sapiens
  heavy chain complementarity determining region 3 for antibody 157
AKDRASGWYAWGY

SEQ ID NO: 315 - protein, 10 aa, Homo sapiens
  light chain complementarity determining region 3 for antibody 158
QQYDYSPPWT

SEQ ID NO: 316 - protein, 14 aa, Homo sapiens
  heavy chain complementarity determining region 3 for antibody 158
SHPTKAARLPIFDY

SEQ ID NO: 317 - protein, 9 aa, Homo sapiens
  light chain complementarity determining region 3 for antibody 159
QQYDHYAHT

SEQ ID NO: 318 - protein, 14 aa, Homo sapiens
  heavy chain complementarity determining region 3 for antibody 159
ARDVHTTGWTLGGY

SEQ ID NO: 319 - protein, 9 aa, Homo sapiens
  light chain complementarity determining region 3 for antibody 160
AQGSYWPAS

SEQ ID NO: 320 - protein, 10 aa, Homo sapiens
  heavy chain complementarity determining region 3 for antibody 160
CRDHEGFGDV

SEQ ID NO: 321 - protein, 10 aa, Homo sapiens
  light chain complementarity determining region 3 for antibody 161
QQYDYSPPWT

SEQ ID NO: 322 - protein, 14 aa, Homo sapiens
  heavy chain complementarity determining region 3 for antibody 161
SHPTRAARLPIFDY

SEQ ID NO: 323 - protein, 9 aa, Homo sapiens
  light chain complementarity determining region 3 for antibody 162
QQRGSWPPT

SEQ ID NO: 324 - protein, 14 aa, Homo sapiens
  heavy chain complementarity determining region 3 for antibody 162
AKGMTTWYLMVVDY

SEQ ID NO: 325 - protein, 9 aa, Homo sapiens
  light chain complementarity determining region 3 for antibody 163
MQGTHWPRT

SEQ ID NO: 326 - protein, 10 aa, Homo sapiens
  heavy chain complementarity determining region 3 for antibody 163
VRDYWNSIDY

SEQ ID NO: 327 - protein, 9 aa, Homo sapiens
  light chain complementarity determining region 3 for antibody 164
QQYDRYAHT

SEQ ID NO: 328 - protein, 14 aa, Homo sapiens
  heavy chain complementarity determining region 3 for antibody 164
ARDVHTTGWTLGGY

SEQ ID NO: 329 - protein, 9 aa, Homo sapiens
  light chain complementarity determining region 3 for antibody 165
QQYGDSPVP

SEQ ID NO: 330 - protein, 18 aa, Homo sapiens
  heavy chain complementarity determining region 3 for antibody 165
ARGDYPEARTGYFLDFDY

SEQ ID NO: 331 - protein, 10 aa, Homo sapiens
  light chain complementarity determining region 3 for antibody 166
QQYGRSPLYT

SEQ ID NO: 332 - protein, 13 aa, Homo sapiens
  heavy chain complementarity determining region 3 for antibody 166
TTYMAARPEYFRH

SEQ ID NO: 333 - protein, 9 aa, Homo sapiens
  light chain complementarity determining region 3 for antibody 167
QQRSNWPRT

SEQ ID NO: 334 - protein, 12 aa, Homo sapiens
  heavy chain complementarity determining region 3 for antibody 167
TRDTIQATILGC

SEQ ID NO: 335 - protein, 9 aa, Homo sapiens
  light chain complementarity determining region 3 for antibody 168
QQSYSTPLT

SEQ ID NO: 336 - protein, 13 aa, Homo sapiens
  heavy chain complementarity determining region 3 for antibody 168
AKEGSSAGPDFDY

SEQ ID NO: 337 - protein, 7 aa, Homo sapiens
  light chain complementarity determining region 3 for antibody 169
QCNRNWA

SEQ ID NO: 338 - protein, 20 aa, Homo sapiens
  heavy chain complementarity determining region 3 for antibody 169
STYLPGDCTCTGCFYWYSDF

SEQ ID NO: 339 - protein, 9 aa, Homo sapiens
  light chain complementarity determining region 3 for antibody 170
QQSYTTPRT

SEQ ID NO: 340 - protein, 16 aa, Homo sapiens
  heavy chain complementarity determining region 3 for antibody 170
AREFPYSSTSVWYFDV

SEQ ID NO: 341 - protein, 10 aa, Homo sapiens
  light chain complementarity determining region 3 for antibody 171
QQYGSSPPIT

SEQ ID NO: 342 - protein, 11 aa, Homo sapiens
  heavy chain complementarity determining region 3 for antibody 171
AREQHGQAPDY

SEQ ID NO: 343 - protein, 9 aa, Homo sapiens
  light chain complementarity determining region 3 for antibody 172
QQRGYWPPT

SEQ ID NO: 344 - protein, 14 aa, Homo sapiens
  heavy chain complementarity determining region 3 for antibody 172
AKHTHNWYLGVLDC

SEQ ID NO: 345 - protein, 9 aa, Homo sapiens
  light chain complementarity determining region 3 for antibody 173
QQYNSYPWT

SEQ ID NO: 346 - protein, 14 aa, Homo sapiens
  heavy chain complementarity determining region 3 for antibody 173
ATGGGSGFEGAFDV

SEQ ID NO: 347 - protein, 11 aa, Homo sapiens
  light chain complementarity determining region 3 for antibody 174
QQSYSTPPRLT

SEQ ID NO: 348 - protein, 13 aa, Homo sapiens
  heavy chain complementarity determining region 3 for antibody 174
TKEGSSAGPDFVY

SEQ ID NO: 349 - protein, 9 aa, Homo sapiens
  light chain complementarity determining region 3 for antibody 175
MQGTHWPHT

SEQ ID NO: 350 - protein, 11 aa, Homo sapiens
  heavy chain complementarity determining region 3 for antibody 175
ATFGISWYFSG

SEQ ID NO: 351 - protein, 10 aa, Homo sapiens
  light chain complementarity determining region 3 for antibody 176
QQHNNWPTIT

SEQ ID NO: 352 - protein, 13 aa, Homo sapiens
  heavy chain complementarity determining region 3 for antibody 176
AKPHYYGSGSGDY

SEQ ID NO: 353 - protein, 9 aa, Homo sapiens
  light chain complementarity determining region 3 for antibody 177
LQDHKYPFT

SEQ ID NO: 354 - protein, 16 aa, Homo sapiens
  heavy chain complementarity determining region 3 for antibody 177
AADLGDHSDVYATLDS

SEQ ID NO: 355 - protein, 9 aa, Homo sapiens
  light chain complementarity determining region 3 for antibody 178
QQYGTTPLT

SEQ ID NO: 356 - protein, 6 aa, Homo sapiens
  heavy chain complementarity determining region 3 for antibody 178
TTGYHA

SEQ ID NO: 357 - protein, 9 aa, Homo sapiens
  light chain complementarity determining region 3 for antibody 179
QQRGSWPPT

SEQ ID NO: 358 - protein, 14 aa, Homo sapiens
  heavy chain complementarity determining region 3 for antibody 179
AKHTHNWYLGVLDC

SEQ ID NO: 359 - protein, 10 aa, Homo sapiens
  light chain complementarity determining region 3 for antibody 180
QQFGGSPMYT

SEQ ID NO: 360 - protein, 13 aa, Homo sapiens
  heavy chain complementarity determining region 3 for antibody 180
TADFYDYVWGPRY

SEQ ID NO: 361 - protein, 12 aa, Homo sapiens
  light chain complementarity determining region 3 for antibody 181
QHYGEGGSPPIT

SEQ ID NO: 362 - protein, 17 aa, Homo sapiens
  heavy chain complementarity determining region 3 for antibody 181
ARNTMVHGWQRQGSVDH

SEQ ID NO: 363 - protein, 10 aa, Homo sapiens
  light chain complementarity determining region 3 for antibody 182
QQYNSYSGYT

SEQ ID NO: 364 - protein, 12 aa, Homo sapiens
  heavy chain complementarity determining region 3 for antibody 182
AIVVPGRWDLDD

SEQ ID NO: 365 - protein, 8 aa, Homo sapiens
  light chain complementarity determining region 3 for antibody 183
QQYGNSFP

SEQ ID NO: 366 - protein, 16 aa, Homo sapiens
  heavy chain complementarity determining region 3 for antibody 183
AIWAAVSSGWSGPFDF

SEQ ID NO: 367 - protein, 9 aa, Homo sapiens
  light chain complementarity determining region 3 for antibody 184
MQALHLPLT

SEQ ID NO: 368 - protein, 15 aa, Homo sapiens
  heavy chain complementarity determining region 3 for antibody 184
VRDPAGLAYFYNMEV

SEQ ID NO: 369 - protein, 9 aa, Homo sapiens
  light chain complementarity determining region 3 for antibody 185
QKYYTVPLT

SEQ ID NO: 370 - protein, 10 aa, Homo sapiens
  heavy chain complementarity determining region 3 for antibody 185
VGGEGWLTDF

SEQ ID NO: 371 - protein, 9 aa, Homo sapiens
  light chain complementarity determining region 3 for antibody 186
QQYGSSTWT

SEQ ID NO: 372 - protein, 15 aa, Homo sapiens
  heavy chain complementarity determining region 3 for antibody 186
ARELPQRKYSDGWDH

SEQ ID NO: 373 - protein, 8 aa, Homo sapiens
  light chain complementarity determining region 3 for antibody 187
QHYGGSPT

SEQ ID NO: 374 - protein, 14 aa, Homo sapiens
  heavy chain complementarity determining region 3 for antibody 187
SHPTRAARLPIFDY

SEQ ID NO: 375 - protein, 8 aa, Homo sapiens
  light chain complementarity determining region 3 for antibody 188
QQYDLSLT

SEQ ID NO: 376 - protein, 14 aa, Homo sapiens
  heavy chain complementarity determining region 3 for antibody 188
ARGTIGDYTDYFPY

SEQ ID NO: 377 - protein, 8 aa, Homo sapiens
  light chain complementarity determining region 3 for antibody 189
QQYDNART

SEQ ID NO: 378 - protein, 9 aa, Homo sapiens
  heavy chain complementarity determining region 3 for antibody 189
ARSEYQPTY

SEQ ID NO: 379 - protein, 9 aa, Homo sapiens
  light chain complementarity determining region 3 for antibody 190
LQHDSSPYT

SEQ ID NO: 380 - protein, 16 aa, Homo sapiens
  heavy chain complementarity determining region 3 for antibody 190
TSDFRYGSSIWYWGAV

SEQ ID NO: 381 - protein, 9 aa, Homo sapiens
  light chain complementarity determining region 3 for antibody 191
LQHNSYPWT

SEQ ID NO: 382 - protein, 18 aa, Homo sapiens
  heavy chain complementarity determining region 3 for antibody 191
VRGPSGAPGAMAYYYLDV

SEQ ID NO: 383 - protein, 9 aa, Homo sapiens
  light chain complementarity determining region 3 for antibody 192
LQYNTYPWT

SEQ ID NO: 384 - protein, 9 aa, Homo sapiens
  heavy chain complementarity determining region 3 for antibody 192
GRGHYGPDY

SEQ ID NO: 385 - protein, 10 aa, Homo sapiens
  light chain complementarity determining region 3 for antibody 193
FQGSHWPPFT

SEQ ID NO: 386 - protein, 9 aa, Homo sapiens
  heavy chain complementarity determining region 3 for antibody 193
VRNNYHMDV

SEQ ID NO: 387 - protein, 9 aa, Homo sapiens
  light chain complementarity determining region 3 for antibody 194
QQRGSWPPT

SEQ ID NO: 388 - protein, 14 aa, Homo sapiens
  heavy chain complementarity determining region 3 for antibody 194
AKGMTSWYLMVVDY

SEQ ID NO: 389 - protein, 9 aa, Homo sapiens
  light chain complementarity determining region 3 for antibody 195
QQLHSYPYT

SEQ ID NO: 390 - protein, 14 aa, Homo sapiens
  heavy chain complementarity determining region 3 for antibody 195
ARGHFDTTGFRLDY

SEQ ID NO: 391 - protein, 9 aa, Homo sapiens
  light chain complementarity determining region 3 for antibody 196
QQSYTTPYT

SEQ ID NO: 392 - protein, 16 aa, Homo sapiens
  heavy chain complementarity determining region 3 for antibody 196
AKSLNIEVSHSGPFDF

SEQ ID NO: 393 - protein, 9 aa, Homo sapiens
  light chain complementarity determining region 3 for antibody 197
QQYGYSPLT

SEQ ID NO: 394 - protein, 18 aa, Homo sapiens
  heavy chain complementarity determining region 3 for antibody 197
ARGDYPEARSDYYLDFDY

SEQ ID NO: 395 - protein, 9 aa, Homo sapiens
  light chain complementarity determining region 3 for antibody 198
QQLHISPYT

SEQ ID NO: 396 - protein, 14 aa, Homo sapiens
  heavy chain complementarity determining region 3 for antibody 198
ARGHFDSTGFRLDY

SEQ ID NO: 397 - protein, 9 aa, Homo sapiens
  light chain complementarity determining region 3 for antibody 199
QHYKGYPIT

SEQ ID NO: 398 - protein, 8 aa, Homo sapiens
  heavy chain complementarity determining region 3 for antibody 199
TGGRYWDV

SEQ ID NO: 399 - protein, 10 aa, Homo sapiens
  light chain complementarity determining region 3 for antibody 200
QQYGSSPPYT

SEQ ID NO: 400 - protein, 13 aa, Homo sapiens
  heavy chain complementarity determining region 3 for antibody 200
AKEGSSPGPDFEY

SEQ ID NO: 401 - protein, 9 aa, Homo sapiens
  light chain complementarity determining region 3 for antibody 201
QQYAKAPLT

SEQ ID NO: 402 - protein, 9 aa, Homo sapiens
  heavy chain complementarity determining region 3 for antibody 201
VRADWLHDY

SEQ ID NO: 403 - protein, 8 aa, Homo sapiens
  light chain complementarity determining region 3 for antibody 202
MQALHRLT

SEQ ID NO: 404 - protein, 8 aa, Homo sapiens
  heavy chain complementarity determining region 3 for antibody 202
VSQTGQNY

SEQ ID NO: 405 - protein, 9 aa, Homo sapiens
  light chain complementarity determining region 3 for antibody 203
HQYYTSPLT

SEQ ID NO: 406 - protein, 10 aa, Homo sapiens
  heavy chain complementarity determining region 3 for antibody 203
AAGSGWLIEY

SEQ ID NO: 407 - protein, 9 aa, Homo sapiens
  light chain complementarity determining region 3 for antibody 204
LQFYTAPWA

SEQ ID NO: 408 - protein, 17 aa, Homo sapiens
  heavy chain complementarity determining region 3 for antibody 204
SRDGRIIWPGSQGSLDS

SEQ ID NO: 409 - protein, 10 aa, Homo sapiens
  light chain complementarity determining region 3 for antibody 205
QQRSNWPPYT

SEQ ID NO: 410 - protein, 12 aa, Homo sapiens
  heavy chain complementarity determining region 3 for antibody 205
TREYSSGWYPGY

SEQ ID NO: 411 - protein, 9 aa, Homo sapiens
  light chain complementarity determining region 3 for antibody 206
QHSYNTPRT

SEQ ID NO: 412 - protein, 17 aa, Homo sapiens
  heavy chain complementarity determining region 3 for antibody 206
ARNTMVHGWQRQGSVDH

SEQ ID NO: 413 - protein, 11 aa, Homo sapiens
  light chain complementarity determining region 3 for antibody 207
AQYGSSSGSGT

SEQ ID NO: 414 - protein, 10 aa, Homo sapiens
  heavy chain complementarity determining region 3 for antibody 207
ARATYWAYDS

SEQ ID NO: 415 - protein, 9 aa, Homo sapiens
  light chain complementarity determining region 3 for antibody 208
QQYGNTPFT

SEQ ID NO: 416 - protein, 12 aa, Homo sapiens
  heavy chain complementarity determining region 3 for antibody 208
NADHGYVDGFDI

SEQ ID NO: 417 - protein, 9 aa, Homo sapiens
  light chain complementarity determining region 3 for antibody 209
LQYYTAPWA

SEQ ID NO: 418 - protein, 17 aa, Homo sapiens
  heavy chain complementarity determining region 3 for antibody 209
SRDGRTVWPGSQGTLDS

SEQ ID NO: 419 - protein, 9 aa, Homo sapiens
  light chain complementarity determining region 3 for antibody 210
QQYSTYPWT

SEQ ID NO: 420 - protein, 10 aa, Homo sapiens
  heavy chain complementarity determining region 3 for antibody 210
AHRINRAFDI

SEQ ID NO: 421 - protein, 9 aa, Homo sapiens
  light chain complementarity determining region 3 for antibody 211
QQLHSDPYT

SEQ ID NO: 422 - protein, 14 aa, Homo sapiens
  heavy chain complementarity determining region 3 for antibody 211
ARGHFDSTGFRLDY

SEQ ID NO: 423 - protein, 7 aa, Homo sapiens
  light chain complementarity determining region 3 for antibody 212
QCNRNWA

SEQ ID NO: 424 - protein, 20 aa, Homo sapiens
  heavy chain complementarity determining region 3 for antibody 212
STYLPGDCTCTACFYWYSDF

SEQ ID NO: 425 - protein, 9 aa, Homo sapiens
  light chain complementarity determining region 3 for antibody 213
LQDHIYPFS

SEQ ID NO: 426 - protein, 16 aa, Homo sapiens
  heavy chain complementarity determining region 3 for antibody 213
AADLDDHSDAFATLDD

SEQ ID NO: 427 - protein, 7 aa, Homo sapiens
  light chain complementarity determining region 3 for antibody 214
QYRSNWG

SEQ ID NO: 428 - protein, 13 aa, Homo sapiens
  heavy chain complementarity determining region 3 for antibody 214
AKDRGSGWYAWGY

SEQ ID NO: 429 - protein, 10 aa, Homo sapiens
  light chain complementarity determining region 3 for antibody 215
QQYGGSPPFT

SEQ ID NO: 430 - protein, 14 aa, Homo sapiens
  heavy chain complementarity determining region 3 for antibody 215
AKTTLITTAWGMDV

SEQ ID NO: 431 - protein, 9 aa, Homo sapiens
  light chain complementarity determining region 3 for antibody 216
LQTIHWPWT

SEQ ID NO: 432 - protein, 10 aa, Homo sapiens
  heavy chain complementarity determining region 3 for antibody 216
TRLPSRASDF

SEQ ID NO: 433 - protein, 9 aa, Homo sapiens
  light chain complementarity determining region 3 for antibody 217
QQYGTLPGT

SEQ ID NO: 434 - protein, 10 aa, Homo sapiens
  heavy chain complementarity determining region 3 for antibody 217
ARAALWSYDY

SEQ ID NO: 435 - protein, 7 aa, Homo sapiens
  light chain complementarity determining region 3 for antibody 218
QQYSSWT

SEQ ID NO: 436 - protein, 12 aa, Homo sapiens
  heavy chain complementarity determining region 3 for antibody 218
AKDRGGRSGMDV

SEQ ID NO: 437 - protein, 9 aa, Homo sapiens
  light chain complementarity determining region 3 for antibody 219
QQYGSSPDT

SEQ ID NO: 438 - protein, 17 aa, Homo sapiens
  heavy chain complementarity determining region 3 for antibody 219
ARNTMVGTWQRQGNLDH

SEQ ID NO: 439 - protein, 7 aa, Homo sapiens
  light chain complementarity determining region 3 for antibody 220
QQYKSWT

SEQ ID NO: 440 - protein, 12 aa, Homo sapiens
  heavy chain complementarity determining region 3 for antibody 220
VKDRGGRSGMDV

SEQ ID NO: 441 - protein, 9 aa, Homo sapiens
  light chain complementarity determining region 3 for antibody 221
QKYGSAPVP

SEQ ID NO: 442 - protein, 18 aa, Homo sapiens
  heavy chain complementarity determining region 3 for antibody 221
ARGDYPEARTGYFLDFDY

SEQ ID NO: 443 - protein, 9 aa, Homo sapiens
  light chain complementarity determining region 3 for antibody 222
MQNTHWPWT

SEQ ID NO: 444 - protein, 16 aa, Homo sapiens
  heavy chain complementarity determining region 3 for antibody 222
ARGHTFPGERRGGSDF

SEQ ID NO: 445 - protein, 9 aa, Homo sapiens
  light chain complementarity determining region 3 for antibody 223
QQYDNSLRT

SEQ ID NO: 446 - protein, 14 aa, Homo sapiens
  heavy chain complementarity determining region 3 for antibody 223
AREGVLIRQPYRDY

SEQ ID NO: 447 - protein, 10 aa, Homo sapiens
  light chain complementarity determining region 3 for antibody 224
QQCGNWPQCT

SEQ ID NO: 448 - protein, 12 aa, Homo sapiens
  heavy chain complementarity determining region 3 for antibody 224
AKPAYGSGSPDY

SEQ ID NO: 449 - protein, 9 aa, Homo sapiens
  light chain complementarity determining region 3 for antibody 225
QQYGNSRWT

SEQ ID NO: 450 - protein, 10 aa, Homo sapiens
  heavy chain complementarity determining region 3 for antibody 225
TTEDWGSGRS

SEQ ID NO: 451 - protein, 9 aa, Homo sapiens
  light chain complementarity determining region 3 for antibody 226
QQYKDAPWT

SEQ ID NO: 452 - protein, 20 aa, Homo sapiens
  heavy chain complementarity determining region 3 for antibody 226
TRDARGSSSYAYGGGGGLDV

SEQ ID NO: 453 - protein, 9 aa, Homo sapiens
  light chain complementarity determining region 3 for antibody 227
QKYYSVPLT

SEQ ID NO: 454 - protein, 12 aa, Homo sapiens
  heavy chain complementarity determining region 3 for antibody 227
SRDKGGRNGMDV

SEQ ID NO: 455 - protein, 10 aa, Homo sapiens
  light chain complementarity determining region 3 for antibody 228
QQYDNWPPWR

SEQ ID NO: 456 - protein, 15 aa, Homo sapiens
  heavy chain complementarity determining region 3 for antibody 228
ARDIRVGASKYYFDY

SEQ ID NO: 457 - protein, 9 aa, Homo sapiens
  light chain complementarity determining region 3 for antibody 229
QQSHSTPHT

SEQ ID NO: 458 - protein, 12 aa, Homo sapiens
  heavy chain complementarity determining region 3 for antibody 229
AIVVPGRWDLDD

SEQ ID NO: 459 - protein, 9 aa, Homo sapiens
  light chain complementarity determining region 3 for antibody 230
QQSYSTPWT

SEQ ID NO: 460 - protein, 11 aa, Homo sapiens
  heavy chain complementarity determining region 3 for antibody 230
ATNSRGQGYEY

SEQ ID NO: 461 - protein, 10 aa, Homo sapiens
  light chain complementarity determining region 3 for antibody 231
QQYGSSPPVT

SEQ ID NO: 462 - protein, 19 aa, Homo sapiens
  heavy chain complementarity determining region 3 for antibody 231
AREAVRCRDGVCYNATFDI

SEQ ID NO: 463 - protein, 8 aa, Homo sapiens
  light chain complementarity determining region 3 for antibody 232
QQSYSTPT

SEQ ID NO: 464 - protein, 12 aa, Homo sapiens
  heavy chain complementarity determining region 3 for antibody 232
ARDKGGRNGMDV

SEQ ID NO: 465 - protein, 9 aa, Homo sapiens
  light chain complementarity determining region 3 for antibody 233
LQHYTAPWT

SEQ ID NO: 466 - protein, 17 aa, Homo sapiens
  heavy chain complementarity determining region 3 for antibody 233
SRDGRIIWPGSQGSLDS

SEQ ID NO: 467 - protein, 9 aa, Homo sapiens
  light chain complementarity determining region 3 for antibody 234
LQHRSYPWT

SEQ ID NO: 468 - protein, 18 aa, Homo sapiens
  heavy chain complementarity determining region 3 for antibody 234
VRGPSGAPGAMAYYYLDV

SEQ ID NO: 469 - protein, 8 aa, Homo sapiens
  light chain complementarity determining region 3 for antibody 235
QQYSSSYT

SEQ ID NO: 470 - protein, 9 aa, Homo sapiens
  heavy chain complementarity determining region 3 for antibody 235
ARGLHLPYD

SEQ ID NO: 471 - protein, 9 aa, Homo sapiens
  light chain complementarity determining region 3 for antibody 236
HQCGTSPKT

SEQ ID NO: 472 - protein, 13 aa, Homo sapiens
  heavy chain complementarity determining region 3 for antibody 236
ARDGSSDWYELAY

SEQ ID NO: 473 - protein, 9 aa, Homo sapiens
  light chain complementarity determining region 3 for antibody 237
QQYRSYPLT

SEQ ID NO: 474 - protein, 23 aa, Homo sapiens
  heavy chain complementarity determining region 3 for antibody 237
ATGLGYCRGGRCFPDTVAGSYVF

SEQ ID NO: 475 - protein, 9 aa, Homo sapiens
  light chain complementarity determining region 3 for antibody 238
LQTATSPRT

SEQ ID NO: 476 - protein, 13 aa, Homo sapiens
  heavy chain complementarity determining region 3 for antibody 238
ARGSTATSWNIDY

SEQ ID NO: 477 - protein, 9 aa, Homo sapiens
  light chain complementarity determining region 3 for antibody 239
QQYGNSPLA

SEQ ID NO: 478 - protein, 18 aa, Homo sapiens
  heavy chain complementarity determining region 3 for antibody 239
AGGDYPEARTGYYLDFDY

SEQ ID NO: 479 - protein, 10 aa, Homo sapiens
  light chain complementarity determining region 3 for antibody 240
LQHNSYPMYT

SEQ ID NO: 480 - protein, 12 aa, Homo sapiens
  heavy chain complementarity determining region 3 for antibody 240
AREGMTTKEFFY

SEQ ID NO: 481 - protein, 9 aa, Homo sapiens
  light chain complementarity determining region 3 for antibody 241
QQYNSYSIT

SEQ ID NO: 482 - protein, 20 aa, Homo sapiens
  heavy chain complementarity determining region 3 for antibody 241
TRDQRSIHLWSFSEGGGMDV

SEQ ID NO: 483 - protein, 9 aa, Homo sapiens
  light chain complementarity determining region 3 for antibody 242
MQGIHWPWT

SEQ ID NO: 484 - protein, 11 aa, Homo sapiens
  heavy chain complementarity determining region 3 for antibody 242
ARSPATGTTDY

SEQ ID NO: 485 - protein, 9 aa, Homo sapiens
  light chain complementarity determining region 3 for antibody 243
IQYDTYPWT

SEQ ID NO: 486 - protein, 9 aa, Homo sapiens
  heavy chain complementarity determining region 3 for antibody 243
GRGHYGPDY

SEQ ID NO: 487 - protein, 9 aa, Homo sapiens
  light chain complementarity determining region 3 for antibody 244
LQHNSYPLT

SEQ ID NO: 488 - protein, 11 aa, Homo sapiens
  heavy chain complementarity determining region 3 for antibody 244
VRVSTGWSFDY

SEQ ID NO: 489 - protein, 8 aa, Homo sapiens
  light chain complementarity determining region 3 for antibody 245
QQLNSYPL

SEQ ID NO: 490 - protein, 11 aa, Homo sapiens
  heavy chain complementarity determining region 3 for antibody 245
AREQHGQAPDY

SEQ ID NO: 491 - protein, 9 aa, Homo sapiens
  light chain complementarity determining region 3 for antibody 246
QKYDTAPFT

SEQ ID NO: 492 - protein, 10 aa, Homo sapiens
  heavy chain complementarity determining region 3 for antibody 246
VREGNWNLDY

SEQ ID NO: 493 - protein, 9 aa, Homo sapiens
  light chain complementarity determining region 3 for antibody 247
LQYNSYPHT

SEQ ID NO: 494 - protein, 10 aa, Homo sapiens
  heavy chain complementarity determining region 3 for antibody 247
ARDSLWAFEI

SEQ ID NO: 495 - protein, 9 aa, Homo sapiens
  light chain complementarity determining region 3 for antibody 248
LQHNSYPWT

SEQ ID NO: 496 - protein, 14 aa, Homo sapiens
  heavy chain complementarity determining region 3 for antibody 248
ANYRASIGARCFDP

SEQ ID NO: 497 - protein, 9 aa, Homo sapiens
  light chain complementarity determining region 3 for antibody 249
LQYNSYPPT

SEQ ID NO: 498 - protein, 9 aa, Homo sapiens
  heavy chain complementarity determining region 3 for antibody 249
AKGRAESTY

SEQ ID NO: 499 - protein, 9 aa, Homo sapiens
  light chain complementarity determining region 3 for antibody 250
MQYTHWPHT

SEQ ID NO: 500 - protein, 8 aa, Homo sapiens
  heavy chain complementarity determining region 3 for antibody 250
AGWNDANY

SEQ ID NO: 501 - protein, 9 aa, Homo sapiens
  light chain complementarity determining region 3 for antibody 251
LQDYNYPFT

SEQ ID NO: 502 - protein, 16 aa, Homo sapiens
  heavy chain complementarity determining region 3 for antibody 251
SADLGDHVDYYATLDY

SEQ ID NO: 503 - protein, 9 aa, Homo sapiens
  light chain complementarity determining region 3 for antibody 252
VQGVHWPWT

SEQ ID NO: 504 - protein, 13 aa, Homo sapiens
  heavy chain complementarity determining region 3 for antibody 252
ARLDNTVAGVIDY

SEQ ID NO: 505 - protein, 9 aa, Homo sapiens
  light chain complementarity determining region 3 for antibody 253
QQSYSTPRT

SEQ ID NO: 506 - protein, 16 aa, Homo sapiens
  heavy chain complementarity determining region 3 for antibody 253
VRDLAGFTRGGSTFDY

SEQ ID NO: 507 - protein, 9 aa, Homo sapiens
  light chain complementarity determining region 3 for antibody 254
QQINTFPLA

SEQ ID NO: 508 - protein, 11 aa, Homo sapiens
  heavy chain complementarity determining region 3 for antibody 254
ARHPPYSPFDH

SEQ ID NO: 509 - protein, 9 aa, Homo sapiens
  light chain complementarity determining region 3 for antibody 255
LQDYNHLGT

SEQ ID NO: 510 - protein, 9 aa, Homo sapiens
  heavy chain complementarity determining region 3 for antibody 255
ASRRPYLDY

SEQ ID NO: 511 - protein, 9 aa, Homo sapiens
  light chain complementarity determining region 3 for antibody 256
QQSYTTPFT

SEQ ID NO: 512 - protein, 14 aa, Homo sapiens
  heavy chain complementarity determining region 3 for antibody 256
VRRDDSSDHGRFDY

SEQ ID NO: 513 - protein, 9 aa, Homo sapiens
  light chain complementarity determining region 3 for antibody 257
LQYYTAPWT

SEQ ID NO: 514 - protein, 17 aa, Homo sapiens
  heavy chain complementarity determining region 3 for antibody 257
SRDGRIIWPGSQGSLDS

SEQ ID NO: 515 - protein, 9 aa, Homo sapiens
  light chain complementarity determining region 3 for antibody 258
HQSSTLPHT

SEQ ID NO: 516 - protein, 10 aa, Homo sapiens
  heavy chain complementarity determining region 3 for antibody 258
ARETSGAYDI

SEQ ID NO: 517 - protein, 10 aa, Homo sapiens
  light chain complementarity determining region 3 for antibody 259
QHYGSSLGIT

SEQ ID NO: 518 - protein, 14 aa, Homo sapiens
  heavy chain complementarity determining region 3 for antibody 259
AGGRHNSGWYSFAY

SEQ ID NO: 519 - protein, 8 aa, Homo sapiens
  light chain complementarity determining region 3 for antibody 260
QQRSNWPT

SEQ ID NO: 520 - protein, 15 aa, Homo sapiens
  heavy chain complementarity determining region 3 for antibody 260
GKEGPGSSGWLTGHY

SEQ ID NO: 521 - protein, 9 aa, Homo sapiens
  light chain complementarity determining region 3 for antibody 261
QQLHGYPIT

SEQ ID NO: 522 - protein, 10 aa, Homo sapiens
  heavy chain complementarity determining region 3 for antibody 261
CRDREGFGDV

SEQ ID NO: 523 - protein, 9 aa, Homo sapiens
  light chain complementarity determining region 3 for antibody 262
MQGTYWPHT

SEQ ID NO: 524 - protein, 11 aa, Homo sapiens
  heavy chain complementarity determining region 3 for antibody 262
VSFGQQWGLAY

SEQ ID NO: 525 - protein, 9 aa, Homo sapiens
  light chain complementarity determining region 3 for antibody 263
QQHDTSHFP

SEQ ID NO: 526 - protein, 10 aa, Homo sapiens
  heavy chain complementarity determining region 3 for antibody 263
ARDISARFDS

SEQ ID NO: 527 - protein, 9 aa, Homo sapiens
  light chain complementarity determining region 3 for antibody 264
QEYKTVPWT

SEQ ID NO: 528 - protein, 20 aa, Homo sapiens
  heavy chain complementarity determining region 3 for antibody 264
AKDGRGTAFYHGAGGGGLDV

SEQ ID NO: 529 - protein, 9 aa, Homo sapiens
  light chain complementarity determining region 3 for antibody 265
MQATHWPRT

SEQ ID NO: 530 - protein, 12 aa, Homo sapiens
  heavy chain complementarity determining region 3 for antibody 265
AGSRSVGGSVDF

SEQ ID NO: 531 - protein, 9 aa, Homo sapiens
  light chain complementarity determining region 3 for antibody 266
QQYYGVPIT

SEQ ID NO: 532 - protein, 8 aa, Homo sapiens
  heavy chain complementarity determining region 3 for antibody 266
ARDFSLTA

SEQ ID NO: 533 - protein, 10 aa, Homo sapiens
  light chain complementarity determining region 3 for antibody 267
QQSYSTLPYT

SEQ ID NO: 534 - protein, 18 aa, Homo sapiens
  heavy chain complementarity determining region 3 for antibody 267
ARGVVVPVATPVPYFFDF

SEQ ID NO: 535 - protein, 9 aa, Homo sapiens
  light chain complementarity determining region 3 for antibody 268
QQGYKWPKT

SEQ ID NO: 536 - protein, 7 aa, Homo sapiens
  heavy chain complementarity determining region 3 for antibody 268
VYQLLNN

SEQ ID NO: 537 - protein, 9 aa, Homo sapiens
  light chain complementarity determining region 3 for antibody 269
QQYDNWPWT

SEQ ID NO: 538 - protein, 17 aa, Homo sapiens
  heavy chain complementarity determining region 3 for antibody 269
VTHYYHDSGIYYDFFNY

SEQ ID NO: 539 - protein, 9 aa, Homo sapiens
  light chain complementarity determining region 3 for antibody 270
QQYGYSPLT

SEQ ID NO: 540 - protein, 18 aa, Homo sapiens
  heavy chain complementarity determining region 3 for antibody 270
ARGDYPEARSGYYLDFDY

SEQ ID NO: 541 - protein, 9 aa, Homo sapiens
  light chain complementarity determining region 3 for antibody 271
QKYNNVPWT

SEQ ID NO: 542 - protein, 10 aa, Homo sapiens
  heavy chain complementarity determining region 3 for antibody 271
ARERSGSYDI

SEQ ID NO: 543 - protein, 11 aa, Homo sapiens
  light chain complementarity determining region 3 for antibody 272
QHFALSQWLWT

SEQ ID NO: 544 - protein, 13 aa, Homo sapiens
  heavy chain complementarity determining region 3 for antibody 272
ARVNRGIFDAFDN

SEQ ID NO: 545 - protein, 10 aa, Homo sapiens
  light chain complementarity determining region 3 for antibody 273
QQYGSSPAWT

SEQ ID NO: 546 - protein, 15 aa, Homo sapiens
  heavy chain complementarity determining region 3 for antibody 273
GKEGPGSSGWLTGHY

SEQ ID NO: 547 - protein, 9 aa, Homo sapiens
  light chain complementarity determining region 3 for antibody 274
QQHYGTPWT

SEQ ID NO: 548 - protein, 10 aa, Homo sapiens
  heavy chain complementarity determining region 3 for antibody 274
ATSTSGWYVY

SEQ ID NO: 549 - protein, 9 aa, Homo sapiens
  light chain complementarity determining region 3 for antibody 275
QQHGTFPLS

SEQ ID NO: 550 - protein, 13 aa, Homo sapiens
  heavy chain complementarity determining region 3 for antibody 275
ARGINILSNNFLH

SEQ ID NO: 551 - protein, 9 aa, Homo sapiens
  light chain complementarity determining region 3 for antibody 276
QERATWPGS

SEQ ID NO: 552 - protein, 13 aa, Homo sapiens
  heavy chain complementarity determining region 3 for antibody 276
ATGAWASSWWGDY

SEQ ID NO: 553 - protein, 11 aa, Homo sapiens
  light chain complementarity determining region 3 for antibody 277
LQHDNVPLGLT

SEQ ID NO: 554 - protein, 9 aa, Homo sapiens
  heavy chain complementarity determining region 3 for antibody 277
GSRRPYFDS

SEQ ID NO: 555 - protein, 9 aa, Homo sapiens
  light chain complementarity determining region 3 for antibody 278
QQYRTVPWT

SEQ ID NO: 556 - protein, 13 aa, Homo sapiens
  heavy chain complementarity determining region 3 for antibody 278
AKEGSSPGPDFDY

SEQ ID NO: 557 - protein, 9 aa, Homo sapiens
  light chain complementarity determining region 3 for antibody 279
QQYGRSPLT

SEQ ID NO: 558 - protein, 9 aa, Homo sapiens
  heavy chain complementarity determining region 3 for antibody 279
ARGSGYNYY

SEQ ID NO: 559 - protein, 9 aa, Homo sapiens
  light chain complementarity determining region 3 for antibody 280
QQRAHWPLT

SEQ ID NO: 560 - protein, 14 aa, Homo sapiens
  heavy chain complementarity determining region 3 for antibody 280
ARTYVYYDGSGSLP

SEQ ID NO: 561 - protein, 8 aa, Homo sapiens
  light chain complementarity determining region 3 for antibody 281
QHYKGFPA

SEQ ID NO: 562 - protein, 12 aa, Homo sapiens
  heavy chain complementarity determining region 3 for antibody 281
CVGGFGGTWFDS

SEQ ID NO: 563 - protein, 10 aa, Homo sapiens
  light chain complementarity determining region 3 for antibody 282
QQSYSTPLFT

SEQ ID NO: 564 - protein, 23 aa, Homo sapiens
  heavy chain complementarity determining region 3 for antibody 282
ARHFPKGGSGVTGTQSLIYYMDV

SEQ ID NO: 565 - protein, 9 aa, Homo sapiens
  light chain complementarity determining region 3 for antibody 283
LQHNTYPWT

SEQ ID NO: 566 - protein, 12 aa, Homo sapiens
  heavy chain complementarity determining region 3 for antibody 283
TRNAAGRDYLDY

SEQ ID NO: 567 - protein, 9 aa, Homo sapiens
  light chain complementarity determining region 3 for antibody 284
QNYNTAPFA

SEQ ID NO: 568 - protein, 10 aa, Homo sapiens
  heavy chain complementarity determining region 3 for antibody 284
VREGYWSLDH

SEQ ID NO: 569 - protein, 9 aa, Homo sapiens
  light chain complementarity determining region 3 for antibody 285
QHRNNWPFT

SEQ ID NO: 570 - protein, 8 aa, Homo sapiens
  heavy chain complementarity determining region 3 for antibody 285
ARGNHVDL

SEQ ID NO: 571 - protein, 10 aa, Homo sapiens
  light chain complementarity determining region 3 for antibody 286
MQGTYWPPIT

SEQ ID NO: 572 - protein, 11 aa, Homo sapiens
  heavy chain complementarity determining region 3 for antibody 286
AGGGAGIKIDS

SEQ ID NO: 573 - protein, 9 aa, Homo sapiens
  light chain complementarity determining region 3 for antibody 287
QQFYEIPLT

SEQ ID NO: 574 - protein, 16 aa, Homo sapiens
  heavy chain complementarity determining region 3 for antibody 287
ARDGRGASSQFNLFDP

SEQ ID NO: 575 - protein, 9 aa, Homo sapiens
  light chain complementarity determining region 3 for antibody 288
QQCAHSPLT

SEQ ID NO: 576 - protein, 13 aa, Homo sapiens
  heavy chain complementarity determining region 3 for antibody 288
VGGLYSGTWYGGY

SEQ ID NO: 577 - protein, 9 aa, Homo sapiens
  light chain complementarity determining region 3 for antibody 289
MQYAHWPHT

SEQ ID NO: 578 - protein, 8 aa, Homo sapiens
  heavy chain complementarity determining region 3 for antibody 289
AGWSDANY

SEQ ID NO: 579 - protein, 8 aa, Homo sapiens
  light chain complementarity determining region 3 for antibody 290
QQYGDSFP

SEQ ID NO: 580 - protein, 16 aa, Homo sapiens
  heavy chain complementarity determining region 3 for antibody 290
AYWAGVASSWSGPFDY

SEQ ID NO: 581 - protein, 9 aa, Homo sapiens
  light chain complementarity determining region 3 for antibody 291
QQYAKSPIT

SEQ ID NO: 582 - protein, 15 aa, Homo sapiens
  heavy chain complementarity determining region 3 for antibody 291
ARASRGGYISFLIEF

SEQ ID NO: 583 - protein, 9 aa, Homo sapiens
  light chain complementarity determining region 3 for antibody 292
FQGTHWPRT

SEQ ID NO: 584 - protein, 8 aa, Homo sapiens
  heavy chain complementarity determining region 3 for antibody 292
GRDRWWSG

SEQ ID NO: 585 - protein, 10 aa, Homo sapiens
  light chain complementarity determining region 3 for antibody 293
QQSYSTPLFT

SEQ ID NO: 586 - protein, 23 aa, Homo sapiens
  heavy chain complementarity determining region 3 for antibody 293
ARHFPKGGSTVTGTQSLLYYMDV

SEQ ID NO: 587 - protein, 9 aa, Homo sapiens
  light chain complementarity determining region 3 for antibody 294
QQYNRYPWT

SEQ ID NO: 588 - protein, 14 aa, Homo sapiens
  heavy chain complementarity determining region 3 for antibody 294
VREQGSGYYRTADY

SEQ ID NO: 589 - protein, 8 aa, Homo sapiens
  light chain complementarity determining region 3 for antibody 295
QQRSTWPT

SEQ ID NO: 590 - protein, 13 aa, Homo sapiens
  heavy chain complementarity determining region 3 for antibody 295
VKDKGNYDRCFDY

SEQ ID NO: 591 - protein, 9 aa, Homo sapiens
  light chain complementarity determining region 3 for antibody 296
QQLYNYPLT

SEQ ID NO: 592 - protein, 14 aa, Homo sapiens
  heavy chain complementarity determining region 3 for antibody 296
ARDTTYNWNDGGIS

SEQ ID NO: 593 - protein, 10 aa, Homo sapiens
  light chain complementarity determining region 3 for antibody 297
QQYKNWPPYT

SEQ ID NO: 594 - protein, 14 aa, Homo sapiens
  heavy chain complementarity determining region 3 for antibody 297
ARENCYGTGSCFDI

SEQ ID NO: 595 - protein, 9 aa, Homo sapiens
  light chain complementarity determining region 3 for antibody 298
QQYDNLPRT

SEQ ID NO: 596 - protein, 9 aa, Homo sapiens
  heavy chain complementarity determining region 3 for antibody 298
ARGRSNFRH

SEQ ID NO: 597 - protein, 9 aa, Homo sapiens
  light chain complementarity determining region 3 for antibody 299
LQYYTAPWT

SEQ ID NO: 598 - protein, 17 aa, Homo sapiens
  heavy chain complementarity determining region 3 for antibody 299
SRDGRTIWPGSQGSLDS

SEQ ID NO: 599 - protein, 9 aa, Homo sapiens
  light chain complementarity determining region 3 for antibody 300
LQFYTAPWA

SEQ ID NO: 600 - protein, 17 aa, Homo sapiens
  heavy chain complementarity determining region 3 for antibody 300
SRDGRITWPGSQGSLDS

SEQ ID NO: 601 - protein, 9 aa, Homo sapiens
  light chain complementarity determining region 3 for antibody 301
QQFNSYPYT

SEQ ID NO: 602 - protein, 9 aa, Homo sapiens
  heavy chain complementarity determining region 3 for antibody 301
ARFWTYGRK

SEQ ID NO: 603 - protein, 9 aa, Homo sapiens
  light chain complementarity determining region 3 for antibody 302
LQHNTYPWT

SEQ ID NO: 604 - protein, 12 aa, Homo sapiens
  heavy chain complementarity determining region 3 for antibody 302
ARDLAGAPYVDS

SEQ ID NO: 605 - protein, 9 aa, Homo sapiens
  light chain complementarity determining region 3 for antibody 303
LQDNSYPFT

SEQ ID NO: 606 - protein, 15 aa, Homo sapiens
  heavy chain complementarity determining region 3 for antibody 303
TRDEFTGSHIEAFDI

SEQ ID NO: 607 - protein, 9 aa, Homo sapiens
  light chain complementarity determining region 3 for antibody 304
QQSYSTPWT

SEQ ID NO: 608 - protein, 15 aa, Homo sapiens
  heavy chain complementarity determining region 3 for antibody 304
ARIWTSSTNCRYMDV

SEQ ID NO: 609 - protein, 9 aa, Homo sapiens
  light chain complementarity determining region 3 for antibody 305
MQALQTPYT

SEQ ID NO: 610 - protein, 15 aa, Homo sapiens
  heavy chain complementarity determining region 3 for antibody 305
ARERRMFGELRGFDV

SEQ ID NO: 611 - protein, 7 aa, Homo sapiens
  light chain complementarity determining region 3 for antibody 306
QHRSNWS

SEQ ID NO: 612 - protein, 11 aa, Homo sapiens
  heavy chain complementarity determining region 3 for antibody 306
GRNDLGGGCVF

SEQ ID NO: 613 - protein, 9 aa, Homo sapiens
  light chain complementarity determining region 3 for antibody 307
QQYGSSTWT

SEQ ID NO: 614 - protein, 15 aa, Homo sapiens
  heavy chain complementarity determining region 3 for antibody 307
ARELPQRTYSDGWDH

SEQ ID NO: 615 - protein, 9 aa, Homo sapiens
  light chain complementarity determining region 3 for antibody 308
MQYTHRPHT

SEQ ID NO: 616 - protein, 8 aa, Homo sapiens
  heavy chain complementarity determining region 3 for antibody 308
AGWGYGNY

SEQ ID NO: 617 - protein, 9 aa, Homo sapiens
  light chain complementarity determining region 3 for antibody 309
MQALQLPLT

SEQ ID NO: 618 - protein, 15 aa, Homo sapiens
  heavy chain complementarity determining region 3 for antibody 309
VRDPGGLAYFYNMEV

SEQ ID NO: 619 - protein, 9 aa, Homo sapiens
  light chain complementarity determining region 3 for antibody 310
LHTFTAPRT

SEQ ID NO: 620 - protein, 15 aa, Homo sapiens
  heavy chain complementarity determining region 3 for antibody 310
SRDYIEASNLLRLDY

SEQ ID NO: 621 - protein, 9 aa, Homo sapiens
  light chain complementarity determining region 3 for antibody 311
QQYGTSPVT

SEQ ID NO: 622 - protein, 13 aa, Homo sapiens
  heavy chain complementarity determining region 3 for antibody 311
AKDRGSGWYAWGY

SEQ ID NO: 623 - protein, 10 aa, Homo sapiens
  light chain complementarity determining region 3 for antibody 312
QQYDGSPPWT

SEQ ID NO: 624 - protein, 14 aa, Homo sapiens
  heavy chain complementarity determining region 3 for antibody 312
SHPTRGARLPIFDY

SEQ ID NO: 625 - protein, 9 aa, Homo sapiens
  light chain complementarity determining region 3 for antibody 313
QQYNNYPLT

SEQ ID NO: 626 - protein, 14 aa, Homo sapiens
  heavy chain complementarity determining region 3 for antibody 313
ANYRASIGARCFDP

SEQ ID NO: 627 - protein, 9 aa, Homo sapiens
  light chain complementarity determining region 3 for antibody 314
LQDHKYPFS

SEQ ID NO: 628 - protein, 16 aa, Homo sapiens
  heavy chain complementarity determining region 3 for antibody 314
GADLGDHGDAYATLDS

SEQ ID NO: 629 - protein, 9 aa, Homo sapiens
  light chain complementarity determining region 3 for antibody 315
LQDHKYPFS

SEQ ID NO: 630 - protein, 16 aa, Homo sapiens
  heavy chain complementarity determining region 3 for antibody 315
AADLGDHADAYATLDS

SEQ ID NO: 631 - protein, 9 aa, Homo sapiens
  light chain complementarity determining region 3 for antibody 316
MQTTHWPRT

SEQ ID NO: 632 - protein, 9 aa, Homo sapiens
  heavy chain complementarity determining region 3 for antibody 316
AKGVFSFDY

SEQ ID NO: 633 - protein, 9 aa, Homo sapiens
  light chain complementarity determining region 3 for antibody 317
MQALQTPYT

SEQ ID NO: 634 - protein, 11 aa, Homo sapiens
  heavy chain complementarity determining region 3 for antibody 317
ATFGQQWRLAH

SEQ ID NO: 635 - protein, 9 aa, Homo sapiens
  light chain complementarity determining region 3 for antibody 318
QQINSFPLA

SEQ ID NO: 636 - protein, 11 aa, Homo sapiens
  heavy chain complementarity determining region 3 for antibody 318
ARHPPYSPFDH

SEQ ID NO: 637 - protein, 9 aa, Homo sapiens
  light chain complementarity determining region 3 for antibody 319
QQSYSTPDT

SEQ ID NO: 638 - protein, 12 aa, Homo sapiens
  heavy chain complementarity determining region 3 for antibody 319
ARDFTANYCPDY

SEQ ID NO: 639 - protein, 9 aa, Homo sapiens
  light chain complementarity determining region 3 for antibody 320
QHSYNTPRT

SEQ ID NO: 640 - protein, 7 aa, Homo sapiens
  heavy chain complementarity determining region 3 for antibody 320
TTGDLRN

SEQ ID NO: 641 - protein, 9 aa, Homo sapiens
  light chain complementarity determining region 3 for antibody 321
QKYNSVPWT

SEQ ID NO: 642 - protein, 17 aa, Homo sapiens
  heavy chain complementarity determining region 3 for antibody 321
TRDRADSTWTSANRRDS

SEQ ID NO: 643 - protein, 9 aa, Homo sapiens
  light chain complementarity determining region 3 for antibody 322
QQYYNIPFA

SEQ ID NO: 644 - protein, 14 aa, Homo sapiens
  heavy chain complementarity determining region 3 for antibody 322
VKGRIASCYSEADY

SEQ ID NO: 645 - protein, 6 aa, Homo sapiens
  light chain complementarity determining region 3 for antibody 323
QQYDNP

SEQ ID NO: 646 - protein, 12 aa, Homo sapiens
  heavy chain complementarity determining region 3 for antibody 323
AIVVPGRWDLDD

SEQ ID NO: 647 - protein, 9 aa, Homo sapiens
  light chain complementarity determining region 3 for antibody 324
QQFANFPRT

SEQ ID NO: 648 - protein, 9 aa, Homo sapiens
  heavy chain complementarity determining region 3 for antibody 324
ARGRSNFRY

SEQ ID NO: 649 - protein, 8 aa, Homo sapiens
  light chain complementarity determining region 3 for antibody 325
QHYGGSPT

SEQ ID NO: 650 - protein, 16 aa, Homo sapiens
  heavy chain complementarity determining region 3 for antibody 325
ARGHGYDLLYVADFDY

SEQ ID NO: 651 - protein, 9 aa, Homo sapiens
  light chain complementarity determining region 3 for antibody 326
LQFYTAPWA

SEQ ID NO: 652 - protein, 17 aa, Homo sapiens
  heavy chain complementarity determining region 3 for antibody 326
SRDGRIEWPGSQGSLDS

SEQ ID NO: 653 - protein, 9 aa, Homo sapiens
  light chain complementarity determining region 3 for antibody 327
QQYNTWPLT

SEQ ID NO: 654 - protein, 15 aa, Homo sapiens
  heavy chain complementarity determining region 3 for antibody 327
ATHEGMAAAGLVFDF

SEQ ID NO: 655 - protein, 8 aa, Homo sapiens
  light chain complementarity determining region 3 for antibody 328
QQYGTSFT

SEQ ID NO: 656 - protein, 16 aa, Homo sapiens
  heavy chain complementarity determining region 3 for antibody 328
SRWAGVASGWSGPFDN

SEQ ID NO: 657 - protein, 9 aa, Homo sapiens
  light chain complementarity determining region 3 for antibody 329
QERSTWPGS

SEQ ID NO: 658 - protein, 13 aa, Homo sapiens
  heavy chain complementarity determining region 3 for antibody 329
ATGAWDSSWWGDY

SEQ ID NO: 659 - protein, 8 aa, Homo sapiens
  light chain complementarity determining region 3 for antibody 330
QQSYTTPT

SEQ ID NO: 660 - protein, 12 aa, Homo sapiens
  heavy chain complementarity determining region 3 for antibody 330
AKWRGDQSEFDF

SEQ ID NO: 661 - protein, 9 aa, Homo sapiens
  light chain complementarity determining region 3 for antibody 331
QQSYSTPLT

SEQ ID NO: 662 - protein, 13 aa, Homo sapiens
  heavy chain complementarity determining region 3 for antibody 331
AKEGSSPGPDFDY

SEQ ID NO: 663 - protein, 9 aa, Homo sapiens
  light chain complementarity determining region 3 for antibody 332
MQALLAPPT

SEQ ID NO: 664 - protein, 10 aa, Homo sapiens
  heavy chain complementarity determining region 3 for antibody 332
TRHYNWHFDY

SEQ ID NO: 665 - protein, 9 aa, Homo sapiens
  light chain complementarity determining region 3 for antibody 333
QQYVSAPVT

SEQ ID NO: 666 - protein, 16 aa, Homo sapiens
  heavy chain complementarity determining region 3 for antibody 333
VGPHLTYNSGWRYFDY

SEQ ID NO: 667 - protein, 7 aa, Homo sapiens
  light chain complementarity determining region 3 for antibody 334
QCFGTSP

SEQ ID NO: 668 - protein, 11 aa, Homo sapiens
  heavy chain complementarity determining region 3 for antibody 334
VRDVSYWRFDP

SEQ ID NO: 669 - protein, 9 aa, Homo sapiens
  light chain complementarity determining region 3 for antibody 335
LQHDYFPWT

SEQ ID NO: 670 - protein, 19 aa, Homo sapiens
  heavy chain complementarity determining region 3 for antibody 335
ASWAGYCPSANCHTTTFDY

SEQ ID NO: 671 - protein, 9 aa, Homo sapiens
  light chain complementarity determining region 3 for antibody 336
HQYGSLPLT

SEQ ID NO: 672 - protein, 13 aa, Homo sapiens
  heavy chain complementarity determining region 3 for antibody 336
AKDRSSGWYAWGY

SEQ ID NO: 673 - protein, 9 aa, Homo sapiens
  light chain complementarity determining region 3 for antibody 337
QQLYNYPIT

SEQ ID NO: 674 - protein, 14 aa, Homo sapiens
  heavy chain complementarity determining region 3 for antibody 337
ARDTTHNWNDGGIS

SEQ ID NO: 675 - protein, 9 aa, Homo sapiens
  light chain complementarity determining region 3 for antibody 338
LQATHWPRT

SEQ ID NO: 676 - protein, 12 aa, Homo sapiens
  heavy chain complementarity determining region 3 for antibody 338
STDVETTFPSVS

SEQ ID NO: 677 - protein, 9 aa, Homo sapiens
  light chain complementarity determining region 3 for antibody 339
QQYYTPPYT

SEQ ID NO: 678 - protein, 10 aa, Homo sapiens
  heavy chain complementarity determining region 3 for antibody 339
TRSTDAYNDI

SEQ ID NO: 679 - protein, 7 aa, Homo sapiens
  light chain complementarity determining region 3 for antibody 340
QQYNTWT

SEQ ID NO: 680 - protein, 10 aa, Homo sapiens
  heavy chain complementarity determining region 3 for antibody 340
ARGGLAGDIQ

SEQ ID NO: 681 - protein, 9 aa, Homo sapiens
  light chain complementarity determining region 3 for antibody 341
QQYGNLPPT

SEQ ID NO: 682 - protein, 9 aa, Homo sapiens
  heavy chain complementarity determining region 3 for antibody 341
ARGNGFNMF

SEQ ID NO: 683 - protein, 10 aa, Homo sapiens
  light chain complementarity determining region 3 for antibody 342
QQLNNWPPLT

SEQ ID NO: 684 - protein, 15 aa, Homo sapiens
  heavy chain complementarity determining region 3 for antibody 342
ACPNGRYNHPHYFDY

SEQ ID NO: 685 - protein, 9 aa, Homo sapiens
  light chain complementarity determining region 3 for antibody 343
MQTLQTPWT

SEQ ID NO: 686 - protein, 12 aa, Homo sapiens
  heavy chain complementarity determining region 3 for antibody 343
ARDADYDEEFDY

SEQ ID NO: 687 - protein, 8 aa, Homo sapiens
  light chain complementarity determining region 3 for antibody 344
QQYHYQVT

SEQ ID NO: 688 - protein, 6 aa, Homo sapiens
  heavy chain complementarity determining region 3 for antibody 344
ARHTGS

SEQ ID NO: 689 - protein, 9 aa, Homo sapiens
  light chain complementarity determining region 3 for antibody 345
QQRSNWLFT

SEQ ID NO: 690 - protein, 13 aa, Homo sapiens
  heavy chain complementarity determining region 3 for antibody 345
AKEGPYPGLDLDY

SEQ ID NO: 691 - protein, 10 aa, Homo sapiens
  light chain complementarity determining region 3 for antibody 346
QHYFSTPPWT

SEQ ID NO: 692 - protein, 13 aa, Homo sapiens
  heavy chain complementarity determining region 3 for antibody 346
ASLRRDNSGHFNY

SEQ ID NO: 693 - protein, 9 aa, Homo sapiens
  light chain complementarity determining region 3 for antibody 347
QHSYNTPRT

SEQ ID NO: 694 - protein, 6 aa, Homo sapiens
  heavy chain complementarity determining region 3 for antibody 347
ARISAY

SEQ ID NO: 695 - protein, 9 aa, Homo sapiens
  light chain complementarity determining region 3 for antibody 348
HQSAKSPRT

SEQ ID NO: 696 - protein, 13 aa, Homo sapiens
  heavy chain complementarity determining region 3 for antibody 348
ARGATATSWNIDY

SEQ ID NO: 697 - protein, 9 aa, Homo sapiens
  light chain complementarity determining region 3 for antibody 349
QQYYNTPET

SEQ ID NO: 698 - protein, 15 aa, Homo sapiens
  heavy chain complementarity determining region 3 for antibody 349
ARDLFSGSYAYGDDY

SEQ ID NO: 699 - protein, 9 aa, Homo sapiens
  light chain complementarity determining region 3 for antibody 350
QQYNTAPWT

SEQ ID NO: 700 - protein, 20 aa, Homo sapiens
  heavy chain complementarity determining region 3 for antibody 350
TRDARGSSSYAYGGGGGLDV

SEQ ID NO: 701 - protein, 9 aa, Homo sapiens
  light chain complementarity determining region 3 for antibody 351
HQSAHSPRT

SEQ ID NO: 702 - protein, 13 aa, Homo sapiens
  heavy chain complementarity determining region 3 for antibody 351
ARGTTATSWNIDY

SEQ ID NO: 703 - protein, 9 aa, Homo sapiens
  light chain complementarity determining region 3 for antibody 352
MQGSHWPYT

SEQ ID NO: 704 - protein, 10 aa, Homo sapiens
  heavy chain complementarity determining region 3 for antibody 352
ARETSGSYDI

SEQ ID NO: 705 - protein, 9 aa, Homo sapiens
  light chain complementarity determining region 3 for antibody 353
QQYYSAPIT

SEQ ID NO: 706 - protein, 15 aa, Homo sapiens
  heavy chain complementarity determining region 3 for antibody 353
VRALSPTEMSYAIAY

SEQ ID NO: 707 - protein, 10 aa, Homo sapiens
  light chain complementarity determining region 3 for antibody 354
QQYYNRPPNT

SEQ ID NO: 708 - protein, 17 aa, Homo sapiens
  heavy chain complementarity determining region 3 for antibody 354
ATTERYYDRSGYHPFEN

SEQ ID NO: 709 - protein, 7 aa, Homo sapiens
  light chain complementarity determining region 3 for antibody 355
HCRDCWV

SEQ ID NO: 710 - protein, 20 aa, Homo sapiens
  heavy chain complementarity determining region 3 for antibody 355
ATYLPGDCSCTGCYYWYFNF

SEQ ID NO: 711 - protein, 9 aa, Homo sapiens
  light chain complementarity determining region 3 for antibody 356
QQYGNSLYT

SEQ ID NO: 712 - protein, 13 aa, Homo sapiens
  heavy chain complementarity determining region 3 for antibody 356
TWISSATYLFLHS

SEQ ID NO: 713 - protein, 9 aa, Homo sapiens
  light chain complementarity determining region 3 for antibody 357
QQYYSTPWT

SEQ ID NO: 714 - protein, 18 aa, Homo sapiens
  heavy chain complementarity determining region 3 for antibody 357
ARGLHQLRLGGYFYGLDV

SEQ ID NO: 715 - protein, 8 aa, Homo sapiens
  light chain complementarity determining region 3 for antibody 358
QQYSSCCS

SEQ ID NO: 716 - protein, 15 aa, Homo sapiens
  heavy chain complementarity determining region 3 for antibody 358
VRGITGTIHPYHFDY

SEQ ID NO: 717 - protein, 9 aa, Homo sapiens
  light chain complementarity determining region 3 for antibody 359
QQYNNWPWT

SEQ ID NO: 718 - protein, 18 aa, Homo sapiens
  heavy chain complementarity determining region 3 for antibody 359
ASWAGSCSSTSCYAVYDY

SEQ ID NO: 719 - protein, 9 aa, Homo sapiens
  light chain complementarity determining region 3 for antibody 360
QQYASSPFG

SEQ ID NO: 720 - protein, 16 aa, Homo sapiens
  heavy chain complementarity determining region 3 for antibody 360
AKDRQGRSSAWWLLEN

SEQ ID NO: 721 - protein, 8 aa, Homo sapiens
  light chain complementarity determining region 3 for antibody 361
QQSYTRPT

SEQ ID NO: 722 - protein, 12 aa, Homo sapiens
  heavy chain complementarity determining region 3 for antibody 361
ARWRGDQSEFEY

SEQ ID NO: 723 - protein, 9 aa, Homo sapiens
  light chain complementarity determining region 3 for antibody 362
QQSYSIPFT

SEQ ID NO: 724 - protein, 17 aa, Homo sapiens
  heavy chain complementarity determining region 3 for antibody 362
ARLGGRHHRGSGSYGDY

SEQ ID NO: 725 - protein, 9 aa, Homo sapiens
  light chain complementarity determining region 3 for antibody 363
LQDHTYPFS

SEQ ID NO: 726 - protein, 16 aa, Homo sapiens
  heavy chain complementarity determining region 3 for antibody 363
AADLGDHSDTYATLDY

SEQ ID NO: 727 - protein, 10 aa, Homo sapiens
  light chain complementarity determining region 3 for antibody 364
QQYHSYSPLT

SEQ ID NO: 728 - protein, 16 aa, Homo sapiens
  heavy chain complementarity determining region 3 for antibody 364
ARWFSRSSTGVSYMDV

SEQ ID NO: 729 - protein, 10 aa, Homo sapiens
  light chain complementarity determining region 3 for antibody 365
QQYGSSPPLT

SEQ ID NO: 730 - protein, 20 aa, Homo sapiens
  heavy chain complementarity determining region 3 for antibody 365
GRDSSRSYSNSWAYYYGTDV

SEQ ID NO: 731 - protein, 9 aa, Homo sapiens
  light chain complementarity determining region 3 for antibody 366
QQFDNLPRT

SEQ ID NO: 732 - protein, 9 aa, Homo sapiens
  heavy chain complementarity determining region 3 for antibody 366
ARGRSNFRY

SEQ ID NO: 733 - protein, 9 aa, Homo sapiens
  light chain complementarity determining region 3 for antibody 367
QKYNSAFLT

SEQ ID NO: 734 - protein, 18 aa, Homo sapiens
  heavy chain complementarity determining region 3 for antibody 367
ARWAGSCSGRSCYAPFDF

SEQ ID NO: 735 - protein, 9 aa, Homo sapiens
  light chain complementarity determining region 3 for antibody 368
HQYGSSRIT

SEQ ID NO: 736 - protein, 14 aa, Homo sapiens
  heavy chain complementarity determining region 3 for antibody 368
AKSRCSTSCYGGDY

SEQ ID NO: 737 - protein, 9 aa, Homo sapiens
  light chain complementarity determining region 3 for antibody 369
QRYNTVPWA

SEQ ID NO: 738 - protein, 20 aa, Homo sapiens
  heavy chain complementarity determining region 3 for antibody 369
TRDQRSIHLWLLAEGGGMDV

SEQ ID NO: 739 - protein, 9 aa, Homo sapiens
  light chain complementarity determining region 3 for antibody 370
QQYGSSPLT

SEQ ID NO: 740 - protein, 13 aa, Homo sapiens
  heavy chain complementarity determining region 3 for antibody 370
AKDRSSGWYAWGY

SEQ ID NO: 741 - protein, 9 aa, Homo sapiens
  light chain complementarity determining region 3 for antibody 371
QQTYSSPWT

SEQ ID NO: 742 - protein, 10 aa, Homo sapiens
  heavy chain complementarity determining region 3 for antibody 371
ARGGLAGDVS

SEQ ID NO: 743 - protein, 8 aa, Homo sapiens
  light chain complementarity determining region 3 for antibody 372
QQSYTTPT

SEQ ID NO: 744 - protein, 26 aa, Homo sapiens
  heavy chain complementarity determining region 3 for antibody 372
ARDFPKGGSYSSGWYGSVGGNYYMDV

SEQ ID NO: 745 - protein, 8 aa, Homo sapiens
  light chain complementarity determining region 3 for antibody 373
QQYGNSLT

SEQ ID NO: 746 - protein, 11 aa, Homo sapiens
  heavy chain complementarity determining region 3 for antibody 373
ARDSQVKWFYS

SEQ ID NO: 747 - protein, 9 aa, Homo sapiens
  light chain complementarity determining region 3 for antibody 374
LQHNSYPLT

SEQ ID NO: 748 - protein, 15 aa, Homo sapiens
  heavy chain complementarity determining region 3 for antibody 374
ARIWTSSTNCRYMDV

SEQ ID NO: 749 - protein, 9 aa, Homo sapiens
  light chain complementarity determining region 3 for antibody 375
LQDHNYPFA

SEQ ID NO: 750 - protein, 16 aa, Homo sapiens
  heavy chain complementarity determining region 3 for antibody 375
AADVGDHIDVYATLDY

SEQ ID NO: 751 - protein, 9 aa, Homo sapiens
  light chain complementarity determining region 3 for antibody 376
QQTYGTPYT

SEQ ID NO: 752 - protein, 14 aa, Homo sapiens
  heavy chain complementarity determining region 3 for antibody 376
ARLHGSGLGRWLDP

SEQ ID NO: 753 - protein, 9 aa, Homo sapiens
  light chain complementarity determining region 3 for antibody 377
QQFSSFPRT

SEQ ID NO: 754 - protein, 9 aa, Homo sapiens
  heavy chain complementarity determining region 3 for antibody 377
ARGNGFNMF

SEQ ID NO: 755 - protein, 9 aa, Homo sapiens
  light chain complementarity determining region 3 for antibody 378
QKYGSSPVP

SEQ ID NO: 756 - protein, 11 aa, Homo sapiens
  heavy chain complementarity determining region 3 for antibody 378
TRGGYSVGYDY

SEQ ID NO: 757 - protein, 10 aa, Homo sapiens
  light chain complementarity determining region 3 for antibody 379
QQSYSTLIFT

SEQ ID NO: 758 - protein, 17 aa, Homo sapiens
  heavy chain complementarity determining region 3 for antibody 379
ARNTMVGTWQRQGNLDH

SEQ ID NO: 759 - protein, 11 aa, Homo sapiens
  light chain complementarity determining region 3 for antibody 380
QQYNDWPPTLT

SEQ ID NO: 760 - protein, 16 aa, Homo sapiens
  heavy chain complementarity determining region 3 for antibody 380
AKVVIGSLGIEGFRDY

SEQ ID NO: 761 - protein, 9 aa, Homo sapiens
  light chain complementarity determining region 3 for antibody 381
QQTYSSPWT

SEQ ID NO: 762 - protein, 15 aa, Homo sapiens
  heavy chain complementarity determining region 3 for antibody 381
ARIWTSSPNCRYMDV

SEQ ID NO: 763 - protein, 9 aa, Homo sapiens
  light chain complementarity determining region 3 for antibody 382
LQDFSYPFS

SEQ ID NO: 764 - protein, 16 aa, Homo sapiens
  heavy chain complementarity determining region 3 for antibody 382
VTDVGDHRDTYTTLDY

SEQ ID NO: 765 - protein, 9 aa, Homo sapiens
  light chain complementarity determining region 3 for antibody 383
QQYSNWPIT

SEQ ID NO: 766 - protein, 15 aa, Homo sapiens
  heavy chain complementarity determining region 3 for antibody 383
AKDVFSSGWYNFFDP

SEQ ID NO: 767 - protein, 6 aa, Homo sapiens
  light chain complementarity determining region 3 for antibody 384
QQYGSS

SEQ ID NO: 768 - protein, 21 aa, Homo sapiens
  heavy chain complementarity determining region 3 for antibody 384
ARDLGTYGSGSHQYYYYGMDV

SEQ ID NO: 769 - protein, 9 aa, Homo sapiens
  light chain complementarity determining region 3 for antibody 385
QQYYSAPQT

SEQ ID NO: 770 - protein, 9 aa, Homo sapiens
  heavy chain complementarity determining region 3 for antibody 385
ARDVWPEDC

SEQ ID NO: 771 - protein, 8 aa, Homo sapiens
  light chain complementarity determining region 3 for antibody 386
QQYYATPT

SEQ ID NO: 772 - protein, 16 aa, Homo sapiens
  heavy chain complementarity determining region 3 for antibody 386
VRAADTSSWSFLISDY

SEQ ID NO: 773 - protein, 11 aa, Homo sapiens
  light chain complementarity determining region 3 for antibody 387
QQYDGWPPFLT

SEQ ID NO: 774 - protein, 15 aa, Homo sapiens
  heavy chain complementarity determining region 3 for antibody 387
ATHGGPAAAGRVLDF

SEQ ID NO: 775 - protein, 9 aa, Homo sapiens
  light chain complementarity determining region 3 for antibody 388
QQYDNLPFT

SEQ ID NO: 776 - protein, 9 aa, Homo sapiens
  heavy chain complementarity determining region 3 for antibody 388
ARSEYQPTY

SEQ ID NO: 777 - protein, 9 aa, Homo sapiens
  light chain complementarity determining region 3 for antibody 389
QHYNSYPWT

SEQ ID NO: 778 - protein, 17 aa, Homo sapiens
  heavy chain complementarity determining region 3 for antibody 389
ARDPKVRGVGRRGWFDP

SEQ ID NO: 779 - protein, 9 aa, Homo sapiens
  light chain complementarity determining region 3 for antibody 390
VQYTNYPRT

SEQ ID NO: 780 - protein, 12 aa, Homo sapiens
  heavy chain complementarity determining region 3 for antibody 390
TRSPASPDKYDY

SEQ ID NO: 781 - protein, 9 aa, Homo sapiens
  light chain complementarity determining region 3 for antibody 391
QQYKTYPWT

SEQ ID NO: 782 - protein, 14 aa, Homo sapiens
  heavy chain complementarity determining region 3 for antibody 391
AREEGSGWYRTSDY

SEQ ID NO: 783 - protein, 8 aa, Homo sapiens
  light chain complementarity determining region 3 for antibody 392
QQYGDSFP

SEQ ID NO: 784 - protein, 12 aa, Homo sapiens
  heavy chain complementarity determining region 3 for antibody 392
ARDKGGLNGMDV

SEQ ID NO: 785 - protein, 9 aa, Homo sapiens
  light chain complementarity determining region 3 for antibody 393
QQTYSSPPT

SEQ ID NO: 786 - protein, 15 aa, Homo sapiens
  heavy chain complementarity determining region 3 for antibody 393
VRGIVLLRGVWGMDV

SEQ ID NO: 787 - protein, 9 aa, Homo sapiens
  light chain complementarity determining region 3 for antibody 394
QQRSKWPGT

SEQ ID NO: 788 - protein, 10 aa, Homo sapiens
  heavy chain complementarity determining region 3 for antibody 394
ARGGLAGDND

SEQ ID NO: 789 - protein, 9 aa, Homo sapiens
  light chain complementarity determining region 3 for antibody 395
QNYNSVPLT

SEQ ID NO: 790 - protein, 10 aa, Homo sapiens
  heavy chain complementarity determining region 3 for antibody 395
CRDREGFGDV

SEQ ID NO: 791 - protein, 8 aa, Homo sapiens
  light chain complementarity determining region 3 for antibody 396
QQYDNART

SEQ ID NO: 792 - protein, 18 aa, Homo sapiens
  heavy chain complementarity determining region 3 for antibody 396
AKGKLPFCSGTRCYPDDL

SEQ ID NO: 793 - protein, 9 aa, Homo sapiens
  light chain complementarity determining region 3 for antibody 397
QKYNSAPFT

SEQ ID NO: 794 - protein, 10 aa, Homo sapiens
  heavy chain complementarity determining region 3 for antibody 397
VREGHWNLDH

SEQ ID NO: 795 - protein, 7 aa, Homo sapiens
  light chain complementarity determining region 3 for antibody 398
QQYNTWP

SEQ ID NO: 796 - protein, 12 aa, Homo sapiens
  heavy chain complementarity determining region 3 for antibody 398
ARDKGGRNGMDV

SEQ ID NO: 797 - protein, 9 aa, Homo sapiens
  light chain complementarity determining region 3 for antibody 399
QQYGNSPVP

SEQ ID NO: 798 - protein, 18 aa, Homo sapiens
  heavy chain complementarity determining region 3 for antibody 399
ARGDYPEARAGYFLDFDY

SEQ ID NO: 799 - protein, 9 aa, Homo sapiens
  light chain complementarity determining region 3 for antibody 400
QQHYSIPFT

SEQ ID NO: 800 - protein, 10 aa, Homo sapiens
  heavy chain complementarity determining region 3 for antibody 400
TTACGGDCSY

SEQ ID NO: 801 - protein, 9 aa, Homo sapiens
  light chain complementarity determining region 3 for antibody 401
LQHTTYPWT

SEQ ID NO: 802 - protein, 12 aa, Homo sapiens
  heavy chain complementarity determining region 3 for antibody 401
ARDLAGAPYVDS

SEQ ID NO: 803 - protein, 9 aa, Homo sapiens
  light chain complementarity determining region 3 for antibody 402
QQYGSSPRT

SEQ ID NO: 804 - protein, 10 aa, Homo sapiens
  heavy chain complementarity determining region 3 for antibody 402
CRDREGFGDV

SEQ ID NO: 805 - protein, 9 aa, Homo sapiens
  light chain complementarity determining region 3 for antibody 403
QQSYNYPLT

SEQ ID NO: 806 - protein, 11 aa, Homo sapiens
  heavy chain complementarity determining region 3 for antibody 403
ARGGALNWLDP

SEQ ID NO: 807 - protein, 9 aa, Homo sapiens
  light chain complementarity determining region 3 for antibody 404
QQFRDLPRT

SEQ ID NO: 808 - protein, 9 aa, Homo sapiens
  heavy chain complementarity determining region 3 for antibody 404
ARGRSNFRH

SEQ ID NO: 809 - protein, 9 aa, Homo sapiens
  light chain complementarity determining region 3 for antibody 405
MQATHWPWT

SEQ ID NO: 810 - protein, 12 aa, Homo sapiens
  heavy chain complementarity determining region 3 for antibody 405
ARGPLRMAAGTS

SEQ ID NO: 811 - protein, 9 aa, Homo sapiens
  light chain complementarity determining region 3 for antibody 406
QQYGGSSFT

SEQ ID NO: 812 - protein, 12 aa, Homo sapiens
  heavy chain complementarity determining region 3 for antibody 406
ARRVAGPYCLDY

SEQ ID NO: 813 - protein, 10 aa, Homo sapiens
  light chain complementarity determining region 3 for antibody 407
QQYDNLPGFT

SEQ ID NO: 814 - protein, 13 aa, Homo sapiens
  heavy chain complementarity determining region 3 for antibody 407
AKEGSSPGPDFDY

SEQ ID NO: 815 - protein, 9 aa, Homo sapiens
  light chain complementarity determining region 3 for antibody 408
QQRSKWPGT

SEQ ID NO: 816 - protein, 13 aa, Homo sapiens
  heavy chain complementarity determining region 3 for antibody 408
AKEGSSPGPDFDS

SEQ ID NO: 817 - protein, 8 aa, Homo sapiens
  light chain complementarity determining region 3 for antibody 409
QQYHMYSD

SEQ ID NO: 818 - protein, 12 aa, Homo sapiens
  heavy chain complementarity determining region 3 for antibody 409
NADHGEVDGFDL

SEQ ID NO: 819 - protein, 9 aa, Homo sapiens
  light chain complementarity determining region 3 for antibody 410
QQYDSLPLT

SEQ ID NO: 820 - protein, 12 aa, Homo sapiens
  heavy chain complementarity determining region 3 for antibody 410
AKDCSGWGCFDS

SEQ ID NO: 821 - protein, 9 aa, Homo sapiens
  light chain complementarity determining region 3 for antibody 411
QKYGDSPVP

SEQ ID NO: 822 - protein, 18 aa, Homo sapiens
  heavy chain complementarity determining region 3 for antibody 411
ARGDYPEARTGYFLDFDY

SEQ ID NO: 823 - protein, 8 aa, Homo sapiens
  light chain complementarity determining region 3 for antibody 412
QHYKGFPA

SEQ ID NO: 824 - protein, 15 aa, Homo sapiens
  heavy chain complementarity determining region 3 for antibody 412
GRHVLSGSHPDYVDY

SEQ ID NO: 825 - protein, 9 aa, Homo sapiens
  light chain complementarity determining region 3 for antibody 413
LQDYNFPRT

SEQ ID NO: 826 - protein, 19 aa, Homo sapiens
  heavy chain complementarity determining region 3 for antibody 413
AREIVVPTADNGNKDAFDL

SEQ ID NO: 827 - protein, 9 aa, Homo sapiens
  light chain complementarity determining region 3 for antibody 414
QRYYNVPWT

SEQ ID NO: 828 - protein, 14 aa, Homo sapiens
  heavy chain complementarity determining region 3 for antibody 414
TRDGINTVVRGGDS

SEQ ID NO: 829 - protein, 9 aa, Homo sapiens
  light chain complementarity determining region 3 for antibody 415
MQTLHTPWT

SEQ ID NO: 830 - protein, 12 aa, Homo sapiens
  heavy chain complementarity determining region 3 for antibody 415
ARLLWQLRGLDV

SEQ ID NO: 831 - protein, 9 aa, Homo sapiens
  light chain complementarity determining region 3 for antibody 416
QQYNKYPWT

SEQ ID NO: 832 - protein, 14 aa, Homo sapiens
  heavy chain complementarity determining region 3 for antibody 416
VREEGSGWYRTADY

SEQ ID NO: 833 - protein, 10 aa, Homo sapiens
  light chain complementarity determining region 3 for antibody 417
QQYGSSSTWT

SEQ ID NO: 834 - protein, 20 aa, Homo sapiens
  heavy chain complementarity determining region 3 for antibody 417
TRDARGSISYAYGGGGGLDV

SEQ ID NO: 835 - protein, 9 aa, Homo sapiens
  light chain complementarity determining region 3 for antibody 418
MQVLQLPLT

SEQ ID NO: 836 - protein, 15 aa, Homo sapiens
  heavy chain complementarity determining region 3 for antibody 418
VRDPGGLAYFYNMEV

SEQ ID NO: 837 - protein, 9 aa, Homo sapiens
  light chain complementarity determining region 3 for antibody 419
LQDYSYPWT

SEQ ID NO: 838 - protein, 13 aa, Homo sapiens
  heavy chain complementarity determining region 3 for antibody 419
ARVNRGIFDAFDN

SEQ ID NO: 839 - protein, 9 aa, Homo sapiens
  light chain complementarity determining region 3 for antibody 420
QQYGSSSIT

SEQ ID NO: 840 - protein, 13 aa, Homo sapiens
  heavy chain complementarity determining region 3 for antibody 420
AKDLLKVLRFLEC

SEQ ID NO: 841 - protein, 10 aa, Homo sapiens
  light chain complementarity determining region 3 for antibody 421
MQGTHWPPIT

SEQ ID NO: 842 - protein, 11 aa, Homo sapiens
  heavy chain complementarity determining region 3 for antibody 421
AGGGAGTKVDS

SEQ ID NO: 843 - protein, 9 aa, Homo sapiens
  light chain complementarity determining region 3 for antibody 422
LHTFTAPRT

SEQ ID NO: 844 - protein, 15 aa, Homo sapiens
  heavy chain complementarity determining region 3 for antibody 422
SRDYIEASNLLRLEY

SEQ ID NO: 845 - protein, 9 aa, Homo sapiens
  light chain complementarity determining region 3 for antibody 423
QHYGGSTLS

SEQ ID NO: 846 - protein, 18 aa, Homo sapiens
  heavy chain complementarity determining region 3 for antibody 423
ATALADYDLLGLHFSLDS

SEQ ID NO: 847 - protein, 9 aa, Homo sapiens
  light chain complementarity determining region 3 for antibody 424
QQYYTPPYT

SEQ ID NO: 848 - protein, 10 aa, Homo sapiens
  heavy chain complementarity determining region 3 for antibody 424
TRSTYAYNDI

SEQ ID NO: 849 - protein, 9 aa, Homo sapiens
  light chain complementarity determining region 3 for antibody 425
QQYLKYPFT

SEQ ID NO: 850 - protein, 11 aa, Homo sapiens
  heavy chain complementarity determining region 3 for antibody 425
LRGSGMVPFDY

SEQ ID NO: 851 - protein, 10 aa, Homo sapiens
  light chain complementarity determining region 3 for antibody 426
QQYGSSPQET

SEQ ID NO: 852 - protein, 13 aa, Homo sapiens
  heavy chain complementarity determining region 3 for antibody 426
AKEGSSPGPDFEY

SEQ ID NO: 853 - protein, 9 aa, Homo sapiens
  light chain complementarity determining region 3 for antibody 427
QQYGSSALT

SEQ ID NO: 854 - protein, 13 aa, Homo sapiens
  heavy chain complementarity determining region 3 for antibody 427
AKDRGSGWYAWGY

SEQ ID NO: 855 - protein, 9 aa, Homo sapiens
  light chain complementarity determining region 3 for antibody 428
QQFANLPRT

SEQ ID NO: 856 - protein, 9 aa, Homo sapiens
  heavy chain complementarity determining region 3 for antibody 428
ARGRSNFRY

SEQ ID NO: 857 - protein, 9 aa, Homo sapiens
  light chain complementarity determining region 3 for antibody 429
QQAHTFPLT

SEQ ID NO: 858 - protein, 13 aa, Homo sapiens
  heavy chain complementarity determining region 3 for antibody 429
ARHPAAGGDWFDP

SEQ ID NO: 859 - protein, 9 aa, Homo sapiens
  light chain complementarity determining region 3 for antibody 430
QHSYNTPRT

SEQ ID NO: 860 - protein, 20 aa, Homo sapiens
  heavy chain complementarity determining region 3 for antibody 430
AREERMGASGGGYYYYGMDV

SEQ ID NO: 861 - protein, 9 aa, Homo sapiens
  light chain complementarity determining region 3 for antibody 431
MQFLQTPPT

SEQ ID NO: 862 - protein, 10 aa, Homo sapiens
  heavy chain complementarity determining region 3 for antibody 431
ARERSGSYDI

SEQ ID NO: 863 - protein, 7 aa, Homo sapiens
  light chain complementarity determining region 3 for antibody 432
QQYNSWT

SEQ ID NO: 864 - protein, 12 aa, Homo sapiens
  heavy chain complementarity determining region 3 for antibody 432
SRDKGGRNGMDV

SEQ ID NO: 865 - protein, 9 aa, Homo sapiens
  light chain complementarity determining region 3 for antibody 433
QQYKGYPNT

SEQ ID NO: 866 - protein, 8 aa, Homo sapiens
  heavy chain complementarity determining region 3 for antibody 433
TGGRYWDV

SEQ ID NO: 867 - protein, 9 aa, Homo sapiens
  light chain complementarity determining region 3 for antibody 434
QQSYSTPPT

SEQ ID NO: 868 - protein, 15 aa, Homo sapiens
  heavy chain complementarity determining region 3 for antibody 434
ARDPGVGELLYAFDV

SEQ ID NO: 869 - protein, 9 aa, Homo sapiens
  light chain complementarity determining region 3 for antibody 435
QQSYSSPWT

SEQ ID NO: 870 - protein, 15 aa, Homo sapiens
  heavy chain complementarity determining region 3 for antibody 435
ARIWTSSTNCRYMDV

SEQ ID NO: 871 - protein, 9 aa, Homo sapiens
  light chain complementarity determining region 3 for antibody 436
QQSHSVPRT

SEQ ID NO: 872 - protein, 10 aa, Homo sapiens
  heavy chain complementarity determining region 3 for antibody 436
VRDWWQREDF

SEQ ID NO: 873 - protein, 9 aa, Homo sapiens
  light chain complementarity determining region 3 for antibody 437
QQSYSHPLS

SEQ ID NO: 874 - protein, 9 aa, Homo sapiens
  heavy chain complementarity determining region 3 for antibody 437
ARSEYQPTY

SEQ ID NO: 875 - protein, 7 aa, Homo sapiens
  light chain complementarity determining region 3 for antibody 438
QCFGASS

SEQ ID NO: 876 - protein, 11 aa, Homo sapiens
  heavy chain complementarity determining region 3 for antibody 438
VRDVAYWRFDP

SEQ ID NO: 877 - protein, 9 aa, Homo sapiens
  light chain complementarity determining region 3 for antibody 439
QQSYSSPRT

SEQ ID NO: 878 - protein, 16 aa, Homo sapiens
  heavy chain complementarity determining region 3 for antibody 439
ARDFSYSSTSVWYFDV

SEQ ID NO: 879 - protein, 9 aa, Homo sapiens
  light chain complementarity determining region 3 for antibody 440
QHYYNWPRT

SEQ ID NO: 880 - protein, 14 aa, Homo sapiens
  heavy chain complementarity determining region 3 for antibody 440
AFQEYSGWSLVLDY

SEQ ID NO: 881 - protein, 9 aa, Homo sapiens
  light chain complementarity determining region 3 for antibody 441
QQYGSLPPT

SEQ ID NO: 882 - protein, 9 aa, Homo sapiens
  heavy chain complementarity determining region 3 for antibody 441
ARGNGFNLF

SEQ ID NO: 883 - protein, 9 aa, Homo sapiens
  light chain complementarity determining region 3 for antibody 442
MQGTHWPWT

SEQ ID NO: 884 - protein, 11 aa, Homo sapiens
  heavy chain complementarity determining region 3 for antibody 442
ARGGGVGTADY

SEQ ID NO: 885 - protein, 9 aa, Homo sapiens
  light chain complementarity determining region 3 for antibody 443
LQYYTAPWA

SEQ ID NO: 886 - protein, 17 aa, Homo sapiens
  heavy chain complementarity determining region 3 for antibody 443
SRDGRIIWPGSQGSLDS

SEQ ID NO: 887 - protein, 9 aa, Homo sapiens
  light chain complementarity determining region 3 for antibody 444
QQFDNFPRT

SEQ ID NO: 888 - protein, 9 aa, Homo sapiens
  heavy chain complementarity determining region 3 for antibody 444
ARGRSNWRY

SEQ ID NO: 889 - protein, 9 aa, Homo sapiens
  light chain complementarity determining region 3 for antibody 445
LQGLQVPFT

SEQ ID NO: 890 - protein, 11 aa, Homo sapiens
  heavy chain complementarity determining region 3 for antibody 445
GRDVDYSTPAF

SEQ ID NO: 891 - protein, 9 aa, Homo sapiens
  light chain complementarity determining region 3 for antibody 446
QHFENFPPT

SEQ ID NO: 892 - protein, 15 aa, Homo sapiens
  heavy chain complementarity determining region 3 for antibody 446
ARQSYGSGIYMVFES

SEQ ID NO: 893 - protein, 9 aa, Homo sapiens
  light chain complementarity determining region 3 for antibody 447
QQYNSYSRT

SEQ ID NO: 894 - protein, 23 aa, Homo sapiens
  heavy chain complementarity determining region 3 for antibody 447
TTGSPCWGPSNRYCSSNHCCYDS

SEQ ID NO: 895 - protein, 9 aa, Homo sapiens
  light chain complementarity determining region 3 for antibody 448
QQYGTSPVT

SEQ ID NO: 896 - protein, 19 aa, Homo sapiens
  heavy chain complementarity determining region 3 for antibody 448
AKGDSSGYPIYYYYYGVDV

SEQ ID NO: 897 - protein, 9 aa, Homo sapiens
  light chain complementarity determining region 3 for antibody 449
QQYAKSPIT

SEQ ID NO: 898 - protein, 14 aa, Homo sapiens
  heavy chain complementarity determining region 3 for antibody 449
ARASRGEIDFLIDS

SEQ ID NO: 899 - protein, 10 aa, Homo sapiens
  light chain complementarity determining region 3 for antibody 450
QHYGGSPRVT

SEQ ID NO: 900 - protein, 14 aa, Homo sapiens
  heavy chain complementarity determining region 3 for antibody 450
AREIIVRGTQQFDS

SEQ ID NO: 901 - protein, 9 aa, Homo sapiens
  light chain complementarity determining region 3 for antibody 451
MQASYWPNT

SEQ ID NO: 902 - protein, 11 aa, Homo sapiens
  heavy chain complementarity determining region 3 for antibody 451
ARGDGWNGLEY

SEQ ID NO: 903 - protein, 9 aa, Homo sapiens
  light chain complementarity determining region 3 for antibody 452
FQHNTYPWT

SEQ ID NO: 904 - protein, 12 aa, Homo sapiens
  heavy chain complementarity determining region 3 for antibody 452
ARLDWNYRAFDI

SEQ ID NO: 905 - protein, 7 aa, Homo sapiens
  light chain complementarity determining region 3 for antibody 453
YRHDRKK

SEQ ID NO: 906 - protein, 10 aa, Homo sapiens
  heavy chain complementarity determining region 3 for antibody 453
AREKLANYDC

SEQ ID NO: 907 - protein, 9 aa, Homo sapiens
  light chain complementarity determining region 3 for antibody 454
QQYNSYPWT

SEQ ID NO: 908 - protein, 15 aa, Homo sapiens
  heavy chain complementarity determining region 3 for antibody 454
AKEGPGYSGWLTGHY

SEQ ID NO: 909 - protein, 9 aa, Homo sapiens
  light chain complementarity determining region 3 for antibody 455
QQAQTYPLT

SEQ ID NO: 910 - protein, 14 aa, Homo sapiens
  heavy chain complementarity determining region 3 for antibody 455
ARDPYGDPSSDFDY

SEQ ID NO: 911 - protein, 9 aa, Homo sapiens
  light chain complementarity determining region 3 for antibody 456
QQANRHPKT

SEQ ID NO: 912 - protein, 12 aa, Homo sapiens
  heavy chain complementarity determining region 3 for antibody 456
TTGHRSGSYYDN

SEQ ID NO: 913 - protein, 9 aa, Homo sapiens
  light chain complementarity determining region 3 for antibody 457
QHSYNIPIT

SEQ ID NO: 914 - protein, 14 aa, Homo sapiens
  heavy chain complementarity determining region 3 for antibody 457
ARLHGSGLGRWLDP

SEQ ID NO: 915 - protein, 9 aa, Homo sapiens
  light chain complementarity determining region 3 for antibody 458
QQFSDIPRT

SEQ ID NO: 916 - protein, 9 aa, Homo sapiens
  heavy chain complementarity determining region 3 for antibody 458
ARGRNNFRR

SEQ ID NO: 917 - protein, 9 aa, Homo sapiens
  light chain complementarity determining region 3 for antibody 459
QQFNSYPYT

SEQ ID NO: 918 - protein, 11 aa, Homo sapiens
  heavy chain complementarity determining region 3 for antibody 459
AREQHGQAPDY

SEQ ID NO: 919 - protein, 8 aa, Homo sapiens
  light chain complementarity determining region 3 for antibody 460
QHYKGFPA

SEQ ID NO: 920 - protein, 15 aa, Homo sapiens
  heavy chain complementarity determining region 3 for antibody 460
GRHVFSGSYPDYVDF

SEQ ID NO: 921 - protein, 9 aa, Homo sapiens
  light chain complementarity determining region 3 for antibody 461
MQGTHWPYT

SEQ ID NO: 922 - protein, 8 aa, Homo sapiens
  heavy chain complementarity determining region 3 for antibody 461
ARGVWFAG

SEQ ID NO: 923 - protein, 9 aa, Homo sapiens
  light chain complementarity determining region 3 for antibody 462
MQATHWPRT

SEQ ID NO: 924 - protein, 9 aa, Homo sapiens
  heavy chain complementarity determining region 3 for antibody 462
VKGVISLDY

SEQ ID NO: 925 - protein, 8 aa, Homo sapiens
  light chain complementarity determining region 3 for antibody 463
QQYSSCCT

SEQ ID NO: 926 - protein, 15 aa, Homo sapiens
  heavy chain complementarity determining region 3 for antibody 463
GRGITGTVHPYHFDY

SEQ ID NO: 927 - protein, 9 aa, Homo sapiens
  light chain complementarity determining region 3 for antibody 464
QQRSNWLFT

SEQ ID NO: 928 - protein, 14 aa, Homo sapiens
  heavy chain complementarity determining region 3 for antibody 464
TRGVLTGGMWYFDL

SEQ ID NO: 929 - protein, 9 aa, Homo sapiens
  light chain complementarity determining region 3 for antibody 465
QQSYSTPYT

SEQ ID NO: 930 - protein, 13 aa, Homo sapiens
  heavy chain complementarity determining region 3 for antibody 465
AKEGSSAGPDFDY

SEQ ID NO: 931 - protein, 9 aa, Homo sapiens
  light chain complementarity determining region 3 for antibody 466
QQSYSTPWT

SEQ ID NO: 932 - protein, 14 aa, Homo sapiens
  heavy chain complementarity determining region 3 for antibody 466
ARLHGSGLGRWLDP

SEQ ID NO: 933 - protein, 9 aa, Homo sapiens
  light chain complementarity determining region 3 for antibody 467
MQTLQTPWT

SEQ ID NO: 934 - protein, 13 aa, Homo sapiens
  heavy chain complementarity determining region 3 for antibody 467
AKRYSTNWGHFDY

SEQ ID NO: 935 - protein, 9 aa, Homo sapiens
  light chain complementarity determining region 3 for antibody 468
QQYTGYPLT

SEQ ID NO: 936 - protein, 11 aa, Homo sapiens
  heavy chain complementarity determining region 3 for antibody 468
ARHGRPYGMAV

SEQ ID NO: 937 - protein, 10 aa, Homo sapiens
  light chain complementarity determining region 3 for antibody 469
QQYGNSPSVT

SEQ ID NO: 938 - protein, 18 aa, Homo sapiens
  heavy chain complementarity determining region 3 for antibody 469
ATPQKYYDSWSGYPPFDY

SEQ ID NO: 939 - protein, 9 aa, Homo sapiens
  light chain complementarity determining region 3 for antibody 470
LQHNAYPLS

SEQ ID NO: 940 - protein, 11 aa, Homo sapiens
  heavy chain complementarity determining region 3 for antibody 470
VRVSIGWYLDY

SEQ ID NO: 941 - protein, 9 aa, Homo sapiens
  light chain complementarity determining region 3 for antibody 471
QQFDSFPRT

SEQ ID NO: 942 - protein, 9 aa, Homo sapiens
  heavy chain complementarity determining region 3 for antibody 471
ARGRNNFRY

SEQ ID NO: 943 - protein, 9 aa, Homo sapiens
  light chain complementarity determining region 3 for antibody 472
MQYTHWPHT

SEQ ID NO: 944 - protein, 8 aa, Homo sapiens
  heavy chain complementarity determining region 3 for antibody 472
AGWSYANY

SEQ ID NO: 945 - protein, 10 aa, Homo sapiens
  light chain complementarity determining region 3 for antibody 473
MQGTHWPPIT

SEQ ID NO: 946 - protein, 16 aa, Homo sapiens
  heavy chain complementarity determining region 3 for antibody 473
ARHGVLPAAIHDAFDI

SEQ ID NO: 947 - protein, 9 aa, Homo sapiens
  light chain complementarity determining region 3 for antibody 474
QQYYSAPIT

SEQ ID NO: 948 - protein, 14 aa, Homo sapiens
  heavy chain complementarity determining region 3 for antibody 474
AKGESTSCDYIFDF

SEQ ID NO: 949 - protein, 9 aa, Homo sapiens
  light chain complementarity determining region 3 for antibody 475
QQYDRAPDT

SEQ ID NO: 950 - protein, 11 aa, Homo sapiens
  heavy chain complementarity determining region 3 for antibody 475
AKEATETTPGY

SEQ ID NO: 951 - protein, 9 aa, Homo sapiens
  light chain complementarity determining region 3 for antibody 476
QQYNSYPHT

SEQ ID NO: 952 - protein, 9 aa, Homo sapiens
  heavy chain complementarity determining region 3 for antibody 476
ATDRSWFDP

SEQ ID NO: 953 - protein, 9 aa, Homo sapiens
  light chain complementarity determining region 3 for antibody 477
QQYNRYPWT

SEQ ID NO: 954 - protein, 14 aa, Homo sapiens
  heavy chain complementarity determining region 3 for antibody 477
VREQGTGYYRTADY

SEQ ID NO: 955 - protein, 9 aa, Homo sapiens
  light chain complementarity determining region 3 for antibody 478
QQYGTSPFT

SEQ ID NO: 956 - protein, 13 aa, Homo sapiens
  heavy chain complementarity determining region 3 for antibody 478
ARGSVAGRSSFDS

SEQ ID NO: 957 - protein, 9 aa, Homo sapiens
  light chain complementarity determining region 3 for antibody 479
QQYAASPLT

SEQ ID NO: 958 - protein, 9 aa, Homo sapiens
  heavy chain complementarity determining region 3 for antibody 479
TRATWLLDY

SEQ ID NO: 959 - protein, 8 aa, Homo sapiens
  light chain complementarity determining region 3 for antibody 480
QQSYTTPT

SEQ ID NO: 960 - protein, 10 aa, Homo sapiens
  heavy chain complementarity determining region 3 for antibody 480
AKGGLAGEND

SEQ ID NO: 961 - protein, 10 aa, Homo sapiens
  light chain complementarity determining region 3 for antibody 481
QQSYSTLTWT

SEQ ID NO: 962 - protein, 11 aa, Homo sapiens
  heavy chain complementarity determining region 3 for antibody 481
AGSSGYYAIDN

SEQ ID NO: 963 - protein, 9 aa, Homo sapiens
  light chain complementarity determining region 3 for antibody 482
QHYKAYPHT

SEQ ID NO: 964 - protein, 17 aa, Homo sapiens
  heavy chain complementarity determining region 3 for antibody 482
ARNTMVGTWQRQGNLDH

SEQ ID NO: 965 - protein, 10 aa, Homo sapiens
  light chain complementarity determining region 3 for antibody 483
QQYDNLPPLT

SEQ ID NO: 966 - protein, 10 aa, Homo sapiens
  heavy chain complementarity determining region 3 for antibody 483
ARGGLAGDIQ

SEQ ID NO: 967 - protein, 9 aa, Homo sapiens
  light chain complementarity determining region 3 for antibody 484
QQLNSYPIS

SEQ ID NO: 968 - protein, 14 aa, Homo sapiens
  heavy chain complementarity determining region 3 for antibody 484
VRETTHNWTDGGIY

SEQ ID NO: 969 - protein, 9 aa, Homo sapiens
  light chain complementarity determining region 3 for antibody 485
LQYYTAPWT

SEQ ID NO: 970 - protein, 17 aa, Homo sapiens
  heavy chain complementarity determining region 3 for antibody 485
SRDGRIEWPGSQGSLDS

SEQ ID NO: 971 - protein, 9 aa, Homo sapiens
  light chain complementarity determining region 3 for antibody 486
LQHNSYPWT

SEQ ID NO: 972 - protein, 15 aa, Homo sapiens
  heavy chain complementarity determining region 3 for antibody 486
ATDMAGVTPDGYCDY

SEQ ID NO: 973 - protein, 7 aa, Homo sapiens
  light chain complementarity determining region 3 for antibody 487
QQYSSWT

SEQ ID NO: 974 - protein, 12 aa, Homo sapiens
  heavy chain complementarity determining region 3 for antibody 487
VKDRGGRSGMDL

SEQ ID NO: 975 - protein, 9 aa, Homo sapiens
  light chain complementarity determining region 3 for antibody 488
QQYNDWPRT

SEQ ID NO: 976 - protein, 17 aa, Homo sapiens
  heavy chain complementarity determining region 3 for antibody 488
ARDLPSRCSRTSCAFDY

SEQ ID NO: 977 - protein, 7 aa, Homo sapiens
  light chain complementarity determining region 3 for antibody 489
QQYGSYT

SEQ ID NO: 978 - protein, 10 aa, Homo sapiens
  heavy chain complementarity determining region 3 for antibody 489
ARRWQRYFDY

SEQ ID NO: 979 - protein, 9 aa, Homo sapiens
  light chain complementarity determining region 3 for antibody 490
QQYGSSPQT

SEQ ID NO: 980 - protein, 10 aa, Homo sapiens
  heavy chain complementarity determining region 3 for antibody 490
AKYLRRAFDV

SEQ ID NO: 981 - protein, 9 aa, Homo sapiens
  light chain complementarity determining region 3 for antibody 491
QQRSNWPPL

SEQ ID NO: 982 - protein, 11 aa, Homo sapiens
  heavy chain complementarity determining region 3 for antibody 491
AKDFRYGFHSE

SEQ ID NO: 983 - protein, 9 aa, Homo sapiens
  light chain complementarity determining region 3 for antibody 492
QQLHASPYT

SEQ ID NO: 984 - protein, 14 aa, Homo sapiens
  heavy chain complementarity determining region 3 for antibody 492
TRGHFDTTGFRLDY

SEQ ID NO: 985 - protein, 9 aa, Homo sapiens
  light chain complementarity determining region 3 for antibody 493
QNYNIAPWT

SEQ ID NO: 986 - protein, 16 aa, Homo sapiens
  heavy chain complementarity determining region 3 for antibody 493
TRDIGWGDSGPRGMDV

SEQ ID NO: 987 - protein, 9 aa, Homo sapiens
  light chain complementarity determining region 3 for antibody 494
QQYNNWPRT

SEQ ID NO: 988 - protein, 10 aa, Homo sapiens
  heavy chain complementarity determining region 3 for antibody 494
VTSLLDGTTR

SEQ ID NO: 989 - protein, 8 aa, Homo sapiens
  light chain complementarity determining region 3 for antibody 495
QQYGSSLT

SEQ ID NO: 990 - protein, 19 aa, Homo sapiens
  heavy chain complementarity determining region 3 for antibody 495
ARRIYCSSTSCYKFDALDM

SEQ ID NO: 991 - protein, 8 aa, Homo sapiens
  light chain complementarity determining region 3 for antibody 496
QQYGNSLT

SEQ ID NO: 992 - protein, 18 aa, Homo sapiens
  heavy chain complementarity determining region 3 for antibody 496
VRWAGIANNDFWSGPFDN

SEQ ID NO: 993 - protein, 9 aa, Homo sapiens
  light chain complementarity determining region 3 for antibody 497
LQHNTYPWT

SEQ ID NO: 994 - protein, 10 aa, Homo sapiens
  heavy chain complementarity determining region 3 for antibody 497
ARETSGSYDI

SEQ ID NO: 995 - protein, 9 aa, Homo sapiens
  light chain complementarity determining region 3 for antibody 498
RQYDNLPLT

SEQ ID NO: 996 - protein, 12 aa, Homo sapiens
  heavy chain complementarity determining region 3 for antibody 498
AIVVPGRWDLDD

SEQ ID NO: 997 - protein, 9 aa, Homo sapiens
  light chain complementarity determining region 3 for antibody 499
QQYAKSPIT

SEQ ID NO: 998 - protein, 14 aa, Homo sapiens
  heavy chain complementarity determining region 3 for antibody 499
ARASRGDVSFLIVS

SEQ ID NO: 999 - protein, 9 aa, Homo sapiens
  light chain complementarity determining region 3 for antibody 500
MQGTHWPYT

SEQ ID NO: 1000 - protein, 8 aa, Homo sapiens
  heavy chain complementarity determining region 3 for antibody 500
ARGNWYAG

SEQ ID NO: 1001 - protein, 9 aa, Homo sapiens
  light chain complementarity determining region 3 for antibody 501
LQYAHWPHT

SEQ ID NO: 1002 - protein, 9 aa, Homo sapiens
  heavy chain complementarity determining region 3 for antibody 501
AGWGGASNY

SEQ ID NO: 1003 - protein, 9 aa, Homo sapiens
  light chain complementarity determining region 3 for antibody 502
QQYYGSPLT

SEQ ID NO: 1004 - protein, 14 aa, Homo sapiens
  heavy chain complementarity determining region 3 for antibody 502
AKPTRGPGSFLIDY

SEQ ID NO: 1005 - protein, 9 aa, Homo sapiens
  light chain complementarity determining region 3 for antibody 503
QQTYRTPYT

SEQ ID NO: 1006 - protein, 14 aa, Homo sapiens
  heavy chain complementarity determining region 3 for antibody 503
ARLHGSGLGRWLDA

SEQ ID NO: 1007 - protein, 9 aa, Homo sapiens
  light chain complementarity determining region 3 for antibody 504
QQHYTAPYT

SEQ ID NO: 1008 - protein, 10 aa, Homo sapiens
  heavy chain complementarity determining region 3 for antibody 504
ARDISRHMDV

SEQ ID NO: 1009 - protein, 9 aa, Homo sapiens
  light chain complementarity determining region 3 for antibody 505
QKYGDSPVP

SEQ ID NO: 1010 - protein, 18 aa, Homo sapiens
  heavy chain complementarity determining region 3 for antibody 505
ARGDYPEARTAYFLDFDY

SEQ ID NO: 1011 - protein, 9 aa, Homo sapiens
  light chain complementarity determining region 3 for antibody 506
LQHSSYPYT

SEQ ID NO: 1012 - protein, 12 aa, Homo sapiens
  heavy chain complementarity determining region 3 for antibody 506
TVRLVDPGYFDF

SEQ ID NO: 1013 - protein, 9 aa, Homo sapiens
  light chain complementarity determining region 3 for antibody 507
QQSYSTPFT

SEQ ID NO: 1014 - protein, 15 aa, Homo sapiens
  heavy chain complementarity determining region 3 for antibody 507
VRIWTNHRGIHYFDF

SEQ ID NO: 1015 - protein, 9 aa, Homo sapiens
  light chain complementarity determining region 3 for antibody 508
QQFRDLPRT

SEQ ID NO: 1016 - protein, 9 aa, Homo sapiens
  heavy chain complementarity determining region 3 for antibody 508
VRGRSNFRH

SEQ ID NO: 1017 - protein, 9 aa, Homo sapiens
  light chain complementarity determining region 3 for antibody 509
QEYKTPPWT

SEQ ID NO: 1018 - protein, 20 aa, Homo sapiens
  heavy chain complementarity determining region 3 for antibody 509
ATDGRGIADYDHSGGGGLDV

SEQ ID NO: 1019 - protein, 8 aa, Homo sapiens
  light chain complementarity determining region 3 for antibody 510
QQYDLSLT

SEQ ID NO: 1020 - protein, 14 aa, Homo sapiens
  heavy chain complementarity determining region 3 for antibody 510
ARGTPGDYTDYFPY

SEQ ID NO: 1021 - protein, 9 aa, Homo sapiens
  light chain complementarity determining region 3 for antibody 511
MQGTHWPWA

SEQ ID NO: 1022 - protein, 12 aa, Homo sapiens
  heavy chain complementarity determining region 3 for antibody 511
AIVVPGRWDLDD

SEQ ID NO: 1023 - protein, 9 aa, Homo sapiens
  light chain complementarity determining region 3 for antibody 512
MHATQWPLT

SEQ ID NO: 1024 - protein, 10 aa, Homo sapiens
  heavy chain complementarity determining region 3 for antibody 512
VKDFWSNVHY

SEQ ID NO: 1025 - protein, 9 aa, Homo sapiens
  light chain complementarity determining region 3 for antibody 513
QQYNNWPQT

SEQ ID NO: 1026 - protein, 16 aa, Homo sapiens
  heavy chain complementarity determining region 3 for antibody 513
ARDLWVAAWYPGALDV

SEQ ID NO: 1027 - protein, 9 aa, Homo sapiens
  light chain complementarity determining region 3 for antibody 514
QQYKTYPWT

SEQ ID NO: 1028 - protein, 14 aa, Homo sapiens
  heavy chain complementarity determining region 3 for antibody 514
AREEGTGWYRTSDY

SEQ ID NO: 1029 - protein, 9 aa, Homo sapiens
  light chain complementarity determining region 3 for antibody 515
QQTYRTPYT

SEQ ID NO: 1030 - protein, 14 aa, Homo sapiens
  heavy chain complementarity determining region 3 for antibody 515
ARLHGSDLGRWLDP

SEQ ID NO: 1031 - protein, 9 aa, Homo sapiens
  light chain complementarity determining region 3 for antibody 516
QQSYSTPYT

SEQ ID NO: 1032 - protein, 17 aa, Homo sapiens
  heavy chain complementarity determining region 3 for antibody 516
SRDGRIIWPGSQGSLDS

SEQ ID NO: 1033 - protein, 9 aa, Homo sapiens
  light chain complementarity determining region 3 for antibody 517
LQHNTYPWT

SEQ ID NO: 1034 - protein, 18 aa, Homo sapiens
  heavy chain complementarity determining region 3 for antibody 517
VRGPSGAPGAMAYYYLDV

SEQ ID NO: 1035 - protein, 9 aa, Homo sapiens
  light chain complementarity determining region 3 for antibody 518
QQYNDYPLT

SEQ ID NO: 1036 - protein, 10 aa, Homo sapiens
  heavy chain complementarity determining region 3 for antibody 518
VRVGPESSRS

SEQ ID NO: 1037 - protein, 9 aa, Homo sapiens
  light chain complementarity determining region 3 for antibody 519
QQYGSSPYT

SEQ ID NO: 1038 - protein, 8 aa, Homo sapiens
  heavy chain complementarity determining region 3 for antibody 519
ARYYGMGT

SEQ ID NO: 1039 - protein, 9 aa, Homo sapiens
  light chain complementarity determining region 3 for antibody 520
HQYSSIPFT

SEQ ID NO: 1040 - protein, 12 aa, Homo sapiens
  heavy chain complementarity determining region 3 for antibody 520
ARGLTEGAAFDV

SEQ ID NO: 1041 - protein, 9 aa, Homo sapiens
  light chain complementarity determining region 3 for antibody 521
QQYYNAPLT

SEQ ID NO: 1042 - protein, 14 aa, Homo sapiens
  heavy chain complementarity determining region 3 for antibody 521
ASGSATPGTFLVDF

SEQ ID NO: 1043 - protein, 9 aa, Homo sapiens
  light chain complementarity determining region 3 for antibody 522
QQRSNWPLT

SEQ ID NO: 1044 - protein, 18 aa, Homo sapiens
  heavy chain complementarity determining region 3 for antibody 522
ARDGGYCTSGTCWNYFDY

SEQ ID NO: 1045 - protein, 9 aa, Homo sapiens
  light chain complementarity determining region 3 for antibody 523
QQLYNYPVT

SEQ ID NO: 1046 - protein, 18 aa, Homo sapiens
  heavy chain complementarity determining region 3 for antibody 523
ARGDYPEARSDYYLDFDY

SEQ ID NO: 1047 - protein, 9 aa, Homo sapiens
  light chain complementarity determining region 3 for antibody 524
IQATHWPLT

SEQ ID NO: 1048 - protein, 10 aa, Homo sapiens
  heavy chain complementarity determining region 3 for antibody 524
VYDFWSPRHY

SEQ ID NO: 1049 - protein, 10 aa, Homo sapiens
  light chain complementarity determining region 3 for antibody 525
HHYGSSPRGT

SEQ ID NO: 1050 - protein, 17 aa, Homo sapiens
  heavy chain complementarity determining region 3 for antibody 525
ARPRDEYEFWSGYFFDY

SEQ ID NO: 1051 - protein, 9 aa, Homo sapiens
  light chain complementarity determining region 3 for antibody 526
QQRSNWPLT

SEQ ID NO: 1052 - protein, 14 aa, Homo sapiens
  heavy chain complementarity determining region 3 for antibody 526
ARDQPMQQWAYIDD

SEQ ID NO: 1053 - protein, 9 aa, Homo sapiens
  light chain complementarity determining region 3 for antibody 527
QQLMGYPYT

SEQ ID NO: 1054 - protein, 14 aa, Homo sapiens
  heavy chain complementarity determining region 3 for antibody 527
ARGHFDSTGFRLDY

SEQ ID NO: 1055 - protein, 9 aa, Homo sapiens
  light chain complementarity determining region 3 for antibody 528
QNYNSVPLT

SEQ ID NO: 1056 - protein, 10 aa, Homo sapiens
  heavy chain complementarity determining region 3 for antibody 528
AREGYYALDY

SEQ ID NO: 1057 - protein, 9 aa, Homo sapiens
  light chain complementarity determining region 3 for antibody 529
LQFYTAPWA

SEQ ID NO: 1058 - protein, 17 aa, Homo sapiens
  heavy chain complementarity determining region 3 for antibody 529
ARDGRIEWPGSHGSLDS

SEQ ID NO: 1059 - protein, 9 aa, Homo sapiens
  light chain complementarity determining region 3 for antibody 530
QQYDTLPLT

SEQ ID NO: 1060 - protein, 21 aa, Homo sapiens
  heavy chain complementarity determining region 3 for antibody 530
ARATQRRFCSTTSCYTDAFDV

SEQ ID NO: 1061 - protein, 9 aa, Homo sapiens
  light chain complementarity determining region 3 for antibody 531
QQSYTMPRT

SEQ ID NO: 1062 - protein, 18 aa, Homo sapiens
  heavy chain complementarity determining region 3 for antibody 531
TTVLSQLLAGDWHLYFHH

SEQ ID NO: 1063 - protein, 9 aa, Homo sapiens
  light chain complementarity determining region 3 for antibody 532
LQYYTAPWA

SEQ ID NO: 1064 - protein, 17 aa, Homo sapiens
  heavy chain complementarity determining region 3 for antibody 532
SRDGRIVWPGSQGTLDS

SEQ ID NO: 1065 - protein, 9 aa, Homo sapiens
  light chain complementarity determining region 3 for antibody 533
LQHNSYPWT

SEQ ID NO: 1066 - protein, 12 aa, Homo sapiens
  heavy chain complementarity determining region 3 for antibody 533
TRSGAGRDYLDY

SEQ ID NO: 1067 - protein, 9 aa, Homo sapiens
  light chain complementarity determining region 3 for antibody 534
HQYAITPWT

SEQ ID NO: 1068 - protein, 11 aa, Homo sapiens
  heavy chain complementarity determining region 3 for antibody 534
ARGRDQSKLGY

SEQ ID NO: 1069 - protein, 11 aa, Homo sapiens
  light chain complementarity determining region 3 for antibody 535
QQYGNSPPGYT

SEQ ID NO: 1070 - protein, 13 aa, Homo sapiens
  heavy chain complementarity determining region 3 for antibody 535
ALVRSISCLSFHY

SEQ ID NO: 1071 - protein, 9 aa, Homo sapiens
  light chain complementarity determining region 3 for antibody 536
QQTSRTPYT

SEQ ID NO: 1072 - protein, 14 aa, Homo sapiens
  heavy chain complementarity determining region 3 for antibody 536
ARLHGSGLGRWFDP

SEQ ID NO: 1073 - protein, 9 aa, Homo sapiens
  light chain complementarity determining region 3 for antibody 537
QQSYSMPRT

SEQ ID NO: 1074 - protein, 18 aa, Homo sapiens
  heavy chain complementarity determining region 3 for antibody 537
VTVLSQLLTGNWYLYFQH

SEQ ID NO: 1075 - protein, 9 aa, Homo sapiens
  light chain complementarity determining region 3 for antibody 538
QQDYFTPRT

SEQ ID NO: 1076 - protein, 11 aa, Homo sapiens
  heavy chain complementarity determining region 3 for antibody 538
ARRSLGGAFDY

SEQ ID NO: 1077 - protein, 9 aa, Homo sapiens
  light chain complementarity determining region 3 for antibody 539
QHYKNWPFS

SEQ ID NO: 1078 - protein, 13 aa, Homo sapiens
  heavy chain complementarity determining region 3 for antibody 539
AKRSASGDYYFDS

SEQ ID NO: 1079 - protein, 9 aa, Homo sapiens
  light chain complementarity determining region 3 for antibody 540
QEANSLPVT

SEQ ID NO: 1080 - protein, 13 aa, Homo sapiens
  heavy chain complementarity determining region 3 for antibody 540
AKEGSSPGPDFEY

SEQ ID NO: 1081 - protein, 9 aa, Homo sapiens
  light chain complementarity determining region 3 for antibody 541
QQYKIYPWT

SEQ ID NO: 1082 - protein, 12 aa, Homo sapiens
  heavy chain complementarity determining region 3 for antibody 541
AGSRSGGGSIDY

SEQ ID NO: 1083 - protein, 9 aa, Homo sapiens
  light chain complementarity determining region 3 for antibody 542
QQFNSYPYT

SEQ ID NO: 1084 - protein, 9 aa, Homo sapiens
  heavy chain complementarity determining region 3 for antibody 542
ARFWTYGRR

SEQ ID NO: 1085 - protein, 9 aa, Homo sapiens
  light chain complementarity determining region 3 for antibody 543
QERSTWPGS

SEQ ID NO: 1086 - protein, 13 aa, Homo sapiens
  heavy chain complementarity determining region 3 for antibody 543
ATGAWASSWWGDY

SEQ ID NO: 1087 - protein, 9 aa, Homo sapiens
  light chain complementarity determining region 3 for antibody 544
MQALQAPLT

SEQ ID NO: 1088 - protein, 14 aa, Homo sapiens
  heavy chain complementarity determining region 3 for antibody 544
ARNAFTGSVYANTY

SEQ ID NO: 1089 - protein, 9 aa, Homo sapiens
  light chain complementarity determining region 3 for antibody 545
LQDYNYPLT

SEQ ID NO: 1090 - protein, 14 aa, Homo sapiens
  heavy chain complementarity determining region 3 for antibody 545
ARLHGSGLGRWLDP

SEQ ID NO: 1091 - protein, 9 aa, Homo sapiens
  light chain complementarity determining region 3 for antibody 546
LQDYIYPFS

SEQ ID NO: 1092 - protein, 16 aa, Homo sapiens
  heavy chain complementarity determining region 3 for antibody 546
TSDVGDHRDSYTTLDF

SEQ ID NO: 1093 - protein, 9 aa, Homo sapiens
  light chain complementarity determining region 3 for antibody 547
QQYYSAPQA

SEQ ID NO: 1094 - protein, 9 aa, Homo sapiens
  heavy chain complementarity determining region 3 for antibody 547
ARDVWPEDY

SEQ ID NO: 1095 - protein, 8 aa, Homo sapiens
  light chain complementarity determining region 3 for antibody 548
QQYNTFYS

SEQ ID NO: 1096 - protein, 10 aa, Homo sapiens
  heavy chain complementarity determining region 3 for antibody 548
VYDFWSPRHY

SEQ ID NO: 1097 - protein, 10 aa, Homo sapiens
  light chain complementarity determining region 3 for antibody 549
QQYNKWPPWR

SEQ ID NO: 1098 - protein, 15 aa, Homo sapiens
  heavy chain complementarity determining region 3 for antibody 549
ARDIRVGASEYYFDR

SEQ ID NO: 1099 - protein, 10 aa, Homo sapiens
  light chain complementarity determining region 3 for antibody 550
QQYDSSSPRT

SEQ ID NO: 1100 - protein, 9 aa, Homo sapiens
  heavy chain complementarity determining region 3 for antibody 550
ARGNKYPGG

SEQ ID NO: 1101 - protein, 10 aa, Homo sapiens
  light chain complementarity determining region 3 for antibody 551
QQRANWPQYT

SEQ ID NO: 1102 - protein, 13 aa, Homo sapiens
  heavy chain complementarity determining region 3 for antibody 551
AKPIYSGSGSPDY

SEQ ID NO: 1103 - protein, 9 aa, Homo sapiens
  light chain complementarity determining region 3 for antibody 552
QHYGHSLFI

SEQ ID NO: 1104 - protein, 10 aa, Homo sapiens
  heavy chain complementarity determining region 3 for antibody 552
TSESWGKFDY

SEQ ID NO: 1105 - protein, 9 aa, Homo sapiens
  light chain complementarity determining region 3 for antibody 553
LQHNTYPWT

SEQ ID NO: 1106 - protein, 12 aa, Homo sapiens
  heavy chain complementarity determining region 3 for antibody 553
TRSGAGRDYLDY

SEQ ID NO: 1107 - protein, 9 aa, Homo sapiens
  light chain complementarity determining region 3 for antibody 554
LQHNSYPWT

SEQ ID NO: 1108 - protein, 15 aa, Homo sapiens
  heavy chain complementarity determining region 3 for antibody 554
ATDLAGITPDGYCDN

SEQ ID NO: 1109 - protein, 10 aa, Homo sapiens
  light chain complementarity determining region 3 for antibody 555
LHYAGSPWIT

SEQ ID NO: 1110 - protein, 6 aa, Homo sapiens
  heavy chain complementarity determining region 3 for antibody 555
ARFFEF

SEQ ID NO: 1111 - protein, 9 aa, Homo sapiens
  light chain complementarity determining region 3 for antibody 556
QQYGSSLWT

SEQ ID NO: 1112 - protein, 19 aa, Homo sapiens
  heavy chain complementarity determining region 3 for antibody 556
ARYGRYLVVEPAAKDAFDI

SEQ ID NO: 1113 - protein, 10 aa, Homo sapiens
  light chain complementarity determining region 3 for antibody 557
QQSYSTPLIT

SEQ ID NO: 1114 - protein, 12 aa, Homo sapiens
  heavy chain complementarity determining region 3 for antibody 557
NADHGYVDGFDI

SEQ ID NO: 1115 - protein, 9 aa, Homo sapiens
  light chain complementarity determining region 3 for antibody 558
QQGHSFPLT

SEQ ID NO: 1116 - protein, 13 aa, Homo sapiens
  heavy chain complementarity determining region 3 for antibody 558
VRDRNGPHYYMDV

SEQ ID NO: 1117 - protein, 9 aa, Homo sapiens
  light chain complementarity determining region 3 for antibody 559
QQFDSLPRT

SEQ ID NO: 1118 - protein, 9 aa, Homo sapiens
  heavy chain complementarity determining region 3 for antibody 559
ARGRSNFRF

SEQ ID NO: 1119 - protein, 8 aa, Homo sapiens
  light chain complementarity determining region 3 for antibody 560
MQGTYWPT

SEQ ID NO: 1120 - protein, 11 aa, Homo sapiens
  heavy chain complementarity determining region 3 for antibody 560
TRGLKANDIDV

SEQ ID NO: 1121 - protein, 9 aa, Homo sapiens
  light chain complementarity determining region 3 for antibody 561
QQYHRYPHT

SEQ ID NO: 1122 - protein, 14 aa, Homo sapiens
  heavy chain complementarity determining region 3 for antibody 561
ARDVHTTGWTLGGY

SEQ ID NO: 1123 - protein, 9 aa, Homo sapiens
  light chain complementarity determining region 3 for antibody 562
QQYGTSPKT

SEQ ID NO: 1124 - protein, 15 aa, Homo sapiens
  heavy chain complementarity determining region 3 for antibody 562
TTEDITGVQGEPLDY

SEQ ID NO: 1125 - protein, 10 aa, Homo sapiens
  light chain complementarity determining region 3 for antibody 563
QQYGNSHTWT

SEQ ID NO: 1126 - protein, 19 aa, Homo sapiens
  heavy chain complementarity determining region 3 for antibody 563
ARHNYGDSFGVSRTNGMDV

SEQ ID NO: 1127 - protein, 10 aa, Homo sapiens
  light chain complementarity determining region 3 for antibody 564
QQRYNWPPYT

SEQ ID NO: 1128 - protein, 12 aa, Homo sapiens
  heavy chain complementarity determining region 3 for antibody 564
VREYSSGWYAGY

SEQ ID NO: 1129 - protein, 9 aa, Homo sapiens
  light chain complementarity determining region 3 for antibody 565
QQGYTFPPT

SEQ ID NO: 1130 - protein, 10 aa, Homo sapiens
  heavy chain complementarity determining region 3 for antibody 565
ARDISRHMDV

SEQ ID NO: 1131 - protein, 10 aa, Homo sapiens
  light chain complementarity determining region 3 for antibody 566
QERSNWPPFT

SEQ ID NO: 1132 - protein, 10 aa, Homo sapiens
  heavy chain complementarity determining region 3 for antibody 566
ARDYYSPFDY

SEQ ID NO: 1133 - protein, 9 aa, Homo sapiens
  light chain complementarity determining region 3 for antibody 567
MQTLQTPWT

SEQ ID NO: 1134 - protein, 10 aa, Homo sapiens
  heavy chain complementarity determining region 3 for antibody 567
CRDREGFGDV

SEQ ID NO: 1135 - protein, 9 aa, Homo sapiens
  light chain complementarity determining region 3 for antibody 568
QQYKSYSRT

SEQ ID NO: 1136 - protein, 17 aa, Homo sapiens
  heavy chain complementarity determining region 3 for antibody 568
AKSLGSCRSSTCEIFDS

SEQ ID NO: 1137 - protein, 9 aa, Homo sapiens
  light chain complementarity determining region 3 for antibody 569
QQLMVYPYT

SEQ ID NO: 1138 - protein, 14 aa, Homo sapiens
  heavy chain complementarity determining region 3 for antibody 569
ARGHFDTTGFRLDY

SEQ ID NO: 1139 - protein, 10 aa, Homo sapiens
  light chain complementarity determining region 3 for antibody 570
MQGTHWPAWT

SEQ ID NO: 1140 - protein, 13 aa, Homo sapiens
  heavy chain complementarity determining region 3 for antibody 570
VTWVESNTGWLDY

SEQ ID NO: 1141 - protein, 9 aa, Homo sapiens
  light chain complementarity determining region 3 for antibody 571
MHATQWPLT

SEQ ID NO: 1142 - protein, 10 aa, Homo sapiens
  heavy chain complementarity determining region 3 for antibody 571
VKDFWSNFHY

SEQ ID NO: 1143 - protein, 9 aa, Homo sapiens
  light chain complementarity determining region 3 for antibody 572
LQHNTYPWT

SEQ ID NO: 1144 - protein, 18 aa, Homo sapiens
  heavy chain complementarity determining region 3 for antibody 572
IRGPSGAPGAMAYYYLDV

SEQ ID NO: 1145 - protein, 10 aa, Homo sapiens
  light chain complementarity determining region 3 for antibody 573
LQGSHWPPFT

SEQ ID NO: 1146 - protein, 9 aa, Homo sapiens
  heavy chain complementarity determining region 3 for antibody 573
VRNNYWMDV

SEQ ID NO: 1147 - protein, 7 aa, Homo sapiens
  light chain complementarity determining region 3 for antibody 574
QQYGSSP

SEQ ID NO: 1148 - protein, 13 aa, Homo sapiens
  heavy chain complementarity determining region 3 for antibody 574
AKEGSSPGPDFDS

SEQ ID NO: 1149 - protein, 8 aa, Homo sapiens
  light chain complementarity determining region 3 for antibody 575
QQYGSSLP

SEQ ID NO: 1150 - protein, 19 aa, Homo sapiens
  heavy chain complementarity determining region 3 for antibody 575
ARWNGIRSQNNFWSGPFDH

SEQ ID NO: 1151 - protein, 10 aa, Homo sapiens
  light chain complementarity determining region 3 for antibody 576
QQYGGSPMYT

SEQ ID NO: 1152 - protein, 13 aa, Homo sapiens
  heavy chain complementarity determining region 3 for antibody 576
TADFYDYVWGPRW

SEQ ID NO: 1153 - protein, 10 aa, Homo sapiens
  light chain complementarity determining region 3 for antibody 577
QQRSNWPPFT

SEQ ID NO: 1154 - protein, 16 aa, Homo sapiens
  heavy chain complementarity determining region 3 for antibody 577
ARHGVLPAAIHDAFDI

SEQ ID NO: 1155 - protein, 9 aa, Homo sapiens
  light chain complementarity determining region 3 for antibody 578
MQGTHWPWT

SEQ ID NO: 1156 - protein, 10 aa, Homo sapiens
  heavy chain complementarity determining region 3 for antibody 578
ARGGLAGDIY

SEQ ID NO: 1157 - protein, 9 aa, Homo sapiens
  light chain complementarity determining region 3 for antibody 579
LQHDYFPWT

SEQ ID NO: 1158 - protein, 19 aa, Homo sapiens
  heavy chain complementarity determining region 3 for antibody 579
ASWAGYCPSTNCHTTTFDY

SEQ ID NO: 1159 - protein, 9 aa, Homo sapiens
  light chain complementarity determining region 3 for antibody 580
LQDNSYPFT

SEQ ID NO: 1160 - protein, 15 aa, Homo sapiens
  heavy chain complementarity determining region 3 for antibody 580
TKDEYPGSQIEAFDI

SEQ ID NO: 1161 - protein, 9 aa, Homo sapiens
  light chain complementarity determining region 3 for antibody 581
QQYNNWPYT

SEQ ID NO: 1162 - protein, 11 aa, Homo sapiens
  heavy chain complementarity determining region 3 for antibody 581
ASIGWTQLRDY

SEQ ID NO: 1163 - protein, 10 aa, Homo sapiens
  light chain complementarity determining region 3 for antibody 582
QQYNIWPRGT

SEQ ID NO: 1164 - protein, 17 aa, Homo sapiens
  heavy chain complementarity determining region 3 for antibody 582
ASWNSPLVVIPAAVFDF

SEQ ID NO: 1165 - protein, 9 aa, Homo sapiens
  light chain complementarity determining region 3 for antibody 583
QQYGSSPKT

SEQ ID NO: 1166 - protein, 9 aa, Homo sapiens
  heavy chain complementarity determining region 3 for antibody 583
TREVNSFDG

SEQ ID NO: 1167 - protein, 9 aa, Homo sapiens
  light chain complementarity determining region 3 for antibody 584
QQSYSTPVT

SEQ ID NO: 1168 - protein, 11 aa, Homo sapiens
  heavy chain complementarity determining region 3 for antibody 584
ARGLSLRFFEW

SEQ ID NO: 1169 - protein, 9 aa, Homo sapiens
  light chain complementarity determining region 3 for antibody 585
QQSYSTPLT

SEQ ID NO: 1170 - protein, 11 aa, Homo sapiens
  heavy chain complementarity determining region 3 for antibody 585
ATFGQQWRLAH

SEQ ID NO: 1171 - protein, 7 aa, Homo sapiens
  light chain complementarity determining region 3 for antibody 586
QCKRNWA

SEQ ID NO: 1172 - protein, 20 aa, Homo sapiens
  heavy chain complementarity determining region 3 for antibody 586
STYLPGDCSCTSCFYWYSDL

SEQ ID NO: 1173 - protein, 9 aa, Homo sapiens
  light chain complementarity determining region 3 for antibody 587
MQTLQNPRT

SEQ ID NO: 1174 - protein, 17 aa, Homo sapiens
  heavy chain complementarity determining region 3 for antibody 587
ARQLGWCTDWSCPGMDV

SEQ ID NO: 1175 - protein, 9 aa, Homo sapiens
  light chain complementarity determining region 3 for antibody 588
MQALQTPWT

SEQ ID NO: 1176 - protein, 17 aa, Homo sapiens
  heavy chain complementarity determining region 3 for antibody 588
ARAGIEGTTIRMAFFDY

SEQ ID NO: 1177 - protein, 9 aa, Homo sapiens
  light chain complementarity determining region 3 for antibody 589
LQHRIYPYT

SEQ ID NO: 1178 - protein, 12 aa, Homo sapiens
  heavy chain complementarity determining region 3 for antibody 589
ARDYSCCNGFDP

SEQ ID NO: 1179 - protein, 8 aa, Homo sapiens
  light chain complementarity determining region 3 for antibody 590
LQDYIFAS

SEQ ID NO: 1180 - protein, 7 aa, Homo sapiens
  heavy chain complementarity determining region 3 for antibody 590
LWITNDY

SEQ ID NO: 1181 - protein, 8 aa, Homo sapiens
  light chain complementarity determining region 3 for antibody 591
QQYHSYSD

SEQ ID NO: 1182 - protein, 12 aa, Homo sapiens
  heavy chain complementarity determining region 3 for antibody 591
LHCSRTICFYTF

SEQ ID NO: 1183 - protein, 9 aa, Homo sapiens
  light chain complementarity determining region 3 for antibody 592
QQTDSTPVT

SEQ ID NO: 1184 - protein, 16 aa, Homo sapiens
  heavy chain complementarity determining region 3 for antibody 592
ARHSLASPVFFIGEPI

SEQ ID NO: 1185 - protein, 9 aa, Homo sapiens
  light chain complementarity determining region 3 for antibody 593
QHYNNWWWT

SEQ ID NO: 1186 - protein, 10 aa, Homo sapiens
  heavy chain complementarity determining region 3 for antibody 593
SKSSSGHFDD

SEQ ID NO: 1187 - protein, 9 aa, Homo sapiens
  light chain complementarity determining region 3 for antibody 594
MQGTHWPPT

SEQ ID NO: 1188 - protein, 10 aa, Homo sapiens
  heavy chain complementarity determining region 3 for antibody 594
AKGGTWDSDY

SEQ ID NO: 1189 - protein, 9 aa, Homo sapiens
  light chain complementarity determining region 3 for antibody 595
LHTFNAPRT

SEQ ID NO: 1190 - protein, 15 aa, Homo sapiens
  heavy chain complementarity determining region 3 for antibody 595
SRDYIEASNLLRLEY

SEQ ID NO: 1191 - protein, 9 aa, Homo sapiens
  light chain complementarity determining region 3 for antibody 596
QQYYNSPLT

SEQ ID NO: 1192 - protein, 14 aa, Homo sapiens
  heavy chain complementarity determining region 3 for antibody 596
AKANSGDVSFLIDY

SEQ ID NO: 1193 - protein, 9 aa, Homo sapiens
  light chain complementarity determining region 3 for antibody 597
QQSYTMPRT

SEQ ID NO: 1194 - protein, 18 aa, Homo sapiens
  heavy chain complementarity determining region 3 for antibody 597
TTVLSHLLAGDWHLYFQH

SEQ ID NO: 1195 - protein, 10 aa, Homo sapiens
  light chain complementarity determining region 3 for antibody 598
HQYGTSPLYT

SEQ ID NO: 1196 - protein, 16 aa, Homo sapiens
  heavy chain complementarity determining region 3 for antibody 598
VGPRLTYSSGWHYFDK

SEQ ID NO: 1197 - protein, 9 aa, Homo sapiens
  light chain complementarity determining region 3 for antibody 599
TQTTHWPWT

SEQ ID NO: 1198 - protein, 11 aa, Homo sapiens
  heavy chain complementarity determining region 3 for antibody 599
TRDLRGSAAAY

SEQ ID NO: 1199 - protein, 9 aa, Homo sapiens
  light chain complementarity determining region 3 for antibody 600
QQYYSSPLT

SEQ ID NO: 1200 - protein, 14 aa, Homo sapiens
  heavy chain complementarity determining region 3 for antibody 600
TKPTRGPGSFLIDY

SEQ ID NO: 1201 - protein, 9 aa, Homo sapiens
  light chain complementarity determining region 3 for antibody 601
QQYNSYSHT

SEQ ID NO: 1202 - protein, 14 aa, Homo sapiens
  heavy chain complementarity determining region 3 for antibody 601
GRDVHTSGWTLGGY

SEQ ID NO: 1203 - protein, 9 aa, Homo sapiens
  light chain complementarity determining region 3 for antibody 602
LQHNTYPWT

SEQ ID NO: 1204 - protein, 10 aa, Homo sapiens
  heavy chain complementarity determining region 3 for antibody 602
ARALGGTPEY

SEQ ID NO: 1205 - protein, 9 aa, Homo sapiens
  light chain complementarity determining region 3 for antibody 603
LQGLQVPFT

SEQ ID NO: 1206 - protein, 11 aa, Homo sapiens
  heavy chain complementarity determining region 3 for antibody 603
GRDVDYSTPGF

SEQ ID NO: 1207 - protein, 9 aa, Homo sapiens
  light chain complementarity determining region 3 for antibody 604
LQDYSYPWT

SEQ ID NO: 1208 - protein, 20 aa, Homo sapiens
  heavy chain complementarity determining region 3 for antibody 604
ARVRAAPGRNIVGELDYLDY

SEQ ID NO: 1209 - protein, 9 aa, Homo sapiens
  light chain complementarity determining region 3 for antibody 605
QQSYSTPRT

SEQ ID NO: 1210 - protein, 17 aa, Homo sapiens
  heavy chain complementarity determining region 3 for antibody 605
ARNTMVGTWQRQGNLDH

SEQ ID NO: 1211 - protein, 9 aa, Homo sapiens
  light chain complementarity determining region 3 for antibody 606
QQSYSTPLT

SEQ ID NO: 1212 - protein, 11 aa, Homo sapiens
  heavy chain complementarity determining region 3 for antibody 606
ARGGALNWLDP

SEQ ID NO: 1213 - protein, 9 aa, Homo sapiens
  light chain complementarity determining region 3 for antibody 607
QQSYSTPFT

SEQ ID NO: 1214 - protein, 15 aa, Homo sapiens
  heavy chain complementarity determining region 3 for antibody 607
ARFEYSSSRMGYMDV

SEQ ID NO: 1215 - protein, 9 aa, Homo sapiens
  light chain complementarity determining region 3 for antibody 608
QQSYNSHPT

SEQ ID NO: 1216 - protein, 19 aa, Homo sapiens
  heavy chain complementarity determining region 3 for antibody 608
AHTKYFYDSTGYYYADFDY

SEQ ID NO: 1217 - protein, 9 aa, Homo sapiens
  light chain complementarity determining region 3 for antibody 609
QQLSRYPIT

SEQ ID NO: 1218 - protein, 14 aa, Homo sapiens
  heavy chain complementarity determining region 3 for antibody 609
GRDTTHDWNDGGIY

SEQ ID NO: 1219 - protein, 9 aa, Homo sapiens
  light chain complementarity determining region 3 for antibody 610
QKYNSAPHT

SEQ ID NO: 1220 - protein, 14 aa, Homo sapiens
  heavy chain complementarity determining region 3 for antibody 610
TRGWVEASTPHFDY

SEQ ID NO: 1221 - protein, 7 aa, Homo sapiens
  light chain complementarity determining region 3 for antibody 611
QHYNSWA

SEQ ID NO: 1222 - protein, 11 aa, Homo sapiens
  heavy chain complementarity determining region 3 for antibody 611
ARETPVAVGGD

SEQ ID NO: 1223 - protein, 9 aa, Homo sapiens
  light chain complementarity determining region 3 for antibody 612
MQGTHWPHT

SEQ ID NO: 1224 - protein, 12 aa, Homo sapiens
  heavy chain complementarity determining region 3 for antibody 612
ARLDWNYRAFDI

SEQ ID NO: 1225 - protein, 9 aa, Homo sapiens
  light chain complementarity determining region 3 for antibody 613
LQHNTYPWT

SEQ ID NO: 1226 - protein, 15 aa, Homo sapiens
  heavy chain complementarity determining region 3 for antibody 613
ATDLAGVTPGGYCDY

SEQ ID NO: 1227 - protein, 9 aa, Homo sapiens
  light chain complementarity determining region 3 for antibody 614
LQDHNYPFT

SEQ ID NO: 1228 - protein, 16 aa, Homo sapiens
  heavy chain complementarity determining region 3 for antibody 614
AADVGDHSDAYATLDS

SEQ ID NO: 1229 - protein, 9 aa, Homo sapiens
  light chain complementarity determining region 3 for antibody 615
HQYNDWPWT

SEQ ID NO: 1230 - protein, 9 aa, Homo sapiens
  heavy chain complementarity determining region 3 for antibody 615
AGRPDSLDM

SEQ ID NO: 1231 - protein, 9 aa, Homo sapiens
  light chain complementarity determining region 3 for antibody 616
AQGSFWPAT

SEQ ID NO: 1232 - protein, 20 aa, Homo sapiens
  heavy chain complementarity determining region 3 for antibody 616
STYLPGDCTCTYCFYWYSDV

SEQ ID NO: 1233 - protein, 9 aa, Homo sapiens
  light chain complementarity determining region 3 for antibody 617
QQYNNWPWT

SEQ ID NO: 1234 - protein, 19 aa, Homo sapiens
  heavy chain complementarity determining region 3 for antibody 617
ARERVRCRSGICYDATFDI

SEQ ID NO: 1235 - protein, 10 aa, Homo sapiens
  light chain complementarity determining region 3 for antibody 618
QQYDYSPPWT

SEQ ID NO: 1236 - protein, 14 aa, Homo sapiens
  heavy chain complementarity determining region 3 for antibody 618
SHPTRGARLPIFDY

SEQ ID NO: 1237 - protein, 9 aa, Homo sapiens
  light chain complementarity determining region 3 for antibody 619
QQLNSYPYT

SEQ ID NO: 1238 - protein, 14 aa, Homo sapiens
  heavy chain complementarity determining region 3 for antibody 619
ARGHYDSTGFRLDY

SEQ ID NO: 1239 - protein, 9 aa, Homo sapiens
  light chain complementarity determining region 3 for antibody 620
QQFRDVPRT

SEQ ID NO: 1240 - protein, 9 aa, Homo sapiens
  heavy chain complementarity determining region 3 for antibody 620
ARGRSNFRH

SEQ ID NO: 1241 - protein, 9 aa, Homo sapiens
  light chain complementarity determining region 3 for antibody 621
QQCASSPLT

SEQ ID NO: 1242 - protein, 13 aa, Homo sapiens
  heavy chain complementarity determining region 3 for antibody 621
VGGLRSGTWYGGY

SEQ ID NO: 1243 - protein, 9 aa, Homo sapiens
  light chain complementarity determining region 3 for antibody 622
QQANSFPYT

SEQ ID NO: 1244 - protein, 16 aa, Homo sapiens
  heavy chain complementarity determining region 3 for antibody 622
ARDQGFGYGVPDACDI

SEQ ID NO: 1245 - protein, 9 aa, Homo sapiens
  light chain complementarity determining region 3 for antibody 623
QEYRTAPWT

SEQ ID NO: 1246 - protein, 24 aa, Homo sapiens
  heavy chain complementarity determining region 3 for antibody 623
ARDGRGTVYYHSAGGGAGGGGLDV

SEQ ID NO: 1247 - protein, 9 aa, Homo sapiens
  light chain complementarity determining region 3 for antibody 624
MQATHWPRT

SEQ ID NO: 1248 - protein, 12 aa, Homo sapiens
  heavy chain complementarity determining region 3 for antibody 624
AGSRSWGGSIDY

SEQ ID NO: 1249 - protein, 8 aa, Homo sapiens
  light chain complementarity determining region 3 for antibody 625
QQYGSSPT

SEQ ID NO: 1250 - protein, 16 aa, Homo sapiens
  heavy chain complementarity determining region 3 for antibody 625
ARGHPYCGGDCYHFDY

SEQ ID NO: 1251 - protein, 9 aa, Homo sapiens
  light chain complementarity determining region 3 for antibody 626
QQFSDFPRT

SEQ ID NO: 1252 - protein, 9 aa, Homo sapiens
  heavy chain complementarity determining region 3 for antibody 626
ARGRNNFRY

SEQ ID NO: 1253 - protein, 9 aa, Homo sapiens
  light chain complementarity determining region 3 for antibody 627
MQTLQTPRT

SEQ ID NO: 1254 - protein, 12 aa, Homo sapiens
  heavy chain complementarity determining region 3 for antibody 627
ARLDWNYRAFDI

SEQ ID NO: 1255 - protein, 9 aa, Homo sapiens
  light chain complementarity determining region 3 for antibody 628
LQDNGYPWT

SEQ ID NO: 1256 - protein, 15 aa, Homo sapiens
  heavy chain complementarity determining region 3 for antibody 628
ARLGLLAGGPNWFDP

SEQ ID NO: 1257 - protein, 9 aa, Homo sapiens
  light chain complementarity determining region 3 for antibody 629
QQYYNIPFT

SEQ ID NO: 1258 - protein, 15 aa, Homo sapiens
  heavy chain complementarity determining region 3 for antibody 629
GKEGPGSSGWLTGHY

SEQ ID NO: 1259 - protein, 9 aa, Homo sapiens
  light chain complementarity determining region 3 for antibody 630
QQYNSDPLT

SEQ ID NO: 1260 - protein, 9 aa, Homo sapiens
  heavy chain complementarity determining region 3 for antibody 630
AALDYGRDY

SEQ ID NO: 1261 - protein, 9 aa, Homo sapiens
  light chain complementarity determining region 3 for antibody 631
QQYNNYPLT

SEQ ID NO: 1262 - protein, 12 aa, Homo sapiens
  heavy chain complementarity determining region 3 for antibody 631
AIVVPGRWDLDD

SEQ ID NO: 1263 - protein, 9 aa, Homo sapiens
  light chain complementarity determining region 3 for antibody 632
QQYGELALT

SEQ ID NO: 1264 - protein, 13 aa, Homo sapiens
  heavy chain complementarity determining region 3 for antibody 632
AKDRGSGWYAWGY

SEQ ID NO: 1265 - protein, 10 aa, Homo sapiens
  light chain complementarity determining region 3 for antibody 633
QQYDNLPPPT

SEQ ID NO: 1266 - protein, 15 aa, Homo sapiens
  heavy chain complementarity determining region 3 for antibody 633
VHSRDGDPPGHWFDS

SEQ ID NO: 1267 - protein, 9 aa, Homo sapiens
  light chain complementarity determining region 3 for antibody 634
QQSYSMPRT

SEQ ID NO: 1268 - protein, 18 aa, Homo sapiens
  heavy chain complementarity determining region 3 for antibody 634
VTVLSRLLTGNWYLYFLH

SEQ ID NO: 1269 - protein, 9 aa, Homo sapiens
  light chain complementarity determining region 3 for antibody 635
QQSYRVPLT

SEQ ID NO: 1270 - protein, 18 aa, Homo sapiens
  heavy chain complementarity determining region 3 for antibody 635
AKVHLQAPLPTPNYYFDY

SEQ ID NO: 1271 - protein, 9 aa, Homo sapiens
  light chain complementarity determining region 3 for antibody 636
WQGTHWPGT

SEQ ID NO: 1272 - protein, 11 aa, Homo sapiens
  heavy chain complementarity determining region 3 for antibody 636
TKDNEGARAGH

SEQ ID NO: 1273 - protein, 9 aa, Homo sapiens
  light chain complementarity determining region 3 for antibody 637
QQYNNWPLT

SEQ ID NO: 1274 - protein, 16 aa, Homo sapiens
  heavy chain complementarity determining region 3 for antibody 637
AKAPPDGYKYYYGMDV

SEQ ID NO: 1275 - protein, 9 aa, Homo sapiens
  light chain complementarity determining region 3 for antibody 638
QQYNDYPLT

SEQ ID NO: 1276 - protein, 18 aa, Homo sapiens
  heavy chain complementarity determining region 3 for antibody 638
AHLRGCAGSDCHFLDGHS

SEQ ID NO: 1277 - protein, 9 aa, Homo sapiens
  light chain complementarity determining region 3 for antibody 639
QQYDNLPLT

SEQ ID NO: 1278 - protein, 10 aa, Homo sapiens
  heavy chain complementarity determining region 3 for antibody 639
ARETSGSYDI

SEQ ID NO: 1279 - protein, 9 aa, Homo sapiens
  light chain complementarity determining region 3 for antibody 640
QQTYRTPYT

SEQ ID NO: 1280 - protein, 14 aa, Homo sapiens
  heavy chain complementarity determining region 3 for antibody 640
ARLHGSGLGRWFDP

SEQ ID NO: 1281 - protein, 9 aa, Homo sapiens
  light chain complementarity determining region 3 for antibody 641
QQSYTTPYT

SEQ ID NO: 1282 - protein, 23 aa, Homo sapiens
  heavy chain complementarity determining region 3 for antibody 641
ARHFPKGGSAITGMQSLYYYMDV

SEQ ID NO: 1283 - protein, 8 aa, Homo sapiens
  light chain complementarity determining region 3 for antibody 642
QQSYTTPT

SEQ ID NO: 1284 - protein, 26 aa, Homo sapiens
  heavy chain complementarity determining region 3 for antibody 642
ARDFPKGGSYSSGWYGSVGGKYYMDV

SEQ ID NO: 1285 - protein, 9 aa, Homo sapiens
  light chain complementarity determining region 3 for antibody 643
QQFDDLPRT

SEQ ID NO: 1286 - protein, 9 aa, Homo sapiens
  heavy chain complementarity determining region 3 for antibody 643
VRGRNNWRV

SEQ ID NO: 1287 - protein, 9 aa, Homo sapiens
  light chain complementarity determining region 3 for antibody 644
QQADSFPIT

SEQ ID NO: 1288 - protein, 17 aa, Homo sapiens
  heavy chain complementarity determining region 3 for antibody 644
ARDSSTTYSTGWYYFDY

SEQ ID NO: 1289 - protein, 9 aa, Homo sapiens
  light chain complementarity determining region 3 for antibody 645
MQGTHWPIT

SEQ ID NO: 1290 - protein, 15 aa, Homo sapiens
  heavy chain complementarity determining region 3 for antibody 645
ARELPQRTYSDGWDH

SEQ ID NO: 1291 - protein, 9 aa, Homo sapiens
  light chain complementarity determining region 3 for antibody 646
QQYNDWPRT

SEQ ID NO: 1292 - protein, 14 aa, Homo sapiens
  heavy chain complementarity determining region 3 for antibody 646
ATPPGYYATAPLDY

SEQ ID NO: 1293 - protein, 9 aa, Homo sapiens
  light chain complementarity determining region 3 for antibody 647
QQSYSTPLT

SEQ ID NO: 1294 - protein, 12 aa, Homo sapiens
  heavy chain complementarity determining region 3 for antibody 647
AIVVPGRWDLDD

SEQ ID NO: 1295 - protein, 9 aa, Homo sapiens
  light chain complementarity determining region 3 for antibody 648
QQHYNLPIT

SEQ ID NO: 1296 - protein, 12 aa, Homo sapiens
  heavy chain complementarity determining region 3 for antibody 648
CVGGFGGTWFDS

SEQ ID NO: 1297 - protein, 10 aa, Homo sapiens
  light chain complementarity determining region 3 for antibody 649
MQGTHWPAWT

SEQ ID NO: 1298 - protein, 12 aa, Homo sapiens
  heavy chain complementarity determining region 3 for antibody 649
VTWIKTSVWLDY

SEQ ID NO: 1299 - protein, 9 aa, Homo sapiens
  light chain complementarity determining region 3 for antibody 650
LQDYSYPFS

SEQ ID NO: 1300 - protein, 16 aa, Homo sapiens
  heavy chain complementarity determining region 3 for antibody 650
ATDVGDHRDRFTTLDY

SEQ ID NO: 1301 - protein, 9 aa, Homo sapiens
  light chain complementarity determining region 3 for antibody 651
QRYDNVPLT

SEQ ID NO: 1302 - protein, 13 aa, Homo sapiens
  heavy chain complementarity determining region 3 for antibody 651
GRSGYSYAKYFVD

SEQ ID NO: 1303 - protein, 9 aa, Homo sapiens
  light chain complementarity determining region 3 for antibody 652
QQYNGYPWT

SEQ ID NO: 1304 - protein, 16 aa, Homo sapiens
  heavy chain complementarity determining region 3 for antibody 652
SRGGGCFSGVCYYADY

SEQ ID NO: 1305 - protein, 10 aa, Homo sapiens
  light chain complementarity determining region 3 for antibody 653
QQYGSSPPLT

SEQ ID NO: 1306 - protein, 20 aa, Homo sapiens
  heavy chain complementarity determining region 3 for antibody 653
GRDSSRSYSNSWAHYYGTDV

SEQ ID NO: 1307 - protein, 9 aa, Homo sapiens
  light chain complementarity determining region 3 for antibody 654
QQSYSTPYT

SEQ ID NO: 1308 - protein, 16 aa, Homo sapiens
  heavy chain complementarity determining region 3 for antibody 654
AREQKWLQENPHAFDI

SEQ ID NO: 1309 - protein, 10 aa, Homo sapiens
  light chain complementarity determining region 3 for antibody 655
QQSYSTPPVT

SEQ ID NO: 1310 - protein, 10 aa, Homo sapiens
  heavy chain complementarity determining region 3 for antibody 655
AKYLARAFDV

SEQ ID NO: 1311 - protein, 9 aa, Homo sapiens
  light chain complementarity determining region 3 for antibody 656
QQFNSYTYT

SEQ ID NO: 1312 - protein, 9 aa, Homo sapiens
  heavy chain complementarity determining region 3 for antibody 656
ARFWTYGRK

SEQ ID NO: 1313 - protein, 9 aa, Homo sapiens
  light chain complementarity determining region 3 for antibody 657
QERSNWPGS

SEQ ID NO: 1314 - protein, 14 aa, Homo sapiens
  heavy chain complementarity determining region 3 for antibody 657
ANYRASIGARCFDP

SEQ ID NO: 1315 - protein, 9 aa, Homo sapiens
  light chain complementarity determining region 3 for antibody 658
MQGSHWPIT

SEQ ID NO: 1316 - protein, 12 aa, Homo sapiens
  heavy chain complementarity determining region 3 for antibody 658
ARGAKLLWFGGS

SEQ ID NO: 1317 - protein, 9 aa, Homo sapiens
  light chain complementarity determining region 3 for antibody 659
LQYITYPFT

SEQ ID NO: 1318 - protein, 9 aa, Homo sapiens
  heavy chain complementarity determining region 3 for antibody 659
AALDYGADY

SEQ ID NO: 1319 - protein, 9 aa, Homo sapiens
  light chain complementarity determining region 3 for antibody 660
HQYGSSPRT

SEQ ID NO: 1320 - protein, 12 aa, Homo sapiens
  heavy chain complementarity determining region 3 for antibody 660
ARSRDLWTPFDY

SEQ ID NO: 1321 - protein, 9 aa, Homo sapiens
  light chain complementarity determining region 3 for antibody 661
QQYGTSPVT

SEQ ID NO: 1322 - protein, 13 aa, Homo sapiens
  heavy chain complementarity determining region 3 for antibody 661
AKDRGDGWYAWGY

SEQ ID NO: 1323 - protein, 9 aa, Homo sapiens
  light chain complementarity determining region 3 for antibody 662
QQYDNLRIT

SEQ ID NO: 1324 - protein, 18 aa, Homo sapiens
  heavy chain complementarity determining region 3 for antibody 662
TTALRYFDWVYISGAFDI

SEQ ID NO: 1325 - protein, 9 aa, Homo sapiens
  light chain complementarity determining region 3 for antibody 663
QQRYNWPLT

SEQ ID NO: 1326 - protein, 19 aa, Homo sapiens
  heavy chain complementarity determining region 3 for antibody 663
AKDKGGHSGSYSWALWFDY

SEQ ID NO: 1327 - protein, 9 aa, Homo sapiens
  light chain complementarity determining region 3 for antibody 664
QQFRDLPRT

SEQ ID NO: 1328 - protein, 9 aa, Homo sapiens
  heavy chain complementarity determining region 3 for antibody 664
ARGRSNFRY

SEQ ID NO: 1329 - protein, 9 aa, Homo sapiens
  light chain complementarity determining region 3 for antibody 665
QHYNNWPRT

SEQ ID NO: 1330 - protein, 15 aa, Homo sapiens
  heavy chain complementarity determining region 3 for antibody 665
TREFFSGAYPDYFEY

SEQ ID NO: 1331 - protein, 9 aa, Homo sapiens
  light chain complementarity determining region 3 for antibody 666
QHYKAYPHT

SEQ ID NO: 1332 - protein, 11 aa, Homo sapiens
  heavy chain complementarity determining region 3 for antibody 666
AREGALYAFDF

SEQ ID NO: 1333 - protein, 9 aa, Homo sapiens
  light chain complementarity determining region 3 for antibody 667
MQGTHWPWT

SEQ ID NO: 1334 - protein, 10 aa, Homo sapiens
  heavy chain complementarity determining region 3 for antibody 667
ARETSGSYDI

SEQ ID NO: 1335 - protein, 9 aa, Homo sapiens
  light chain complementarity determining region 3 for antibody 668
MQGIHWPWT

SEQ ID NO: 1336 - protein, 17 aa, Homo sapiens
  heavy chain complementarity determining region 3 for antibody 668
AKRLPDLLGGGHHYIDV

SEQ ID NO: 1337 - protein, 9 aa, Homo sapiens
  light chain complementarity determining region 3 for antibody 669
LQDYKYPFT

SEQ ID NO: 1338 - protein, 16 aa, Homo sapiens
  heavy chain complementarity determining region 3 for antibody 669
AADLGDHADAYATLDS

SEQ ID NO: 1339 - protein, 9 aa, Homo sapiens
  light chain complementarity determining region 3 for antibody 670
QQYRTVPWT

SEQ ID NO: 1340 - protein, 12 aa, Homo sapiens
  heavy chain complementarity determining region 3 for antibody 670
AGSRSWGGSIDY

SEQ ID NO: 1341 - protein, 9 aa, Homo sapiens
  light chain complementarity determining region 3 for antibody 671
QQYNSYLWS

SEQ ID NO: 1342 - protein, 13 aa, Homo sapiens
  heavy chain complementarity determining region 3 for antibody 671
ARRHRVTNYGMDV

SEQ ID NO: 1343 - protein, 8 aa, Homo sapiens
  light chain complementarity determining region 3 for antibody 672
QQYGSGKT

SEQ ID NO: 1344 - protein, 14 aa, Homo sapiens
  heavy chain complementarity determining region 3 for antibody 672
ARDNVHYGDYSLDL

SEQ ID NO: 1345 - protein, 10 aa, Homo sapiens
  light chain complementarity determining region 3 for antibody 673
QQYGNSPRYT

SEQ ID NO: 1346 - protein, 18 aa, Homo sapiens
  heavy chain complementarity determining region 3 for antibody 673
ARWASLCSSANCYVPFDY

SEQ ID NO: 1347 - protein, 9 aa, Homo sapiens
  light chain complementarity determining region 3 for antibody 674
QQSYNTPRT

SEQ ID NO: 1348 - protein, 15 aa, Homo sapiens
  heavy chain complementarity determining region 3 for antibody 674
AKDHRSSRGYYYMDV

SEQ ID NO: 1349 - protein, 10 aa, Homo sapiens
  light chain complementarity determining region 3 for antibody 675
QQRSNWAPTA

SEQ ID NO: 1350 - protein, 14 aa, Homo sapiens
  heavy chain complementarity determining region 3 for antibody 675
VRDALGPGVTRFDS

SEQ ID NO: 1351 - protein, 9 aa, Homo sapiens
  light chain complementarity determining region 3 for antibody 676
QQLYSYPLT

SEQ ID NO: 1352 - protein, 18 aa, Homo sapiens
  heavy chain complementarity determining region 3 for antibody 676
AHTPGINCAAGRCYGFAN

SEQ ID NO: 1353 - protein, 9 aa, Homo sapiens
  light chain complementarity determining region 3 for antibody 677
QQANSFPLS

SEQ ID NO: 1354 - protein, 15 aa, Homo sapiens
  heavy chain complementarity determining region 3 for antibody 677
ASFGLGVGDSNWFGT

SEQ ID NO: 1355 - protein, 9 aa, Homo sapiens
  light chain complementarity determining region 3 for antibody 678
QKYDSAPWT

SEQ ID NO: 1356 - protein, 17 aa, Homo sapiens
  heavy chain complementarity determining region 3 for antibody 678
TRDRPDSTWTSANRRDF

SEQ ID NO: 1357 - protein, 9 aa, Homo sapiens
  light chain complementarity determining region 3 for antibody 679
MQTVQTPGT

SEQ ID NO: 1358 - protein, 12 aa, Homo sapiens
  heavy chain complementarity determining region 3 for antibody 679
ARLDWNYRAFDI

SEQ ID NO: 1359 - protein, 9 aa, Homo sapiens
  light chain complementarity determining region 3 for antibody 680
LQHSSYPLT

SEQ ID NO: 1360 - protein, 11 aa, Homo sapiens
  heavy chain complementarity determining region 3 for antibody 680
VRVSTGWNFDY

SEQ ID NO: 1361 - protein, 7 aa, Homo sapiens
  light chain complementarity determining region 3 for antibody 681
QQYNTWT

SEQ ID NO: 1362 - protein, 12 aa, Homo sapiens
  heavy chain complementarity determining region 3 for antibody 681
VKDRGGRSGMDY

SEQ ID NO: 1363 - protein, 11 aa, Homo sapiens
  light chain complementarity determining region 3 for antibody 682
QQYNSYSPGGT

SEQ ID NO: 1364 - protein, 9 aa, Homo sapiens
  heavy chain complementarity determining region 3 for antibody 682
GRAWTYARH

SEQ ID NO: 1365 - protein, 9 aa, Homo sapiens
  light chain complementarity determining region 3 for antibody 683
QQYNDWPQT

SEQ ID NO: 1366 - protein, 16 aa, Homo sapiens
  heavy chain complementarity determining region 3 for antibody 683
ARDLWVAAWYPGALDI

SEQ ID NO: 1367 - protein, 7 aa, Homo sapiens
  light chain complementarity determining region 3 for antibody 684
QQYDNLP

SEQ ID NO: 1368 - protein, 9 aa, Homo sapiens
  heavy chain complementarity determining region 3 for antibody 684
GSRRPYFDS

SEQ ID NO: 1369 - protein, 9 aa, Homo sapiens
  light chain complementarity determining region 3 for antibody 685
QQLNSYPRT

SEQ ID NO: 1370 - protein, 12 aa, Homo sapiens
  heavy chain complementarity determining region 3 for antibody 685
NADHGYVDGFDI

SEQ ID NO: 1371 - protein, 9 aa, Homo sapiens
  light chain complementarity determining region 3 for antibody 686
QNYKSAPHT

SEQ ID NO: 1372 - protein, 14 aa, Homo sapiens
  heavy chain complementarity determining region 3 for antibody 686
VRGWLDPSTPHYDY

SEQ ID NO: 1373 - protein, 10 aa, Homo sapiens
  light chain complementarity determining region 3 for antibody 687
QHYGGSVPIT

SEQ ID NO: 1374 - protein, 14 aa, Homo sapiens
  heavy chain complementarity determining region 3 for antibody 687
AREVIIRGTQHFDY

SEQ ID NO: 1375 - protein, 7 aa, Homo sapiens
  light chain complementarity determining region 3 for antibody 688
QCNRNWA

SEQ ID NO: 1376 - protein, 20 aa, Homo sapiens
  heavy chain complementarity determining region 3 for antibody 688
STYLPGDCTCANCFYWYSDF

SEQ ID NO: 1377 - protein, 9 aa, Homo sapiens
  light chain complementarity determining region 3 for antibody 689
MQTLQTPWT

SEQ ID NO: 1378 - protein, 10 aa, Homo sapiens
  heavy chain complementarity determining region 3 for antibody 689
AHRINRAFDI

SEQ ID NO: 1379 - protein, 9 aa, Homo sapiens
  light chain complementarity determining region 3 for antibody 690
MQATHWPLT

SEQ ID NO: 1380 - protein, 7 aa, Homo sapiens
  heavy chain complementarity determining region 3 for antibody 690
ASERWND

SEQ ID NO: 1381 - protein, 9 aa, Homo sapiens
  light chain complementarity determining region 3 for antibody 691
LQYYTAPWM

SEQ ID NO: 1382 - protein, 17 aa, Homo sapiens
  heavy chain complementarity determining region 3 for antibody 691
SRDGRIIWPGSQGTLDS

SEQ ID NO: 1383 - protein, 9 aa, Homo sapiens
  light chain complementarity determining region 3 for antibody 692
LQHNSYPLT

SEQ ID NO: 1384 - protein, 15 aa, Homo sapiens
  heavy chain complementarity determining region 3 for antibody 692
TTSRTASAWYNAFDI

SEQ ID NO: 1385 - protein, 7 aa, Homo sapiens
  light chain complementarity determining region 3 for antibody 693
QQYNSWT

SEQ ID NO: 1386 - protein, 12 aa, Homo sapiens
  heavy chain complementarity determining region 3 for antibody 693
AKDRGGRSGMDV

SEQ ID NO: 1387 - protein, 9 aa, Homo sapiens
  light chain complementarity determining region 3 for antibody 694
QQYHSTPWT

SEQ ID NO: 1388 - protein, 11 aa, Homo sapiens
  heavy chain complementarity determining region 3 for antibody 694
ATGKDNAKTGY

SEQ ID NO: 1389 - protein, 10 aa, Homo sapiens
  light chain complementarity determining region 3 for antibody 695
QQYGGSPRYT

SEQ ID NO: 1390 - protein, 18 aa, Homo sapiens
  heavy chain complementarity determining region 3 for antibody 695
ARDRGMSVAGTWFAWFDS

SEQ ID NO: 1391 - protein, 9 aa, Homo sapiens
  light chain complementarity determining region 3 for antibody 696
QLSGSSLLT

SEQ ID NO: 1392 - protein, 17 aa, Homo sapiens
  heavy chain complementarity determining region 3 for antibody 696
ARNTMVGTWQRQGNLDH

SEQ ID NO: 1393 - protein, 10 aa, Homo sapiens
  light chain complementarity determining region 3 for antibody 697
QHYGDSPPIT

SEQ ID NO: 1394 - protein, 6 aa, Homo sapiens
  heavy chain complementarity determining region 3 for antibody 697
ARFFEY

SEQ ID NO: 1395 - protein, 9 aa, Homo sapiens
  light chain complementarity determining region 3 for antibody 698
FQYKYGPHT

SEQ ID NO: 1396 - protein, 8 aa, Homo sapiens
  heavy chain complementarity determining region 3 for antibody 698
AGWGYGNY

SEQ ID NO: 1397 - protein, 9 aa, Homo sapiens
  light chain complementarity determining region 3 for antibody 699
QQYKTYPLT

SEQ ID NO: 1398 - protein, 12 aa, Homo sapiens
  heavy chain complementarity determining region 3 for antibody 699
VSGRITARPLEY

SEQ ID NO: 1399 - protein, 10 aa, Homo sapiens
  light chain complementarity determining region 3 for antibody 700
QQSHTTPALT

SEQ ID NO: 1400 - protein, 17 aa, Homo sapiens
  heavy chain complementarity determining region 3 for antibody 700
AKGYYYDSSGRLRAFDI

SEQ ID NO: 1401 - protein, 9 aa, Homo sapiens
  light chain complementarity determining region 3 for antibody 701
QQRSNWPLT

SEQ ID NO: 1402 - protein, 17 aa, Homo sapiens
  heavy chain complementarity determining region 3 for antibody 701
AKASSTPSHRGFYYMDV

SEQ ID NO: 1403 - protein, 9 aa, Homo sapiens
  light chain complementarity determining region 3 for antibody 702
QQRSNWPLT

SEQ ID NO: 1404 - protein, 12 aa, Homo sapiens
  heavy chain complementarity determining region 3 for antibody 702
AIVVPGRWDLDD

SEQ ID NO: 1405 - protein, 9 aa, Homo sapiens
  light chain complementarity determining region 3 for antibody 703
MQGTHWPPT

SEQ ID NO: 1406 - protein, 11 aa, Homo sapiens
  heavy chain complementarity determining region 3 for antibody 703
ATFGQQWRLAH

SEQ ID NO: 1407 - protein, 9 aa, Homo sapiens
  light chain complementarity determining region 3 for antibody 704
LQHNTYPPT

SEQ ID NO: 1408 - protein, 9 aa, Homo sapiens
  heavy chain complementarity determining region 3 for antibody 704
ARYRAESAY

SEQ ID NO: 1409 - protein, 9 aa, Homo sapiens
  light chain complementarity determining region 3 for antibody 705
LQDRKYPFS

SEQ ID NO: 1410 - protein, 16 aa, Homo sapiens
  heavy chain complementarity determining region 3 for antibody 705
GADLGDHGDAYATLDS

SEQ ID NO: 1411 - protein, 7 aa, Homo sapiens
  light chain complementarity determining region 3 for antibody 706
QQYNTWT

SEQ ID NO: 1412 - protein, 12 aa, Homo sapiens
  heavy chain complementarity determining region 3 for antibody 706
VRDRGGRSGMDY

SEQ ID NO: 1413 - protein, 9 aa, Homo sapiens
  light chain complementarity determining region 3 for antibody 707
QQYNSYPWT

SEQ ID NO: 1414 - protein, 8 aa, Homo sapiens
  heavy chain complementarity determining region 3 for antibody 707
AGWSDANY

SEQ ID NO: 1415 - protein, 9 aa, Homo sapiens
  light chain complementarity determining region 3 for antibody 708
QQYNNWPRT

SEQ ID NO: 1416 - protein, 9 aa, Homo sapiens
  heavy chain complementarity determining region 3 for antibody 708
ARGGLYPGY

SEQ ID NO: 1417 - protein, 9 aa, Homo sapiens
  light chain complementarity determining region 3 for antibody 709
QQYNNWPLT

SEQ ID NO: 1418 - protein, 15 aa, Homo sapiens
  heavy chain complementarity determining region 3 for antibody 709
ARDNPITKWYFGLFY

SEQ ID NO: 1419 - protein, 9 aa, Homo sapiens
  light chain complementarity determining region 3 for antibody 710
QQYKTAPWT

SEQ ID NO: 1420 - protein, 20 aa, Homo sapiens
  heavy chain complementarity determining region 3 for antibody 710
TRDARGSSSYAYGGGGGLDV

SEQ ID NO: 1421 - protein, 9 aa, Homo sapiens
  light chain complementarity determining region 3 for antibody 711
QQYGNSPLA

SEQ ID NO: 1422 - protein, 18 aa, Homo sapiens
  heavy chain complementarity determining region 3 for antibody 711
AGGDYPEARNGYYLDFDY

SEQ ID NO: 1423 - protein, 9 aa, Homo sapiens
  light chain complementarity determining region 3 for antibody 712
QQYDNLPWT

SEQ ID NO: 1424 - protein, 19 aa, Homo sapiens
  heavy chain complementarity determining region 3 for antibody 712
ARDSGYDSLGGYYYYYMDV

SEQ ID NO: 1425 - protein, 9 aa, Homo sapiens
  light chain complementarity determining region 3 for antibody 713
QEYRTPPWT

SEQ ID NO: 1426 - protein, 20 aa, Homo sapiens
  heavy chain complementarity determining region 3 for antibody 713
ARDGRGIVEYDYAGGGGLDV

SEQ ID NO: 1427 - protein, 9 aa, Homo sapiens
  light chain complementarity determining region 3 for antibody 714
MQALHTPIT

SEQ ID NO: 1428 - protein, 12 aa, Homo sapiens
  heavy chain complementarity determining region 3 for antibody 714
TKDSEMKWEMRD

SEQ ID NO: 1429 - protein, 9 aa, Homo sapiens
  light chain complementarity determining region 3 for antibody 715
QQYKTVPWT

SEQ ID NO: 1430 - protein, 20 aa, Homo sapiens
  heavy chain complementarity determining region 3 for antibody 715
TKDGRGIPLYHSAGGGGLDV

SEQ ID NO: 1431 - protein, 9 aa, Homo sapiens
  light chain complementarity determining region 3 for antibody 716
QQYKTVPWT

SEQ ID NO: 1432 - protein, 20 aa, Homo sapiens
  heavy chain complementarity determining region 3 for antibody 716
AKDGRGTADYHSAGGGGLDV

SEQ ID NO: 1433 - protein, 9 aa, Homo sapiens
  light chain complementarity determining region 3 for antibody 717
QQYDNLPYT

SEQ ID NO: 1434 - protein, 12 aa, Homo sapiens
  heavy chain complementarity determining region 3 for antibody 717
ARLDWNYRAFDI

SEQ ID NO: 1435 - protein, 9 aa, Homo sapiens
  light chain complementarity determining region 3 for antibody 718
QQANSFPRT

SEQ ID NO: 1436 - protein, 12 aa, Homo sapiens
  heavy chain complementarity determining region 3 for antibody 718
AGSRSWGGSIDY

SEQ ID NO: 1437 - protein, 9 aa, Homo sapiens
  light chain complementarity determining region 3 for antibody 719
MQGTHWPHT

SEQ ID NO: 1438 - protein, 11 aa, Homo sapiens
  heavy chain complementarity determining region 3 for antibody 719
AAFGQQWRLAH

SEQ ID NO: 1439 - protein, 9 aa, Homo sapiens
  light chain complementarity determining region 3 for antibody 720
MQALQAPPT

SEQ ID NO: 1440 - protein, 10 aa, Homo sapiens
  heavy chain complementarity determining region 3 for antibody 720
TRHYNWHFDY

SEQ ID NO: 1441 - protein, 8 aa, Homo sapiens
  light chain complementarity determining region 3 for antibody 721
MQALHRLT

SEQ ID NO: 1442 - protein, 8 aa, Homo sapiens
  heavy chain complementarity determining region 3 for antibody 721
VSQTGHNY

SEQ ID NO: 1443 - protein, 7 aa, Homo sapiens
  light chain complementarity determining region 3 for antibody 722
QQYHIGT

SEQ ID NO: 1444 - protein, 11 aa, Homo sapiens
  heavy chain complementarity determining region 3 for antibody 722
VRVSTGWNFDY

SEQ ID NO: 1445 - protein, 9 aa, Homo sapiens
  light chain complementarity determining region 3 for antibody 723
QQYGSSPRT

SEQ ID NO: 1446 - protein, 20 aa, Homo sapiens
  heavy chain complementarity determining region 3 for antibody 723
ARERYCSSNRCHMGVGWFDP

SEQ ID NO: 1447 - protein, 11 aa, Homo sapiens
  light chain complementarity determining region 3 for antibody 724
QQYGSSPPMYT

SEQ ID NO: 1448 - protein, 12 aa, Homo sapiens
  heavy chain complementarity determining region 3 for antibody 724
ASQETLPYTYGY

SEQ ID NO: 1449 - protein, 9 aa, Homo sapiens
  light chain complementarity determining region 3 for antibody 725
QQYDSLPFT

SEQ ID NO: 1450 - protein, 14 aa, Homo sapiens
  heavy chain complementarity determining region 3 for antibody 725
ARSRFSGNYFSFKY

SEQ ID NO: 1451 - protein, 10 aa, Homo sapiens
  light chain complementarity determining region 3 for antibody 726
QQYDNWPPWR

SEQ ID NO: 1452 - protein, 15 aa, Homo sapiens
  heavy chain complementarity determining region 3 for antibody 726
ARDIRVGPSKYYFDY

SEQ ID NO: 1453 - protein, 9 aa, Homo sapiens
  light chain complementarity determining region 3 for antibody 727
QQYAAAPLT

SEQ ID NO: 1454 - protein, 9 aa, Homo sapiens
  heavy chain complementarity determining region 3 for antibody 727
VRADWIHDY

SEQ ID NO: 1455 - protein, 9 aa, Homo sapiens
  light chain complementarity determining region 3 for antibody 728
QQFNTYPLT

SEQ ID NO: 1456 - protein, 20 aa, Homo sapiens
  heavy chain complementarity determining region 3 for antibody 728
ARNLQYCSGGSCYGPFYFDY

SEQ ID NO: 1457 - protein, 9 aa, Homo sapiens
  light chain complementarity determining region 3 for antibody 729
QKYNSAPFT

SEQ ID NO: 1458 - protein, 10 aa, Homo sapiens
  heavy chain complementarity determining region 3 for antibody 729
VREGHWSLDH

SEQ ID NO: 1459 - protein, 9 aa, Homo sapiens
  light chain complementarity determining region 3 for antibody 730
QHSYNYPLT

SEQ ID NO: 1460 - protein, 11 aa, Homo sapiens
  heavy chain complementarity determining region 3 for antibody 730
AKGGALNWFDS

SEQ ID NO: 1461 - protein, 9 aa, Homo sapiens
  light chain complementarity determining region 3 for antibody 731
MQGTWWPYT

SEQ ID NO: 1462 - protein, 11 aa, Homo sapiens
  heavy chain complementarity determining region 3 for antibody 731
AREGWGTLLDY

SEQ ID NO: 1463 - protein, 9 aa, Homo sapiens
  light chain complementarity determining region 3 for antibody 732
MPTLQTPWT

SEQ ID NO: 1464 - protein, 12 aa, Homo sapiens
  heavy chain complementarity determining region 3 for antibody 732
ARLDWNYRAFDI

SEQ ID NO: 1465 - protein, 9 aa, Homo sapiens
  light chain complementarity determining region 3 for antibody 733
QQYYSSPLT

SEQ ID NO: 1466 - protein, 14 aa, Homo sapiens
  heavy chain complementarity determining region 3 for antibody 733
AKPTRGPGSFLIDY

SEQ ID NO: 1467 - protein, 9 aa, Homo sapiens
  light chain complementarity determining region 3 for antibody 734
QQYNSYPYT

SEQ ID NO: 1468 - protein, 10 aa, Homo sapiens
  heavy chain complementarity determining region 3 for antibody 734
ARGAALALDY

SEQ ID NO: 1469 - protein, 10 aa, Homo sapiens [sequence omitted]

SEQ ID NO: 1470 - protein, 19 aa, Homo sapiens
  heavy chain complementarity determining region 3 for antibody 735
ARMIGRGVSGDWWLGEFDY

SEQ ID NO: 1471 - protein, 9 aa, Homo sapiens
  light chain complementarity determining region 3 for antibody 736
QQYKTAPWT

SEQ ID NO: 1472 - protein, 20 aa, Homo sapiens
  heavy chain complementarity determining region 3 for antibody 736
ARDARGSSSYAYGGGGGLDV

SEQ ID NO: 1473 - protein, 8 aa, Homo sapiens
  light chain complementarity determining region 3 for antibody 737
QQYGSSFT

SEQ ID NO: 1474 - protein, 21 aa, Homo sapiens
  heavy chain complementarity determining region 3 for antibody 737
AHLYDFWSGSGRLDYYYVMDV

SEQ ID NO: 1475 - protein, 10 aa, Homo sapiens
  light chain complementarity determining region 3 for antibody 738
QQSYSTPLFT

SEQ ID NO: 1476 - protein, 17 aa, Homo sapiens
  heavy chain complementarity determining region 3 for antibody 738
ARNTMVGTWQRQGNLDH

SEQ ID NO: 1477 - protein, 10 aa, Homo sapiens
  light chain complementarity determining region 3 for antibody 739
QQHNNWPTIT

SEQ ID NO: 1478 - protein, 9 aa, Homo sapiens
  heavy chain complementarity determining region 3 for antibody 739
ARGSGFNYY

SEQ ID NO: 1479 - protein, 9 aa, Homo sapiens
  light chain complementarity determining region 3 for antibody 740
QERATWPGS

SEQ ID NO: 1480 - protein, 13 aa, Homo sapiens
  heavy chain complementarity determining region 3 for antibody 740
ATGAWASSWWGDF

SEQ ID NO: 1481 - protein, 9 aa, Homo sapiens
  light chain complementarity determining region 3 for antibody 741
MQYTHWPHT

SEQ ID NO: 1482 - protein, 8 aa, Homo sapiens
  heavy chain complementarity determining region 3 for antibody 741
AGWNNANY

SEQ ID NO: 1483 - protein, 9 aa, Homo sapiens
  light chain complementarity determining region 3 for antibody 742
FQRNSWPLT

SEQ ID NO: 1484 - protein, 10 aa, Homo sapiens
  heavy chain complementarity determining region 3 for antibody 742
GRDRLRAYDI

SEQ ID NO: 1485 - protein, 9 aa, Homo sapiens
  light chain complementarity determining region 3 for antibody 743
QRYKNVPWT

SEQ ID NO: 1486 - protein, 20 aa, Homo sapiens
  heavy chain complementarity determining region 3 for antibody 743
ARDQRSIDLWSLPVGGGMDV

SEQ ID NO: 1487 - protein, 9 aa, Homo sapiens
  light chain complementarity determining region 3 for antibody 744
QQYYYWPRT

SEQ ID NO: 1488 - protein, 17 aa, Homo sapiens
  heavy chain complementarity determining region 3 for antibody 744
ARCYNDRRNYDDEFIDY

SEQ ID NO: 1489 - protein, 9 aa, Homo sapiens
  light chain complementarity determining region 3 for antibody 745
QQYYNTPET

SEQ ID NO: 1490 - protein, 15 aa, Homo sapiens
  heavy chain complementarity determining region 3 for antibody 745
ARDLFSGSYAYGDDW

SEQ ID NO: 1491 - protein, 9 aa, Homo sapiens
  light chain complementarity determining region 3 for antibody 746
QQYGTIPLT

SEQ ID NO: 1492 - protein, 16 aa, Homo sapiens
  heavy chain complementarity determining region 3 for antibody 746
VRDLAGFTRGGSTFDY

SEQ ID NO: 1493 - protein, 9 aa, Homo sapiens
  light chain complementarity determining region 3 for antibody 747
QQTNRTPYT

SEQ ID NO: 1494 - protein, 14 aa, Homo sapiens
  heavy chain complementarity determining region 3 for antibody 747
ARLHGSGLGRWLDP

SEQ ID NO: 1495 - protein, 9 aa, Homo sapiens
  light chain complementarity determining region 3 for antibody 748
QQRSNWPLA

SEQ ID NO: 1496 - protein, 9 aa, Homo sapiens
  heavy chain complementarity determining region 3 for antibody 748
GSRRPYFDS

SEQ ID NO: 1497 - protein, 9 aa, Homo sapiens
  light chain complementarity determining region 3 for antibody 749
QQLNSFPYT

SEQ ID NO: 1498 - protein, 14 aa, Homo sapiens
  heavy chain complementarity determining region 3 for antibody 749
ARGHFDSTGFRLDY

SEQ ID NO: 1499 - protein, 9 aa, Homo sapiens
  light chain complementarity determining region 3 for antibody 750
QEYRTPPWT

SEQ ID NO: 1500 - protein, 20 aa, Homo sapiens
  heavy chain complementarity determining region 3 for antibody 750
ATDGRGIADYDHSGGGGLDV

SEQ ID NO: 1501 - protein, 9 aa, Homo sapiens
  light chain complementarity determining region 3 for antibody 751
MQFLQTPLT

SEQ ID NO: 1502 - protein, 10 aa, Homo sapiens
  heavy chain complementarity determining region 3 for antibody 751
ARERSSSYDI

SEQ ID NO: 1503 - protein, 8 aa, Homo sapiens
  light chain complementarity determining region 3 for antibody 752
MQALHRLT

SEQ ID NO: 1504 - protein, 8 aa, Homo sapiens
  heavy chain complementarity determining region 3 for antibody 752
VSQTGRNY

SEQ ID NO: 1505 - protein, 9 aa, Homo sapiens
  light chain complementarity determining region 3 for antibody 753
LQYYTAPWA

SEQ ID NO: 1506 - protein, 17 aa, Homo sapiens
  heavy chain complementarity determining region 3 for antibody 753
ARDGRIIWPGSQGSLDS

SEQ ID NO: 1507 - protein, 9 aa, Homo sapiens
  light chain complementarity determining region 3 for antibody 754
LQDYIYPFS

SEQ ID NO: 1508 - protein, 16 aa, Homo sapiens
  heavy chain complementarity determining region 3 for antibody 754
SSDVGDHRDSYTTLDF

SEQ ID NO: 1509 - protein, 9 aa, Homo sapiens
  light chain complementarity determining region 3 for antibody 755
HQYASSPLT

SEQ ID NO: 1510 - protein, 10 aa, Homo sapiens
  heavy chain complementarity determining region 3 for antibody 755
AGSSGWLMYV

SEQ ID NO: 1511 - protein, 9 aa, Homo sapiens
  light chain complementarity determining region 3 for antibody 756
QQTYSSPWT

SEQ ID NO: 1512 - protein, 15 aa, Homo sapiens
  heavy chain complementarity determining region 3 for antibody 756
ARIGTSSTNCRYMDV

SEQ ID NO: 1513 - protein, 10 aa, Homo sapiens
  light chain complementarity determining region 3 for antibody 757
QQTSNWPSIS

SEQ ID NO: 1514 - protein, 13 aa, Homo sapiens
  heavy chain complementarity determining region 3 for antibody 757
AKPHYHGSGSPDY

SEQ ID NO: 1515 - protein, 9 aa, Homo sapiens
  light chain complementarity determining region 3 for antibody 758
QNYNSAPFT

SEQ ID NO: 1516 - protein, 10 aa, Homo sapiens
  heavy chain complementarity determining region 3 for antibody 758
VREGYWSLDH

SEQ ID NO: 1517 - protein, 9 aa, Homo sapiens
  light chain complementarity determining region 3 for antibody 759
QHTNSFPRT

SEQ ID NO: 1518 - protein, 14 aa, Homo sapiens
  heavy chain complementarity determining region 3 for antibody 759
AREAGTYYQYAFDI

SEQ ID NO: 1519 - protein, 9 aa, Homo sapiens
  light chain complementarity determining region 3 for antibody 760
QHSYSTPRT

SEQ ID NO: 1520 - protein, 20 aa, Homo sapiens
  heavy chain complementarity determining region 3 for antibody 760
ARETSIAAAANGYYYYVMDV

SEQ ID NO: 1521 - protein, 9 aa, Homo sapiens
  light chain complementarity determining region 3 for antibody 761
MQGTHWPRT

SEQ ID NO: 1522 - protein, 13 aa, Homo sapiens
  heavy chain complementarity determining region 3 for antibody 761
TKEGSSAGPDFVY

SEQ ID NO: 1523 - protein, 9 aa, Homo sapiens
  light chain complementarity determining region 3 for antibody 762
MQGTHWPIT

SEQ ID NO: 1524 - protein, 14 aa, Homo sapiens
  heavy chain complementarity determining region 3 for antibody 762
AKHTHNWYLGVLDC

SEQ ID NO: 1525 - protein, 9 aa, Homo sapiens
  light chain complementarity determining region 3 for antibody 763
MQDTHWPKT

SEQ ID NO: 1526 - protein, 6 aa, Homo sapiens
  heavy chain complementarity determining region 3 for antibody 763
AKGSDS

SEQ ID NO: 1527 - protein, 9 aa, Homo sapiens
  light chain complementarity determining region 3 for antibody 764
MQALQTPVT

SEQ ID NO: 1528 - protein, 10 aa, Homo sapiens
  heavy chain complementarity determining region 3 for antibody 764
AHRINRAFDI

SEQ ID NO: 1529 - protein, 9 aa, Homo sapiens
  light chain complementarity determining region 3 for antibody 765
LQDYNYPFT

SEQ ID NO: 1530 - protein, 16 aa, Homo sapiens
  heavy chain complementarity determining region 3 for antibody 765
AADLGDHADAYATLDY

SEQ ID NO: 1531 - protein, 9 aa, Homo sapiens
  light chain complementarity determining region 3 for antibody 766
LQDYKYPFA

SEQ ID NO: 1532 - protein, 16 aa, Homo sapiens
  heavy chain complementarity determining region 3 for antibody 766
AADLGDHADAYATLDS

SEQ ID NO: 1533 - protein, 9 aa, Homo sapiens
  light chain complementarity determining region 3 for antibody 767
LQDRTYPYT

SEQ ID NO: 1534 - protein, 16 aa, Homo sapiens
  heavy chain complementarity determining region 3 for antibody 767
ARDRLAADGPHVEFDV

SEQ ID NO: 1535 - protein, 9 aa, Homo sapiens
  light chain complementarity determining region 3 for antibody 768
AQGSFWPAT

SEQ ID NO: 1536 - protein, 17 aa, Homo sapiens
  heavy chain complementarity determining region 3 for antibody 768
ARNTMVGAWQRQGNLDH

SEQ ID NO: 1537 - protein, 9 aa, Homo sapiens
  light chain complementarity determining region 3 for antibody 769
VQGVHWPWT

SEQ ID NO: 1538 - protein, 17 aa, Homo sapiens
  heavy chain complementarity determining region 3 for antibody 769
ARNTMVGTWQRQGNLDH

SEQ ID NO: 1539 - protein, 9 aa, Homo sapiens
  light chain complementarity determining region 3 for antibody 770
QQSFNWPRT

SEQ ID NO: 1540 - protein, 14 aa, Homo sapiens
  heavy chain complementarity determining region 3 for antibody 770
TTSPGYYDSSPWDY

SEQ ID NO: 1541 - protein, 9 aa, Homo sapiens
  light chain complementarity determining region 3 for antibody 771
QHYGNFTWT

SEQ ID NO: 1542 - protein, 15 aa, Homo sapiens
  heavy chain complementarity determining region 3 for antibody 771
ARELPQRTNSDGWDH

SEQ ID NO: 1543 - protein, 9 aa, Homo sapiens
  light chain complementarity determining region 3 for antibody 772
QHYDTSILT

SEQ ID NO: 1544 - protein, 12 aa, Homo sapiens
  heavy chain complementarity determining region 3 for antibody 772
ALDEWHPNWYKY

SEQ ID NO: 1545 - protein, 9 aa, Homo sapiens
  light chain complementarity determining region 3 for antibody 773
MQGTHWPWT

SEQ ID NO: 1546 - protein, 12 aa, Homo sapiens
  heavy chain complementarity determining region 3 for antibody 773
ASGPLREVAGMV

SEQ ID NO: 1547 - protein, 9 aa, Homo sapiens
  light chain complementarity determining region 3 for antibody 774
MQGTHWPRT

SEQ ID NO: 1548 - protein, 11 aa, Homo sapiens
  heavy chain complementarity determining region 3 for antibody 774
AREDGVNTCDY

SEQ ID NO: 1549 - protein, 9 aa, Homo sapiens
  light chain complementarity determining region 3 for antibody 775
QVYATSRGT

SEQ ID NO: 1550 - protein, 12 aa, Homo sapiens
  heavy chain complementarity determining region 3 for antibody 775
AKAQTYYYAFDV

SEQ ID NO: 1551 - protein, 10 aa, Homo sapiens
  light chain complementarity determining region 3 for antibody 776
QQYYTTPLFT

SEQ ID NO: 1552 - protein, 13 aa, Homo sapiens
  heavy chain complementarity determining region 3 for antibody 776
ARPYGDYGWAFNI

SEQ ID NO: 1553 - protein, 9 aa, Homo sapiens
  light chain complementarity determining region 3 for antibody 777
QQYVSSLWT

SEQ ID NO: 1554 - protein, 14 aa, Homo sapiens
  heavy chain complementarity determining region 3 for antibody 777
ARENWNDVGGWFDP

SEQ ID NO: 1555 - protein, 10 aa, Homo sapiens
  light chain complementarity determining region 3 for antibody 778
QQYNFYSTLT

SEQ ID NO: 1556 - protein, 16 aa, Homo sapiens
  heavy chain complementarity determining region 3 for antibody 778
GRQVVSGTKWPNRLDY

SEQ ID NO: 1557 - protein, 9 aa, Homo sapiens
  light chain complementarity determining region 3 for antibody 779
QQYKSYPYT

SEQ ID NO: 1558 - protein, 9 aa, Homo sapiens
  heavy chain complementarity determining region 3 for antibody 779
ARFWTYGRK

SEQ ID NO: 1559 - protein, 10 aa, Homo sapiens
  light chain complementarity determining region 3 for antibody 780
QQYDPVSPWT

SEQ ID NO: 1560 - protein, 11 aa, Homo sapiens
  heavy chain complementarity determining region 3 for antibody 780
VKMSFTGYPEY

SEQ ID NO: 1561 - protein, 9 aa, Homo sapiens
  light chain complementarity determining region 3 for antibody 781
QQYDNLPLT

SEQ ID NO: 1562 - protein, 11 aa, Homo sapiens
  heavy chain complementarity determining region 3 for antibody 781
AREQHGQAPDY

SEQ ID NO: 1563 - protein, 9 aa, Homo sapiens
  light chain complementarity determining region 3 for antibody 782
QQYDNLPLT

SEQ ID NO: 1564 - protein, 12 aa, Homo sapiens
  heavy chain complementarity determining region 3 for antibody 782
ARDYSHLAPGGY

SEQ ID NO: 1565 - protein, 10 aa, Homo sapiens
  light chain complementarity determining region 3 for antibody 783
QQRTNWLPYT

SEQ ID NO: 1566 - protein, 8 aa, Homo sapiens
  heavy chain complementarity determining region 3 for antibody 783
ARDRAGDH

SEQ ID NO: 1567 - protein, 9 aa, Homo sapiens
  light chain complementarity determining region 3 for antibody 784
QQRSNWPPL

SEQ ID NO: 1568 - protein, 11 aa, Homo sapiens
  heavy chain complementarity determining region 3 for antibody 784
ARDFRYGFLSD

SEQ ID NO: 1569 - protein, 9 aa, Homo sapiens
  light chain complementarity determining region 3 for antibody 785
QNYDDWPHT

SEQ ID NO: 1570 - protein, 17 aa, Homo sapiens
  heavy chain complementarity determining region 3 for antibody 785
ARDHCLDSAIYCTYFDC

SEQ ID NO: 1571 - protein, 9 aa, Homo sapiens
  light chain complementarity determining region 3 for antibody 786
LQHNTYPVT

SEQ ID NO: 1572 - protein, 10 aa, Homo sapiens
  heavy chain complementarity determining region 3 for antibody 786
STVAGITNDY

SEQ ID NO: 1573 - protein, 9 aa, Homo sapiens
  light chain complementarity determining region 3 for antibody 787
LQHNSYPLT

SEQ ID NO: 1574 - protein, 11 aa, Homo sapiens
  heavy chain complementarity determining region 3 for antibody 787
VRVSAGWNFDY

SEQ ID NO: 1575 - protein, 9 aa, Homo sapiens
  light chain complementarity determining region 3 for antibody 788
LQFYTAPWT

SEQ ID NO: 1576 - protein, 17 aa, Homo sapiens
  heavy chain complementarity determining region 3 for antibody 788
SRDVRIEWPGSHGSLDS

SEQ ID NO: 1577 - protein, 9 aa, Homo sapiens
  light chain complementarity determining region 3 for antibody 789
LQDYSYPLS

SEQ ID NO: 1578 - protein, 16 aa, Homo sapiens
  heavy chain complementarity determining region 3 for antibody 789
SADVGDHRDRYVTLDH

SEQ ID NO: 1579 - protein, 9 aa, Homo sapiens
  light chain complementarity determining region 3 for antibody 790
HQRSNWPST

SEQ ID NO: 1580 - protein, 15 aa, Homo sapiens
  heavy chain complementarity determining region 3 for antibody 790
ARGAEPRDYYYNMDV

SEQ ID NO: 1581 - protein, 9 aa, Homo sapiens
  light chain complementarity determining region 3 for antibody 791
VQGVHWPWT

SEQ ID NO: 1582 - protein, 13 aa, Homo sapiens
  heavy chain complementarity determining region 3 for antibody 791
ARLDNTVSGVIDY

SEQ ID NO: 1583 - protein, 8 aa, Homo sapiens
  light chain complementarity determining region 3 for antibody 792
QQYYSWKT

SEQ ID NO: 1584 - protein, 8 aa, Homo sapiens
  heavy chain complementarity determining region 3 for antibody 792
ARDGDGYD

SEQ ID NO: 1585 - protein, 8 aa, Homo sapiens
  light chain complementarity determining region 3 for antibody 793
QQYYSSPT

SEQ ID NO: 1586 - protein, 18 aa, Homo sapiens
  heavy chain complementarity determining region 3 for antibody 793
AREEYTTSGYYYFYYIDV

SEQ ID NO: 1587 - protein, 9 aa, Homo sapiens
  light chain complementarity determining region 3 for antibody 794
QQYSDSPRT

SEQ ID NO: 1588 - protein, 10 aa, Homo sapiens
  heavy chain complementarity determining region 3 for antibody 794
ARETSGAYDI

SEQ ID NO: 1589 - protein, 9 aa, Homo sapiens
  light chain complementarity determining region 3 for antibody 795
QQADPFPRT

SEQ ID NO: 1590 - protein, 10 aa, Homo sapiens
  heavy chain complementarity determining region 3 for antibody 795
ARETSGSYDI

SEQ ID NO: 1591 - protein, 10 aa, Homo sapiens
  light chain complementarity determining region 3 for antibody 796
QESYSTPLFT

SEQ ID NO: 1592 - protein, 23 aa, Homo sapiens
  heavy chain complementarity determining region 3 for antibody 796
ARHFPKGGSGITGTQSLHYYMDV

SEQ ID NO: 1593 - protein, 9 aa, Homo sapiens
  light chain complementarity determining region 3 for antibody 797
AQGSYWPAS

SEQ ID NO: 1594 - protein, 10 aa, Homo sapiens
  heavy chain complementarity determining region 3 for antibody 797
CREREGFGDV

SEQ ID NO: 1595 - protein, 9 aa, Homo sapiens
  light chain complementarity determining region 3 for antibody 798
QQYYSTPPT

SEQ ID NO: 1596 - protein, 10 aa, Homo sapiens
  heavy chain complementarity determining region 3 for antibody 798
AKNSINYYDM

SEQ ID NO: 1597 - protein, 10 aa, Homo sapiens
  light chain complementarity determining region 3 for antibody 799
QQYNNWPPYT

SEQ ID NO: 1598 - protein, 14 aa, Homo sapiens
  heavy chain complementarity determining region 3 for antibody 799
ARENCYGTGSCFDY

SEQ ID NO: 1599 - protein, 9 aa, Homo sapiens
  light chain complementarity determining region 3 for antibody 800
QQYDNLPLT

SEQ ID NO: 1600 - protein, 11 aa, Homo sapiens
  heavy chain complementarity determining region 3 for antibody 800
AREPAWGDLDY

SEQ ID NO: 1601 - protein, 9 aa, Homo sapiens
  light chain complementarity determining region 3 for antibody 801
QKYDNAPWT

SEQ ID NO: 1602 - protein, 7 aa, Homo sapiens
  heavy chain complementarity determining region 3 for antibody 801
GDGHYGR

SEQ ID NO: 1603 - protein, 10 aa, Homo sapiens
  light chain complementarity determining region 3 for antibody 802
QESYSTPLFT

SEQ ID NO: 1604 - protein, 23 aa, Homo sapiens
  heavy chain complementarity determining region 3 for antibody 802
ARHFPKGGSGVTGTQSLHYYMDV

SEQ ID NO: 1605 - protein, 9 aa, Homo sapiens
  light chain complementarity determining region 3 for antibody 803
MQLLQIPIT

SEQ ID NO: 1606 - protein, 11 aa, Homo sapiens
  heavy chain complementarity determining region 3 for antibody 803
ARSLTGNLMDV

SEQ ID NO: 1607 - protein, 9 aa, Homo sapiens
  light chain complementarity determining region 3 for antibody 804
LQHNSYPPT

SEQ ID NO: 1608 - protein, 10 aa, Homo sapiens
  heavy chain complementarity determining region 3 for antibody 804
TTGSGPTNDY

SEQ ID NO: 1609 - protein, 9 aa, Homo sapiens
  light chain complementarity determining region 3 for antibody 805
HQYNYFPYT

SEQ ID NO: 1610 - protein, 17 aa, Homo sapiens
  heavy chain complementarity determining region 3 for antibody 805
AREDWNDVDLRLFYLDY

SEQ ID NO: 1611 - protein, 9 aa, Homo sapiens
  light chain complementarity determining region 3 for antibody 806
QQYYSFPPT

SEQ ID NO: 1612 - protein, 13 aa, Homo sapiens
  heavy chain complementarity determining region 3 for antibody 806
ATGAPSSGSVFDN

SEQ ID NO: 1613 - protein, 9 aa, Homo sapiens
  light chain complementarity determining region 3 for antibody 807
QQYYNIPFA

SEQ ID NO: 1614 - protein, 14 aa, Homo sapiens
  heavy chain complementarity determining region 3 for antibody 807
AKGRIASCYDVSDM

SEQ ID NO: 1615 - protein, 7 aa, Homo sapiens
  light chain complementarity determining region 3 for antibody 808
QQYNTWT

SEQ ID NO: 1616 - protein, 12 aa, Homo sapiens
  heavy chain complementarity determining region 3 for antibody 808
AIVVPGRWDLDD

SEQ ID NO: 1617 - protein, 8 aa, Homo sapiens
  light chain complementarity determining region 3 for antibody 809
QQYGDSFP

SEQ ID NO: 1618 - protein, 16 aa, Homo sapiens
  heavy chain complementarity determining region 3 for antibody 809
AIWAAVSSGWSGPFDF

SEQ ID NO: 1619 - protein, 10 aa, Homo sapiens
  light chain complementarity determining region 3 for antibody 810
QQRTNWPQLT

SEQ ID NO: 1620 - protein, 15 aa, Homo sapiens
  heavy chain complementarity determining region 3 for antibody 810
AKPWFTVTTTGVFDI

SEQ ID NO: 1621 - protein, 9 aa, Homo sapiens
  light chain complementarity determining region 3 for antibody 811
MQGTYWPHT

SEQ ID NO: 1622 - protein, 11 aa, Homo sapiens
  heavy chain complementarity determining region 3 for antibody 811
ARDPGWGACDY

SEQ ID NO: 1623 - protein, 9 aa, Homo sapiens
  light chain complementarity determining region 3 for antibody 812
MQGTHWPHT

SEQ ID NO: 1624 - protein, 11 aa, Homo sapiens
  heavy chain complementarity determining region 3 for antibody 812
ATFGQQWRLPH

SEQ ID NO: 1625 - protein, 9 aa, Homo sapiens
  light chain complementarity determining region 3 for antibody 813
LQTANSPRT

SEQ ID NO: 1626 - protein, 13 aa, Homo sapiens
  heavy chain complementarity determining region 3 for antibody 813
ARGSTATSWNIDY

SEQ ID NO: 1627 - protein, 9 aa, Homo sapiens
  light chain complementarity determining region 3 for antibody 814
LQFYTAPWT

SEQ ID NO: 1628 - protein, 17 aa, Homo sapiens
  heavy chain complementarity determining region 3 for antibody 814
SRDGRIIWPGSQGSLDS

SEQ ID NO: 1629 - protein, 9 aa, Homo sapiens
  light chain complementarity determining region 3 for antibody 815
LQDYSYPFT

SEQ ID NO: 1630 - protein, 15 aa, Homo sapiens
  heavy chain complementarity determining region 3 for antibody 815
TRDEYTGSHIEAFDI

SEQ ID NO: 1631 - protein, 10 aa, Homo sapiens
  light chain complementarity determining region 3 for antibody 816
FQGSHWPPFT

SEQ ID NO: 1632 - protein, 9 aa, Homo sapiens
  heavy chain complementarity determining region 3 for antibody 816
VRNNYYMDV

SEQ ID NO: 1633 - protein, 10 aa, Homo sapiens
  light chain complementarity determining region 3 for antibody 817
QQYHNLPPWT

SEQ ID NO: 1634 - protein, 18 aa, Homo sapiens
  heavy chain complementarity determining region 3 for antibody 817
AKDTFGTPYDTSGYYYDY

SEQ ID NO: 1635 - protein, 9 aa, Homo sapiens
  light chain complementarity determining region 3 for antibody 818
QQYGSSLWT

SEQ ID NO: 1636 - protein, 11 aa, Homo sapiens
  heavy chain complementarity determining region 3 for antibody 818
ALKIAAFPFDY

SEQ ID NO: 1637 - protein, 9 aa, Homo sapiens
  light chain complementarity determining region 3 for antibody 819
QQSYTTPLT

SEQ ID NO: 1638 - protein, 15 aa, Homo sapiens
  heavy chain complementarity determining region 3 for antibody 819
ARSPYGGFLEWSQHD

SEQ ID NO: 1639 - protein, 9 aa, Homo sapiens
  light chain complementarity determining region 3 for antibody 820
QQSYSTPWT

SEQ ID NO: 1640 - protein, 15 aa, Homo sapiens
  heavy chain complementarity determining region 3 for antibody 820
ARIWRSSRNVYYFDF

SEQ ID NO: 1641 - protein, 9 aa, Homo sapiens
  light chain complementarity determining region 3 for antibody 821
QQSYSAPRT

SEQ ID NO: 1642 - protein, 12 aa, Homo sapiens
  heavy chain complementarity determining region 3 for antibody 821
QGGNWGRDGFDI

SEQ ID NO: 1643 - protein, 9 aa, Homo sapiens
  light chain complementarity determining region 3 for antibody 822
QQSDSTPYT

SEQ ID NO: 1644 - protein, 13 aa, Homo sapiens
  heavy chain complementarity determining region 3 for antibody 822
ARGGVLTGWEFDS

SEQ ID NO: 1645 - protein, 9 aa, Homo sapiens
  light chain complementarity determining region 3 for antibody 823
QQLNSYPLT

SEQ ID NO: 1646 - protein, 13 aa, Homo sapiens
  heavy chain complementarity determining region 3 for antibody 823
ARRPGLDYVGFEY

SEQ ID NO: 1647 - protein, 9 aa, Homo sapiens
  light chain complementarity determining region 3 for antibody 824
QQLNSSPYT

SEQ ID NO: 1648 - protein, 12 aa, Homo sapiens
  heavy chain complementarity determining region 3 for antibody 824
NADHGYVDGFDI

SEQ ID NO: 1649 - protein, 9 aa, Homo sapiens
  light chain complementarity determining region 3 for antibody 825
QQIHSAPPT

SEQ ID NO: 1650 - protein, 13 aa, Homo sapiens
  heavy chain complementarity determining region 3 for antibody 825
TRFGPTPHTNRDH

SEQ ID NO: 1651 - protein, 9 aa, Homo sapiens
  light chain complementarity determining region 3 for antibody 826
QQDYDFPWT

SEQ ID NO: 1652 - protein, 13 aa, Homo sapiens
  heavy chain complementarity determining region 3 for antibody 826
AKDVRAYLSMIDL

SEQ ID NO: 1653 - protein, 8 aa, Homo sapiens
  light chain complementarity determining region 3 for antibody 827
QHYKGYPA

SEQ ID NO: 1654 - protein, 15 aa, Homo sapiens
  heavy chain complementarity determining region 3 for antibody 827
GRHVFSGSQPDYVDY

SEQ ID NO: 1655 - protein, 9 aa, Homo sapiens
  light chain complementarity determining region 3 for antibody 828
WQGTHWPGT

SEQ ID NO: 1656 - protein, 11 aa, Homo sapiens
  heavy chain complementarity determining region 3 for antibody 828
TKDHGGARAGH

SEQ ID NO: 1657 - protein, 9 aa, Homo sapiens
  light chain complementarity determining region 3 for antibody 829
QQYSNWPWT

SEQ ID NO: 1658 - protein, 16 aa, Homo sapiens
  heavy chain complementarity determining region 3 for antibody 829
AKDQYFGKSINGPFDS

SEQ ID NO: 1659 - protein, 9 aa, Homo sapiens
  light chain complementarity determining region 3 for antibody 830
QQYNRYPWT

SEQ ID NO: 1660 - protein, 14 aa, Homo sapiens
  heavy chain complementarity determining region 3 for antibody 830
VREQGSGWYRTADY

SEQ ID NO: 1661 - protein, 8 aa, Homo sapiens
  light chain complementarity determining region 3 for antibody 831
QQYGSSWT

SEQ ID NO: 1662 - protein, 15 aa, Homo sapiens
  heavy chain complementarity determining region 3 for antibody 831
ARAGSVLAGLSFFDS

SEQ ID NO: 1663 - protein, 7 aa, Homo sapiens
  light chain complementarity determining region 3 for antibody 832
QQYGSPG

SEQ ID NO: 1664 - protein, 17 aa, Homo sapiens
  heavy chain complementarity determining region 3 for antibody 832
ARNTMVGTWQRQGNLDH

SEQ ID NO: 1665 - protein, 9 aa, Homo sapiens
  light chain complementarity determining region 3 for antibody 833
QQYGNSPLT

SEQ ID NO: 1666 - protein, 6 aa, Homo sapiens
  heavy chain complementarity determining region 3 for antibody 833
VRSVDY

SEQ ID NO: 1667 - protein, 10 aa, Homo sapiens
  light chain complementarity determining region 3 for antibody 834
QQYGNLASLT

SEQ ID NO: 1668 - protein, 13 aa, Homo sapiens
  heavy chain complementarity determining region 3 for antibody 834
AKEGSSPGPDFEY

SEQ ID NO: 1669 - protein, 9 aa, Homo sapiens
  light chain complementarity determining region 3 for antibody 835
QQSINWPRT

SEQ ID NO: 1670 - protein, 14 aa, Homo sapiens
  heavy chain complementarity determining region 3 for antibody 835
ATCPGYWDSCPFDY

SEQ ID NO: 1671 - protein, 9 aa, Homo sapiens
  light chain complementarity determining region 3 for antibody 836
QQLNSYPYT

SEQ ID NO: 1672 - protein, 9 aa, Homo sapiens
  heavy chain complementarity determining region 3 for antibody 836
ARGSGYNYY

SEQ ID NO: 1673 - protein, 9 aa, Homo sapiens
  light chain complementarity determining region 3 for antibody 837
MQVTHWPRT

SEQ ID NO: 1674 - protein, 15 aa, Homo sapiens
  heavy chain complementarity determining region 3 for antibody 837
ATVTCTNGWYNAFDI

SEQ ID NO: 1675 - protein, 9 aa, Homo sapiens
  light chain complementarity determining region 3 for antibody 838
MQGTYWPNT

SEQ ID NO: 1676 - protein, 11 aa, Homo sapiens
  heavy chain complementarity determining region 3 for antibody 838
ARGDGWYGLDF

SEQ ID NO: 1677 - protein, 9 aa, Homo sapiens
  light chain complementarity determining region 3 for antibody 839
MQALQTLYT

SEQ ID NO: 1678 - protein, 18 aa, Homo sapiens
  heavy chain complementarity determining region 3 for antibody 839
ARHSPIAFGVVSHYGMDV

SEQ ID NO: 1679 - protein, 9 aa, Homo sapiens
  light chain complementarity determining region 3 for antibody 840
LQNTNWPPT

SEQ ID NO: 1680 - protein, 10 aa, Homo sapiens
  heavy chain complementarity determining region 3 for antibody 840
ARDHWFSLDL

SEQ ID NO: 1681 - protein, 9 aa, Homo sapiens
  light chain complementarity determining region 3 for antibody 841
LQHNSYPWT

SEQ ID NO: 1682 - protein, 12 aa, Homo sapiens
  heavy chain complementarity determining region 3 for antibody 841
AIVVPGRWDLDD

SEQ ID NO: 1683 - protein, 9 aa, Homo sapiens
  light chain complementarity determining region 3 for antibody 842
QQYYSTPYT

SEQ ID NO: 1684 - protein, 16 aa, Homo sapiens
  heavy chain complementarity determining region 3 for antibody 842
AREYCGGDCYHSYFRY

SEQ ID NO: 1685 - protein, 9 aa, Homo sapiens
  light chain complementarity determining region 3 for antibody 843
QQYYSAPQA

SEQ ID NO: 1686 - protein, 9 aa, Homo sapiens
  heavy chain complementarity determining region 3 for antibody 843
ARDVWPEDC

SEQ ID NO: 1687 - protein, 9 aa, Homo sapiens
  light chain complementarity determining region 3 for antibody 844
QQYNTYPWT

SEQ ID NO: 1688 - protein, 14 aa, Homo sapiens
  heavy chain complementarity determining region 3 for antibody 844
VREEGSGYYRTADY

SEQ ID NO: 1689 - protein, 8 aa, Homo sapiens
  light chain complementarity determining region 3 for antibody 845
QQYKTDWT

SEQ ID NO: 1690 - protein, 11 aa, Homo sapiens
  heavy chain complementarity determining region 3 for antibody 845
IRHLEFQRPDV

SEQ ID NO: 1691 - protein, 9 aa, Homo sapiens
  light chain complementarity determining region 3 for antibody 846
QQSYSAPRT

SEQ ID NO: 1692 - protein, 17 aa, Homo sapiens
  heavy chain complementarity determining region 3 for antibody 846
ARDFLAGRTGNYYYMDV

SEQ ID NO: 1693 - protein, 9 aa, Homo sapiens
  light chain complementarity determining region 3 for antibody 847
QQSYMTPPT

SEQ ID NO: 1694 - protein, 21 aa, Homo sapiens
  heavy chain complementarity determining region 3 for antibody 847
VRDFPRGGRYRTDRDYYYMDV

SEQ ID NO: 1695 - protein, 10 aa, Homo sapiens
  light chain complementarity determining region 3 for antibody 848
QHYYSTPPWT

SEQ ID NO: 1696 - protein, 14 aa, Homo sapiens
  heavy chain complementarity determining region 3 for antibody 848
VSQSRSAVNGGGVY

SEQ ID NO: 1697 - protein, 9 aa, Homo sapiens
  light chain complementarity determining region 3 for antibody 849
QHYYSAPLT

SEQ ID NO: 1698 - protein, 14 aa, Homo sapiens
  heavy chain complementarity determining region 3 for antibody 849
ARPTSGPGSFLIDS

SEQ ID NO: 1699 - protein, 10 aa, Homo sapiens
  light chain complementarity determining region 3 for antibody 850
QHYHDWPPYT

SEQ ID NO: 1700 - protein, 17 aa, Homo sapiens
  heavy chain complementarity determining region 3 for antibody 850
ARGWAPGKTRNRDGYNC

SEQ ID NO: 1701 - protein, 10 aa, Homo sapiens
  light chain complementarity determining region 3 for antibody 851
QHFGSSPIYT

SEQ ID NO: 1702 - protein, 18 aa, Homo sapiens
  heavy chain complementarity determining region 3 for antibody 851
AREMSSDYDDSYYYAMDV

SEQ ID NO: 1703 - protein, 9 aa, Homo sapiens
  light chain complementarity determining region 3 for antibody 852
MQGTHWPVT

SEQ ID NO: 1704 - protein, 12 aa, Homo sapiens
  heavy chain complementarity determining region 3 for antibody 852
TRDPDTSSKVDY

SEQ ID NO: 1705 - protein, 9 aa, Homo sapiens
  light chain complementarity determining region 3 for antibody 853
LQYYTAPWA

SEQ ID NO: 1706 - protein, 17 aa, Homo sapiens
  heavy chain complementarity determining region 3 for antibody 853
ARDGRIEWPGSQGSLDS

SEQ ID NO: 1707 - protein, 9 aa, Homo sapiens
  light chain complementarity determining region 3 for antibody 854
QQYVGSVRT

SEQ ID NO: 1708 - protein, 14 aa, Homo sapiens
  heavy chain complementarity determining region 3 for antibody 854
AAPPGGYSYAPFEF

SEQ ID NO: 1709 - protein, 9 aa, Homo sapiens
  light chain complementarity determining region 3 for antibody 855
QQYNSYPLT

SEQ ID NO: 1710 - protein, 12 aa, Homo sapiens
  heavy chain complementarity determining region 3 for antibody 855
MRGNPPSSSLDY

SEQ ID NO: 1711 - protein, 9 aa, Homo sapiens
  light chain complementarity determining region 3 for antibody 856
QQYGSSPWT

SEQ ID NO: 1712 - protein, 12 aa, Homo sapiens
  heavy chain complementarity determining region 3 for antibody 856
ARDKGGRNGMDV

SEQ ID NO: 1713 - protein, 9 aa, Homo sapiens
  light chain complementarity determining region 3 for antibody 857
QQTYSTVFT

SEQ ID NO: 1714 - protein, 14 aa, Homo sapiens
  heavy chain complementarity determining region 3 for antibody 857
ARDFVIRGHVGMDV

SEQ ID NO: 1715 - protein, 9 aa, Homo sapiens
  light chain complementarity determining region 3 for antibody 858
QQSYGGMYT

SEQ ID NO: 1716 - protein, 14 aa, Homo sapiens
  heavy chain complementarity determining region 3 for antibody 858
ASVRGRIAVAAFDS

SEQ ID NO: 1717 - protein, 9 aa, Homo sapiens
  light chain complementarity determining region 3 for antibody 859
QQFNSYPYT

SEQ ID NO: 1718 - protein, 9 aa, Homo sapiens
  heavy chain complementarity determining region 3 for antibody 859
ARDVWPEDY

SEQ ID NO: 1719 - protein, 7 aa, Homo sapiens
  light chain complementarity determining region 3 for antibody 860
QHYNSWT

SEQ ID NO: 1720 - protein, 13 aa, Homo sapiens
  heavy chain complementarity determining region 3 for antibody 860
AKEGSSPGPDFEY

SEQ ID NO: 1721 - protein, 9 aa, Homo sapiens
  light chain complementarity determining region 3 for antibody 861
LQYDTYPWT

SEQ ID NO: 1722 - protein, 9 aa, Homo sapiens
  heavy chain complementarity determining region 3 for antibody 861
ARGHYGPDY

SEQ ID NO: 1723 - protein, 9 aa, Homo sapiens
  light chain complementarity determining region 3 for antibody 862
LQHNSYPYT

SEQ ID NO: 1724 - protein, 10 aa, Homo sapiens
  heavy chain complementarity determining region 3 for antibody 862
ASVLSGNSGY

SEQ ID NO: 1725 - protein, 9 aa, Homo sapiens
  light chain complementarity determining region 3 for antibody 863
HQCASSPKT

SEQ ID NO: 1726 - protein, 13 aa, Homo sapiens
  heavy chain complementarity determining region 3 for antibody 863
ARDGSSDWYELAY

SEQ ID NO: 1727 - protein, 7 aa, Homo sapiens
  light chain complementarity determining region 3 for antibody 864
QQYNSYG

SEQ ID NO: 1728 - protein, 18 aa, Homo sapiens
  heavy chain complementarity determining region 3 for antibody 864
AKEWKWAAVAGAGVGFNY

SEQ ID NO: 1729 - protein, 9 aa, Homo sapiens
  light chain complementarity determining region 3 for antibody 865
QQYKSYPLT

SEQ ID NO: 1730 - protein, 18 aa, Homo sapiens
  heavy chain complementarity determining region 3 for antibody 865
TCLPTGPTSNYYYNGMDV

SEQ ID NO: 1731 - protein, 10 aa, Homo sapiens
  light chain complementarity determining region 3 for antibody 866
QQYKNWPPYT

SEQ ID NO: 1732 - protein, 14 aa, Homo sapiens
  heavy chain complementarity determining region 3 for antibody 866
ARENCYGVGSCFDY

SEQ ID NO: 1733 - protein, 10 aa, Homo sapiens
  light chain complementarity determining region 3 for antibody 867
QQYGSSPRYT

SEQ ID NO: 1734 - protein, 12 aa, Homo sapiens
  heavy chain complementarity determining region 3 for antibody 867
ARVRGAAGEFDY

SEQ ID NO: 1735 - protein, 9 aa, Homo sapiens
  light chain complementarity determining region 3 for antibody 868
QQLSRYPIT

SEQ ID NO: 1736 - protein, 13 aa, Homo sapiens
  heavy chain complementarity determining region 3 for antibody 868
AKEGSAPGPDFEY

SEQ ID NO: 1737 - protein, 9 aa, Homo sapiens
  light chain complementarity determining region 3 for antibody 869
QQFYNTPYT

SEQ ID NO: 1738 - protein, 10 aa, Homo sapiens
  heavy chain complementarity determining region 3 for antibody 869
SRSSDGYPDY

SEQ ID NO: 1739 - protein, 9 aa, Homo sapiens
  light chain complementarity determining region 3 for antibody 870
MQALQAPPT

SEQ ID NO: 1740 - protein, 10 aa, Homo sapiens
  heavy chain complementarity determining region 3 for antibody 870
TRHYNWHFDH

SEQ ID NO: 1741 - protein, 11 aa, Homo sapiens
  light chain complementarity determining region 3 for antibody 871
HQRSRWPPEFT

SEQ ID NO: 1742 - protein, 15 aa, Homo sapiens
  heavy chain complementarity determining region 3 for antibody 871
ARDGGSGTSQTYLDY

SEQ ID NO: 1743 - protein, 9 aa, Homo sapiens
  light chain complementarity determining region 3 for antibody 872
HHYGGSPRT

SEQ ID NO: 1744 - protein, 16 aa, Homo sapiens
  heavy chain complementarity determining region 3 for antibody 872
AQDLGSEWNHFNWFDP

SEQ ID NO: 1745 - protein, 8 aa, Homo sapiens
  light chain complementarity determining region 3 for antibody 873
QQYVSSLT

SEQ ID NO: 1746 - protein, 19 aa, Homo sapiens
  heavy chain complementarity determining region 3 for antibody 873
AKRAGTMTTFNYYYYYMDV

SEQ ID NO: 1747 - protein, 7 aa, Homo sapiens
  light chain complementarity determining region 3 for antibody 874
QQYSSWT

SEQ ID NO: 1748 - protein, 16 aa, Homo sapiens
  heavy chain complementarity determining region 3 for antibody 874
AKEHSTAKQWYGDFDS

SEQ ID NO: 1749 - protein, 10 aa, Homo sapiens
  light chain complementarity determining region 3 for antibody 875
QQYNKWPPWR

SEQ ID NO: 1750 - protein, 15 aa, Homo sapiens
  heavy chain complementarity determining region 3 for antibody 875
ARDIRVGASEYYFDC

SEQ ID NO: 1751 - protein, 9 aa, Homo sapiens
  light chain complementarity determining region 3 for antibody 876
QQYAASPLT

SEQ ID NO: 1752 - protein, 13 aa, Homo sapiens
  heavy chain complementarity determining region 3 for antibody 876
VRGTCAGCWQFDY

SEQ ID NO: 1753 - protein, 9 aa, Homo sapiens
  light chain complementarity determining region 3 for antibody 877
QQSYSSPYT

SEQ ID NO: 1754 - protein, 11 aa, Homo sapiens
  heavy chain complementarity determining region 3 for antibody 877
ARDAGWGACDY

SEQ ID NO: 1755 - protein, 10 aa, Homo sapiens
  light chain complementarity determining region 3 for antibody 878
QQRSNWPRLT

SEQ ID NO: 1756 - protein, 21 aa, Homo sapiens
  heavy chain complementarity determining region 3 for antibody 878
GRWGAGYYDSNGNYFGRAIDN

SEQ ID NO: 1757 - protein, 9 aa, Homo sapiens
  light chain complementarity determining region 3 for antibody 879
QQHGSYPLT

SEQ ID NO: 1758 - protein, 16 aa, Homo sapiens
  heavy chain complementarity determining region 3 for antibody 879
ARHGVLPAAIHDAFDI

SEQ ID NO: 1759 - protein, 9 aa, Homo sapiens
  light chain complementarity determining region 3 for antibody 880
QQADSFPYT

SEQ ID NO: 1760 - protein, 16 aa, Homo sapiens
  heavy chain complementarity determining region 3 for antibody 880
ARDQRLGYGVPDACDI

SEQ ID NO: 1761 - protein, 9 aa, Homo sapiens
  light chain complementarity determining region 3 for antibody 881
QLSGGSLLT

SEQ ID NO: 1762 - protein, 12 aa, Homo sapiens
  heavy chain complementarity determining region 3 for antibody 881
ALDEWHPSWYKY

SEQ ID NO: 1763 - protein, 10 aa, Homo sapiens
  light chain complementarity determining region 3 for antibody 882
QKYNSAPPIT

SEQ ID NO: 1764 - protein, 17 aa, Homo sapiens
  heavy chain complementarity determining region 3 for antibody 882
ARNTMVGTWQRQGNLDH

SEQ ID NO: 1765 - protein, 10 aa, Homo sapiens
  light chain complementarity determining region 3 for antibody 883
QHYGTSYPNT

SEQ ID NO: 1766 - protein, 14 aa, Homo sapiens
  heavy chain complementarity determining region 3 for antibody 883
ATHKFDTPRGAFDI

SEQ ID NO: 1767 - protein, 9 aa, Homo sapiens
  light chain complementarity determining region 3 for antibody 884
MQSTHWPYT

SEQ ID NO: 1768 - protein, 14 aa, Homo sapiens
  heavy chain complementarity determining region 3 for antibody 884
ARDSFFDWPASGDY

SEQ ID NO: 1769 - protein, 9 aa, Homo sapiens
  light chain complementarity determining region 3 for antibody 885
MQGLQIPRT

SEQ ID NO: 1770 - protein, 13 aa, Homo sapiens
  heavy chain complementarity determining region 3 for antibody 885
ARDHTYSVPRGGY

SEQ ID NO: 1771 - protein, 8 aa, Homo sapiens
  light chain complementarity determining region 3 for antibody 886
MQGAQWPT

SEQ ID NO: 1772 - protein, 18 aa, Homo sapiens
  heavy chain complementarity determining region 3 for antibody 886
AGGDYPEARTGYYLDFDY

SEQ ID NO: 1773 - protein, 9 aa, Homo sapiens
  light chain complementarity determining region 3 for antibody 887
LQHNSYPWT

SEQ ID NO: 1774 - protein, 11 aa, Homo sapiens
  heavy chain complementarity determining region 3 for antibody 887
ARDGGRFSDDY

SEQ ID NO: 1775 - protein, 9 aa, Homo sapiens
  light chain complementarity determining region 3 for antibody 888
LQHNNYPYT

SEQ ID NO: 1776 - protein, 13 aa, Homo sapiens
  heavy chain complementarity determining region 3 for antibody 888
AKDNPSAPGTFDQ

SEQ ID NO: 1777 - protein, 9 aa, Homo sapiens
  light chain complementarity determining region 3 for antibody 889
LHDYNYPLT

SEQ ID NO: 1778 - protein, 18 aa, Homo sapiens
  heavy chain complementarity determining region 3 for antibody 889
ARVENHHDSGNYFWALDI

SEQ ID NO: 1779 - protein, 9 aa, Homo sapiens
  light chain complementarity determining region 3 for antibody 890
QQYNVYPLT

SEQ ID NO: 1780 - protein, 13 aa, Homo sapiens
  heavy chain complementarity determining region 3 for antibody 890
ARDGSSDWYELAY

SEQ ID NO: 1781 - protein, 9 aa, Homo sapiens
  light chain complementarity determining region 3 for antibody 891
QQSYSSPRT

SEQ ID NO: 1782 - protein, 12 aa, Homo sapiens
  heavy chain complementarity determining region 3 for antibody 891
TSSRSGGGSVDF

SEQ ID NO: 1783 - protein, 10 aa, Homo sapiens
  light chain complementarity determining region 3 for antibody 892
QQSYSNPPYT

SEQ ID NO: 1784 - protein, 20 aa, Homo sapiens
  heavy chain complementarity determining region 3 for antibody 892
ARARSSGPGLYYDILTAFDC

SEQ ID NO: 1785 - protein, 10 aa, Homo sapiens
  light chain complementarity determining region 3 for antibody 893
QQSYSAPLFT

SEQ ID NO: 1786 - protein, 12 aa, Homo sapiens
  heavy chain complementarity determining region 3 for antibody 893
AIVVPGRWDLDD

SEQ ID NO: 1787 - protein, 9 aa, Homo sapiens
  light chain complementarity determining region 3 for antibody 894
QQMYRTPYT

SEQ ID NO: 1788 - protein, 14 aa, Homo sapiens
  heavy chain complementarity determining region 3 for antibody 894
ARMHGSGVGRWLDP

SEQ ID NO: 1789 - protein, 9 aa, Homo sapiens
  light chain complementarity determining region 3 for antibody 895
QQLKTYPIT

SEQ ID NO: 1790 - protein, 14 aa, Homo sapiens
  heavy chain complementarity determining region 3 for antibody 895
VRETTHNWTDGGIY

SEQ ID NO: 1791 - protein, 9 aa, Homo sapiens
  light chain complementarity determining region 3 for antibody 896
QQANSFPYT

SEQ ID NO: 1792 - protein, 17 aa, Homo sapiens
  heavy chain complementarity determining region 3 for antibody 896
ARGASGMNKEVKNWFDS

SEQ ID NO: 1793 - protein, 9 aa, Homo sapiens
  light chain complementarity determining region 3 for antibody 897
QHANTYPRT

SEQ ID NO: 1794 - protein, 10 aa, Homo sapiens
  heavy chain complementarity determining region 3 for antibody 897
ARETSGSYDL

SEQ ID NO: 1795 - protein, 7 aa, Homo sapiens
  light chain complementarity determining region 3 for antibody 898
QCNRNWA

SEQ ID NO: 1796 - protein, 20 aa, Homo sapiens
  heavy chain complementarity determining region 3 for antibody 898
STYLPGDCTCIGCFYWYSDF

SEQ ID NO: 1797 - protein, 9 aa, Homo sapiens
  light chain complementarity determining region 3 for antibody 899
MQGTHWPHT

SEQ ID NO: 1798 - protein, 11 aa, Homo sapiens
  heavy chain complementarity determining region 3 for antibody 899
ATCGQQWRLAH

SEQ ID NO: 1799 - protein, 9 aa, Homo sapiens
  light chain complementarity determining region 3 for antibody 900
MQDTHWPVA

SEQ ID NO: 1800 - protein, 8 aa, Homo sapiens
  heavy chain complementarity determining region 3 for antibody 900
VRGPSAQY

SEQ ID NO: 1801 - protein, 9 aa, Homo sapiens
  light chain complementarity determining region 3 for antibody 901
MQATHWPGT

SEQ ID NO: 1802 - protein, 12 aa, Homo sapiens
  heavy chain complementarity determining region 3 for antibody 901
ARGPLKMAGGSS

SEQ ID NO: 1803 - protein, 9 aa, Homo sapiens
  light chain complementarity determining region 3 for antibody 902
LYYDTYSRV

SEQ ID NO: 1804 - protein, 11 aa, Homo sapiens
  heavy chain complementarity determining region 3 for antibody 902
ATDSFSGGPGF

SEQ ID NO: 1805 - protein, 9 aa, Homo sapiens
  light chain complementarity determining region 3 for antibody 903
HQFKSYPWA

SEQ ID NO: 1806 - protein, 13 aa, Homo sapiens
  heavy chain complementarity determining region 3 for antibody 903
AKATVPTGGHFDY

SEQ ID NO: 1807 - protein, 9 aa, Homo sapiens
  light chain complementarity determining region 3 for antibody 904
HQCGSSPKT

SEQ ID NO: 1808 - protein, 13 aa, Homo sapiens
  heavy chain complementarity determining region 3 for antibody 904
ARDGDSDWYELAY

SEQ ID NO: 1809 - protein, 9 aa, Homo sapiens
  light chain complementarity determining region 3 for antibody 905
QQYYTSPRT

SEQ ID NO: 1810 - protein, 9 aa, Homo sapiens
  heavy chain complementarity determining region 3 for antibody 905
ARENYYLDA

SEQ ID NO: 1811 - protein, 9 aa, Homo sapiens
  light chain complementarity determining region 3 for antibody 906
QQYGSSPHI

SEQ ID NO: 1812 - protein, 17 aa, Homo sapiens
  heavy chain complementarity determining region 3 for antibody 906
ARNTMVHGWQRQGSVDH

SEQ ID NO: 1813 - protein, 10 aa, Homo sapiens
  light chain complementarity determining region 3 for antibody 907
QQRSNWPPIT

SEQ ID NO: 1814 - protein, 19 aa, Homo sapiens
  heavy chain complementarity determining region 3 for antibody 907
ARGNGPNWGILNSFYYMDV

SEQ ID NO: 1815 - protein, 9 aa, Homo sapiens
  light chain complementarity determining region 3 for antibody 908
QQHLYPPLT

SEQ ID NO: 1816 - protein, 21 aa, Homo sapiens
  heavy chain complementarity determining region 3 for antibody 908
ARGRRTDCRNGDIGCRPMFDF

SEQ ID NO: 1817 - protein, 9 aa, Homo sapiens
  light chain complementarity determining region 3 for antibody 909
QQCHTSPWT

SEQ ID NO: 1818 - protein, 10 aa, Homo sapiens
  heavy chain complementarity determining region 3 for antibody 909
AKSQGSYYSY

SEQ ID NO: 1819 - protein, 9 aa, Homo sapiens
  light chain complementarity determining region 3 for antibody 910
QHFGRSAWP

SEQ ID NO: 1820 - protein, 18 aa, Homo sapiens
  heavy chain complementarity determining region 3 for antibody 910
ARVIGREVTWGWQLGLDP

SEQ ID NO: 1821 - protein, 9 aa, Homo sapiens
  light chain complementarity determining region 3 for antibody 911
MQGTHWPIT

SEQ ID NO: 1822 - protein, 14 aa, Homo sapiens
  heavy chain complementarity determining region 3 for antibody 911
CRGWLDPATPHYDF

SEQ ID NO: 1823 - protein, 9 aa, Homo sapiens
  light chain complementarity determining region 3 for antibody 912
QQYNTAPWT

SEQ ID NO: 1824 - protein, 13 aa, Homo sapiens
  heavy chain complementarity determining region 3 for antibody 912
AKEGSSPGPDFDY

SEQ ID NO: 1825 - protein, 9 aa, Homo sapiens
  light chain complementarity determining region 3 for antibody 913
QQYHSTPIT

SEQ ID NO: 1826 - protein, 13 aa, Homo sapiens
  heavy chain complementarity determining region 3 for antibody 913
ARDSFSLPLEIDN

SEQ ID NO: 1827 - protein, 9 aa, Homo sapiens
  light chain complementarity determining region 3 for antibody 914
QQYGSSPHI

SEQ ID NO: 1828 - protein, 7 aa, Homo sapiens
  heavy chain complementarity determining region 3 for antibody 914
TTGDLRN

SEQ ID NO: 1829 - protein, 8 aa, Homo sapiens
  light chain complementarity determining region 3 for antibody 915
QQYGRPWT

SEQ ID NO: 1830 - protein, 13 aa, Homo sapiens
  heavy chain complementarity determining region 3 for antibody 915
ARDRPSTGWYLEY

SEQ ID NO: 1831 - protein, 8 aa, Homo sapiens
  light chain complementarity determining region 3 for antibody 916
QQSYTTPT

SEQ ID NO: 1832 - protein, 11 aa, Homo sapiens
  heavy chain complementarity determining region 3 for antibody 916
AKEATETTPGY

SEQ ID NO: 1833 - protein, 9 aa, Homo sapiens
  light chain complementarity determining region 3 for antibody 917
QQLNTYPVT

SEQ ID NO: 1834 - protein, 18 aa, Homo sapiens
  heavy chain complementarity determining region 3 for antibody 917
TRPDCSSPGCQGRDHFDP

SEQ ID NO: 1835 - protein, 9 aa, Homo sapiens
  light chain complementarity determining region 3 for antibody 918
QHYNNWWWT

SEQ ID NO: 1836 - protein, 10 aa, Homo sapiens
  heavy chain complementarity determining region 3 for antibody 918
AQSSSGHFDN

SEQ ID NO: 1837 - protein, 10 aa, Homo sapiens
  light chain complementarity determining region 3 for antibody 919
QHYGTSLGVT

SEQ ID NO: 1838 - protein, 16 aa, Homo sapiens
  heavy chain complementarity determining region 3 for antibody 919
AGILPPCGVMCLPFDY

SEQ ID NO: 1839 - protein, 9 aa, Homo sapiens
  light chain complementarity determining region 3 for antibody 920
MQSVDTPLG

SEQ ID NO: 1840 - protein, 12 aa, Homo sapiens
  heavy chain complementarity determining region 3 for antibody 920
VHQSHRMGMFAS

SEQ ID NO: 1841 - protein, 9 aa, Homo sapiens
  light chain complementarity determining region 3 for antibody 921
MQALQAPPT

SEQ ID NO: 1842 - protein, 10 aa, Homo sapiens
  heavy chain complementarity determining region 3 for antibody 921
ARHYNWHFDY

SEQ ID NO: 1843 - protein, 10 aa, Homo sapiens
  light chain complementarity determining region 3 for antibody 922
MAGAHWPPYT

SEQ ID NO: 1844 - protein, 10 aa, Homo sapiens
  heavy chain complementarity determining region 3 for antibody 922
ARDVWWSFDY

SEQ ID NO: 1845 - protein, 9 aa, Homo sapiens
  light chain complementarity determining region 3 for antibody 923
LQHYIYPYT

SEQ ID NO: 1846 - protein, 12 aa, Homo sapiens
  heavy chain complementarity determining region 3 for antibody 923
ARDYSCCNGFDP

SEQ ID NO: 1847 - protein, 9 aa, Homo sapiens
  light chain complementarity determining region 3 for antibody 924
LQDHKYPFT

SEQ ID NO: 1848 - protein, 16 aa, Homo sapiens
  heavy chain complementarity determining region 3 for antibody 924
AADLGDHADAYATLDN

SEQ ID NO: 1849 - protein, 9 aa, Homo sapiens
  light chain complementarity determining region 3 for antibody 925
VQGVHWPWT

SEQ ID NO: 1850 - protein, 13 aa, Homo sapiens
  heavy chain complementarity determining region 3 for antibody 925
ARLDNTVAGVIDF

SEQ ID NO: 1851 - protein, 8 aa, Homo sapiens
  light chain complementarity determining region 3 for antibody 926
QQYLSHFT

SEQ ID NO: 1852 - protein, 11 aa, Homo sapiens
  heavy chain complementarity determining region 3 for antibody 926
ARDRGGGALDH

SEQ ID NO: 1853 - protein, 9 aa, Homo sapiens
  light chain complementarity determining region 3 for antibody 927
QQYDNLPLT

SEQ ID NO: 1854 - protein, 12 aa, Homo sapiens
  heavy chain complementarity determining region 3 for antibody 927
ARDFTANYCPDY

SEQ ID NO: 1855 - protein, 9 aa, Homo sapiens
  light chain complementarity determining region 3 for antibody 928
QQTDRTPYT

SEQ ID NO: 1856 - protein, 14 aa, Homo sapiens
  heavy chain complementarity determining region 3 for antibody 928
ARLHGAGLGRWLDP

SEQ ID NO: 1857 - protein, 8 aa, Homo sapiens
  light chain complementarity determining region 3 for antibody 929
QQSYTKAT

SEQ ID NO: 1858 - protein, 10 aa, Homo sapiens
  heavy chain complementarity determining region 3 for antibody 929
ARETSGSYDI

SEQ ID NO: 1859 - protein, 9 aa, Homo sapiens
  light chain complementarity determining region 3 for antibody 930
QQSYSTPYT

SEQ ID NO: 1860 - protein, 21 aa, Homo sapiens
  heavy chain complementarity determining region 3 for antibody 930
ARAWRPSRKYYDILTGGYMDV

SEQ ID NO: 1861 - protein, 9 aa, Homo sapiens
  light chain complementarity determining region 3 for antibody 931
QQSYSTPYT

SEQ ID NO: 1862 - protein, 11 aa, Homo sapiens
  heavy chain complementarity determining region 3 for antibody 931
AHSGGSSVWVN

SEQ ID NO: 1863 - protein, 9 aa, Homo sapiens
  light chain complementarity determining region 3 for antibody 932
QQSYSTPQT

SEQ ID NO: 1864 - protein, 9 aa, Homo sapiens
  heavy chain complementarity determining region 3 for antibody 932
ARVRNGLDY

SEQ ID NO: 1865 - protein, 9 aa, Homo sapiens
  light chain complementarity determining region 3 for antibody 933
QQFRDLPRT

SEQ ID NO: 1866 - protein, 9 aa, Homo sapiens
  heavy chain complementarity determining region 3 for antibody 933
ARGRNNFRF

SEQ ID NO: 1867 - protein, 9 aa, Homo sapiens
  light chain complementarity determining region 3 for antibody 934
QQAYNLPLT

SEQ ID NO: 1868 - protein, 19 aa, Homo sapiens
  heavy chain complementarity determining region 3 for antibody 934
GRGQGFCTSTACRADAFDI

SEQ ID NO: 1869 - protein, 9 aa, Homo sapiens
  light chain complementarity determining region 3 for antibody 935
MQGRYWPYT

SEQ ID NO: 1870 - protein, 11 aa, Homo sapiens
  heavy chain complementarity determining region 3 for antibody 935
AREGWGSLLDY

SEQ ID NO: 1871 - protein, 9 aa, Homo sapiens
  light chain complementarity determining region 3 for antibody 936
MQARQIPYT

SEQ ID NO: 1872 - protein, 11 aa, Homo sapiens
  heavy chain complementarity determining region 3 for antibody 936
ATNSRGQGYEY

SEQ ID NO: 1873 - protein, 8 aa, Homo sapiens
  light chain complementarity determining region 3 for antibody 937
MQALQTPT

SEQ ID NO: 1874 - protein, 14 aa, Homo sapiens
  heavy chain complementarity determining region 3 for antibody 937
ATSPGYYESSPFDY

SEQ ID NO: 1875 - protein, 9 aa, Homo sapiens
  light chain complementarity determining region 3 for antibody 938
HQYHNWPRT

SEQ ID NO: 1876 - protein, 18 aa, Homo sapiens
  heavy chain complementarity determining region 3 for antibody 938
AKDLSGTPSKHTSSSQNY

SEQ ID NO: 1877 - protein, 9 aa, Homo sapiens
  light chain complementarity determining region 3 for antibody 939
HQHGNSPNT

SEQ ID NO: 1878 - protein, 11 aa, Homo sapiens
  heavy chain complementarity determining region 3 for antibody 939
ARDRLSSGYYD

SEQ ID NO: 1879 - protein, 10 aa, Homo sapiens
  light chain complementarity determining region 3 for antibody 940
FQGSHWPPFT

SEQ ID NO: 1880 - protein, 9 aa, Homo sapiens
  heavy chain complementarity determining region 3 for antibody 940
VRNNYWMDV

SEQ ID NO: 1881 - protein, 9 aa, Homo sapiens
  light chain complementarity determining region 3 for antibody 941
QQYSNWPWT

SEQ ID NO: 1882 - protein, 18 aa, Homo sapiens
  heavy chain complementarity determining region 3 for antibody 941
ASWAGSCSSTSCYAVYDY

SEQ ID NO: 1883 - protein, 9 aa, Homo sapiens
  light chain complementarity determining region 3 for antibody 942
QQYNSPPYT

SEQ ID NO: 1884 - protein, 15 aa, Homo sapiens
  heavy chain complementarity determining region 3 for antibody 942
ARHLSGETKVRYFDY

SEQ ID NO: 1885 - protein, 9 aa, Homo sapiens
  light chain complementarity determining region 3 for antibody 943
QQYNSFPWT

SEQ ID NO: 1886 - protein, 16 aa, Homo sapiens
  heavy chain complementarity determining region 3 for antibody 943
AKEWGYSSGWYGEFDY

SEQ ID NO: 1887 - protein, 9 aa, Homo sapiens
  light chain complementarity determining region 3 for antibody 944
QQYGTIPLT

SEQ ID NO: 1888 - protein, 11 aa, Homo sapiens
  heavy chain complementarity determining region 3 for antibody 944
ARSPATGTVDS

SEQ ID NO: 1889 - protein, 8 aa, Homo sapiens
  light chain complementarity determining region 3 for antibody 945
QQYGSSLT

SEQ ID NO: 1890 - protein, 13 aa, Homo sapiens
  heavy chain complementarity determining region 3 for antibody 945
ARRPGLDYVGFEY

SEQ ID NO: 1891 - protein, 8 aa, Homo sapiens
  light chain complementarity determining region 3 for antibody 946
QQSFGMYT

SEQ ID NO: 1892 - protein, 14 aa, Homo sapiens
  heavy chain complementarity determining region 3 for antibody 946
ANYRASIGANCFDP

SEQ ID NO: 1893 - protein, 7 aa, Homo sapiens
  light chain complementarity determining region 3 for antibody 947
QQRSNWL

SEQ ID NO: 1894 - protein, 11 aa, Homo sapiens
  heavy chain complementarity determining region 3 for antibody 947
VRERGGYYFDY

SEQ ID NO: 1895 - protein, 9 aa, Homo sapiens
  light chain complementarity determining region 3 for antibody 948
QQGGSPPYT

SEQ ID NO: 1896 - protein, 10 aa, Homo sapiens
  heavy chain complementarity determining region 3 for antibody 948
ARHFNWIYDY

SEQ ID NO: 1897 - protein, 9 aa, Homo sapiens
  light chain complementarity determining region 3 for antibody 949
QQFSDFPRT

SEQ ID NO: 1898 - protein, 9 aa, Homo sapiens
  heavy chain complementarity determining region 3 for antibody 949
LRGRNNFRY

SEQ ID NO: 1899 - protein, 10 aa, Homo sapiens
  light chain complementarity determining region 3 for antibody 950
QHYDTSPGWT

SEQ ID NO: 1900 - protein, 9 aa, Homo sapiens
  heavy chain complementarity determining region 3 for antibody 950
VGSSPDFDY

SEQ ID NO: 1901 - protein, 9 aa, Homo sapiens
  light chain complementarity determining region 3 for antibody 951
QERSTWPGS

SEQ ID NO: 1902 - protein, 13 aa, Homo sapiens
  heavy chain complementarity determining region 3 for antibody 951
ATAAWASSWWGDY

SEQ ID NO: 1903 - protein, 9 aa, Homo sapiens
  light chain complementarity determining region 3 for antibody 952
MQGTYWPNT

SEQ ID NO: 1904 - protein, 11 aa, Homo sapiens
  heavy chain complementarity determining region 3 for antibody 952
ARGDGWYGLDY

SEQ ID NO: 1905 - protein, 9 aa, Homo sapiens
  light chain complementarity determining region 3 for antibody 953
LQHNTYPWT

SEQ ID NO: 1906 - protein, 17 aa, Homo sapiens
  heavy chain complementarity determining region 3 for antibody 953
ARNTMVGTWQRQGNLDH

SEQ ID NO: 1907 - protein, 9 aa, Homo sapiens
  light chain complementarity determining region 3 for antibody 954
AQGSYWPAS

SEQ ID NO: 1908 - protein, 10 aa, Homo sapiens
  heavy chain complementarity determining region 3 for antibody 954
TTACGGDCSY

SEQ ID NO: 1909 - protein, 9 aa, Homo sapiens
  light chain complementarity determining region 3 for antibody 955
QQYNSYPFT

SEQ ID NO: 1910 - protein, 11 aa, Homo sapiens
  heavy chain complementarity determining region 3 for antibody 955
ARVAGPQLFDY

SEQ ID NO: 1911 - protein, 10 aa, Homo sapiens [sequence omitted]

SEQ ID NO: 1912 - protein, 13 aa, Homo sapiens
  heavy chain complementarity determining region 3 for antibody 956
AKEGSSPGPDFDS

SEQ ID NO: 1913 - protein, 9 aa, Homo sapiens
  light chain complementarity determining region 3 for antibody 957
QQYKTAPWT

SEQ ID NO: 1914 - protein, 20 aa, Homo sapiens
  heavy chain complementarity determining region 3 for antibody 957
ARDARGSTYYAYGGGGGLDV

SEQ ID NO: 1915 - protein, 9 aa, Homo sapiens
  light chain complementarity determining region 3 for antibody 958
QQYGNSPVP

SEQ ID NO: 1916 - protein, 18 aa, Homo sapiens
  heavy chain complementarity determining region 3 for antibody 958
ARGDYPEARANYFLDFDY

SEQ ID NO: 1917 - protein, 9 aa, Homo sapiens
  light chain complementarity determining region 3 for antibody 959
QQTSSFPLT

SEQ ID NO: 1918 - protein, 15 aa, Homo sapiens
  heavy chain complementarity determining region 3 for antibody 959
AKDTDLSYWFGWFDV

SEQ ID NO: 1919 - protein, 9 aa, Homo sapiens
  light chain complementarity determining region 3 for antibody 960
QQLYSYPLT

SEQ ID NO: 1920 - protein, 18 aa, Homo sapiens
  heavy chain complementarity determining region 3 for antibody 960
AHTPGINCAANRCYGFDS

SEQ ID NO: 1921 - protein, 10 aa, Homo sapiens
  light chain complementarity determining region 3 for antibody 961
QQFGGSPMYT

SEQ ID NO: 1922 - protein, 11 aa, Homo sapiens
  heavy chain complementarity determining region 3 for antibody 961
TRGGFSVGYDY

SEQ ID NO: 1923 - protein, 9 aa, Homo sapiens
  light chain complementarity determining region 3 for antibody 962
QQAYTYPLT

SEQ ID NO: 1924 - protein, 14 aa, Homo sapiens
  heavy chain complementarity determining region 3 for antibody 962
ARDPYGDPSSDFDY

SEQ ID NO: 1925 - protein, 8 aa, Homo sapiens
  light chain complementarity determining region 3 for antibody 963
QHYGRSLT

SEQ ID NO: 1926 - protein, 16 aa, Homo sapiens
  heavy chain complementarity determining region 3 for antibody 963
ARWNGYSESWSGPLDD

SEQ ID NO: 1927 - protein, 9 aa, Homo sapiens
  light chain complementarity determining region 3 for antibody 964
QEYKTPPWT

SEQ ID NO: 1928 - protein, 20 aa, Homo sapiens
  heavy chain complementarity determining region 3 for antibody 964
ARDGRGIVEYDYAGGGGLDV

SEQ ID NO: 1929 - protein, 9 aa, Homo sapiens
  light chain complementarity determining region 3 for antibody 965
MQGTHWPYT

SEQ ID NO: 1930 - protein, 8 aa, Homo sapiens
  heavy chain complementarity determining region 3 for antibody 965
LYYDYGDY

SEQ ID NO: 1931 - protein, 9 aa, Homo sapiens
  light chain complementarity determining region 3 for antibody 966
MQGTHWPWT

SEQ ID NO: 1932 - protein, 12 aa, Homo sapiens
  heavy chain complementarity determining region 3 for antibody 966
ASGPLREVTGML

SEQ ID NO: 1933 - protein, 9 aa, Homo sapiens
  light chain complementarity determining region 3 for antibody 967
MQGTHWPHT

SEQ ID NO: 1934 - protein, 12 aa, Homo sapiens
  heavy chain complementarity determining region 3 for antibody 967
AIVVPGRWDLDD

SEQ ID NO: 1935 - protein, 9 aa, Homo sapiens
  light chain complementarity determining region 3 for antibody 968
LQYHSYPLT

SEQ ID NO: 1936 - protein, 16 aa, Homo sapiens
  heavy chain complementarity determining region 3 for antibody 968
GRGNPPSCSGGTCFDY

SEQ ID NO: 1937 - protein, 9 aa, Homo sapiens
  light chain complementarity determining region 3 for antibody 969
LQHNYYALA

SEQ ID NO: 1938 - protein, 11 aa, Homo sapiens
  heavy chain complementarity determining region 3 for antibody 969
VRVSPGWNFDY

SEQ ID NO: 1939 - protein, 9 aa, Homo sapiens
  light chain complementarity determining region 3 for antibody 970
LQDYKYPFS

SEQ ID NO: 1940 - protein, 16 aa, Homo sapiens
  heavy chain complementarity determining region 3 for antibody 970
TSDVGDHRDSYTTLDI

SEQ ID NO: 1941 - protein, 9 aa, Homo sapiens
  light chain complementarity determining region 3 for antibody 971
IQATHWPFT

SEQ ID NO: 1942 - protein, 9 aa, Homo sapiens
  heavy chain complementarity determining region 3 for antibody 971
VRVGYGYDY

SEQ ID NO: 1943 - protein, 9 aa, Homo sapiens
  light chain complementarity determining region 3 for antibody 972
HQFKSYPWA

SEQ ID NO: 1944 - protein, 13 aa, Homo sapiens
  heavy chain complementarity determining region 3 for antibody 972
AKATVPTGGHFDH

SEQ ID NO: 1945 - protein, 9 aa, Homo sapiens
  light chain complementarity determining region 3 for antibody 973
QQYTGSPST

SEQ ID NO: 1946 - protein, 16 aa, Homo sapiens
  heavy chain complementarity determining region 3 for antibody 973
ARGPDRYSGYNLVFDY

SEQ ID NO: 1947 - protein, 9 aa, Homo sapiens
  light chain complementarity determining region 3 for antibody 974
QQYHTTLRT

SEQ ID NO: 1948 - protein, 19 aa, Homo sapiens
  heavy chain complementarity determining region 3 for antibody 974
VRARSDCSSAGCFEGFFDS

SEQ ID NO: 1949 - protein, 8 aa, Homo sapiens
  light chain complementarity determining region 3 for antibody 975
QQYGTSRT

SEQ ID NO: 1950 - protein, 17 aa, Homo sapiens
  heavy chain complementarity determining region 3 for antibody 975
ARDAILTSGWYVGLFDS

SEQ ID NO: 1951 - protein, 9 aa, Homo sapiens
  light chain complementarity determining region 3 for antibody 976
QQYGSSPRT

SEQ ID NO: 1952 - protein, 12 aa, Homo sapiens
  heavy chain complementarity determining region 3 for antibody 976
AKLWSMADTLDI

SEQ ID NO: 1953 - protein, 9 aa, Homo sapiens
  light chain complementarity determining region 3 for antibody 977
QQYGSSPLT

SEQ ID NO: 1954 - protein, 13 aa, Homo sapiens
  heavy chain complementarity determining region 3 for antibody 977
AKEGSSPGPDFDY

SEQ ID NO: 1955 - protein, 9 aa, Homo sapiens
  light chain complementarity determining region 3 for antibody 978
QQYGSFPRT

SEQ ID NO: 1956 - protein, 9 aa, Homo sapiens
  heavy chain complementarity determining region 3 for antibody 978
ARGDGFNLY

SEQ ID NO: 1957 - protein, 9 aa, Homo sapiens
  light chain complementarity determining region 3 for antibody 979
QQYGGSLIT

SEQ ID NO: 1958 - protein, 12 aa, Homo sapiens
  heavy chain complementarity determining region 3 for antibody 979
AADQWNISWYKY

SEQ ID NO: 1959 - protein, 9 aa, Homo sapiens
  light chain complementarity determining region 3 for antibody 980
QQYDSFSWT

SEQ ID NO: 1960 - protein, 11 aa, Homo sapiens
  heavy chain complementarity determining region 3 for antibody 980
ARTRPSVPFDN

SEQ ID NO: 1961 - protein, 9 aa, Homo sapiens
  light chain complementarity determining region 3 for antibody 981
QQYADSPNT

SEQ ID NO: 1962 - protein, 9 aa, Homo sapiens
  heavy chain complementarity determining region 3 for antibody 981
ASLYGSGSR

SEQ ID NO: 1963 - protein, 8 aa, Homo sapiens
  light chain complementarity determining region 3 for antibody 982
QQSYTTPT

SEQ ID NO: 1964 - protein, 11 aa, Homo sapiens
  heavy chain complementarity determining region 3 for antibody 982
AREQHGQAPDY

SEQ ID NO: 1965 - protein, 9 aa, Homo sapiens
  light chain complementarity determining region 3 for antibody 983
QQSYSTPPA

SEQ ID NO: 1966 - protein, 13 aa, Homo sapiens
  heavy chain complementarity determining region 3 for antibody 983
AKDGLYGSGRTLD

SEQ ID NO: 1967 - protein, 10 aa, Homo sapiens
  light chain complementarity determining region 3 for antibody 984
QDFNSAPTWT

SEQ ID NO: 1968 - protein, 14 aa, Homo sapiens
  heavy chain complementarity determining region 3 for antibody 984
ARDPGYTNGHAFDI

SEQ ID NO: 1969 - protein, 9 aa, Homo sapiens
  light chain complementarity determining region 3 for antibody 985
MQYSHWPHT

SEQ ID NO: 1970 - protein, 8 aa, Homo sapiens
  heavy chain complementarity determining region 3 for antibody 985
AGWGYANY

SEQ ID NO: 1971 - protein, 9 aa, Homo sapiens
  light chain complementarity determining region 3 for antibody 986
MQVTHWPRT

SEQ ID NO: 1972 - protein, 16 aa, Homo sapiens
  heavy chain complementarity determining region 3 for antibody 986
TADVGDHRDRYVTLDH

SEQ ID NO: 1973 - protein, 9 aa, Homo sapiens
  light chain complementarity determining region 3 for antibody 987
MQTTHWPRT

SEQ ID NO: 1974 - protein, 9 aa, Homo sapiens
  heavy chain complementarity determining region 3 for antibody 987
VKGVISLDY

SEQ ID NO: 1975 - protein, 9 aa, Homo sapiens
  light chain complementarity determining region 3 for antibody 988
MQGTYWPYT

SEQ ID NO: 1976 - protein, 11 aa, Homo sapiens
  heavy chain complementarity determining region 3 for antibody 988
AREGWGSLLDF

SEQ ID NO: 1977 - protein, 9 aa, Homo sapiens
  light chain complementarity determining region 3 for antibody 989
LQDHKYPFT

SEQ ID NO: 1978 - protein, 12 aa, Homo sapiens
  heavy chain complementarity determining region 3 for antibody 989
ARDKGGRNGMDV

SEQ ID NO: 1979 - protein, 9 aa, Homo sapiens
  light chain complementarity determining region 3 for antibody 990
HQYYTSPPT

SEQ ID NO: 1980 - protein, 10 aa, Homo sapiens
  heavy chain complementarity determining region 3 for antibody 990
AAGSGWLIEY

SEQ ID NO: 1981 - protein, 9 aa, Homo sapiens
  light chain complementarity determining region 3 for antibody 991
YQSAKSPRT

SEQ ID NO: 1982 - protein, 13 aa, Homo sapiens
  heavy chain complementarity determining region 3 for antibody 991
ARGATATSWNIDY

SEQ ID NO: 1983 - protein, 10 aa, Homo sapiens
  light chain complementarity determining region 3 for antibody 992
QQYYSTPPWT

SEQ ID NO: 1984 - protein, 12 aa, Homo sapiens
  heavy chain complementarity determining region 3 for antibody 992
QGLDRSGYSSVY

SEQ ID NO: 1985 - protein, 8 aa, Homo sapiens
  light chain complementarity determining region 3 for antibody 993
QQYSSHST

SEQ ID NO: 1986 - protein, 11 aa, Homo sapiens
  heavy chain complementarity determining region 3 for antibody 993
ARVRRRSPFDP

SEQ ID NO: 1987 - protein, 9 aa, Homo sapiens
  light chain complementarity determining region 3 for antibody 994
QQYRTVPWT

SEQ ID NO: 1988 - protein, 20 aa, Homo sapiens
  heavy chain complementarity determining region 3 for antibody 994
VKDGRGVGDYHSAGGSGLDV

SEQ ID NO: 1989 - protein, 9 aa, Homo sapiens
  light chain complementarity determining region 3 for antibody 995
QQYNSYPLT

SEQ ID NO: 1990 - protein, 10 aa, Homo sapiens
  heavy chain complementarity determining region 3 for antibody 995
AKYLRRAFDV

SEQ ID NO: 1991 - protein, 9 aa, Homo sapiens
  light chain complementarity determining region 3 for antibody 996
QQYNSYPFT

SEQ ID NO: 1992 - protein, 14 aa, Homo sapiens
  heavy chain complementarity determining region 3 for antibody 996
VRGALESSAYYFDY

SEQ ID NO: 1993 - protein, 9 aa, Homo sapiens
  light chain complementarity determining region 3 for antibody 997
QQYNSYLYT

SEQ ID NO: 1994 - protein, 19 aa, Homo sapiens
  heavy chain complementarity determining region 3 for antibody 997
VREGVRCRDGVCYNVTFDI

SEQ ID NO: 1995 - protein, 9 aa, Homo sapiens
  light chain complementarity determining region 3 for antibody 998
QQYGSSPRT

SEQ ID NO: 1996 - protein, 18 aa, Homo sapiens
  heavy chain complementarity determining region 3 for antibody 998
ARPLSLRGVSGTGDAFDI

SEQ ID NO: 1997 - protein, 9 aa, Homo sapiens
  light chain complementarity determining region 3 for antibody 999
QQYAYSPIT

SEQ ID NO: 1998 - protein, 14 aa, Homo sapiens
  heavy chain complementarity determining region 3 for antibody 999
ARADSGGVSFLINF

SEQ ID NO: 1999 - protein, 8 aa, Homo sapiens
  light chain complementarity determining region 3 for antibody 1000
QHYGHDWT

SEQ ID NO: 2000 - protein, 11 aa, Homo sapiens
  heavy chain complementarity determining region 3 for antibody 1000
GRHVFGVGLDV

SEQ ID NO: 2001 - protein, 9 aa, Homo sapiens
  light chain complementarity determining region 3 for antibody 1001
MQYTHWPHT

SEQ ID NO: 2002 - protein, 8 aa, Homo sapiens
  heavy chain complementarity determining region 3 for antibody 1001
AGWSGANY

SEQ ID NO: 2003 - protein, 9 aa, Homo sapiens
  light chain complementarity determining region 3 for antibody 1002
MQTTHWPRT

SEQ ID NO: 2004 - protein, 12 aa, Homo sapiens
  heavy chain complementarity determining region 3 for antibody 1002
VKDRGGRSGMDL

SEQ ID NO: 2005 - protein, 9 aa, Homo sapiens
  light chain complementarity determining region 3 for antibody 1003
MQTLQTPWP

SEQ ID NO: 2006 - protein, 12 aa, Homo sapiens
  heavy chain complementarity determining region 3 for antibody 1003
ARLDWNYRAFDI

SEQ ID NO: 2007 - protein, 9 aa, Homo sapiens
  light chain complementarity determining region 3 for antibody 1004
MQALQTPRT

SEQ ID NO: 2008 - protein, 18 aa, Homo sapiens
  heavy chain complementarity determining region 3 for antibody 1004
ASARPVLPGTTRLRGIGY

SEQ ID NO: 2009 - protein, 9 aa, Homo sapiens
  light chain complementarity determining region 3 for antibody 1005
LQTIHWPWT

SEQ ID NO: 2010 - protein, 10 aa, Homo sapiens
  heavy chain complementarity determining region 3 for antibody 1005
TRLPNRASDF

SEQ ID NO: 2011 - protein, 11 aa, Homo sapiens
  light chain complementarity determining region 3 for antibody 1006
LKNDNFPLMWH

SEQ ID NO: 2012 - protein, 15 aa, Homo sapiens
  heavy chain complementarity determining region 3 for antibody 1006
ARVRTNNYDSSGYDV

SEQ ID NO: 2013 - protein, 9 aa, Homo sapiens
  light chain complementarity determining region 3 for antibody 1007
HQYYSSPRT

SEQ ID NO: 2014 - protein, 9 aa, Homo sapiens
  heavy chain complementarity determining region 3 for antibody 1007
ARENYYLDV

SEQ ID NO: 2015 - protein, 9 aa, Homo sapiens
  light chain complementarity determining region 3 for antibody 1008
HQYATSPQT

SEQ ID NO: 2016 - protein, 15 aa, Homo sapiens
  heavy chain complementarity determining region 3 for antibody 1008
VKTYWAVDFDWLLYY

SEQ ID NO: 2017 - protein, 9 aa, Homo sapiens
  light chain complementarity determining region 3 for antibody 1009
QQYYSTPYT

SEQ ID NO: 2018 - protein, 14 aa, Homo sapiens
  heavy chain complementarity determining region 3 for antibody 1009
AASYSSGWLEYFQH

SEQ ID NO: 2019 - protein, 9 aa, Homo sapiens
  light chain complementarity determining region 3 for antibody 1010
QQYYSAPIT

SEQ ID NO: 2020 - protein, 14 aa, Homo sapiens
  heavy chain complementarity determining region 3 for antibody 1010
ARGESTSCDFIFDF

SEQ ID NO: 2021 - protein, 9 aa, Homo sapiens
  light chain complementarity determining region 3 for antibody 1011
QQYYGTPLT

SEQ ID NO: 2022 - protein, 17 aa, Homo sapiens
  heavy chain complementarity determining region 3 for antibody 1011
ATGLGFCGDSSATCDDW

SEQ ID NO: 2023 - protein, 8 aa, Homo sapiens
  light chain complementarity determining region 3 for antibody 1012
QQYNSYSP

SEQ ID NO: 2024 - protein, 13 aa, Homo sapiens
  heavy chain complementarity determining region 3 for antibody 1012
ARGGEMATILFNY

SEQ ID NO: 2025 - protein, 9 aa, Homo sapiens
  light chain complementarity determining region 3 for antibody 1013
QQYKTAPWT

SEQ ID NO: 2026 - protein, 20 aa, Homo sapiens
  heavy chain complementarity determining region 3 for antibody 1013
TRDARGSSYYAYGGGGGMDV

SEQ ID NO: 2027 - protein, 9 aa, Homo sapiens
  light chain complementarity determining region 3 for antibody 1014
QQYGSSPYT

SEQ ID NO: 2028 - protein, 10 aa, Homo sapiens
  heavy chain complementarity determining region 3 for antibody 1014
TTIIWHDIDY

SEQ ID NO: 2029 - protein, 9 aa, Homo sapiens
  light chain complementarity determining region 3 for antibody 1015
QQTYSSPWT

SEQ ID NO: 2030 - protein, 15 aa, Homo sapiens
  heavy chain complementarity determining region 3 for antibody 1015
ARIWTSSTTCRYMDV

SEQ ID NO: 2031 - protein, 9 aa, Homo sapiens
  light chain complementarity determining region 3 for antibody 1016
QQTYSPPYT

SEQ ID NO: 2032 - protein, 19 aa, Homo sapiens
  heavy chain complementarity determining region 3 for antibody 1016
ARGGNDNDDLFYYFYGMDV

SEQ ID NO: 2033 - protein, 9 aa, Homo sapiens
  light chain complementarity determining region 3 for antibody 1017
QQTNSFPHT

SEQ ID NO: 2034 - protein, 13 aa, Homo sapiens
  heavy chain complementarity determining region 3 for antibody 1017
ARYYYNSGRAFDI

SEQ ID NO: 2035 - protein, 9 aa, Homo sapiens
  light chain complementarity determining region 3 for antibody 1018
QQSYSTPYT

SEQ ID NO: 2036 - protein, 11 aa, Homo sapiens
  heavy chain complementarity determining region 3 for antibody 1018
ARQGVGGAIDY

SEQ ID NO: 2037 - protein, 9 aa, Homo sapiens
  light chain complementarity determining region 3 for antibody 1019
QQSYSTPLT

SEQ ID NO: 2038 - protein, 14 aa, Homo sapiens
  heavy chain complementarity determining region 3 for antibody 1019
ARMKEGGYRDAFDI

SEQ ID NO: 2039 - protein, 10 aa, Homo sapiens
  light chain complementarity determining region 3 for antibody 1020
QQSYSTPLFT

SEQ ID NO: 2040 - protein, 9 aa, Homo sapiens
  heavy chain complementarity determining region 3 for antibody 1020
AGWGGTSNY

SEQ ID NO: 2041 - protein, 10 aa, Homo sapiens
  light chain complementarity determining region 3 for antibody 1021
QQSYSAPLFT

SEQ ID NO: 2042 - protein, 23 aa, Homo sapiens
  heavy chain complementarity determining region 3 for antibody 1021
VRHFPKGGSGVIGTQSPHYYMDV

SEQ ID NO: 2043 - protein, 9 aa, Homo sapiens
  light chain complementarity determining region 3 for antibody 1022
QQLKSYPLT

SEQ ID NO: 2044 - protein, 19 aa, Homo sapiens
  heavy chain complementarity determining region 3 for antibody 1022
AKGLYYYDSSGYNCEYLQH

SEQ ID NO: 2045 - protein, 9 aa, Homo sapiens
  light chain complementarity determining region 3 for antibody 1023
QQFGSLPWT

SEQ ID NO: 2046 - protein, 21 aa, Homo sapiens
  heavy chain complementarity determining region 3 for antibody 1023
AREIGYYGSGTSGTYHYTFDV

SEQ ID NO: 2047 - protein, 10 aa, Homo sapiens
  light chain complementarity determining region 3 for antibody 1024
QDYNSPVEWT

SEQ ID NO: 2048 - protein, 10 aa, Homo sapiens
  heavy chain complementarity determining region 3 for antibody 1024
ARRSTAALDF

SEQ ID NO: 2049 - protein, 9 aa, Homo sapiens
  light chain complementarity determining region 3 for antibody 1025
MQGTHWPWT

SEQ ID NO: 2050 - protein, 9 aa, Homo sapiens
  heavy chain complementarity determining region 3 for antibody 1025
ARSEYQPTY

SEQ ID NO: 2051 - protein, 9 aa, Homo sapiens
  light chain complementarity determining region 3 for antibody 1026
MQGLQAPVT

SEQ ID NO: 2052 - protein, 12 aa, Homo sapiens
  heavy chain complementarity determining region 3 for antibody 1026
MRGNPPSSSLDY

SEQ ID NO: 2053 - protein, 9 aa, Homo sapiens
  light chain complementarity determining region 3 for antibody 1027
AQGSFWPAT

SEQ ID NO: 2054 - protein, 10 aa, Homo sapiens
  heavy chain complementarity determining region 3 for antibody 1027
TRDHRGFGDV

SEQ ID NO: 2055 - protein, 9 aa, Homo sapiens
  light chain complementarity determining region 3 for antibody 1028
QQYYVTPPL

SEQ ID NO: 2056 - protein, 17 aa, Homo sapiens
  heavy chain complementarity determining region 3 for antibody 1028
ARNTMVDGWQRQGSVDH

SEQ ID NO: 2057 - protein, 7 aa, Homo sapiens
  light chain complementarity determining region 3 for antibody 1029
QQYSSWT

SEQ ID NO: 2058 - protein, 14 aa, Homo sapiens
  heavy chain complementarity determining region 3 for antibody 1029
ARRHYTSSSRYFDL

SEQ ID NO: 2059 - protein, 7 aa, Homo sapiens
  light chain complementarity determining region 3 for antibody 1030
QQYSSWT

SEQ ID NO: 2060 - protein, 10 aa, Homo sapiens
  heavy chain complementarity determining region 3 for antibody 1030
ARETSGSYDI

SEQ ID NO: 2061 - protein, 10 aa, Homo sapiens
  light chain complementarity determining region 3 for antibody 1031
QQYSSSPLIT

SEQ ID NO: 2062 - protein, 21 aa, Homo sapiens
  heavy chain complementarity determining region 3 for antibody 1031
VRAHPPPLLWVAESFQYYMDI

SEQ ID NO: 2063 - protein, 8 aa, Homo sapiens
  light chain complementarity determining region 3 for antibody 1032
QQYNSYST

SEQ ID NO: 2064 - protein, 23 aa, Homo sapiens
  heavy chain complementarity determining region 3 for antibody 1032
ARLRVWGSYRYMVDPYYYYGMDV

SEQ ID NO: 2065 - protein, 11 aa, Homo sapiens
  light chain complementarity determining region 3 for antibody 1033
QQYNSYSPRFT

SEQ ID NO: 2066 - protein, 13 aa, Homo sapiens
  heavy chain complementarity determining region 3 for antibody 1033
AKEGSSPGPDFDY

SEQ ID NO: 2067 - protein, 10 aa, Homo sapiens
  light chain complementarity determining region 3 for antibody 1034
QQYNFYSTLT

SEQ ID NO: 2068 - protein, 16 aa, Homo sapiens
  heavy chain complementarity determining region 3 for antibody 1034
GRQVISGTKWPNRLDY

SEQ ID NO: 2069 - protein, 9 aa, Homo sapiens
  light chain complementarity determining region 3 for antibody 1035
QQYGYSPLT

SEQ ID NO: 2070 - protein, 18 aa, Homo sapiens
  heavy chain complementarity determining region 3 for antibody 1035
ARGDYPEARSSYYLDFDY

SEQ ID NO: 2071 - protein, 9 aa, Homo sapiens
  light chain complementarity determining region 3 for antibody 1036
QQTYSTPLT

SEQ ID NO: 2072 - protein, 10 aa, Homo sapiens
  heavy chain complementarity determining region 3 for antibody 1036
ARERSGSYDI

SEQ ID NO: 2073 - protein, 9 aa, Homo sapiens
  light chain complementarity determining region 3 for antibody 1037
QQTYSIPRT

SEQ ID NO: 2074 - protein, 16 aa, Homo sapiens
  heavy chain complementarity determining region 3 for antibody 1037
AREFSRSSTRVNYMDA

SEQ ID NO: 2075 - protein, 9 aa, Homo sapiens
  light chain complementarity determining region 3 for antibody 1038
QQSYTMPRT

SEQ ID NO: 2076 - protein, 11 aa, Homo sapiens
  heavy chain complementarity determining region 3 for antibody 1038
AREQHGQAPDY

SEQ ID NO: 2077 - protein, 9 aa, Homo sapiens
  light chain complementarity determining region 3 for antibody 1039
QQSYTFPRT

SEQ ID NO: 2078 - protein, 18 aa, Homo sapiens
  heavy chain complementarity determining region 3 for antibody 1039
TTVLSQLLAGDWHLYFQH

SEQ ID NO: 2079 - protein, 9 aa, Homo sapiens
  light chain complementarity determining region 3 for antibody 1040
QQRSNWPPT

SEQ ID NO: 2080 - protein, 12 aa, Homo sapiens
  heavy chain complementarity determining region 3 for antibody 1040
ARDDGSRCPFEY

SEQ ID NO: 2081 - protein, 9 aa, Homo sapiens
  light chain complementarity determining region 3 for antibody 1041
QQFNSYPYT

SEQ ID NO: 2082 - protein, 9 aa, Homo sapiens
  heavy chain complementarity determining region 3 for antibody 1041
ARGRSNFRF

SEQ ID NO: 2083 - protein, 9 aa, Homo sapiens
  light chain complementarity determining region 3 for antibody 1042
QQFHSFPRT

SEQ ID NO: 2084 - protein, 9 aa, Homo sapiens
  heavy chain complementarity determining region 3 for antibody 1042
ARGRNNFRY

SEQ ID NO: 2085 - protein, 9 aa, Homo sapiens
  light chain complementarity determining region 3 for antibody 1043
QQAYSFPHT

SEQ ID NO: 2086 - protein, 17 aa, Homo sapiens
  heavy chain complementarity determining region 3 for antibody 1043
AKDLDTPMDYYFYGMDV

SEQ ID NO: 2087 - protein, 9 aa, Homo sapiens
  light chain complementarity determining region 3 for antibody 1044
QQADSFPYT

SEQ ID NO: 2088 - protein, 16 aa, Homo sapiens
  heavy chain complementarity determining region 3 for antibody 1044
ARDQGLGYGVPDACDI

SEQ ID NO: 2089 - protein, 9 aa, Homo sapiens
  light chain complementarity determining region 3 for antibody 1045
QKYKHVPWT

SEQ ID NO: 2090 - protein, 20 aa, Homo sapiens
  heavy chain complementarity determining region 3 for antibody 1045
TRDQRSIHLWSFSEGGGMDV

SEQ ID NO: 2091 - protein, 9 aa, Homo sapiens
  light chain complementarity determining region 3 for antibody 1046
MQPLQTTWT

SEQ ID NO: 2092 - protein, 10 aa, Homo sapiens
  heavy chain complementarity determining region 3 for antibody 1046
VGYNWGNDHF

SEQ ID NO: 2093 - protein, 9 aa, Homo sapiens
  light chain complementarity determining region 3 for antibody 1047
MQGTHWPRT

SEQ ID NO: 2094 - protein, 9 aa, Homo sapiens
  heavy chain complementarity determining region 3 for antibody 1047
ARDSHSFSY

SEQ ID NO: 2095 - protein, 9 aa, Homo sapiens
  light chain complementarity determining region 3 for antibody 1048
MQGTHWPHT

SEQ ID NO: 2096 - protein, 8 aa, Homo sapiens
  heavy chain complementarity determining region 3 for antibody 1048
ARGRWWAG

SEQ ID NO: 2097 - protein, 11 aa, Homo sapiens
  light chain complementarity determining region 3 for antibody 1049
LQHDDFPLTWT

SEQ ID NO: 2098 - protein, 14 aa, Homo sapiens
  heavy chain complementarity determining region 3 for antibody 1049
VGRDDYSDHGRFDY

SEQ ID NO: 2099 - protein, 9 aa, Homo sapiens
  light chain complementarity determining region 3 for antibody 1050
LQDYTYPFS

SEQ ID NO: 2100 - protein, 16 aa, Homo sapiens
  heavy chain complementarity determining region 3 for antibody 1050
VTDVGDHRDSYTTLDY

SEQ ID NO: 2101 - protein, 9 aa, Homo sapiens
  light chain complementarity determining region 3 for antibody 1051
QQYYSTPYT

SEQ ID NO: 2102 - protein, 13 aa, Homo sapiens
  heavy chain complementarity determining region 3 for antibody 1051
ATEPYYGSGRGVY

SEQ ID NO: 2103 - protein, 9 aa, Homo sapiens
  light chain complementarity determining region 3 for antibody 1052
QQYYSLPIT

SEQ ID NO: 2104 - protein, 15 aa, Homo sapiens
  heavy chain complementarity determining region 3 for antibody 1052
AKDHSGYNWNDAFDI

SEQ ID NO: 2105 - protein, 9 aa, Homo sapiens
  light chain complementarity determining region 3 for antibody 1053
QQYYGTPET

SEQ ID NO: 2106 - protein, 15 aa, Homo sapiens
  heavy chain complementarity determining region 3 for antibody 1053
ARDLFSGSYAYGDDY

SEQ ID NO: 2107 - protein, 9 aa, Homo sapiens
  light chain complementarity determining region 3 for antibody 1054
QQYNYYPLT

SEQ ID NO: 2108 - protein, 15 aa, Homo sapiens
  heavy chain complementarity determining region 3 for antibody 1054
ARGDYGDYIGAPFDY

SEQ ID NO: 2109 - protein, 9 aa, Homo sapiens
  light chain complementarity determining region 3 for antibody 1055
QQYNSYPYT

SEQ ID NO: 2110 - protein, 13 aa, Homo sapiens
  heavy chain complementarity determining region 3 for antibody 1055
AKEGSAPGPDFEY

SEQ ID NO: 2111 - protein, 9 aa, Homo sapiens
  light chain complementarity determining region 3 for antibody 1056
QQYNRFSGT

SEQ ID NO: 2112 - protein, 10 aa, Homo sapiens
  heavy chain complementarity determining region 3 for antibody 1056
CRDREGFGDV

SEQ ID NO: 2113 - protein, 9 aa, Homo sapiens
  light chain complementarity determining region 3 for antibody 1057
QQYLTYPLT

SEQ ID NO: 2114 - protein, 16 aa, Homo sapiens
  heavy chain complementarity determining region 3 for antibody 1057
AKERGYSSGWYGELDY

SEQ ID NO: 2115 - protein, 9 aa, Homo sapiens
  light chain complementarity determining region 3 for antibody 1058
QQYGSSPET

SEQ ID NO: 2116 - protein, 10 aa, Homo sapiens
  heavy chain complementarity determining region 3 for antibody 1058
ARETSGAYDI

SEQ ID NO: 2117 - protein, 9 aa, Homo sapiens
  light chain complementarity determining region 3 for antibody 1059
QQYGSSLLT

SEQ ID NO: 2118 - protein, 12 aa, Homo sapiens
  heavy chain complementarity determining region 3 for antibody 1059
ALDEYNNSWFKY

SEQ ID NO: 2119 - protein, 9 aa, Homo sapiens
  light chain complementarity determining region 3 for antibody 1060
QQYGSSLIT

SEQ ID NO: 2120 - protein, 12 aa, Homo sapiens
  heavy chain complementarity determining region 3 for antibody 1060
AIVVPGRWDLDD

SEQ ID NO: 2121 - protein, 9 aa, Homo sapiens
  light chain complementarity determining region 3 for antibody 1061
QQYGGSPYT

SEQ ID NO: 2122 - protein, 16 aa, Homo sapiens
  heavy chain complementarity determining region 3 for antibody 1061
AADLGDHTDAYATLDN

SEQ ID NO: 2123 - protein, 9 aa, Homo sapiens
  light chain complementarity determining region 3 for antibody 1062
QQYGASPRT

SEQ ID NO: 2124 - protein, 17 aa, Homo sapiens
  heavy chain complementarity determining region 3 for antibody 1062
ATTDGSGNYHYYHGMDV

SEQ ID NO: 2125 - protein, 9 aa, Homo sapiens
  light chain complementarity determining region 3 for antibody 1063
QQSYSTPWT

SEQ ID NO: 2126 - protein, 15 aa, Homo sapiens
  heavy chain complementarity determining region 3 for antibody 1063
ARIWRSSRSVYYFDF

SEQ ID NO: 2127 - protein, 9 aa, Homo sapiens
  light chain complementarity determining region 3 for antibody 1064
QQSYSMPRT

SEQ ID NO: 2128 - protein, 18 aa, Homo sapiens
  heavy chain complementarity determining region 3 for antibody 1064
VTVLSLFLSGDWRLYFQH

SEQ ID NO: 2129 - protein, 8 aa, Homo sapiens
  light chain complementarity determining region 3 for antibody 1065
QQRSNWLT

SEQ ID NO: 2130 - protein, 9 aa, Homo sapiens
  heavy chain complementarity determining region 3 for antibody 1065
ARDSHSFSY

SEQ ID NO: 2131 - protein, 9 aa, Homo sapiens
  light chain complementarity determining region 3 for antibody 1066
QQRSKWPLT

SEQ ID NO: 2132 - protein, 16 aa, Homo sapiens
  heavy chain complementarity determining region 3 for antibody 1066
VRGGGWNDVGGYYFDS

SEQ ID NO: 2133 - protein, 9 aa, Homo sapiens
  light chain complementarity determining region 3 for antibody 1067
QQRGHWPPT

SEQ ID NO: 2134 - protein, 14 aa, Homo sapiens
  heavy chain complementarity determining region 3 for antibody 1067
AKHTHNWYLGVLDC

SEQ ID NO: 2135 - protein, 9 aa, Homo sapiens
  light chain complementarity determining region 3 for antibody 1068
MQTLPTPWT

SEQ ID NO: 2136 - protein, 12 aa, Homo sapiens
  heavy chain complementarity determining region 3 for antibody 1068
ARLDWNYRAFDI

SEQ ID NO: 2137 - protein, 8 aa, Homo sapiens
  light chain complementarity determining region 3 for antibody 1069
MQGTHWPA

SEQ ID NO: 2138 - protein, 13 aa, Homo sapiens
  heavy chain complementarity determining region 3 for antibody 1069
ARGPYYGSGPEDR

SEQ ID NO: 2139 - protein, 9 aa, Homo sapiens
  light chain complementarity determining region 3 for antibody 1070
MQAVREPLT

SEQ ID NO: 2140 - protein, 18 aa, Homo sapiens
  heavy chain complementarity determining region 3 for antibody 1070
ARRQGVRGIAGWGYNMDV

SEQ ID NO: 2141 - protein, 9 aa, Homo sapiens
  light chain complementarity determining region 3 for antibody 1071
MQALQTPFT

SEQ ID NO: 2142 - protein, 11 aa, Homo sapiens
  heavy chain complementarity determining region 3 for antibody 1071
VKDKGQWLPVD

SEQ ID NO: 2143 - protein, 9 aa, Homo sapiens
  light chain complementarity determining region 3 for antibody 1072
LQYGSPPRT

SEQ ID NO: 2144 - protein, 11 aa, Homo sapiens
  heavy chain complementarity determining region 3 for antibody 1072
TRGGYSVGYDY

SEQ ID NO: 2145 - protein, 9 aa, Homo sapiens
  light chain complementarity determining region 3 for antibody 1073
LQHNSYPWT

SEQ ID NO: 2146 - protein, 18 aa, Homo sapiens
  heavy chain complementarity determining region 3 for antibody 1073
TRGPSGAPGAMPYYYLDV

SEQ ID NO: 2147 - protein, 9 aa, Homo sapiens
  light chain complementarity determining region 3 for antibody 1074
LQHDGSPYT

SEQ ID NO: 2148 - protein, 16 aa, Homo sapiens
  heavy chain complementarity determining region 3 for antibody 1074
TSDFRYGSSIWYWGAV

SEQ ID NO: 2149 - protein, 9 aa, Homo sapiens
  light chain complementarity determining region 3 for antibody 1075
LHYNSYPLT

SEQ ID NO: 2150 - protein, 7 aa, Homo sapiens
  heavy chain complementarity determining region 3 for antibody 1075
AQLGLGV

SEQ ID NO: 2151 - protein, 10 aa, Homo sapiens
  light chain complementarity determining region 3 for antibody 1076
QRYGSSPPFT

SEQ ID NO: 2152 - protein, 21 aa, Homo sapiens
  heavy chain complementarity determining region 3 for antibody 1076
ARWAGNCDTTSCYGFSGPFDD

SEQ ID NO: 2153 - protein, 7 aa, Homo sapiens
  light chain complementarity determining region 3 for antibody 1077
QQYSSWT

SEQ ID NO: 2154 - protein, 17 aa, Homo sapiens
  heavy chain complementarity determining region 3 for antibody 1077
ARNTMVGAWQRQGNLDH

SEQ ID NO: 2155 - protein, 9 aa, Homo sapiens
  light chain complementarity determining region 3 for antibody 1078
QQYGSSPET

SEQ ID NO: 2156 - protein, 12 aa, Homo sapiens
  heavy chain complementarity determining region 3 for antibody 1078
AIVVPGRWDLDD

SEQ ID NO: 2157 - protein, 9 aa, Homo sapiens
  light chain complementarity determining region 3 for antibody 1079
QQYESAFYT

SEQ ID NO: 2158 - protein, 13 aa, Homo sapiens
  heavy chain complementarity determining region 3 for antibody 1079
AHRRGGTLTAFDN

SEQ ID NO: 2159 - protein, 10 aa, Homo sapiens
  light chain complementarity determining region 3 for antibody 1080
QQYDNLPPWT

SEQ ID NO: 2160 - protein, 15 aa, Homo sapiens
  heavy chain complementarity determining region 3 for antibody 1080
TKDEYPGNQIEAFDI

SEQ ID NO: 2161 - protein, 9 aa, Homo sapiens
  light chain complementarity determining region 3 for antibody 1081
QQTYSSPWT

SEQ ID NO: 2162 - protein, 15 aa, Homo sapiens
  heavy chain complementarity determining region 3 for antibody 1081
ARIWPSSTNCRYMDV

SEQ ID NO: 2163 - protein, 9 aa, Homo sapiens
  light chain complementarity determining region 3 for antibody 1082
QQSSNTPLT

SEQ ID NO: 2164 - protein, 16 aa, Homo sapiens
  heavy chain complementarity determining region 3 for antibody 1082
VRDLAGFTRGGSPFDY

SEQ ID NO: 2165 - protein, 9 aa, Homo sapiens
  light chain complementarity determining region 3 for antibody 1083
QQSANSPRT

SEQ ID NO: 2166 - protein, 13 aa, Homo sapiens
  heavy chain complementarity determining region 3 for antibody 1083
ARGSTATSWNIDY

SEQ ID NO: 2167 - protein, 9 aa, Homo sapiens
  light chain complementarity determining region 3 for antibody 1084
QQLYDYPIT

SEQ ID NO: 2168 - protein, 18 aa, Homo sapiens
  heavy chain complementarity determining region 3 for antibody 1084
TRPECDSRGCQGRDQFDP

SEQ ID NO: 2169 - protein, 9 aa, Homo sapiens
  light chain complementarity determining region 3 for antibody 1085
QQHYNTPYT

SEQ ID NO: 2170 - protein, 18 aa, Homo sapiens
  heavy chain complementarity determining region 3 for antibody 1085
ARAADCIGDKCYQSYFDF

SEQ ID NO: 2171 - protein, 10 aa, Homo sapiens
  light chain complementarity determining region 3 for antibody 1086
QQHHPSPGWT

SEQ ID NO: 2172 - protein, 15 aa, Homo sapiens
  heavy chain complementarity determining region 3 for antibody 1086
ARHDGAGAGAGVFDT

SEQ ID NO: 2173 - protein, 10 aa, Homo sapiens
  light chain complementarity determining region 3 for antibody 1087
QHYNNWPPLT

SEQ ID NO: 2174 - protein, 14 aa, Homo sapiens
  heavy chain complementarity determining region 3 for antibody 1087
ATGGGSGFEGAFDV

SEQ ID NO: 2175 - protein, 8 aa, Homo sapiens
  light chain complementarity determining region 3 for antibody 1088
MQTLQGHT

SEQ ID NO: 2176 - protein, 19 aa, Homo sapiens
  heavy chain complementarity determining region 3 for antibody 1088
ARKTAFSLSKGGTYYYMDV

SEQ ID NO: 2177 - protein, 10 aa, Homo sapiens
  light chain complementarity determining region 3 for antibody 1089
MQGTHWPAGT

SEQ ID NO: 2178 - protein, 12 aa, Homo sapiens
  heavy chain complementarity determining region 3 for antibody 1089
TTWIKTSVWLDY

SEQ ID NO: 2179 - protein, 9 aa, Homo sapiens
  light chain complementarity determining region 3 for antibody 1090
MQGIHWPWT

SEQ ID NO: 2180 - protein, 14 aa, Homo sapiens
  heavy chain complementarity determining region 3 for antibody 1090
VRDYCSGGTCYSGS

SEQ ID NO: 2181 - protein, 8 aa, Homo sapiens
  light chain complementarity determining region 3 for antibody 1091
QQYGWSLS

SEQ ID NO: 2182 - protein, 15 aa, Homo sapiens
  heavy chain complementarity determining region 3 for antibody 1091
ARGRGNTNGWYYFDY

SEQ ID NO: 2183 - protein, 8 aa, Homo sapiens
  light chain complementarity determining region 3 for antibody 1092
QQYEKLVS

SEQ ID NO: 2184 - protein, 8 aa, Homo sapiens
  heavy chain complementarity determining region 3 for antibody 1092
ARDPGARH

SEQ ID NO: 2185 - protein, 8 aa, Homo sapiens
  light chain complementarity determining region 3 for antibody 1093
QQYDNPPT

SEQ ID NO: 2186 - protein, 17 aa, Homo sapiens
  heavy chain complementarity determining region 3 for antibody 1093
ARNTMVGTWQRQGNLDH

SEQ ID NO: 2187 - protein, 11 aa, Homo sapiens
  light chain complementarity determining region 3 for antibody 1094
QQYDNLPGALT

SEQ ID NO: 2188 - protein, 13 aa, Homo sapiens
  heavy chain complementarity determining region 3 for antibody 1094
AKEGSSPGPDFDY

SEQ ID NO: 2189 - protein, 9 aa, Homo sapiens
  light chain complementarity determining region 3 for antibody 1095
QQSYTMPRT

SEQ ID NO: 2190 - protein, 17 aa, Homo sapiens
  heavy chain complementarity determining region 3 for antibody 1095
ARNTMVDGWQRQGSVDH

SEQ ID NO: 2191 - protein, 8 aa, Homo sapiens
  light chain complementarity determining region 3 for antibody 1096
QQSYSTPT

SEQ ID NO: 2192 - protein, 26 aa, Homo sapiens
  heavy chain complementarity determining region 3 for antibody 1096
ARDFPKGGSYISGWYESTGGSYYMDV

SEQ ID NO: 2193 - protein, 10 aa, Homo sapiens
  light chain complementarity determining region 3 for antibody 1097
QQRSNWPALT

SEQ ID NO: 2194 - protein, 13 aa, Homo sapiens
  heavy chain complementarity determining region 3 for antibody 1097
ATEGSSPGPDFEY

SEQ ID NO: 2195 - protein, 9 aa, Homo sapiens
  light chain complementarity determining region 3 for antibody 1098
QQHYDNMYT

SEQ ID NO: 2196 - protein, 17 aa, Homo sapiens
  heavy chain complementarity determining region 3 for antibody 1098
ATFFCGGRSCFQSPFDH

SEQ ID NO: 2197 - protein, 9 aa, Homo sapiens
  light chain complementarity determining region 3 for antibody 1099
QQFNTFPRT

SEQ ID NO: 2198 - protein, 9 aa, Homo sapiens
  heavy chain complementarity determining region 3 for antibody 1099
ARGRNNFRY

SEQ ID NO: 2199 - protein, 9 aa, Homo sapiens
  light chain complementarity determining region 3 for antibody 1100
QNYDTAPFA

SEQ ID NO: 2200 - protein, 10 aa, Homo sapiens
  heavy chain complementarity determining region 3 for antibody 1100
VREGYWSLDH

SEQ ID NO: 2201 - protein, 9 aa, Homo sapiens
  light chain complementarity determining region 3 for antibody 1101
MQGTHWPYT

SEQ ID NO: 2202 - protein, 8 aa, Homo sapiens
  heavy chain complementarity determining region 3 for antibody 1101
ARGGRGDC

SEQ ID NO: 2203 - protein, 9 aa, Homo sapiens
  light chain complementarity determining region 3 for antibody 1102
LQDYSYPLS

SEQ ID NO: 2204 - protein, 16 aa, Homo sapiens
  heavy chain complementarity determining region 3 for antibody 1102
VTDVGDHRDRYTTLDY

SEQ ID NO: 2205 - protein, 9 aa, Homo sapiens
  light chain complementarity determining region 3 for antibody 1103
LQDNSYPFT

SEQ ID NO: 2206 - protein, 15 aa, Homo sapiens
  heavy chain complementarity determining region 3 for antibody 1103
TRDAYPGSPIEAFDI

SEQ ID NO: 2207 - protein, 7 aa, Homo sapiens
  light chain complementarity determining region 3 for antibody 1104
HSRDNWG

SEQ ID NO: 2208 - protein, 20 aa, Homo sapiens
  heavy chain complementarity determining region 3 for antibody 1104
ATFLPGDCSCTGCFYWYFDF

SEQ ID NO: 2209 - protein, 9 aa, Homo sapiens
  light chain complementarity determining region 3 for antibody 1105
QQYYVSPIT

SEQ ID NO: 2210 - protein, 8 aa, Homo sapiens
  heavy chain complementarity determining region 3 for antibody 1105
ARRNDFDQ

SEQ ID NO: 2211 - protein, 9 aa, Homo sapiens
  light chain complementarity determining region 3 for antibody 1106
QQYYGSPLT

SEQ ID NO: 2212 - protein, 14 aa, Homo sapiens
  heavy chain complementarity determining region 3 for antibody 1106
TKATLGEVSFLIDY

SEQ ID NO: 2213 - protein, 9 aa, Homo sapiens
  light chain complementarity determining region 3 for antibody 1107
QQYNYWPWT

SEQ ID NO: 2214 - protein, 9 aa, Homo sapiens
  heavy chain complementarity determining region 3 for antibody 1107
VRGSPVWDA

SEQ ID NO: 2215 - protein, 9 aa, Homo sapiens
  light chain complementarity determining region 3 for antibody 1108
QQYLKYPFT

SEQ ID NO: 2216 - protein, 13 aa, Homo sapiens
  heavy chain complementarity determining region 3 for antibody 1108
AKEGSSPGPDFDY

SEQ ID NO: 2217 - protein, 9 aa, Homo sapiens
  light chain complementarity determining region 3 for antibody 1109
QQYHFYPWT

SEQ ID NO: 2218 - protein, 11 aa, Homo sapiens
  heavy chain complementarity determining region 3 for antibody 1109
ARIVARKPDDY

SEQ ID NO: 2219 - protein, 10 aa, Homo sapiens
  light chain complementarity determining region 3 for antibody 1110
QQYGSSPPWT

SEQ ID NO: 2220 - protein, 23 aa, Homo sapiens
  heavy chain complementarity determining region 3 for antibody 1110
ARHFPMGGSTVTGTQSLLYYMDV

SEQ ID NO: 2221 - protein, 9 aa, Homo sapiens
  light chain complementarity determining region 3 for antibody 1111
QQYDNLPIT

SEQ ID NO: 2222 - protein, 13 aa, Homo sapiens
  heavy chain complementarity determining region 3 for antibody 1111
AKEGSSPGPDFEY

SEQ ID NO: 2223 - protein, 9 aa, Homo sapiens
  light chain complementarity determining region 3 for antibody 1112
QQTYSSPWT

SEQ ID NO: 2224 - protein, 15 aa, Homo sapiens
  heavy chain complementarity determining region 3 for antibody 1112
ARIWTSSANCRYMDV

SEQ ID NO: 2225 - protein, 9 aa, Homo sapiens
  light chain complementarity determining region 3 for antibody 1113
QQTQSFPLT

SEQ ID NO: 2226 - protein, 15 aa, Homo sapiens
  heavy chain complementarity determining region 3 for antibody 1113
ASASGTRFPQHGMDV

SEQ ID NO: 2227 - protein, 9 aa, Homo sapiens
  light chain complementarity determining region 3 for antibody 1114
QQSYSTPPT

SEQ ID NO: 2228 - protein, 16 aa, Homo sapiens
  heavy chain complementarity determining region 3 for antibody 1114
SGPKLTYSNGWHYFDK

SEQ ID NO: 2229 - protein, 9 aa, Homo sapiens
  light chain complementarity determining region 3 for antibody 1115
QQSSNTPLT

SEQ ID NO: 2230 - protein, 16 aa, Homo sapiens
  heavy chain complementarity determining region 3 for antibody 1115
VRDLAGLTRGGSTFDY

SEQ ID NO: 2231 - protein, 10 aa, Homo sapiens
  light chain complementarity determining region 3 for antibody 1116
QQRSDWPRLT

SEQ ID NO: 2232 - protein, 21 aa, Homo sapiens
  heavy chain complementarity determining region 3 for antibody 1116
GRWGAGYYDSNGNYFGRAIDN

SEQ ID NO: 2233 - protein, 10 aa, Homo sapiens
  light chain complementarity determining region 3 for antibody 1117
QQRKDWPPYT

SEQ ID NO: 2234 - protein, 18 aa, Homo sapiens
  heavy chain complementarity determining region 3 for antibody 1117
ARGNYCSGGSCYSGLFEF

SEQ ID NO: 2235 - protein, 9 aa, Homo sapiens
  light chain complementarity determining region 3 for antibody 1118
QQGNGFPRT

SEQ ID NO: 2236 - protein, 13 aa, Homo sapiens
  heavy chain complementarity determining region 3 for antibody 1118
ARDPVDGNWYFDL

SEQ ID NO: 2237 - protein, 9 aa, Homo sapiens
  light chain complementarity determining region 3 for antibody 1119
QQCGSWPYT

SEQ ID NO: 2238 - protein, 14 aa, Homo sapiens
  heavy chain complementarity determining region 3 for antibody 1119
ARQDSPDYNKYMDV

SEQ ID NO: 2239 - protein, 9 aa, Homo sapiens
  light chain complementarity determining region 3 for antibody 1120
QKYDSAPWT

SEQ ID NO: 2240 - protein, 17 aa, Homo sapiens
  heavy chain complementarity determining region 3 for antibody 1120
TRDRPDSTWTSGNRRDL

SEQ ID NO: 2241 - protein, 9 aa, Homo sapiens
  light chain complementarity determining region 3 for antibody 1121
QKYDNVPWT

SEQ ID NO: 2242 - protein, 20 aa, Homo sapiens
  heavy chain complementarity determining region 3 for antibody 1121
TRDQRNIDLWLLPVGGGMDV

SEQ ID NO: 2243 - protein, 12 aa, Homo sapiens
  light chain complementarity determining region 3 for antibody 1122
QHFDSTPPGGYT

SEQ ID NO: 2244 - protein, 21 aa, Homo sapiens
  heavy chain complementarity determining region 3 for antibody 1122
ARVRRRGVGYGSYERYYAMDV

SEQ ID NO: 2245 - protein, 9 aa, Homo sapiens
  light chain complementarity determining region 3 for antibody 1123
MQYTYWPHT

SEQ ID NO: 2246 - protein, 8 aa, Homo sapiens
  heavy chain complementarity determining region 3 for antibody 1123
AGWSDANY

SEQ ID NO: 2247 - protein, 9 aa, Homo sapiens
  light chain complementarity determining region 3 for antibody 1124
MQSLRIPLT

SEQ ID NO: 2248 - protein, 15 aa, Homo sapiens
  heavy chain complementarity determining region 3 for antibody 1124
VRDPAGLANFYNMDV

SEQ ID NO: 2249 - protein, 9 aa, Homo sapiens
  light chain complementarity determining region 3 for antibody 1125
MQPLQTPWT

SEQ ID NO: 2250 - protein, 12 aa, Homo sapiens
  heavy chain complementarity determining region 3 for antibody 1125
ARLDWNYRAFDI

SEQ ID NO: 2251 - protein, 9 aa, Homo sapiens
  light chain complementarity determining region 3 for antibody 1126
MQGTHWPQT

SEQ ID NO: 2252 - protein, 11 aa, Homo sapiens
  heavy chain complementarity determining region 3 for antibody 1126
ATFGQQWRLAH

SEQ ID NO: 2253 - protein, 10 aa, Homo sapiens
  light chain complementarity determining region 3 for antibody 1127
MQGTHWPPIT

SEQ ID NO: 2254 - protein, 11 aa, Homo sapiens
  heavy chain complementarity determining region 3 for antibody 1127
TGGGAGTKIDS

SEQ ID NO: 2255 - protein, 9 aa, Homo sapiens
  light chain complementarity determining region 3 for antibody 1128
HQYSSWEFT

SEQ ID NO: 2256 - protein, 16 aa, Homo sapiens
  heavy chain complementarity determining region 3 for antibody 1128
ARERGGYTGLGQPFDC

SEQ ID NO: 2257 - protein, 9 aa, Homo sapiens
  light chain complementarity determining region 3 for antibody 1129
EQYGSSPRT

SEQ ID NO: 2258 - protein, 9 aa, Homo sapiens
  heavy chain complementarity determining region 3 for antibody 1129
AREWSAFDF

SEQ ID NO: 2259 - protein, 9 aa, Homo sapiens
  light chain complementarity determining region 3 for antibody 1130
QQYYSTPPT

SEQ ID NO: 2260 - protein, 13 aa, Homo sapiens
  heavy chain complementarity determining region 3 for antibody 1130
ARGSSSNWSPSDY

SEQ ID NO: 2261 - protein, 9 aa, Homo sapiens
  light chain complementarity determining region 3 for antibody 1131
QQYYRTPMT

SEQ ID NO: 2262 - protein, 13 aa, Homo sapiens
  heavy chain complementarity determining region 3 for antibody 1131
VRDQPGSSDAFDV

SEQ ID NO: 2263 - protein, 9 aa, Homo sapiens
  light chain complementarity determining region 3 for antibody 1132
QQYSSYSIT

SEQ ID NO: 2264 - protein, 18 aa, Homo sapiens
  heavy chain complementarity determining region 3 for antibody 1132
TKAGAGHYGSNSGRNFDL

SEQ ID NO: 2265 - protein, 7 aa, Homo sapiens
  light chain complementarity determining region 3 for antibody 1133
QQYSSWT

SEQ ID NO: 2266 - protein, 11 aa, Homo sapiens
  heavy chain complementarity determining region 3 for antibody 1133
ARDWEGRQFDY

SEQ ID NO: 2267 - protein, 10 aa, Homo sapiens
  light chain complementarity determining region 3 for antibody 1134
QQYKNWPPYT

SEQ ID NO: 2268 - protein, 14 aa, Homo sapiens
  heavy chain complementarity determining region 3 for antibody 1134
ARENCYGTGSCFDF

SEQ ID NO: 2269 - protein, 9 aa, Homo sapiens
  light chain complementarity determining region 3 for antibody 1135
QQYGSSPYT

SEQ ID NO: 2270 - protein, 17 aa, Homo sapiens
  heavy chain complementarity determining region 3 for antibody 1135
ARNTMVHGWQRQGSVDH

SEQ ID NO: 2271 - protein, 9 aa, Homo sapiens
  light chain complementarity determining region 3 for antibody 1136
QQYDNLIFT

SEQ ID NO: 2272 - protein, 8 aa, Homo sapiens
  heavy chain complementarity determining region 3 for antibody 1136
TSIAVAGR

SEQ ID NO: 2273 - protein, 9 aa, Homo sapiens
  light chain complementarity determining region 3 for antibody 1137
QQSYTMPRT

SEQ ID NO: 2274 - protein, 15 aa, Homo sapiens
  heavy chain complementarity determining region 3 for antibody 1137
ARDLRHSTGSTCFDY

SEQ ID NO: 2275 - protein, 9 aa, Homo sapiens
  light chain complementarity determining region 3 for antibody 1138
QQSYTIPLT

SEQ ID NO: 2276 - protein, 20 aa, Homo sapiens
  heavy chain complementarity determining region 3 for antibody 1138
ARGREGGKYLPVFDRYFFDS

SEQ ID NO: 2277 - protein, 9 aa, Homo sapiens
  light chain complementarity determining region 3 for antibody 1139
QQSYSTPST

SEQ ID NO: 2278 - protein, 17 aa, Homo sapiens
  heavy chain complementarity determining region 3 for antibody 1139
ARNTMVGAWQRQGNLDH

SEQ ID NO: 2279 - protein, 10 aa, Homo sapiens
  light chain complementarity determining region 3 for antibody 1140
QQSYSTPPYT

SEQ ID NO: 2280 - protein, 14 aa, Homo sapiens
  heavy chain complementarity determining region 3 for antibody 1140
ARDLGSNWRHWFDP

SEQ ID NO: 2281 - protein, 10 aa, Homo sapiens
  light chain complementarity determining region 3 for antibody 1141
QQSYSTPPLT

SEQ ID NO: 2282 - protein, 10 aa, Homo sapiens
  heavy chain complementarity determining region 3 for antibody 1141
CRDRRGFGDV

SEQ ID NO: 2283 - protein, 9 aa, Homo sapiens
  light chain complementarity determining region 3 for antibody 1142
QQSYSIPYT

SEQ ID NO: 2284 - protein, 16 aa, Homo sapiens
  heavy chain complementarity determining region 3 for antibody 1142
ARAGLRYGYNPVYFDY

SEQ ID NO: 2285 - protein, 9 aa, Homo sapiens
  light chain complementarity determining region 3 for antibody 1143
QQRNNWPLT

SEQ ID NO: 2286 - protein, 17 aa, Homo sapiens
  heavy chain complementarity determining region 3 for antibody 1143
ARNTMVGAWQRQGNLDH

SEQ ID NO: 2287 - protein, 9 aa, Homo sapiens
  light chain complementarity determining region 3 for antibody 1144
QQLSNAPLT

SEQ ID NO: 2288 - protein, 17 aa, Homo sapiens
  heavy chain complementarity determining region 3 for antibody 1144
AKRLPELLGGGHHYIDV

SEQ ID NO: 2289 - protein, 9 aa, Homo sapiens
  light chain complementarity determining region 3 for antibody 1145
QHYDVSPQT

SEQ ID NO: 2290 - protein, 15 aa, Homo sapiens
  heavy chain complementarity determining region 3 for antibody 1145
ARRGSVAATWRAFDI

SEQ ID NO: 2291 - protein, 9 aa, Homo sapiens
  light chain complementarity determining region 3 for antibody 1146
MQTLQTPWT

SEQ ID NO: 2292 - protein, 12 aa, Homo sapiens
  heavy chain complementarity determining region 3 for antibody 1146
ARWDWNYRAFDI

SEQ ID NO: 2293 - protein, 9 aa, Homo sapiens
  light chain complementarity determining region 3 for antibody 1147
LQYNNYPRT

SEQ ID NO: 2294 - protein, 11 aa, Homo sapiens
  heavy chain complementarity determining region 3 for antibody 1147
AKVSGLGNFEY

SEQ ID NO: 2295 - protein, 9 aa, Homo sapiens
  light chain complementarity determining region 3 for antibody 1148
HQHGTPPGT

SEQ ID NO: 2296 - protein, 18 aa, Homo sapiens
  heavy chain complementarity determining region 3 for antibody 1148
ASWAGYCGGDCSSVSLDY

SEQ ID NO: 2297 - protein, 9 aa, Homo sapiens
  light chain complementarity determining region 3 for antibody 1149
QVYRSAPHT

SEQ ID NO: 2298 - protein, 14 aa, Homo sapiens
  heavy chain complementarity determining region 3 for antibody 1149
CRGWLDPATPHYDF

SEQ ID NO: 2299 - protein, 9 aa, Homo sapiens
  light chain complementarity determining region 3 for antibody 1150
QRYGGTPGT

SEQ ID NO: 2300 - protein, 17 aa, Homo sapiens
  heavy chain complementarity determining region 3 for antibody 1150
ARGIWSCHLGGGSSMDV

SEQ ID NO: 2301 - protein, 9 aa, Homo sapiens
  light chain complementarity determining region 3 for antibody 1151
QQYYSFPPT

SEQ ID NO: 2302 - protein, 13 aa, Homo sapiens
  heavy chain complementarity determining region 3 for antibody 1151
TTGAPDSGSVFDN

SEQ ID NO: 2303 - protein, 9 aa, Homo sapiens
  light chain complementarity determining region 3 for antibody 1152
QQYYSAPIT

SEQ ID NO: 2304 - protein, 14 aa, Homo sapiens
  heavy chain complementarity determining region 3 for antibody 1152
ARGESPSCDFILDY

SEQ ID NO: 2305 - protein, 9 aa, Homo sapiens
  light chain complementarity determining region 3 for antibody 1153
QQYWSTPPT

SEQ ID NO: 2306 - protein, 19 aa, Homo sapiens
  heavy chain complementarity determining region 3 for antibody 1153
AKGPFSDFWSGYSNTWFDR

SEQ ID NO: 2307 - protein, 7 aa, Homo sapiens
  light chain complementarity determining region 3 for antibody 1154
QQYNTWT

SEQ ID NO: 2308 - protein, 15 aa, Homo sapiens
  heavy chain complementarity determining region 3 for antibody 1154
TTDLSSAPWYNCFDP

SEQ ID NO: 2309 - protein, 9 aa, Homo sapiens
  light chain complementarity determining region 3 for antibody 1155
QQYNNYPWT

SEQ ID NO: 2310 - protein, 14 aa, Homo sapiens
  heavy chain complementarity determining region 3 for antibody 1155
VREQGSGYYRTADY

SEQ ID NO: 2311 - protein, 9 aa, Homo sapiens
  light chain complementarity determining region 3 for antibody 1156
QQYNNWPRT

SEQ ID NO: 2312 - protein, 14 aa, Homo sapiens
  heavy chain complementarity determining region 3 for antibody 1156
TTAPGFWGTSPFDY

SEQ ID NO: 2313 - protein, 9 aa, Homo sapiens
  light chain complementarity determining region 3 for antibody 1157
QQYNIYPWT

SEQ ID NO: 2314 - protein, 15 aa, Homo sapiens
  heavy chain complementarity determining region 3 for antibody 1157
ARIRGEQQTGGPFDY

SEQ ID NO: 2315 - protein, 10 aa, Homo sapiens
  light chain complementarity determining region 3 for antibody 1158
QQYNFYSTLT

SEQ ID NO: 2316 - protein, 16 aa, Homo sapiens
  heavy chain complementarity determining region 3 for antibody 1158
GRQVVSGSRWPNRLDY

SEQ ID NO: 2317 - protein, 8 aa, Homo sapiens
  light chain complementarity determining region 3 for antibody 1159
QQYGSSPT

SEQ ID NO: 2318 - protein, 18 aa, Homo sapiens
  heavy chain complementarity determining region 3 for antibody 1159
ARQIARYCSSTSCYYSDY

SEQ ID NO: 2319 - protein, 9 aa, Homo sapiens
  light chain complementarity determining region 3 for antibody 1160
QQYGSSPIT

SEQ ID NO: 2320 - protein, 12 aa, Homo sapiens
  heavy chain complementarity determining region 3 for antibody 1160
VKDRGGRSGMDL

SEQ ID NO: 2321 - protein, 10 aa, Homo sapiens
  light chain complementarity determining region 3 for antibody 1161
QQYGRSTGLT

SEQ ID NO: 2322 - protein, 19 aa, Homo sapiens
  heavy chain complementarity determining region 3 for antibody 1161
ARAPTRLLYSGYVDGAFDI

SEQ ID NO: 2323 - protein, 9 aa, Homo sapiens
  light chain complementarity determining region 3 for antibody 1162
QQYGNSLIT

SEQ ID NO: 2324 - protein, 17 aa, Homo sapiens
  heavy chain complementarity determining region 3 for antibody 1162
ARFCNRGGSCHWASLDS

SEQ ID NO: 2325 - protein, 9 aa, Homo sapiens
  light chain complementarity determining region 3 for antibody 1163
QQYGDLPLT

SEQ ID NO: 2326 - protein, 17 aa, Homo sapiens
  heavy chain complementarity determining region 3 for antibody 1163
ARHNGPDRRGYFYYMDV

SEQ ID NO: 2327 - protein, 9 aa, Homo sapiens
  light chain complementarity determining region 3 for antibody 1164
QQYDRAPDT

SEQ ID NO: 2328 - protein, 11 aa, Homo sapiens
  heavy chain complementarity determining region 3 for antibody 1164
AREATETTPGY

SEQ ID NO: 2329 - protein, 10 aa, Homo sapiens
  light chain complementarity determining region 3 for antibody 1165
QQVNSYPPYT

SEQ ID NO: 2330 - protein, 9 aa, Homo sapiens
  heavy chain complementarity determining region 3 for antibody 1165
ARSEYQPTY

SEQ ID NO: 2331 - protein, 10 aa, Homo sapiens
  light chain complementarity determining region 3 for antibody 1166
QQTYSTPRFT

SEQ ID NO: 2332 - protein, 18 aa, Homo sapiens
  heavy chain complementarity determining region 3 for antibody 1166
AHTLPYRSGWYGGGYFDY

SEQ ID NO: 2333 - protein, 8 aa, Homo sapiens
  light chain complementarity determining region 3 for antibody 1167
QQSYTTPT

SEQ ID NO: 2334 - protein, 15 aa, Homo sapiens
  heavy chain complementarity determining region 3 for antibody 1167
ARGRGNTNGWYYFDY

SEQ ID NO: 2335 - protein, 8 aa, Homo sapiens
  light chain complementarity determining region 3 for antibody 1168
QQSYTTPT

SEQ ID NO: 2336 - protein, 26 aa, Homo sapiens
  heavy chain complementarity determining region 3 for antibody 1168
ARDFPKGGSYNSGWYGSVGGNYYMDV

SEQ ID NO: 2337 - protein, 9 aa, Homo sapiens
  light chain complementarity determining region 3 for antibody 1169
QQSYTTPRT

SEQ ID NO: 2338 - protein, 15 aa, Homo sapiens
  heavy chain complementarity determining region 3 for antibody 1169
AKDHRSSRGYYYMDV

SEQ ID NO: 2339 - protein, 9 aa, Homo sapiens
  light chain complementarity determining region 3 for antibody 1170
QQSHKTPYT

SEQ ID NO: 2340 - protein, 12 aa, Homo sapiens
  heavy chain complementarity determining region 3 for antibody 1170
ARHPALKNWFDP

SEQ ID NO: 2341 - protein, 9 aa, Homo sapiens
  light chain complementarity determining region 3 for antibody 1171
QLSGSSLLP

SEQ ID NO: 2342 - protein, 12 aa, Homo sapiens
  heavy chain complementarity determining region 3 for antibody 1171
ALDEWHPSWYKY

SEQ ID NO: 2343 - protein, 9 aa, Homo sapiens
  light chain complementarity determining region 3 for antibody 1172
MQTLQNPWT

SEQ ID NO: 2344 - protein, 12 aa, Homo sapiens
  heavy chain complementarity determining region 3 for antibody 1172
ARLDWNYRAFDI

SEQ ID NO: 2345 - protein, 9 aa, Homo sapiens
  light chain complementarity determining region 3 for antibody 1173
MQPLQTSWT

SEQ ID NO: 2346 - protein, 11 aa, Homo sapiens
  heavy chain complementarity determining region 3 for antibody 1173
TTDPVGLWRAH

SEQ ID NO: 2347 - protein, 9 aa, Homo sapiens
  light chain complementarity determining region 3 for antibody 1174
MQGTNWPHT

SEQ ID NO: 2348 - protein, 11 aa, Homo sapiens
  heavy chain complementarity determining region 3 for antibody 1174
ATFGQQWRLAH

SEQ ID NO: 2349 - protein, 9 aa, Homo sapiens
  light chain complementarity determining region 3 for antibody 1175
MQGLQTPLT

SEQ ID NO: 2350 - protein, 17 aa, Homo sapiens
  heavy chain complementarity determining region 3 for antibody 1175
ANRRPLATTYFFYGMDV

SEQ ID NO: 2351 - protein, 9 aa, Homo sapiens
  light chain complementarity determining region 3 for antibody 1176
MQFLQTPLP

SEQ ID NO: 2352 - protein, 10 aa, Homo sapiens
  heavy chain complementarity determining region 3 for antibody 1176
ARERSGSYDI

SEQ ID NO: 2353 - protein, 9 aa, Homo sapiens
  light chain complementarity determining region 3 for antibody 1177
MQALRLPLT

SEQ ID NO: 2354 - protein, 15 aa, Homo sapiens
  heavy chain complementarity determining region 3 for antibody 1177
VRDPAGLAYFYNMEV

SEQ ID NO: 2355 - protein, 9 aa, Homo sapiens
  light chain complementarity determining region 3 for antibody 1178
LQHISYPWT

SEQ ID NO: 2356 - protein, 15 aa, Homo sapiens
  heavy chain complementarity determining region 3 for antibody 1178
ARDGRGYGSSSSFDY

SEQ ID NO: 2357 - protein, 9 aa, Homo sapiens
  light chain complementarity determining region 3 for antibody 1179
HQYGSLPLT

SEQ ID NO: 2358 - protein, 13 aa, Homo sapiens
  heavy chain complementarity determining region 3 for antibody 1179
AKDRGSGWYAWGY

SEQ ID NO: 2359 - protein, 9 aa, Homo sapiens
  light chain complementarity determining region 3 for antibody 1180
QQYYSAPIT

SEQ ID NO: 2360 - protein, 14 aa, Homo sapiens
  heavy chain complementarity determining region 3 for antibody 1180
AKGESTSCDFIIDS

SEQ ID NO: 2361 - protein, 8 aa, Homo sapiens
  light chain complementarity determining region 3 for antibody 1181
QQYNSYWT

SEQ ID NO: 2362 - protein, 10 aa, Homo sapiens
  heavy chain complementarity determining region 3 for antibody 1181
ARERSGSYDI

SEQ ID NO: 2363 - protein, 8 aa, Homo sapiens
  light chain complementarity determining region 3 for antibody 1182
QQYNSYST

SEQ ID NO: 2364 - protein, 9 aa, Homo sapiens
  heavy chain complementarity determining region 3 for antibody 1182
ARAWKYGRV

SEQ ID NO: 2365 - protein, 8 aa, Homo sapiens
  light chain complementarity determining region 3 for antibody 1183
QQYNSYSA

SEQ ID NO: 2366 - protein, 17 aa, Homo sapiens
  heavy chain complementarity determining region 3 for antibody 1183
AKRGSAIQYGTYYYMDV

SEQ ID NO: 2367 - protein, 9 aa, Homo sapiens
  light chain complementarity determining region 3 for antibody 1184
QQYNRYPLT

SEQ ID NO: 2368 - protein, 11 aa, Homo sapiens
  heavy chain complementarity determining region 3 for antibody 1184
ATFGQQWRLAH

SEQ ID NO: 2369 - protein, 8 aa, Homo sapiens
  light chain complementarity determining region 3 for antibody 1185
QQYGSSSR

SEQ ID NO: 2370 - protein, 18 aa, Homo sapiens
  heavy chain complementarity determining region 3 for antibody 1185
TRSYYDDNSASFLYGMDV

SEQ ID NO: 2371 - protein, 7 aa, Homo sapiens
  light chain complementarity determining region 3 for antibody 1186
QQYDTWT

SEQ ID NO: 2372 - protein, 13 aa, Homo sapiens
  heavy chain complementarity determining region 3 for antibody 1186
AKPHYSGSGSGDY

SEQ ID NO: 2373 - protein, 8 aa, Homo sapiens
  light chain complementarity determining region 3 for antibody 1187
QQYDLYLT

SEQ ID NO: 2374 - protein, 14 aa, Homo sapiens
  heavy chain complementarity determining region 3 for antibody 1187
ARGTIGDYTDYFPY

SEQ ID NO: 2375 - protein, 9 aa, Homo sapiens
  light chain complementarity determining region 3 for antibody 1188
QQYATSART

SEQ ID NO: 2376 - protein, 12 aa, Homo sapiens
  heavy chain complementarity determining region 3 for antibody 1188
QGGNWGRDGFDI

SEQ ID NO: 2377 - protein, 9 aa, Homo sapiens
  light chain complementarity determining region 3 for antibody 1189
QQTFRTPYT

SEQ ID NO: 2378 - protein, 14 aa, Homo sapiens
  heavy chain complementarity determining region 3 for antibody 1189
ARLHGSGLGRWLDP

SEQ ID NO: 2379 - protein, 8 aa, Homo sapiens
  light chain complementarity determining region 3 for antibody 1190
QQSYTTPT

SEQ ID NO: 2380 - protein, 15 aa, Homo sapiens
  heavy chain complementarity determining region 3 for antibody 1190
ATPLGSITWYNAFDV

SEQ ID NO: 2381 - protein, 9 aa, Homo sapiens
  light chain complementarity determining region 3 for antibody 1191
QQSYSTPST

SEQ ID NO: 2382 - protein, 10 aa, Homo sapiens
  heavy chain complementarity determining region 3 for antibody 1191
ARETSGSYDI

SEQ ID NO: 2383 - protein, 9 aa, Homo sapiens
  light chain complementarity determining region 3 for antibody 1192
QQSYSTPST

SEQ ID NO: 2384 - protein, 17 aa, Homo sapiens
  heavy chain complementarity determining region 3 for antibody 1192
AKRLPDLLGGGHHYIDV

SEQ ID NO: 2385 - protein, 9 aa, Homo sapiens
  light chain complementarity determining region 3 for antibody 1193
QQSYSTPIT

SEQ ID NO: 2386 - protein, 15 aa, Homo sapiens
  heavy chain complementarity determining region 3 for antibody 1193
ARDSYVGSGGYQTDS

SEQ ID NO: 2387 - protein, 9 aa, Homo sapiens
  light chain complementarity determining region 3 for antibody 1194
QQLYNYPVT

SEQ ID NO: 2388 - protein, 17 aa, Homo sapiens
  heavy chain complementarity determining region 3 for antibody 1194
ARNTMVGTWQRQGNLDH

SEQ ID NO: 2389 - protein, 9 aa, Homo sapiens
  light chain complementarity determining region 3 for antibody 1195
QQLNSYPRT

SEQ ID NO: 2390 - protein, 9 aa, Homo sapiens
  heavy chain complementarity determining region 3 for antibody 1195
ARGRTAMFT

SEQ ID NO: 2391 - protein, 9 aa, Homo sapiens
  light chain complementarity determining region 3 for antibody 1196
QQLKYYPIT

SEQ ID NO: 2392 - protein, 14 aa, Homo sapiens
  heavy chain complementarity determining region 3 for antibody 1196
VRETTHDWADGGIY

SEQ ID NO: 2393 - protein, 9 aa, Homo sapiens
  light chain complementarity determining region 3 for antibody 1197
QKYNSAPWT

SEQ ID NO: 2394 - protein, 18 aa, Homo sapiens
  heavy chain complementarity determining region 3 for antibody 1197
ARSSAGVWHVVVETGFDF

SEQ ID NO: 2395 - protein, 10 aa, Homo sapiens
  light chain complementarity determining region 3 for antibody 1198
QHYGSSLPVT

SEQ ID NO: 2396 - protein, 18 aa, Homo sapiens
  heavy chain complementarity determining region 3 for antibody 1198
SRGHAYPSSWNSYPDFDF

SEQ ID NO: 2397 - protein, 9 aa, Homo sapiens
  light chain complementarity determining region 3 for antibody 1199
QERSTWPGS

SEQ ID NO: 2398 - protein, 13 aa, Homo sapiens
  heavy chain complementarity determining region 3 for antibody 1199
ATGAWCSSWWGDY

SEQ ID NO: 2399 - protein, 9 aa, Homo sapiens
  light chain complementarity determining region 3 for antibody 1200
MQTLQTPWK

SEQ ID NO: 2400 - protein, 12 aa, Homo sapiens
  heavy chain complementarity determining region 3 for antibody 1200
ARLDWNYRAFDI

SEQ ID NO: 2401 - protein, 8 aa, Homo sapiens
  light chain complementarity determining region 3 for antibody 1201
MQSIHRLT

SEQ ID NO: 2402 - protein, 8 aa, Homo sapiens
  heavy chain complementarity determining region 3 for antibody 1201
VSQTLVVN

SEQ ID NO: 2403 - protein, 9 aa, Homo sapiens
  light chain complementarity determining region 3 for antibody 1202
MQGTQWPPT

SEQ ID NO: 2404 - protein, 12 aa, Homo sapiens
  heavy chain complementarity determining region 3 for antibody 1202
ARDGPVRYGMDV

SEQ ID NO: 2405 - protein, 9 aa, Homo sapiens
  light chain complementarity determining region 3 for antibody 1203
MQGTHWPWT

SEQ ID NO: 2406 - protein, 13 aa, Homo sapiens
  heavy chain complementarity determining region 3 for antibody 1203
AKEGSSPGPDFDY

SEQ ID NO: 2407 - protein, 9 aa, Homo sapiens
  light chain complementarity determining region 3 for antibody 1204
MQGLQIPRT

SEQ ID NO: 2408 - protein, 13 aa, Homo sapiens
  heavy chain complementarity determining region 3 for antibody 1204
TRDHTYSVPGGGY

SEQ ID NO: 2409 - protein, 9 aa, Homo sapiens
  light chain complementarity determining region 3 for antibody 1205
MQALQTPLT

SEQ ID NO: 2410 - protein, 15 aa, Homo sapiens
  heavy chain complementarity determining region 3 for antibody 1205
ATEIYFGESIYGMDV

SEQ ID NO: 2411 - protein, 9 aa, Homo sapiens
  light chain complementarity determining region 3 for antibody 1206
LQHNSYPWT

SEQ ID NO: 2412 - protein, 12 aa, Homo sapiens
  heavy chain complementarity determining region 3 for antibody 1206
TRNGAGRDYLDY

SEQ ID NO: 2413 - protein, 9 aa, Homo sapiens
  light chain complementarity determining region 3 for antibody 1207
LQGLRVPFT

SEQ ID NO: 2414 - protein, 11 aa, Homo sapiens
  heavy chain complementarity determining region 3 for antibody 1207
GRDVDYSTPAF

SEQ ID NO: 2415 - protein, 11 aa, Homo sapiens
  light chain complementarity determining region 3 for antibody 1208
LQFKGSPHTVT

SEQ ID NO: 2416 - protein, 11 aa, Homo sapiens
  heavy chain complementarity determining region 3 for antibody 1208
VRDRNGYVFDY

SEQ ID NO: 2417 - protein, 9 aa, Homo sapiens
  light chain complementarity determining region 3 for antibody 1209
QQYYSSPLT

SEQ ID NO: 2418 - protein, 13 aa, Homo sapiens
  heavy chain complementarity determining region 3 for antibody 1209
VRGECASCYLVDY

SEQ ID NO: 2419 - protein, 9 aa, Homo sapiens
  light chain complementarity determining region 3 for antibody 1210
QQYYSSPFT

SEQ ID NO: 2420 - protein, 14 aa, Homo sapiens
  heavy chain complementarity determining region 3 for antibody 1210
AASYSSGWLEYFPY

SEQ ID NO: 2421 - protein, 9 aa, Homo sapiens
  light chain complementarity determining region 3 for antibody 1211
QQYYSAPQM

SEQ ID NO: 2422 - protein, 9 aa, Homo sapiens
  heavy chain complementarity determining region 3 for antibody 1211
ARDVWPEDC

SEQ ID NO: 2423 - protein, 9 aa, Homo sapiens
  light chain complementarity determining region 3 for antibody 1212
QQYSDYSVT

SEQ ID NO: 2424 - protein, 14 aa, Homo sapiens
  heavy chain complementarity determining region 3 for antibody 1212
ARGGLNYYYYYMDV

SEQ ID NO: 2425 - protein, 8 aa, Homo sapiens
  light chain complementarity determining region 3 for antibody 1213
QQYNSYYT

SEQ ID NO: 2426 - protein, 17 aa, Homo sapiens
  heavy chain complementarity determining region 3 for antibody 1213
AREGHNDSSGPLKHFDY

SEQ ID NO: 2427 - protein, 9 aa, Homo sapiens
  light chain complementarity determining region 3 for antibody 1214
QQYNSYSWT

SEQ ID NO: 2428 - protein, 18 aa, Homo sapiens
  heavy chain complementarity determining region 3 for antibody 1214
ARGLHQLILGGYFYGLDV

SEQ ID NO: 2429 - protein, 9 aa, Homo sapiens
  light chain complementarity determining region 3 for antibody 1215
QQYLTYPLT

SEQ ID NO: 2430 - protein, 18 aa, Homo sapiens
  heavy chain complementarity determining region 3 for antibody 1215
ARGSYCDGSSWCPYGFDI

SEQ ID NO: 2431 - protein, 9 aa, Homo sapiens
  light chain complementarity determining region 3 for antibody 1216
QQYKSPPYT

SEQ ID NO: 2432 - protein, 13 aa, Homo sapiens
  heavy chain complementarity determining region 3 for antibody 1216
ARPGVWSDYDLDY

SEQ ID NO: 2433 - protein, 10 aa, Homo sapiens
  light chain complementarity determining region 3 for antibody 1217
QQYKNWPPYT

SEQ ID NO: 2434 - protein, 14 aa, Homo sapiens
  heavy chain complementarity determining region 3 for antibody 1217
VRENCYGTGSCFDY

SEQ ID NO: 2435 - protein, 9 aa, Homo sapiens
  light chain complementarity determining region 3 for antibody 1218
QQSYSTPIT

SEQ ID NO: 2436 - protein, 12 aa, Homo sapiens
  heavy chain complementarity determining region 3 for antibody 1218
ARDKGGRNGMDV

SEQ ID NO: 2437 - protein, 9 aa, Homo sapiens
  light chain complementarity determining region 3 for antibody 1219
QNYNSVPLT

SEQ ID NO: 2438 - protein, 10 aa, Homo sapiens
  heavy chain complementarity determining region 3 for antibody 1219
CRDRKGFGDV

SEQ ID NO: 2439 - protein, 9 aa, Homo sapiens
  light chain complementarity determining region 3 for antibody 1220
QHYDSYPLT

SEQ ID NO: 2440 - protein, 13 aa, Homo sapiens
  heavy chain complementarity determining region 3 for antibody 1220
AKEGSSPGPDFDS

SEQ ID NO: 2441 - protein, 9 aa, Homo sapiens
  light chain complementarity determining region 3 for antibody 1221
MQGTHWPWT

SEQ ID NO: 2442 - protein, 16 aa, Homo sapiens
  heavy chain complementarity determining region 3 for antibody 1221
ARWFSRSSTGVSYMDV

SEQ ID NO: 2443 - protein, 9 aa, Homo sapiens
  light chain complementarity determining region 3 for antibody 1222
MQGTHWPHT

SEQ ID NO: 2444 - protein, 11 aa, Homo sapiens
  heavy chain complementarity determining region 3 for antibody 1222
ATVGQQWRLAH

SEQ ID NO: 2445 - protein, 9 aa, Homo sapiens
  light chain complementarity determining region 3 for antibody 1223
MQGTHWPFT

SEQ ID NO: 2446 - protein, 11 aa, Homo sapiens
  heavy chain complementarity determining region 3 for antibody 1223
VAYNWGSSSDY

SEQ ID NO: 2447 - protein, 9 aa, Homo sapiens
  light chain complementarity determining region 3 for antibody 1224
MQGLHGLPV

SEQ ID NO: 2448 - protein, 15 aa, Homo sapiens
  heavy chain complementarity determining region 3 for antibody 1224
SRDASADSFPDAFDV

SEQ ID NO: 2449 - protein, 9 aa, Homo sapiens
  light chain complementarity determining region 3 for antibody 1225
MQFLQTPLT

SEQ ID NO: 2450 - protein, 10 aa, Homo sapiens
  heavy chain complementarity determining region 3 for antibody 1225
ARERSGAYDI

SEQ ID NO: 2451 - protein, 8 aa, Homo sapiens
  light chain complementarity determining region 3 for antibody 1226
MQALQTLT

SEQ ID NO: 2452 - protein, 12 aa, Homo sapiens
  heavy chain complementarity determining region 3 for antibody 1226
ARVTTVTAGRAY

SEQ ID NO: 2453 - protein, 9 aa, Homo sapiens
  light chain complementarity determining region 3 for antibody 1227
LQHNSYPWT

SEQ ID NO: 2454 - protein, 13 aa, Homo sapiens
  heavy chain complementarity determining region 3 for antibody 1227
AKEGSSPGPDFDY

SEQ ID NO: 2455 - protein, 9 aa, Homo sapiens
  light chain complementarity determining region 3 for antibody 1228
APGSYWPAS

SEQ ID NO: 2456 - protein, 10 aa, Homo sapiens
  heavy chain complementarity determining region 3 for antibody 1228
CRDREGFGDV

SEQ ID NO: 2457 - protein, 9 aa, Homo sapiens
  light chain complementarity determining region 3 for antibody 1229
QQYRSTPFT

SEQ ID NO: 2458 - protein, 16 aa, Homo sapiens
  heavy chain complementarity determining region 3 for antibody 1229
ARSRQEDVRYSGWFDP

SEQ ID NO: 2459 - protein, 9 aa, Homo sapiens
  light chain complementarity determining region 3 for antibody 1230
QQYNTYPWT

SEQ ID NO: 2460 - protein, 21 aa, Homo sapiens
  heavy chain complementarity determining region 3 for antibody 1230
ARGRRTDCRNGDIGCRPMFDF

SEQ ID NO: 2461 - protein, 9 aa, Homo sapiens
  light chain complementarity determining region 3 for antibody 1231
QQYNSYPWT

SEQ ID NO: 2462 - protein, 17 aa, Homo sapiens
  heavy chain complementarity determining region 3 for antibody 1231
AKVQDSSGYTYYYPMDV

SEQ ID NO: 2463 - protein, 10 aa, Homo sapiens [sequence omitted]

SEQ ID NO: 2464 - protein, 25 aa, Homo sapiens
  heavy chain complementarity determining region 3 for antibody 1232
ARESESGWFGELLAQINYYYYGMDV

SEQ ID NO: 2465 - protein, 9 aa, Homo sapiens
  light chain complementarity determining region 3 for antibody 1233
QQYGTSLWT

SEQ ID NO: 2466 - protein, 15 aa, Homo sapiens
  heavy chain complementarity determining region 3 for antibody 1233
AAAYNYGYSLYAFDL

SEQ ID NO: 2467 - protein, 9 aa, Homo sapiens
  light chain complementarity determining region 3 for antibody 1234
QQYGSSPLT

SEQ ID NO: 2468 - protein, 13 aa, Homo sapiens
  heavy chain complementarity determining region 3 for antibody 1234
AKEGSSPGPDFDS

SEQ ID NO: 2469 - protein, 9 aa, Homo sapiens
  light chain complementarity determining region 3 for antibody 1235
QQYGSLPLT

SEQ ID NO: 2470 - protein, 13 aa, Homo sapiens
  heavy chain complementarity determining region 3 for antibody 1235
AKDRGAGWYAWGY

SEQ ID NO: 2471 - protein, 9 aa, Homo sapiens
  light chain complementarity determining region 3 for antibody 1236
QQYGNSLYT

SEQ ID NO: 2472 - protein, 11 aa, Homo sapiens
  heavy chain complementarity determining region 3 for antibody 1236
AAVDSYGTLVY

SEQ ID NO: 2473 - protein, 9 aa, Homo sapiens
  light chain complementarity determining region 3 for antibody 1237
QQYDNLPNT

SEQ ID NO: 2474 - protein, 8 aa, Homo sapiens
  heavy chain complementarity determining region 3 for antibody 1237
GSWGSWVV

SEQ ID NO: 2475 - protein, 9 aa, Homo sapiens
  light chain complementarity determining region 3 for antibody 1238
QQTYRPPLT

SEQ ID NO: 2476 - protein, 6 aa, Homo sapiens
  heavy chain complementarity determining region 3 for antibody 1238
GRDVGP

SEQ ID NO: 2477 - protein, 9 aa, Homo sapiens
  light chain complementarity determining region 3 for antibody 1239
QQTSRTPYT

SEQ ID NO: 2478 - protein, 14 aa, Homo sapiens
  heavy chain complementarity determining region 3 for antibody 1239
ARLHGSGLGRWLDP

SEQ ID NO: 2479 - protein, 8 aa, Homo sapiens
  light chain complementarity determining region 3 for antibody 1240
QQSYTTPT

SEQ ID NO: 2480 - protein, 15 aa, Homo sapiens
  heavy chain complementarity determining region 3 for antibody 1240
TTSRTASAWYNAFDI

SEQ ID NO: 2481 - protein, 9 aa, Homo sapiens
  light chain complementarity determining region 3 for antibody 1241
QQSYTMPRT

SEQ ID NO: 2482 - protein, 18 aa, Homo sapiens
  heavy chain complementarity determining region 3 for antibody 1241
TTILSQMLTGDWHLYFPH

SEQ ID NO: 2483 - protein, 11 aa, Homo sapiens
  light chain complementarity determining region 3 for antibody 1242
QQRSNWPPVYT

SEQ ID NO: 2484 - protein, 9 aa, Homo sapiens
  heavy chain complementarity determining region 3 for antibody 1242
ARREPAHDY

SEQ ID NO: 2485 - protein, 9 aa, Homo sapiens
  light chain complementarity determining region 3 for antibody 1243
QQNDDLPLT

SEQ ID NO: 2486 - protein, 11 aa, Homo sapiens
  heavy chain complementarity determining region 3 for antibody 1243
TRGGYSVGYDY

SEQ ID NO: 2487 - protein, 9 aa, Homo sapiens
  light chain complementarity determining region 3 for antibody 1244
QQLNSHPYT

SEQ ID NO: 2488 - protein, 14 aa, Homo sapiens
  heavy chain complementarity determining region 3 for antibody 1244
ARGHFDSTGFRLDY

SEQ ID NO: 2489 - protein, 9 aa, Homo sapiens
  light chain complementarity determining region 3 for antibody 1245
QQLMVYPYT

SEQ ID NO: 2490 - protein, 10 aa, Homo sapiens
  heavy chain complementarity determining region 3 for antibody 1245
CRDREGFGDV

SEQ ID NO: 2491 - protein, 9 aa, Homo sapiens
  light chain complementarity determining region 3 for antibody 1246
QKYNSAPPT

SEQ ID NO: 2492 - protein, 13 aa, Homo sapiens
  heavy chain complementarity determining region 3 for antibody 1246
AKEGSSPGPDFDY

SEQ ID NO: 2493 - protein, 10 aa, Homo sapiens
  light chain complementarity determining region 3 for antibody 1247
QHYGTSPGWT

SEQ ID NO: 2494 - protein, 9 aa, Homo sapiens
  heavy chain complementarity determining region 3 for antibody 1247
VGATPDSDY

SEQ ID NO: 2495 - protein, 8 aa, Homo sapiens
  light chain complementarity determining region 3 for antibody 1248
QHYGGSPT

SEQ ID NO: 2496 - protein, 10 aa, Homo sapiens
  heavy chain complementarity determining region 3 for antibody 1248
ARALGGTPEY

SEQ ID NO: 2497 - protein, 9 aa, Homo sapiens
  light chain complementarity determining region 3 for antibody 1249
QHSYSTPRT

SEQ ID NO: 2498 - protein, 20 aa, Homo sapiens
  heavy chain complementarity determining region 3 for antibody 1249
ATENRMAPAGSGYYYYGMDV

SEQ ID NO: 2499 - protein, 9 aa, Homo sapiens
  light chain complementarity determining region 3 for antibody 1250
QGLNTFPWT

SEQ ID NO: 2500 - protein, 13 aa, Homo sapiens
  heavy chain complementarity determining region 3 for antibody 1250
SRPTWKQLWLQDF

SEQ ID NO: 2501 - protein, 9 aa, Homo sapiens
  light chain complementarity determining region 3 for antibody 1251
MQGKEWPYT

SEQ ID NO: 2502 - protein, 12 aa, Homo sapiens
  heavy chain complementarity determining region 3 for antibody 1251
AIVVPGRWDLDD

SEQ ID NO: 2503 - protein, 9 aa, Homo sapiens
  light chain complementarity determining region 3 for antibody 1252
LQFAHWPHP

SEQ ID NO: 2504 - protein, 9 aa, Homo sapiens
  heavy chain complementarity determining region 3 for antibody 1252
AGWGGLSNY

SEQ ID NO: 2505 - protein, 9 aa, Homo sapiens
  light chain complementarity determining region 3 for antibody 1253
HQYYIPPFT

SEQ ID NO: 2506 - protein, 10 aa, Homo sapiens
  heavy chain complementarity determining region 3 for antibody 1253
ARGRPYGMDV

SEQ ID NO: 2507 - protein, 9 aa, Homo sapiens
  light chain complementarity determining region 3 for antibody 1254
QRYNNVPWA

SEQ ID NO: 2508 - protein, 20 aa, Homo sapiens
  heavy chain complementarity determining region 3 for antibody 1254
TRDQRSIHLWLLAEGGGMDV

SEQ ID NO: 2509 - protein, 9 aa, Homo sapiens
  light chain complementarity determining region 3 for antibody 1255
QQYYKSPIT

SEQ ID NO: 2510 - protein, 10 aa, Homo sapiens
  heavy chain complementarity determining region 3 for antibody 1255
ARDAFSKGDY

SEQ ID NO: 2511 - protein, 10 aa, Homo sapiens
  light chain complementarity determining region 3 for antibody 1256
QQYTNRPPWT

SEQ ID NO: 2512 - protein, 13 aa, Homo sapiens
  heavy chain complementarity determining region 3 for antibody 1256
ARDSPSGLYVVDN

SEQ ID NO: 2513 - protein, 9 aa, Homo sapiens
  light chain complementarity determining region 3 for antibody 1257
QQYNNWPLT

SEQ ID NO: 2514 - protein, 15 aa, Homo sapiens
  heavy chain complementarity determining region 3 for antibody 1257
ARGPLNNWNPAPFDH

SEQ ID NO: 2515 - protein, 8 aa, Homo sapiens
  light chain complementarity determining region 3 for antibody 1258
QQYKSDWT

SEQ ID NO: 2516 - protein, 12 aa, Homo sapiens
  heavy chain complementarity determining region 3 for antibody 1258
ARHRVGDRVTDF

SEQ ID NO: 2517 - protein, 9 aa, Homo sapiens
  light chain complementarity determining region 3 for antibody 1259
QQYGNSRWT

SEQ ID NO: 2518 - protein, 10 aa, Homo sapiens
  heavy chain complementarity determining region 3 for antibody 1259
TTEDYGSGRS

SEQ ID NO: 2519 - protein, 9 aa, Homo sapiens
  light chain complementarity determining region 3 for antibody 1260
QQYGNLPPT

SEQ ID NO: 2520 - protein, 11 aa, Homo sapiens
  heavy chain complementarity determining region 3 for antibody 1260
ARDGGRFSDDY

SEQ ID NO: 2521 - protein, 9 aa, Homo sapiens
  light chain complementarity determining region 3 for antibody 1261
QQYGGSLLT

SEQ ID NO: 2522 - protein, 11 aa, Homo sapiens
  heavy chain complementarity determining region 3 for antibody 1261
ARDPPGKDLDY

SEQ ID NO: 2523 - protein, 8 aa, Homo sapiens
  light chain complementarity determining region 3 for antibody 1262
QQYDTYST

SEQ ID NO: 2524 - protein, 25 aa, Homo sapiens
  heavy chain complementarity determining region 3 for antibody 1262
ARDRVLAGPYCGAGGCYGQADAFDI

SEQ ID NO: 2525 - protein, 9 aa, Homo sapiens
  light chain complementarity determining region 3 for antibody 1263
QQSYSTPST

SEQ ID NO: 2526 - protein, 12 aa, Homo sapiens
  heavy chain complementarity determining region 3 for antibody 1263
ARDKGGRNGMDV

SEQ ID NO: 2527 - protein, 9 aa, Homo sapiens
  light chain complementarity determining region 3 for antibody 1264
QQSYSAPYT

SEQ ID NO: 2528 - protein, 25 aa, Homo sapiens
  heavy chain complementarity determining region 3 for antibody 1264
ARGFPKGGPKYSSQRSLKVYWYFDL

SEQ ID NO: 2529 - protein, 9 aa, Homo sapiens
  light chain complementarity determining region 3 for antibody 1265
QQRSDWPIT

SEQ ID NO: 2530 - protein, 15 aa, Homo sapiens
  heavy chain complementarity determining region 3 for antibody 1265
ARAGFGSASPNWFDP

SEQ ID NO: 2531 - protein, 9 aa, Homo sapiens
  light chain complementarity determining region 3 for antibody 1266
QQGYSTPFT

SEQ ID NO: 2532 - protein, 14 aa, Homo sapiens
  heavy chain complementarity determining region 3 for antibody 1266
VGRDDYSDHGRFDY

SEQ ID NO: 2533 - protein, 9 aa, Homo sapiens
  light chain complementarity determining region 3 for antibody 1267
QQCSSSPLT

SEQ ID NO: 2534 - protein, 16 aa, Homo sapiens
  heavy chain complementarity determining region 3 for antibody 1267
AKWAGSGPYYIVTFDY

SEQ ID NO: 2535 - protein, 9 aa, Homo sapiens
  light chain complementarity determining region 3 for antibody 1268
QQAYNLPLT

SEQ ID NO: 2536 - protein, 13 aa, Homo sapiens
  heavy chain complementarity determining region 3 for antibody 1268
AKEGSSPGPDFDY

SEQ ID NO: 2537 - protein, 10 aa, Homo sapiens
  light chain complementarity determining region 3 for antibody 1269
QHYDVSSSIT

SEQ ID NO: 2538 - protein, 10 aa, Homo sapiens
  heavy chain complementarity determining region 3 for antibody 1269
AHRINRAFDI

SEQ ID NO: 2539 - protein, 9 aa, Homo sapiens
  light chain complementarity determining region 3 for antibody 1270
QHYANWPRT

SEQ ID NO: 2540 - protein, 15 aa, Homo sapiens
  heavy chain complementarity determining region 3 for antibody 1270
AREVFSGAYPDFFEY

SEQ ID NO: 2541 - protein, 9 aa, Homo sapiens
  light chain complementarity determining region 3 for antibody 1271
QHFNNYLVT

SEQ ID NO: 2542 - protein, 25 aa, Homo sapiens
  heavy chain complementarity determining region 3 for antibody 1271
AREICHTAACYEILWFGQTPYYFDS

SEQ ID NO: 2543 - protein, 9 aa, Homo sapiens
  light chain complementarity determining region 3 for antibody 1272
MQTLQTPWT

SEQ ID NO: 2544 - protein, 12 aa, Homo sapiens
  heavy chain complementarity determining region 3 for antibody 1272
ARLDWNYRAFHI

SEQ ID NO: 2545 - protein, 9 aa, Homo sapiens
  light chain complementarity determining region 3 for antibody 1273
MQTLKTPWT

SEQ ID NO: 2546 - protein, 12 aa, Homo sapiens
  heavy chain complementarity determining region 3 for antibody 1273
ARLDWNYRAFDI

SEQ ID NO: 2547 - protein, 8 aa, Homo sapiens
  light chain complementarity determining region 3 for antibody 1274
MQGTHWPA

SEQ ID NO: 2548 - protein, 10 aa, Homo sapiens
  heavy chain complementarity determining region 3 for antibody 1274
ARETSGSYDI

SEQ ID NO: 2549 - protein, 9 aa, Homo sapiens
  light chain complementarity determining region 3 for antibody 1275
LQDYDYPWT

SEQ ID NO: 2550 - protein, 14 aa, Homo sapiens
  heavy chain complementarity determining region 3 for antibody 1275
ARLIATSGRFALDY

SEQ ID NO: 2551 - protein, 9 aa, Homo sapiens
  light chain complementarity determining region 3 for antibody 1276
HQYYTSPLT

SEQ ID NO: 2552 - protein, 10 aa, Homo sapiens
  heavy chain complementarity determining region 3 for antibody 1276
GGGEGWLTDF

SEQ ID NO: 2553 - protein, 9 aa, Homo sapiens
  light chain complementarity determining region 3 for antibody 1277
HHYATSRRT

SEQ ID NO: 2554 - protein, 17 aa, Homo sapiens
  heavy chain complementarity determining region 3 for antibody 1277
ARALRSDSQYGADFIDV

SEQ ID NO: 2555 - protein, 9 aa, Homo sapiens
  light chain complementarity determining region 3 for antibody 1278
AQGSYGPAS

SEQ ID NO: 2556 - protein, 10 aa, Homo sapiens
  heavy chain complementarity determining region 3 for antibody 1278
CRDREGFGDV

SEQ ID NO: 2557 - protein, 9 aa, Homo sapiens
  light chain complementarity determining region 3 for antibody 1279
QQYYRAPIT

SEQ ID NO: 2558 - protein, 14 aa, Homo sapiens
  heavy chain complementarity determining region 3 for antibody 1279
AKGESTSCDYIIDY

SEQ ID NO: 2559 - protein, 8 aa, Homo sapiens
  light chain complementarity determining region 3 for antibody 1280
QQYYATPT

SEQ ID NO: 2560 - protein, 16 aa, Homo sapiens
  heavy chain complementarity determining region 3 for antibody 1280
VRATDTSSWSFLISDY

SEQ ID NO: 2561 - protein, 9 aa, Homo sapiens
  light chain complementarity determining region 3 for antibody 1281
QQYGSSPQT

SEQ ID NO: 2562 - protein, 14 aa, Homo sapiens
  heavy chain complementarity determining region 3 for antibody 1281
VHPTKAARLPIFDY

SEQ ID NO: 2563 - protein, 9 aa, Homo sapiens
  light chain complementarity determining region 3 for antibody 1282
QQYGSSLLT

SEQ ID NO: 2564 - protein, 13 aa, Homo sapiens
  heavy chain complementarity determining region 3 for antibody 1282
AKEGSAPGPDFEY

SEQ ID NO: 2565 - protein, 9 aa, Homo sapiens
  light chain complementarity determining region 3 for antibody 1283
QQYGSPPAT

SEQ ID NO: 2566 - protein, 10 aa, Homo sapiens
  heavy chain complementarity determining region 3 for antibody 1283
ARERSGSYDI

SEQ ID NO: 2567 - protein, 8 aa, Homo sapiens
  light chain complementarity determining region 3 for antibody 1284
QQYGRSPT

SEQ ID NO: 2568 - protein, 16 aa, Homo sapiens
  heavy chain complementarity determining region 3 for antibody 1284
ATGHPYCNGDCWHFDF

SEQ ID NO: 2569 - protein, 9 aa, Homo sapiens
  light chain complementarity determining region 3 for antibody 1285
QQYDSLQGT

SEQ ID NO: 2570 - protein, 11 aa, Homo sapiens
  heavy chain complementarity determining region 3 for antibody 1285
AREQHGQAPDY

SEQ ID NO: 2571 - protein, 9 aa, Homo sapiens
  light chain complementarity determining region 3 for antibody 1286
QQYDNLPPF

SEQ ID NO: 2572 - protein, 10 aa, Homo sapiens
  heavy chain complementarity determining region 3 for antibody 1286
ARETSGSYDV

SEQ ID NO: 2573 - protein, 9 aa, Homo sapiens
  light chain complementarity determining region 3 for antibody 1287
QQSYSTPRT

SEQ ID NO: 2574 - protein, 16 aa, Homo sapiens
  heavy chain complementarity determining region 3 for antibody 1287
ARSFNRSGTKVWYFDL

SEQ ID NO: 2575 - protein, 9 aa, Homo sapiens
  light chain complementarity determining region 3 for antibody 1288
QQSYSTPQT

SEQ ID NO: 2576 - protein, 15 aa, Homo sapiens
  heavy chain complementarity determining region 3 for antibody 1288
ARASRGLLEARPFDY

SEQ ID NO: 2577 - protein, 10 aa, Homo sapiens
  light chain complementarity determining region 3 for antibody 1289
QQSYGTPPWT

SEQ ID NO: 2578 - protein, 12 aa, Homo sapiens
  heavy chain complementarity determining region 3 for antibody 1289
TKDSEMKWEMRD

SEQ ID NO: 2579 - protein, 9 aa, Homo sapiens
  light chain complementarity determining region 3 for antibody 1290
QQRVNWPPT

SEQ ID NO: 2580 - protein, 17 aa, Homo sapiens
  heavy chain complementarity determining region 3 for antibody 1290
ARDMPMIVATPGGCFDC

SEQ ID NO: 2581 - protein, 9 aa, Homo sapiens
  light chain complementarity determining region 3 for antibody 1291
QQFYDIPLT

SEQ ID NO: 2582 - protein, 16 aa, Homo sapiens
  heavy chain complementarity determining region 3 for antibody 1291
ARDGRGASSQFNLFDP

SEQ ID NO: 2583 - protein, 9 aa, Homo sapiens
  light chain complementarity determining region 3 for antibody 1292
QQADSFPYT

SEQ ID NO: 2584 - protein, 16 aa, Homo sapiens
  heavy chain complementarity determining region 3 for antibody 1292
ARDQGFGYGVPDACDI

SEQ ID NO: 2585 - protein, 9 aa, Homo sapiens
  light chain complementarity determining region 3 for antibody 1293
QHHNNWPQT

SEQ ID NO: 2586 - protein, 11 aa, Homo sapiens
  heavy chain complementarity determining region 3 for antibody 1293
ARDGDKWNFDY

SEQ ID NO: 2587 - protein, 9 aa, Homo sapiens
  light chain complementarity determining region 3 for antibody 1294
MQSTHWPNT

SEQ ID NO: 2588 - protein, 11 aa, Homo sapiens
  heavy chain complementarity determining region 3 for antibody 1294
ARGDGWYGLDF

SEQ ID NO: 2589 - protein, 9 aa, Homo sapiens
  light chain complementarity determining region 3 for antibody 1295
MQGTHWPIT

SEQ ID NO: 2590 - protein, 15 aa, Homo sapiens
  heavy chain complementarity determining region 3 for antibody 1295
ARIWTSSTNCRYMDV

SEQ ID NO: 2591 - protein, 8 aa, Homo sapiens
  light chain complementarity determining region 3 for antibody 1296
MQALQTFT

SEQ ID NO: 2592 - protein, 18 aa, Homo sapiens
  heavy chain complementarity determining region 3 for antibody 1296
TRRSRDDWTSPRGRAFDI

SEQ ID NO: 2593 - protein, 9 aa, Homo sapiens
  light chain complementarity determining region 3 for antibody 1297
MEALDISYT

SEQ ID NO: 2594 - protein, 15 aa, Homo sapiens
  heavy chain complementarity determining region 3 for antibody 1297
VRGPSYGARSDYLDF

SEQ ID NO: 2595 - protein, 9 aa, Homo sapiens
  light chain complementarity determining region 3 for antibody 1298
LQYYTAPWA

SEQ ID NO: 2596 - protein, 17 aa, Homo sapiens
  heavy chain complementarity determining region 3 for antibody 1298
CRDGRIIWPGSQGSLDS

SEQ ID NO: 2597 - protein, 6 aa, Homo sapiens
  light chain complementarity determining region 3 for antibody 1299
LQYHGH

SEQ ID NO: 2598 - protein, 16 aa, Homo sapiens
  heavy chain complementarity determining region 3 for antibody 1299
ARSRLLSDFWTGFPDR

SEQ ID NO: 2599 - protein, 9 aa, Homo sapiens
  light chain complementarity determining region 3 for antibody 1300
LQATHWPRT

SEQ ID NO: 2600 - protein, 8 aa, Homo sapiens
  heavy chain complementarity determining region 3 for antibody 1300
GRDRWWSG

SEQ ID NO: 2601 - protein, 9 aa, Homo sapiens
  light chain complementarity determining region 3 for antibody 1301
HQYSQPPWT

SEQ ID NO: 2602 - protein, 11 aa, Homo sapiens
  heavy chain complementarity determining region 3 for antibody 1301
ARGRDAYKVGY

SEQ ID NO: 2603 - protein, 9 aa, Homo sapiens
  light chain complementarity determining region 3 for antibody 1302
HQYHDWPWT

SEQ ID NO: 2604 - protein, 11 aa, Homo sapiens
  heavy chain complementarity determining region 3 for antibody 1302
ARDYFGWMGGY

SEQ ID NO: 2605 - protein, 10 aa, Homo sapiens
  light chain complementarity determining region 3 for antibody 1303
HQYDSSPPWT

SEQ ID NO: 2606 - protein, 14 aa, Homo sapiens
  heavy chain complementarity determining region 3 for antibody 1303
SHPTRGARLPIFDY

SEQ ID NO: 2607 - protein, 9 aa, Homo sapiens
  light chain complementarity determining region 3 for antibody 1304
VQYTNYPRT

SEQ ID NO: 2608 - protein, 14 aa, Homo sapiens
  heavy chain complementarity determining region 3 for antibody 1304
ARPRSAKSTYYFDY

SEQ ID NO: 2609 - protein, 9 aa, Homo sapiens
  light chain complementarity determining region 3 for antibody 1305
TQTTHWPWT

SEQ ID NO: 2610 - protein, 11 aa, Homo sapiens
  heavy chain complementarity determining region 3 for antibody 1305
TRDLRGSAGAY

SEQ ID NO: 2611 - protein, 9 aa, Homo sapiens
  light chain complementarity determining region 3 for antibody 1306
QQYYNAPLT

SEQ ID NO: 2612 - protein, 13 aa, Homo sapiens
  heavy chain complementarity determining region 3 for antibody 1306
ARGHASGSFLIDY

SEQ ID NO: 2613 - protein, 7 aa, Homo sapiens
  light chain complementarity determining region 3 for antibody 1307
QQYNTWT

SEQ ID NO: 2614 - protein, 17 aa, Homo sapiens
  heavy chain complementarity determining region 3 for antibody 1307
ARNTMVHGWQRQGSVDH

SEQ ID NO: 2615 - protein, 7 aa, Homo sapiens
  light chain complementarity determining region 3 for antibody 1308
QQYNTWT

SEQ ID NO: 2616 - protein, 17 aa, Homo sapiens
  heavy chain complementarity determining region 3 for antibody 1308
ARNTMVGTWQRQGNLDH

SEQ ID NO: 2617 - protein, 8 aa, Homo sapiens
  light chain complementarity determining region 3 for antibody 1309
QQYNSYYT

SEQ ID NO: 2618 - protein, 10 aa, Homo sapiens
  heavy chain complementarity determining region 3 for antibody 1309
ARETSGSYDI

SEQ ID NO: 2619 - protein, 9 aa, Homo sapiens
  light chain complementarity determining region 3 for antibody 1310
QQYGSSPNT

SEQ ID NO: 2620 - protein, 17 aa, Homo sapiens
  heavy chain complementarity determining region 3 for antibody 1310
AKGRGSVAMALIYYLDL

SEQ ID NO: 2621 - protein, 10 aa, Homo sapiens
  light chain complementarity determining region 3 for antibody 1311
QQYGRSPPYT

SEQ ID NO: 2622 - protein, 9 aa, Homo sapiens
  heavy chain complementarity determining region 3 for antibody 1311
ARDSHSFSY

SEQ ID NO: 2623 - protein, 9 aa, Homo sapiens
  light chain complementarity determining region 3 for antibody 1312
QQYFSIPLT

SEQ ID NO: 2624 - protein, 17 aa, Homo sapiens
  heavy chain complementarity determining region 3 for antibody 1312
ARNTMVHGWQRQGSVDH

SEQ ID NO: 2625 - protein, 10 aa, Homo sapiens
  light chain complementarity determining region 3 for antibody 1313
QQYDNLASLT

SEQ ID NO: 2626 - protein, 13 aa, Homo sapiens
  heavy chain complementarity determining region 3 for antibody 1313
AKEGSAPGPDFEY

SEQ ID NO: 2627 - protein, 11 aa, Homo sapiens
  light chain complementarity determining region 3 for antibody 1314
QQYDGWPPFLT

SEQ ID NO: 2628 - protein, 15 aa, Homo sapiens
  heavy chain complementarity determining region 3 for antibody 1314
ATHGGPAAAGRVLDY

SEQ ID NO: 2629 - protein, 9 aa, Homo sapiens
  light chain complementarity determining region 3 for antibody 1315
QQYDDLPYT

SEQ ID NO: 2630 - protein, 12 aa, Homo sapiens
  heavy chain complementarity determining region 3 for antibody 1315
AIVVPGRWDLDD

SEQ ID NO: 2631 - protein, 9 aa, Homo sapiens
  light chain complementarity determining region 3 for antibody 1316
QQSYSTPLT

SEQ ID NO: 2632 - protein, 15 aa, Homo sapiens
  heavy chain complementarity determining region 3 for antibody 1316
ATHGGPAAAGRVLDY

SEQ ID NO: 2633 - protein, 9 aa, Homo sapiens
  light chain complementarity determining region 3 for antibody 1317
QQSYSTPLT

SEQ ID NO: 2634 - protein, 11 aa, Homo sapiens
  heavy chain complementarity determining region 3 for antibody 1317
ARGGALNWFDL

SEQ ID NO: 2635 - protein, 10 aa, Homo sapiens
  light chain complementarity determining region 3 for antibody 1318
QQSYSTPLFT

SEQ ID NO: 2636 - protein, 19 aa, Homo sapiens
  heavy chain complementarity determining region 3 for antibody 1318
ARWNGIRSQNNFWSGPFDH

SEQ ID NO: 2637 - protein, 8 aa, Homo sapiens
  light chain complementarity determining region 3 for antibody 1319
QQSYSTLT

SEQ ID NO: 2638 - protein, 9 aa, Homo sapiens
  heavy chain complementarity determining region 3 for antibody 1319
IRGSYYFEI

SEQ ID NO: 2639 - protein, 9 aa, Homo sapiens
  light chain complementarity determining region 3 for antibody 1320
QQSYGTPRT

SEQ ID NO: 2640 - protein, 20 aa, Homo sapiens
  heavy chain complementarity determining region 3 for antibody 1320
AREAKIAAAGSGYYYYGMDA

SEQ ID NO: 2641 - protein, 9 aa, Homo sapiens
  light chain complementarity determining region 3 for antibody 1321
QQSSSSPWT

SEQ ID NO: 2642 - protein, 13 aa, Homo sapiens
  heavy chain complementarity determining region 3 for antibody 1321
ARDNFGAGPPFDS

SEQ ID NO: 2643 - protein, 9 aa, Homo sapiens
  light chain complementarity determining region 3 for antibody 1322
QQSNSFPLT

SEQ ID NO: 2644 - protein, 17 aa, Homo sapiens
  heavy chain complementarity determining region 3 for antibody 1322
ARDPAPTMGSSWKYFDY

SEQ ID NO: 2645 - protein, 9 aa, Homo sapiens
  light chain complementarity determining region 3 for antibody 1323
QQLNSNPLT

SEQ ID NO: 2646 - protein, 13 aa, Homo sapiens
  heavy chain complementarity determining region 3 for antibody 1323
ASRRAPNSGYYVF

SEQ ID NO: 2647 - protein, 9 aa, Homo sapiens
  light chain complementarity determining region 3 for antibody 1324
QQDYYNPRT

SEQ ID NO: 2648 - protein, 11 aa, Homo sapiens
  heavy chain complementarity determining region 3 for antibody 1324
ARRSLGGAFDY

SEQ ID NO: 2649 - protein, 10 aa, Homo sapiens
  light chain complementarity determining region 3 for antibody 1325
QEGYNGPALT

SEQ ID NO: 2650 - protein, 14 aa, Homo sapiens
  heavy chain complementarity determining region 3 for antibody 1325
AKAGGKLLPRRVDY

SEQ ID NO: 2651 - protein, 9 aa, Homo sapiens
  light chain complementarity determining region 3 for antibody 1326
MQTLQTPWT

SEQ ID NO: 2652 - protein, 13 aa, Homo sapiens
  heavy chain complementarity determining region 3 for antibody 1326
AKEGSAPGPDFEY

SEQ ID NO: 2653 - protein, 9 aa, Homo sapiens
  light chain complementarity determining region 3 for antibody 1327
MQGTHWPWT

SEQ ID NO: 2654 - protein, 13 aa, Homo sapiens
  heavy chain complementarity determining region 3 for antibody 1327
TKEGSSAGPDFVY

SEQ ID NO: 2655 - protein, 9 aa, Homo sapiens
  light chain complementarity determining region 3 for antibody 1328
MQASHWPWT

SEQ ID NO: 2656 - protein, 10 aa, Homo sapiens
  heavy chain complementarity determining region 3 for antibody 1328
ARDVRWSYAF

SEQ ID NO: 2657 - protein, 9 aa, Homo sapiens
  light chain complementarity determining region 3 for antibody 1329
MQALRTPRT

SEQ ID NO: 2658 - protein, 17 aa, Homo sapiens
  heavy chain complementarity determining region 3 for antibody 1329
ARRINADPGPVDYGMDV

SEQ ID NO: 2659 - protein, 9 aa, Homo sapiens
  light chain complementarity determining region 3 for antibody 1330
LQHNSYPLT

SEQ ID NO: 2660 - protein, 11 aa, Homo sapiens
  heavy chain complementarity determining region 3 for antibody 1330
VRVSTVWNFDY

SEQ ID NO: 2661 - protein, 10 aa, Homo sapiens
  light chain complementarity determining region 3 for antibody 1331
LQGSHWPPFT

SEQ ID NO: 2662 - protein, 9 aa, Homo sapiens
  heavy chain complementarity determining region 3 for antibody 1331
VRNNYYMDV

SEQ ID NO: 2663 - protein, 9 aa, Homo sapiens
  light chain complementarity determining region 3 for antibody 1332
LQDYYTPRT

SEQ ID NO: 2664 - protein, 11 aa, Homo sapiens
  heavy chain complementarity determining region 3 for antibody 1332
TRRSLGGAFDY

SEQ ID NO: 2665 - protein, 9 aa, Homo sapiens
  light chain complementarity determining region 3 for antibody 1333
HQYARSPRT

SEQ ID NO: 2666 - protein, 13 aa, Homo sapiens
  heavy chain complementarity determining region 3 for antibody 1333
VRGVSGESWLIDY

SEQ ID NO: 2667 - protein, 9 aa, Homo sapiens
  light chain complementarity determining region 3 for antibody 1334
QRYNTVPWA

SEQ ID NO: 2668 - protein, 20 aa, Homo sapiens
  heavy chain complementarity determining region 3 for antibody 1334
TRDQRSIHLWSLAEGGGMDV

SEQ ID NO: 2669 - protein, 9 aa, Homo sapiens
  light chain complementarity determining region 3 for antibody 1335
QQYYSYPFT

SEQ ID NO: 2670 - protein, 13 aa, Homo sapiens
  heavy chain complementarity determining region 3 for antibody 1335
ARGATTAGWTLDY

SEQ ID NO: 2671 - protein, 9 aa, Homo sapiens
  light chain complementarity determining region 3 for antibody 1336
QQYYSTLYT

SEQ ID NO: 2672 - protein, 15 aa, Homo sapiens
  heavy chain complementarity determining region 3 for antibody 1336
VKNSGWSGLRDSFGP

SEQ ID NO: 2673 - protein, 8 aa, Homo sapiens
  light chain complementarity determining region 3 for antibody 1337
QQYYSPLT

SEQ ID NO: 2674 - protein, 21 aa, Homo sapiens
  heavy chain complementarity determining region 3 for antibody 1337
ARGRRTDCNDGDTGCRPMFDY

SEQ ID NO: 2675 - protein, 9 aa, Homo sapiens
  light chain complementarity determining region 3 for antibody 1338
QQYYSAPIT

SEQ ID NO: 2676 - protein, 14 aa, Homo sapiens
  heavy chain complementarity determining region 3 for antibody 1338
ARGESSSCDFIFDF

SEQ ID NO: 2677 - protein, 9 aa, Homo sapiens
  light chain complementarity determining region 3 for antibody 1339
QQYYGSPLT

SEQ ID NO: 2678 - protein, 15 aa, Homo sapiens
  heavy chain complementarity determining region 3 for antibody 1339
ATSIKYGDNSFLCDS

SEQ ID NO: 2679 - protein, 10 aa, Homo sapiens
  light chain complementarity determining region 3 for antibody 1340
QQYYDISMYT

SEQ ID NO: 2680 - protein, 16 aa, Homo sapiens
  heavy chain complementarity determining region 3 for antibody 1340
AHRAVVTSNLNCRFDF

SEQ ID NO: 2681 - protein, 10 aa, Homo sapiens
  light chain complementarity determining region 3 for antibody 1341
QQYNSYSPRP

SEQ ID NO: 2682 - protein, 9 aa, Homo sapiens
  heavy chain complementarity determining region 3 for antibody 1341
ARGRSNFRF

SEQ ID NO: 2683 - protein, 9 aa, Homo sapiens
  light chain complementarity determining region 3 for antibody 1342
QQYNNWPRT

SEQ ID NO: 2684 - protein, 14 aa, Homo sapiens
  heavy chain complementarity determining region 3 for antibody 1342
ATAPGFWSIAPFDY

SEQ ID NO: 2685 - protein, 9 aa, Homo sapiens
  light chain complementarity determining region 3 for antibody 1343
QQYLTYPLT

SEQ ID NO: 2686 - protein, 12 aa, Homo sapiens
  heavy chain complementarity determining region 3 for antibody 1343
NADHGEVDGFDL

SEQ ID NO: 2687 - protein, 9 aa, Homo sapiens
  light chain complementarity determining region 3 for antibody 1344
QQYKTAPWT

SEQ ID NO: 2688 - protein, 20 aa, Homo sapiens
  heavy chain complementarity determining region 3 for antibody 1344
TRDARGSISYAYGGGGGLGV

SEQ ID NO: 2689 - protein, 9 aa, Homo sapiens
  light chain complementarity determining region 3 for antibody 1345
QQYGNSPKT

SEQ ID NO: 2690 - protein, 25 aa, Homo sapiens
  heavy chain complementarity determining region 3 for antibody 1345
ARGTARSGAITLVVGVSRRAYYFDS

SEQ ID NO: 2691 - protein, 10 aa, Homo sapiens
  light chain complementarity determining region 3 for antibody 1346
QQYGGSLPYT

SEQ ID NO: 2692 - protein, 11 aa, Homo sapiens
  heavy chain complementarity determining region 3 for antibody 1346
TAIGSSGEFRY

SEQ ID NO: 2693 - protein, 10 aa, Homo sapiens
  light chain complementarity determining region 3 for antibody 1347
QQSHTTPALT

SEQ ID NO: 2694 - protein, 17 aa, Homo sapiens
  heavy chain complementarity determining region 3 for antibody 1347
ARDGRIIWPGSQGSLDS

SEQ ID NO: 2695 - protein, 9 aa, Homo sapiens
  light chain complementarity determining region 3 for antibody 1348
QQRSNWPPL

SEQ ID NO: 2696 - protein, 18 aa, Homo sapiens
  heavy chain complementarity determining region 3 for antibody 1348
ARGSGDYYDSSAYGWFDP

SEQ ID NO: 2697 - protein, 10 aa, Homo sapiens
  light chain complementarity determining region 3 for antibody 1349
QQDYSSPPWA

SEQ ID NO: 2698 - protein, 16 aa, Homo sapiens
  heavy chain complementarity determining region 3 for antibody 1349
ASLNRGDKEFGVPPAL

SEQ ID NO: 2699 - protein, 9 aa, Homo sapiens
  light chain complementarity determining region 3 for antibody 1350
QQDGGSLLT

SEQ ID NO: 2700 - protein, 10 aa, Homo sapiens
  heavy chain complementarity determining region 3 for antibody 1350
CRDRWGFGDV

SEQ ID NO: 2701 - protein, 9 aa, Homo sapiens
  light chain complementarity determining region 3 for antibody 1351
QKYYSVPLT

SEQ ID NO: 2702 - protein, 17 aa, Homo sapiens
  heavy chain complementarity determining region 3 for antibody 1351
ARQGRHCDTGSCHPPEY

SEQ ID NO: 2703 - protein, 9 aa, Homo sapiens
  light chain complementarity determining region 3 for antibody 1352
QKYNTAPFT

SEQ ID NO: 2704 - protein, 17 aa, Homo sapiens
  heavy chain complementarity determining region 3 for antibody 1352
ARNTMVGTWQRQGNLDH

SEQ ID NO: 2705 - protein, 9 aa, Homo sapiens
  light chain complementarity determining region 3 for antibody 1353
QEAKSFPRT

SEQ ID NO: 2706 - protein, 15 aa, Homo sapiens
  heavy chain complementarity determining region 3 for antibody 1353
AREVGSVTTSWHFDL

SEQ ID NO: 2707 - protein, 9 aa, Homo sapiens
  light chain complementarity determining region 3 for antibody 1354
MQGTHWPLT

SEQ ID NO: 2708 - protein, 7 aa, Homo sapiens
  heavy chain complementarity determining region 3 for antibody 1354
ASERWND

SEQ ID NO: 2709 - protein, 9 aa, Homo sapiens
  light chain complementarity determining region 3 for antibody 1355
MQGIHWPWT

SEQ ID NO: 2710 - protein, 13 aa, Homo sapiens
  heavy chain complementarity determining region 3 for antibody 1355
TKEGSSAGPDFVY

SEQ ID NO: 2711 - protein, 9 aa, Homo sapiens
  light chain complementarity determining region 3 for antibody 1356
MQFLQTPLT

SEQ ID NO: 2712 - protein, 10 aa, Homo sapiens
  heavy chain complementarity determining region 3 for antibody 1356
ARERSGPYDI

SEQ ID NO: 2713 - protein, 9 aa, Homo sapiens
  light chain complementarity determining region 3 for antibody 1357
MQAVETPFA

SEQ ID NO: 2714 - protein, 9 aa, Homo sapiens
  heavy chain complementarity determining region 3 for antibody 1357
ASDLWGPAY

SEQ ID NO: 2715 - protein, 9 aa, Homo sapiens
  light chain complementarity determining region 3 for antibody 1358
LQTLHWPWT

SEQ ID NO: 2716 - protein, 10 aa, Homo sapiens
  heavy chain complementarity determining region 3 for antibody 1358
VRLPSRACDF

SEQ ID NO: 2717 - protein, 9 aa, Homo sapiens
  light chain complementarity determining region 3 for antibody 1359
LQHYTAPWT

SEQ ID NO: 2718 - protein, 17 aa, Homo sapiens
  heavy chain complementarity determining region 3 for antibody 1359
ARDGRITWPGSQGSLDS

SEQ ID NO: 2719 - protein, 9 aa, Homo sapiens
  light chain complementarity determining region 3 for antibody 1360
LQFYRYPLT

SEQ ID NO: 2720 - protein, 16 aa, Homo sapiens
  heavy chain complementarity determining region 3 for antibody 1360
TRGNPPSCRGGTCFDS

SEQ ID NO: 2721 - protein, 9 aa, Homo sapiens
  light chain complementarity determining region 3 for antibody 1361
LQDHNYPFT

SEQ ID NO: 2722 - protein, 16 aa, Homo sapiens
  heavy chain complementarity determining region 3 for antibody 1361
AADLGDHADVYATLDS

SEQ ID NO: 2723 - protein, 9 aa, Homo sapiens
  light chain complementarity determining region 3 for antibody 1362
HHFGSATGT

SEQ ID NO: 2724 - protein, 10 aa, Homo sapiens
  heavy chain complementarity determining region 3 for antibody 1362
AHRINRAFDI

SEQ ID NO: 2725 - protein, 9 aa, Homo sapiens
  light chain complementarity determining region 3 for antibody 1363
AQGSYWPAS

SEQ ID NO: 2726 - protein, 19 aa, Homo sapiens
  heavy chain complementarity determining region 3 for antibody 1363
VKRLPMTSTIKLVTYAMDV

SEQ ID NO: 2727 - protein, 9 aa, Homo sapiens
  light chain complementarity determining region 3 for antibody 1364
QQYYSFPPT

SEQ ID NO: 2728 - protein, 16 aa, Homo sapiens
  heavy chain complementarity determining region 3 for antibody 1364
AGILPPCGVMCLPFDY

SEQ ID NO: 2729 - protein, 9 aa, Homo sapiens
  light chain complementarity determining region 3 for antibody 1365
QQYRHAPWT

SEQ ID NO: 2730 - protein, 20 aa, Homo sapiens
  heavy chain complementarity determining region 3 for antibody 1365
AKDGRGTTNYHGGGGGGLDV

SEQ ID NO: 2731 - protein, 9 aa, Homo sapiens
  light chain complementarity determining region 3 for antibody 1366
QQYNNWPAT

SEQ ID NO: 2732 - protein, 18 aa, Homo sapiens
  heavy chain complementarity determining region 3 for antibody 1366
ARGFCGGDCSVGGRTSDY

SEQ ID NO: 2733 - protein, 10 aa, Homo sapiens
  light chain complementarity determining region 3 for antibody 1367
QQYKNWPPYT

SEQ ID NO: 2734 - protein, 14 aa, Homo sapiens
  heavy chain complementarity determining region 3 for antibody 1367
VRENCYGTGSCFDS

SEQ ID NO: 2735 - protein, 8 aa, Homo sapiens
  light chain complementarity determining region 3 for antibody 1368
QQYGSSIT

SEQ ID NO: 2736 - protein, 17 aa, Homo sapiens
  heavy chain complementarity determining region 3 for antibody 1368
AKDIGVKRYYYYYYQDV

SEQ ID NO: 2737 - protein, 10 aa, Homo sapiens
  light chain complementarity determining region 3 for antibody 1369
QQYGNSPSVT

SEQ ID NO: 2738 - protein, 22 aa, Homo sapiens
  heavy chain complementarity determining region 3 for antibody 1369
ARDKLWSDYVWGNYRPSDAFDF

SEQ ID NO: 2739 - protein, 9 aa, Homo sapiens
  light chain complementarity determining region 3 for antibody 1370
QQYGALPLT

SEQ ID NO: 2740 - protein, 13 aa, Homo sapiens
  heavy chain complementarity determining region 3 for antibody 1370
AKDRGGGWYAWGY

SEQ ID NO: 2741 - protein, 9 aa, Homo sapiens
  light chain complementarity determining region 3 for antibody 1371
QQSYTTPRT

SEQ ID NO: 2742 - protein, 11 aa, Homo sapiens
  heavy chain complementarity determining region 3 for antibody 1371
ATGKDNAKTGY

SEQ ID NO: 2743 - protein, 8 aa, Homo sapiens
  light chain complementarity determining region 3 for antibody 1372
QQSYSTRT

SEQ ID NO: 2744 - protein, 17 aa, Homo sapiens
  heavy chain complementarity determining region 3 for antibody 1372
ARDFKAGRAGGYYYMDV

SEQ ID NO: 2745 - protein, 9 aa, Homo sapiens
  light chain complementarity determining region 3 for antibody 1373
QQSYSTPWT

SEQ ID NO: 2746 - protein, 13 aa, Homo sapiens
  heavy chain complementarity determining region 3 for antibody 1373
ARGSGGSGSYLPD

SEQ ID NO: 2747 - protein, 8 aa, Homo sapiens
  light chain complementarity determining region 3 for antibody 1374
QQSYRTYT

SEQ ID NO: 2748 - protein, 15 aa, Homo sapiens
  heavy chain complementarity determining region 3 for antibody 1374
ATVTCTNGWYNAFDI

SEQ ID NO: 2749 - protein, 9 aa, Homo sapiens
  light chain complementarity determining region 3 for antibody 1375
QQSYNTPRT

SEQ ID NO: 2750 - protein, 20 aa, Homo sapiens
  heavy chain complementarity determining region 3 for antibody 1375
ARETSIAAAANGYYYYAMDV

SEQ ID NO: 2751 - protein, 8 aa, Homo sapiens
  light chain complementarity determining region 3 for antibody 1376
QQRGSGLT

SEQ ID NO: 2752 - protein, 14 aa, Homo sapiens
  heavy chain complementarity determining region 3 for antibody 1376
ARAVGRGPGAHFDY

SEQ ID NO: 2753 - protein, 10 aa, Homo sapiens
  light chain complementarity determining region 3 for antibody 1377
QQRFHWPPFT

SEQ ID NO: 2754 - protein, 14 aa, Homo sapiens
  heavy chain complementarity determining region 3 for antibody 1377
AKDLRWLQSGEFGS

SEQ ID NO: 2755 - protein, 9 aa, Homo sapiens
  light chain complementarity determining region 3 for antibody 1378
QQLYSYPRG

SEQ ID NO: 2756 - protein, 13 aa, Homo sapiens
  heavy chain complementarity determining region 3 for antibody 1378
ARHRTTGTTWFDP

SEQ ID NO: 2757 - protein, 9 aa, Homo sapiens
  light chain complementarity determining region 3 for antibody 1379
QQFSNLPRT

SEQ ID NO: 2758 - protein, 9 aa, Homo sapiens
  heavy chain complementarity determining region 3 for antibody 1379
ARGRNNFRY

SEQ ID NO: 2759 - protein, 9 aa, Homo sapiens
  light chain complementarity determining region 3 for antibody 1380
QQFDSFPRT

SEQ ID NO: 2760 - protein, 13 aa, Homo sapiens
  heavy chain complementarity determining region 3 for antibody 1380
AKEGSAPGPDFEY

SEQ ID NO: 2761 - protein, 9 aa, Homo sapiens
  light chain complementarity determining region 3 for antibody 1381
QHYYNAPLT

SEQ ID NO: 2762 - protein, 13 aa, Homo sapiens
  heavy chain complementarity determining region 3 for antibody 1381
ARGHASGSFLIDY

SEQ ID NO: 2763 - protein, 9 aa, Homo sapiens
  light chain complementarity determining region 3 for antibody 1382
QHYKNWPRT

SEQ ID NO: 2764 - protein, 15 aa, Homo sapiens
  heavy chain complementarity determining region 3 for antibody 1382
AREVFSGAYPDFFEY

SEQ ID NO: 2765 - protein, 9 aa, Homo sapiens
  light chain complementarity determining region 3 for antibody 1383
MQGTHCRGT

SEQ ID NO: 2766 - protein, 16 aa, Homo sapiens
  heavy chain complementarity determining region 3 for antibody 1383
VRDLAGFTRGGSTFDY

SEQ ID NO: 2767 - protein, 9 aa, Homo sapiens
  light chain complementarity determining region 3 for antibody 1384
MQGKHWPHT

SEQ ID NO: 2768 - protein, 11 aa, Homo sapiens
  heavy chain complementarity determining region 3 for antibody 1384
ATFGQQWRLAH

SEQ ID NO: 2769 - protein, 9 aa, Homo sapiens
  light chain complementarity determining region 3 for antibody 1385
MHTLQTPWT

SEQ ID NO: 2770 - protein, 12 aa, Homo sapiens
  heavy chain complementarity determining region 3 for antibody 1385
ARLDWNYRAFDI

SEQ ID NO: 2771 - protein, 9 aa, Homo sapiens
  light chain complementarity determining region 3 for antibody 1386
LQGTHWPRT

SEQ ID NO: 2772 - protein, 8 aa, Homo sapiens
  heavy chain complementarity determining region 3 for antibody 1386
GRDRWWSG

SEQ ID NO: 2773 - protein, 9 aa, Homo sapiens
  light chain complementarity determining region 3 for antibody 1387
LQDYKYPSS

SEQ ID NO: 2774 - protein, 16 aa, Homo sapiens
  heavy chain complementarity determining region 3 for antibody 1387
AADLGDHADAYATLDS

SEQ ID NO: 2775 - protein, 9 aa, Homo sapiens
  light chain complementarity determining region 3 for antibody 1388
LQDYIYPYT

SEQ ID NO: 2776 - protein, 16 aa, Homo sapiens
  heavy chain complementarity determining region 3 for antibody 1388
ARDRIAAGGRQVAFDI

SEQ ID NO: 2777 - protein, 9 aa, Homo sapiens
  light chain complementarity determining region 3 for antibody 1389
LQALQIPYT

SEQ ID NO: 2778 - protein, 13 aa, Homo sapiens
  heavy chain complementarity determining region 3 for antibody 1389
VHSGSYYNPRFEY

SEQ ID NO: 2779 - protein, 9 aa, Homo sapiens
  light chain complementarity determining region 3 for antibody 1390
HQTYRTPYT

SEQ ID NO: 2780 - protein, 14 aa, Homo sapiens
  heavy chain complementarity determining region 3 for antibody 1390
ARLHGSGLGRWLDP

SEQ ID NO: 2781 - protein, 8 aa, Homo sapiens
  light chain complementarity determining region 3 for antibody 1391
QRYGSSYT

SEQ ID NO: 2782 - protein, 18 aa, Homo sapiens
  heavy chain complementarity determining region 3 for antibody 1391
ARWAAGIRDVAFGGPYDY

SEQ ID NO: 2783 - protein, 9 aa, Homo sapiens
  light chain complementarity determining region 3 for antibody 1392
QQYYTTPYT

SEQ ID NO: 2784 - protein, 10 aa, Homo sapiens
  heavy chain complementarity determining region 3 for antibody 1392
TNSFNGYNVY

SEQ ID NO: 2785 - protein, 10 aa, Homo sapiens
  light chain complementarity determining region 3 for antibody 1393
QQYYTDPALT

SEQ ID NO: 2786 - protein, 13 aa, Homo sapiens
  heavy chain complementarity determining region 3 for antibody 1393
ARYGYGYARPFDF

SEQ ID NO: 2787 - protein, 8 aa, Homo sapiens
  light chain complementarity determining region 3 for antibody 1394
QQYYSYGT

SEQ ID NO: 2788 - protein, 20 aa, Homo sapiens
  heavy chain complementarity determining region 3 for antibody 1394
ASRFMRSGVVTLNMDDGFDT

SEQ ID NO: 2789 - protein, 9 aa, Homo sapiens
  light chain complementarity determining region 3 for antibody 1395
QQYYSTPWT

SEQ ID NO: 2790 - protein, 21 aa, Homo sapiens
  heavy chain complementarity determining region 3 for antibody 1395
GRLVLDPTSWNYGPSHNGMDV

SEQ ID NO: 2791 - protein, 9 aa, Homo sapiens
  light chain complementarity determining region 3 for antibody 1396
QQYYSTLYT

SEQ ID NO: 2792 - protein, 14 aa, Homo sapiens
  heavy chain complementarity determining region 3 for antibody 1396
ARPGRTGTTFAFDI

SEQ ID NO: 2793 - protein, 9 aa, Homo sapiens
  light chain complementarity determining region 3 for antibody 1397
QQYYNSPIT

SEQ ID NO: 2794 - protein, 20 aa, Homo sapiens
  heavy chain complementarity determining region 3 for antibody 1397
ARGCSYYYEDTIHVTNWFDP

SEQ ID NO: 2795 - protein, 8 aa, Homo sapiens
  light chain complementarity determining region 3 for antibody 1398
QQYTSFWT

SEQ ID NO: 2796 - protein, 15 aa, Homo sapiens
  heavy chain complementarity determining region 3 for antibody 1398
AKSQTQSSSIVCFDS

SEQ ID NO: 2797 - protein, 7 aa, Homo sapiens
  light chain complementarity determining region 3 for antibody 1399
QQYSTWT

SEQ ID NO: 2798 - protein, 12 aa, Homo sapiens
  heavy chain complementarity determining region 3 for antibody 1399
VKDRGGRSGMDL

SEQ ID NO: 2799 - protein, 8 aa, Homo sapiens
  light chain complementarity determining region 3 for antibody 1400
QQYRSLKT

SEQ ID NO: 2800 - protein, 15 aa, Homo sapiens
  heavy chain complementarity determining region 3 for antibody 1400
TTPSSVDAWYNAYDI

SEQ ID NO: 2801 - protein, 7 aa, Homo sapiens
  light chain complementarity determining region 3 for antibody 1401
QQYNTWT

SEQ ID NO: 2802 - protein, 12 aa, Homo sapiens
  heavy chain complementarity determining region 3 for antibody 1401
AREKGGRNGMDV

SEQ ID NO: 2803 - protein, 9 aa, Homo sapiens
  light chain complementarity determining region 3 for antibody 1402
QQYNSYPWT

SEQ ID NO: 2804 - protein, 5 aa, Homo sapiens
  heavy chain complementarity determining region 3 for antibody 1402
AKVGV

SEQ ID NO: 2805 - protein, 7 aa, Homo sapiens
  light chain complementarity determining region 3 for antibody 1403
QQYNNWT

SEQ ID NO: 2806 - protein, 12 aa, Homo sapiens
  heavy chain complementarity determining region 3 for antibody 1403
ARDKGGRNGMDV

SEQ ID NO: 2807 - protein, 9 aa, Homo sapiens
  light chain complementarity determining region 3 for antibody 1404
QQYHRYPPT

SEQ ID NO: 2808 - protein, 13 aa, Homo sapiens
  heavy chain complementarity determining region 3 for antibody 1404
AHPYSGNFYYFDY

SEQ ID NO: 2809 - protein, 9 aa, Homo sapiens
  light chain complementarity determining region 3 for antibody 1405
QQYGSSALT

SEQ ID NO: 2810 - protein, 13 aa, Homo sapiens
  heavy chain complementarity determining region 3 for antibody 1405
AKDRASGWYAWGY

SEQ ID NO: 2811 - protein, 8 aa, Homo sapiens
  light chain complementarity determining region 3 for antibody 1406
QQYDNLIT

SEQ ID NO: 2812 - protein, 18 aa, Homo sapiens
  heavy chain complementarity determining region 3 for antibody 1406
AKGTTAYCRGVRCYPFDY

SEQ ID NO: 2813 - protein, 9 aa, Homo sapiens
  light chain complementarity determining region 3 for antibody 1407
QQYARAPIT

SEQ ID NO: 2814 - protein, 13 aa, Homo sapiens
  heavy chain complementarity determining region 3 for antibody 1407
VKGTGSGSFRVDY

SEQ ID NO: 2815 - protein, 9 aa, Homo sapiens
  light chain complementarity determining region 3 for antibody 1408
QQSYSTPWT

SEQ ID NO: 2816 - protein, 10 aa, Homo sapiens
  heavy chain complementarity determining region 3 for antibody 1408
AREGYYGLDY

SEQ ID NO: 2817 - protein, 7 aa, Homo sapiens
  light chain complementarity determining region 3 for antibody 1409
QQSSSVT

SEQ ID NO: 2818 - protein, 18 aa, Homo sapiens
  heavy chain complementarity determining region 3 for antibody 1409
ARHGWFGELLYDHNWLDP

SEQ ID NO: 2819 - protein, 9 aa, Homo sapiens
  light chain complementarity determining region 3 for antibody 1410
QQSINWPRT

SEQ ID NO: 2820 - protein, 14 aa, Homo sapiens
  heavy chain complementarity determining region 3 for antibody 1410
ATSPGYYDSSPFDY

SEQ ID NO: 2821 - protein, 10 aa, Homo sapiens
  light chain complementarity determining region 3 for antibody 1411
QQRSNWPPIT

SEQ ID NO: 2822 - protein, 11 aa, Homo sapiens
  heavy chain complementarity determining region 3 for antibody 1411
TRGGYSVGYDY

SEQ ID NO: 2823 - protein, 8 aa, Homo sapiens
  light chain complementarity determining region 3 for antibody 1412
QQRSNGYT

SEQ ID NO: 2824 - protein, 14 aa, Homo sapiens
  heavy chain complementarity determining region 3 for antibody 1412
ARLLGSYYDEGFDY

SEQ ID NO: 2825 - protein, 9 aa, Homo sapiens
  light chain complementarity determining region 3 for antibody 1413
QQHYSIPPT

SEQ ID NO: 2826 - protein, 14 aa, Homo sapiens
  heavy chain complementarity determining region 3 for antibody 1413
AKGRGGSSYSSLDY

SEQ ID NO: 2827 - protein, 9 aa, Homo sapiens
  light chain complementarity determining region 3 for antibody 1414
QQHYLTPWT

SEQ ID NO: 2828 - protein, 12 aa, Homo sapiens
  heavy chain complementarity determining region 3 for antibody 1414
ARDVGWQLPLDS

SEQ ID NO: 2829 - protein, 9 aa, Homo sapiens
  light chain complementarity determining region 3 for antibody 1415
QQFNSYPYT

SEQ ID NO: 2830 - protein, 13 aa, Homo sapiens
  heavy chain complementarity determining region 3 for antibody 1415
AKEGSSPGPDFDY

SEQ ID NO: 2831 - protein, 9 aa, Homo sapiens
  light chain complementarity determining region 3 for antibody 1416
QKDGSSPVP

SEQ ID NO: 2832 - protein, 18 aa, Homo sapiens
  heavy chain complementarity determining region 3 for antibody 1416
ARGDYPEARTGYFLDFDY

SEQ ID NO: 2833 - protein, 9 aa, Homo sapiens
  light chain complementarity determining region 3 for antibody 1417
QHYRSSPLT

SEQ ID NO: 2834 - protein, 16 aa, Homo sapiens
  heavy chain complementarity determining region 3 for antibody 1417
ARLPHPAEGSSWPEDC

SEQ ID NO: 2835 - protein, 9 aa, Homo sapiens
  light chain complementarity determining region 3 for antibody 1418
QHYNNWPPT

SEQ ID NO: 2836 - protein, 17 aa, Homo sapiens
  heavy chain complementarity determining region 3 for antibody 1418
AKSHCIADGCYRGYFDY

SEQ ID NO: 2837 - protein, 9 aa, Homo sapiens
  light chain complementarity determining region 3 for antibody 1419
MQGTHWPIT

SEQ ID NO: 2838 - protein, 12 aa, Homo sapiens
  heavy chain complementarity determining region 3 for antibody 1419
AIVVPGRWDLDD

SEQ ID NO: 2839 - protein, 8 aa, Homo sapiens
  light chain complementarity determining region 3 for antibody 1420
MQALQTRT

SEQ ID NO: 2840 - protein, 17 aa, Homo sapiens
  heavy chain complementarity determining region 3 for antibody 1420
ARNTMVGGWQRQGNLDL

SEQ ID NO: 2841 - protein, 9 aa, Homo sapiens
  light chain complementarity determining region 3 for antibody 1421
MHAIQFPYT

SEQ ID NO: 2842 - protein, 11 aa, Homo sapiens
  heavy chain complementarity determining region 3 for antibody 1421
ATNHNGQGYEF

SEQ ID NO: 2843 - protein, 9 aa, Homo sapiens
  light chain complementarity determining region 3 for antibody 1422
LQHNSYPRT

SEQ ID NO: 2844 - protein, 13 aa, Homo sapiens
  heavy chain complementarity determining region 3 for antibody 1422
ANGGIMAAPSFDP

SEQ ID NO: 2845 - protein, 9 aa, Homo sapiens
  light chain complementarity determining region 3 for antibody 1423
LQHNSYPLT

SEQ ID NO: 2846 - protein, 11 aa, Homo sapiens
  heavy chain complementarity determining region 3 for antibody 1423
VRVSSGWNFDY

SEQ ID NO: 2847 - protein, 9 aa, Homo sapiens
  light chain complementarity determining region 3 for antibody 1424
LQHDNFPLT

SEQ ID NO: 2848 - protein, 17 aa, Homo sapiens
  heavy chain complementarity determining region 3 for antibody 1424
ARNTMVHGWQRQGSVDH

SEQ ID NO: 2849 - protein, 9 aa, Homo sapiens
  light chain complementarity determining region 3 for antibody 1425
LKYNIAPWT

SEQ ID NO: 2850 - protein, 17 aa, Homo sapiens
  heavy chain complementarity determining region 3 for antibody 1425
SRDGRMEWHGSQGSLDS

SEQ ID NO: 2851 - protein, 9 aa, Homo sapiens
  light chain complementarity determining region 3 for antibody 1426
LHTFNAPRT

SEQ ID NO: 2852 - protein, 15 aa, Homo sapiens
  heavy chain complementarity determining region 3 for antibody 1426
SRDYIEGSNLLRLDY

SEQ ID NO: 2853 - protein, 7 aa, Homo sapiens
  light chain complementarity determining region 3 for antibody 1427
HYRSNWG

SEQ ID NO: 2854 - protein, 20 aa, Homo sapiens
  heavy chain complementarity determining region 3 for antibody 1427
ATYLPGDCSCTGCYYWYFDF

SEQ ID NO: 2855 - protein, 9 aa, Homo sapiens
  light chain complementarity determining region 3 for antibody 1428
AQGSYWPSS

SEQ ID NO: 2856 - protein, 10 aa, Homo sapiens
  heavy chain complementarity determining region 3 for antibody 1428
CRDREGFGDV

SEQ ID NO: 2857 - protein, 9 aa, Homo sapiens
  light chain complementarity determining region 3 for antibody 1429
TQTTHWPWT

SEQ ID NO: 2858 - protein, 11 aa, Homo sapiens
  heavy chain complementarity determining region 3 for antibody 1429
TRDLLGSAGGY

SEQ ID NO: 2859 - protein, 9 aa, Homo sapiens
  light chain complementarity determining region 3 for antibody 1430
QTYNSPPFT

SEQ ID NO: 2860 - protein, 6 aa, Homo sapiens
  heavy chain complementarity determining region 3 for antibody 1430
ARGGYD

SEQ ID NO: 2861 - protein, 9 aa, Homo sapiens
  light chain complementarity determining region 3 for antibody 1431
QQYYSIPLT

SEQ ID NO: 2862 - protein, 9 aa, Homo sapiens
  heavy chain complementarity determining region 3 for antibody 1431
TTVTPPDPA

SEQ ID NO: 2863 - protein, 9 aa, Homo sapiens
  light chain complementarity determining region 3 for antibody 1432
QQYYNPPLT

SEQ ID NO: 2864 - protein, 16 aa, Homo sapiens
  heavy chain complementarity determining region 3 for antibody 1432
ARKRYYYENDKGWFDS

SEQ ID NO: 2865 - protein, 9 aa, Homo sapiens
  light chain complementarity determining region 3 for antibody 1433
QQYNSFPYT

SEQ ID NO: 2866 - protein, 15 aa, Homo sapiens
  heavy chain complementarity determining region 3 for antibody 1433
VRHGSVIAHKNYFDY

SEQ ID NO: 2867 - protein, 9 aa, Homo sapiens
  light chain complementarity determining region 3 for antibody 1434
QQYHTSPLS

SEQ ID NO: 2868 - protein, 15 aa, Homo sapiens
  heavy chain complementarity determining region 3 for antibody 1434
AKNYGNGYGFSFMEV

SEQ ID NO: 2869 - protein, 9 aa, Homo sapiens
  light chain complementarity determining region 3 for antibody 1435
QQYGSSQWT

SEQ ID NO: 2870 - protein, 16 aa, Homo sapiens
  heavy chain complementarity determining region 3 for antibody 1435
AGPNTLGHLVGVAFDY

SEQ ID NO: 2871 - protein, 9 aa, Homo sapiens
  light chain complementarity determining region 3 for antibody 1436
QQYGGSLLP

SEQ ID NO: 2872 - protein, 10 aa, Homo sapiens
  heavy chain complementarity determining region 3 for antibody 1436
CRDRWGFGDV

SEQ ID NO: 2873 - protein, 9 aa, Homo sapiens
  light chain complementarity determining region 3 for antibody 1437
QQYDNYSRT

SEQ ID NO: 2874 - protein, 15 aa, Homo sapiens
  heavy chain complementarity determining region 3 for antibody 1437
ATSILTTVTPSYFDY

SEQ ID NO: 2875 - protein, 10 aa, Homo sapiens
  light chain complementarity determining region 3 for antibody 1438
QQYDNLASLT

SEQ ID NO: 2876 - protein, 13 aa, Homo sapiens
  heavy chain complementarity determining region 3 for antibody 1438
AKEGSSPGPDFDY

SEQ ID NO: 2877 - protein, 9 aa, Homo sapiens
  light chain complementarity determining region 3 for antibody 1439
QQYAIAPLT

SEQ ID NO: 2878 - protein, 9 aa, Homo sapiens
  heavy chain complementarity determining region 3 for antibody 1439
VRADWLHDY

SEQ ID NO: 2879 - protein, 9 aa, Homo sapiens
  light chain complementarity determining region 3 for antibody 1440
QQTYSSPWT

SEQ ID NO: 2880 - protein, 15 aa, Homo sapiens
  heavy chain complementarity determining region 3 for antibody 1440
ARSWTSSTNCRYMDV

SEQ ID NO: 2881 - protein, 8 aa, Homo sapiens
  light chain complementarity determining region 3 for antibody 1441
QQSYSTPT

SEQ ID NO: 2882 - protein, 26 aa, Homo sapiens
  heavy chain complementarity determining region 3 for antibody 1441
ARDFPKGDSYISGWYESTGGSYYMDV

SEQ ID NO: 2883 - protein, 9 aa, Homo sapiens
  light chain complementarity determining region 3 for antibody 1442
QQSYSTPRT

SEQ ID NO: 2884 - protein, 10 aa, Homo sapiens
  heavy chain complementarity determining region 3 for antibody 1442
ARERSGSYDI

SEQ ID NO: 2885 - protein, 10 aa, Homo sapiens
  light chain complementarity determining region 3 for antibody 1443
QQSYSTPLFT

SEQ ID NO: 2886 - protein, 20 aa, Homo sapiens
  heavy chain complementarity determining region 3 for antibody 1443
ASRFMRSGVVTLNMDDGFDT

SEQ ID NO: 2887 - protein, 9 aa, Homo sapiens
  light chain complementarity determining region 3 for antibody 1444
QQRNNWPLT

SEQ ID NO: 2888 - protein, 10 aa, Homo sapiens
  heavy chain complementarity determining region 3 for antibody 1444
ARDPNRRFDY

SEQ ID NO: 2889 - protein, 9 aa, Homo sapiens
  light chain complementarity determining region 3 for antibody 1445
QQLNSYPLT

SEQ ID NO: 2890 - protein, 19 aa, Homo sapiens
  heavy chain complementarity determining region 3 for antibody 1445
AKGLYYYDSSGYKCEYLQH

SEQ ID NO: 2891 - protein, 9 aa, Homo sapiens
  light chain complementarity determining region 3 for antibody 1446
QQLNSHPYT

SEQ ID NO: 2892 - protein, 14 aa, Homo sapiens
  heavy chain complementarity determining region 3 for antibody 1446
TRGHFDSTGFRLDY

SEQ ID NO: 2893 - protein, 9 aa, Homo sapiens
  light chain complementarity determining region 3 for antibody 1447
QQHYSTPYT

SEQ ID NO: 2894 - protein, 18 aa, Homo sapiens
  heavy chain complementarity determining region 3 for antibody 1447
ARAADCIGGNCYQSHFDF

SEQ ID NO: 2895 - protein, 9 aa, Homo sapiens
  light chain complementarity determining region 3 for antibody 1448
QQGYSTPFT

SEQ ID NO: 2896 - protein, 16 aa, Homo sapiens
  heavy chain complementarity determining region 3 for antibody 1448
AYWAGVASSWSGPFDY

SEQ ID NO: 2897 - protein, 9 aa, Homo sapiens
  light chain complementarity determining region 3 for antibody 1449
QLSGSSLPT

SEQ ID NO: 2898 - protein, 12 aa, Homo sapiens
  heavy chain complementarity determining region 3 for antibody 1449
ALDEWHPSWYKY

SEQ ID NO: 2899 - protein, 9 aa, Homo sapiens
  light chain complementarity determining region 3 for antibody 1450
QKYNSAPWT

SEQ ID NO: 2900 - protein, 12 aa, Homo sapiens
  heavy chain complementarity determining region 3 for antibody 1450
ARELGTSFPFDY

SEQ ID NO: 2901 - protein, 9 aa, Homo sapiens
  light chain complementarity determining region 3 for antibody 1451
QKYKSAPFT

SEQ ID NO: 2902 - protein, 10 aa, Homo sapiens
  heavy chain complementarity determining region 3 for antibody 1451
VREGNWNLDY

SEQ ID NO: 2903 - protein, 9 aa, Homo sapiens
  light chain complementarity determining region 3 for antibody 1452
MQVTHWPRT

SEQ ID NO: 2904 - protein, 12 aa, Homo sapiens
  heavy chain complementarity determining region 3 for antibody 1452
AIVVPGRWDLDD

SEQ ID NO: 2905 - protein, 9 aa, Homo sapiens
  light chain complementarity determining region 3 for antibody 1453
MQTLRTPPT

SEQ ID NO: 2906 - protein, 14 aa, Homo sapiens
  heavy chain complementarity determining region 3 for antibody 1453
AKARYPNGWYVFDS

SEQ ID NO: 2907 - protein, 9 aa, Homo sapiens
  light chain complementarity determining region 3 for antibody 1454
MQTLHTPWT

SEQ ID NO: 2908 - protein, 12 aa, Homo sapiens
  heavy chain complementarity determining region 3 for antibody 1454
ARLDWNYRAFDI

SEQ ID NO: 2909 - protein, 9 aa, Homo sapiens
  light chain complementarity determining region 3 for antibody 1455
MQGTHWPYT

SEQ ID NO: 2910 - protein, 8 aa, Homo sapiens
  heavy chain complementarity determining region 3 for antibody 1455
ARGSREHF

SEQ ID NO: 2911 - protein, 9 aa, Homo sapiens
  light chain complementarity determining region 3 for antibody 1456
MQGLLTPPA

SEQ ID NO: 2912 - protein, 18 aa, Homo sapiens
  heavy chain complementarity determining region 3 for antibody 1456
ARTRVGLYSGGSPFMFDP

SEQ ID NO: 2913 - protein, 7 aa, Homo sapiens
  light chain complementarity determining region 3 for antibody 1457
MQGGHWT

SEQ ID NO: 2914 - protein, 17 aa, Homo sapiens
  heavy chain complementarity determining region 3 for antibody 1457
ARDLPPGVSKRRDAFDI

SEQ ID NO: 2915 - protein, 9 aa, Homo sapiens
  light chain complementarity determining region 3 for antibody 1458
MQGAHWPYT

SEQ ID NO: 2916 - protein, 8 aa, Homo sapiens
  heavy chain complementarity determining region 3 for antibody 1458
ARGVWFAG

SEQ ID NO: 2917 - protein, 9 aa, Homo sapiens
  light chain complementarity determining region 3 for antibody 1459
MQALQSPPT

SEQ ID NO: 2918 - protein, 10 aa, Homo sapiens
  heavy chain complementarity determining region 3 for antibody 1459
TRHYNWNFDY

SEQ ID NO: 2919 - protein, 10 aa, Homo sapiens
  light chain complementarity determining region 3 for antibody 1460
MHHRHWPPYT

SEQ ID NO: 2920 - protein, 13 aa, Homo sapiens
  heavy chain complementarity determining region 3 for antibody 1460
TTLSTTIVHGGDY

SEQ ID NO: 2921 - protein, 9 aa, Homo sapiens
  light chain complementarity determining region 3 for antibody 1461
LQHNSYPLT

SEQ ID NO: 2922 - protein, 11 aa, Homo sapiens
  heavy chain complementarity determining region 3 for antibody 1461
VRVGTGWNFDY

SEQ ID NO: 2923 - protein, 9 aa, Homo sapiens
  light chain complementarity determining region 3 for antibody 1462
LQHNSYPLT

SEQ ID NO: 2924 - protein, 11 aa, Homo sapiens
  heavy chain complementarity determining region 3 for antibody 1462
VGVSTGWNFDY

SEQ ID NO: 2925 - protein, 9 aa, Homo sapiens
  light chain complementarity determining region 3 for antibody 1463
LQFYTAPWT

SEQ ID NO: 2926 - protein, 17 aa, Homo sapiens
  heavy chain complementarity determining region 3 for antibody 1463
SRDGRIIWPGAQGSLDS

SEQ ID NO: 2927 - protein, 9 aa, Homo sapiens
  light chain complementarity determining region 3 for antibody 1464
LQDHNYPFS

SEQ ID NO: 2928 - protein, 16 aa, Homo sapiens
  heavy chain complementarity determining region 3 for antibody 1464
AADLGDHADAYATLDN

SEQ ID NO: 2929 - protein, 9 aa, Homo sapiens
  light chain complementarity determining region 3 for antibody 1465
LQDHKYPFT

SEQ ID NO: 2930 - protein, 16 aa, Homo sapiens
  heavy chain complementarity determining region 3 for antibody 1465
AADLGDHTDAYAPLDN

SEQ ID NO: 2931 - protein, 9 aa, Homo sapiens
  light chain complementarity determining region 3 for antibody 1466
AQGSFWPAS

SEQ ID NO: 2932 - protein, 10 aa, Homo sapiens
  heavy chain complementarity determining region 3 for antibody 1466
CRDRRGFGDV

SEQ ID NO: 2933 - protein, 10 aa, Homo sapiens
  light chain complementarity determining region 3 for antibody 1467
QQYYTTPRKT

SEQ ID NO: 2934 - protein, 12 aa, Homo sapiens
  heavy chain complementarity determining region 3 for antibody 1467
AKAQTYYYAFDV

SEQ ID NO: 2935 - protein, 9 aa, Homo sapiens
  light chain complementarity determining region 3 for antibody 1468
QQYYSAPIT

SEQ ID NO: 2936 - protein, 14 aa, Homo sapiens
  heavy chain complementarity determining region 3 for antibody 1468
VRGESPSCDFIFGY

SEQ ID NO: 2937 - protein, 9 aa, Homo sapiens
  light chain complementarity determining region 3 for antibody 1469
QQYNTYSWT

SEQ ID NO: 2938 - protein, 12 aa, Homo sapiens
  heavy chain complementarity determining region 3 for antibody 1469
ARSGWGLLSMIV

SEQ ID NO: 2939 - protein, 9 aa, Homo sapiens
  light chain complementarity determining region 3 for antibody 1470
QQYNNWPLT

SEQ ID NO: 2940 - protein, 15 aa, Homo sapiens
  heavy chain complementarity determining region 3 for antibody 1470
ARGPLNNWNPAPFDY

SEQ ID NO: 2941 - protein, 9 aa, Homo sapiens
  light chain complementarity determining region 3 for antibody 1471
QQYNNWPGG

SEQ ID NO: 2942 - protein, 10 aa, Homo sapiens
  heavy chain complementarity determining region 3 for antibody 1471
ARAGWHQVDY

SEQ ID NO: 2943 - protein, 9 aa, Homo sapiens
  light chain complementarity determining region 3 for antibody 1472
QQYNAYPWT

SEQ ID NO: 2944 - protein, 17 aa, Homo sapiens
  heavy chain complementarity determining region 3 for antibody 1472
AKVQDSSGYTYYYPMDV

SEQ ID NO: 2945 - protein, 9 aa, Homo sapiens
  light chain complementarity determining region 3 for antibody 1473
QQYHSTPPT

SEQ ID NO: 2946 - protein, 12 aa, Homo sapiens
  heavy chain complementarity determining region 3 for antibody 1473
ASESGGYDPFDH

SEQ ID NO: 2947 - protein, 9 aa, Homo sapiens
  light chain complementarity determining region 3 for antibody 1474
QQYHRYPIT

SEQ ID NO: 2948 - protein, 13 aa, Homo sapiens
  heavy chain complementarity determining region 3 for antibody 1474
ARPYSGNYYWFDY

SEQ ID NO: 2949 - protein, 10 aa, Homo sapiens
  light chain complementarity determining region 3 for antibody 1475
QQYGSSPYST

SEQ ID NO: 2950 - protein, 17 aa, Homo sapiens
  heavy chain complementarity determining region 3 for antibody 1475
AKSLGSCRSSTCEIFDS

SEQ ID NO: 2951 - protein, 9 aa, Homo sapiens
  light chain complementarity determining region 3 for antibody 1476
QQYGSSPWT

SEQ ID NO: 2952 - protein, 14 aa, Homo sapiens
  heavy chain complementarity determining region 3 for antibody 1476
ANYRASIGANCFDP

SEQ ID NO: 2953 - protein, 9 aa, Homo sapiens
  light chain complementarity determining region 3 for antibody 1477
QQYGSSPRT

SEQ ID NO: 2954 - protein, 16 aa, Homo sapiens
  heavy chain complementarity determining region 3 for antibody 1477
AKERGYSSGWYGELDY

SEQ ID NO: 2955 - protein, 10 aa, Homo sapiens
  light chain complementarity determining region 3 for antibody 1478
QQYGSSPLFT

SEQ ID NO: 2956 - protein, 11 aa, Homo sapiens
  heavy chain complementarity determining region 3 for antibody 1478
ARAGSSSSFDP

SEQ ID NO: 2957 - protein, 11 aa, Homo sapiens
  light chain complementarity determining region 3 for antibody 1479
QQYGSSPGVYT

SEQ ID NO: 2958 - protein, 10 aa, Homo sapiens
  heavy chain complementarity determining region 3 for antibody 1479
AHRINRAFDI

SEQ ID NO: 2959 - protein, 9 aa, Homo sapiens
  light chain complementarity determining region 3 for antibody 1480
QQYGNLPPT

SEQ ID NO: 2960 - protein, 9 aa, Homo sapiens
  heavy chain complementarity determining region 3 for antibody 1480
ARGNGFNLF

SEQ ID NO: 2961 - protein, 9 aa, Homo sapiens
  light chain complementarity determining region 3 for antibody 1481
QQYGISTRT

SEQ ID NO: 2962 - protein, 10 aa, Homo sapiens
  heavy chain complementarity determining region 3 for antibody 1481
VKDGGGYYDY

SEQ ID NO: 2963 - protein, 10 aa, Homo sapiens
  light chain complementarity determining region 3 for antibody 1482
QQYGGSSLLT

SEQ ID NO: 2964 - protein, 18 aa, Homo sapiens
  heavy chain complementarity determining region 3 for antibody 1482
AKDHRWGCSATNCYLFDY

SEQ ID NO: 2965 - protein, 9 aa, Homo sapiens
  light chain complementarity determining region 3 for antibody 1483
QQYFGWPLT

SEQ ID NO: 2966 - protein, 14 aa, Homo sapiens
  heavy chain complementarity determining region 3 for antibody 1483
TRGSGTYYAGSSDY

SEQ ID NO: 2967 - protein, 9 aa, Homo sapiens
  light chain complementarity determining region 3 for antibody 1484
QQYDNLPPA

SEQ ID NO: 2968 - protein, 13 aa, Homo sapiens
  heavy chain complementarity determining region 3 for antibody 1484
AKEGSSAGPDFVY

SEQ ID NO: 2969 - protein, 9 aa, Homo sapiens
  light chain complementarity determining region 3 for antibody 1485
QQSYTTPVT

SEQ ID NO: 2970 - protein, 11 aa, Homo sapiens
  heavy chain complementarity determining region 3 for antibody 1485
VRGLSLRFFEW

SEQ ID NO: 2971 - protein, 9 aa, Homo sapiens
  light chain complementarity determining region 3 for antibody 1486
QQSYTTPRT

SEQ ID NO: 2972 - protein, 15 aa, Homo sapiens
  heavy chain complementarity determining region 3 for antibody 1486
AKPRSNMFAHDAFDI

SEQ ID NO: 2973 - protein, 10 aa, Homo sapiens
  light chain complementarity determining region 3 for antibody 1487
QQSYSTPPYT

SEQ ID NO: 2974 - protein, 10 aa, Homo sapiens
  heavy chain complementarity determining region 3 for antibody 1487
AHRINRAFDI

SEQ ID NO: 2975 - protein, 9 aa, Homo sapiens
  light chain complementarity determining region 3 for antibody 1488
QQSYSTLWT

SEQ ID NO: 2976 - protein, 12 aa, Homo sapiens
  heavy chain complementarity determining region 3 for antibody 1488
AGSRSGGGSIDY

SEQ ID NO: 2977 - protein, 8 aa, Homo sapiens
  light chain complementarity determining region 3 for antibody 1489
QQSYSSPT

SEQ ID NO: 2978 - protein, 12 aa, Homo sapiens
  heavy chain complementarity determining region 3 for antibody 1489
ARWRWQQSEFDY

SEQ ID NO: 2979 - protein, 10 aa, Homo sapiens
  light chain complementarity determining region 3 for antibody 1490
QQSYSSLTWT

SEQ ID NO: 2980 - protein, 11 aa, Homo sapiens
  heavy chain complementarity determining region 3 for antibody 1490
AGSSGHYAIDD

SEQ ID NO: 2981 - protein, 9 aa, Homo sapiens
  light chain complementarity determining region 3 for antibody 1491
QQSLSAPPT

SEQ ID NO: 2982 - protein, 13 aa, Homo sapiens
  heavy chain complementarity determining region 3 for antibody 1491
TRYGAAANTNRDY

SEQ ID NO: 2983 - protein, 8 aa, Homo sapiens
  light chain complementarity determining region 3 for antibody 1492
QQSIGTPT

SEQ ID NO: 2984 - protein, 12 aa, Homo sapiens
  heavy chain complementarity determining region 3 for antibody 1492
NRWLGAQSEFDY

SEQ ID NO: 2985 - protein, 9 aa, Homo sapiens
  light chain complementarity determining region 3 for antibody 1493
QQLNSYPYT

SEQ ID NO: 2986 - protein, 14 aa, Homo sapiens
  heavy chain complementarity determining region 3 for antibody 1493
ARGHVDSTGFRLDY

SEQ ID NO: 2987 - protein, 9 aa, Homo sapiens
  light chain complementarity determining region 3 for antibody 1494
QKYNSAPVA

SEQ ID NO: 2988 - protein, 15 aa, Homo sapiens
  heavy chain complementarity determining region 3 for antibody 1494
ARDVGDLRNYWYFDL

SEQ ID NO: 2989 - protein, 9 aa, Homo sapiens
  light chain complementarity determining region 3 for antibody 1495
QHYTGYPIT

SEQ ID NO: 2990 - protein, 8 aa, Homo sapiens
  heavy chain complementarity determining region 3 for antibody 1495
TGGRYWDV

SEQ ID NO: 2991 - protein, 8 aa, Homo sapiens
  light chain complementarity determining region 3 for antibody 1496
QHYKGFPA

SEQ ID NO: 2992 - protein, 15 aa, Homo sapiens
  heavy chain complementarity determining region 3 for antibody 1496
GRHVFSGSQPDYIDY

SEQ ID NO: 2993 - protein, 9 aa, Homo sapiens
  light chain complementarity determining region 3 for antibody 1497
QHFHSLPRT

SEQ ID NO: 2994 - protein, 10 aa, Homo sapiens
  heavy chain complementarity determining region 3 for antibody 1497
AREFSGSYDY

SEQ ID NO: 2995 - protein, 9 aa, Homo sapiens
  light chain complementarity determining region 3 for antibody 1498
QEYDNLPPT

SEQ ID NO: 2996 - protein, 14 aa, Homo sapiens
  heavy chain complementarity determining region 3 for antibody 1498
ARHGNHYGGKSADY

SEQ ID NO: 2997 - protein, 9 aa, Homo sapiens
  light chain complementarity determining region 3 for antibody 1499
MQSLQAPPT

SEQ ID NO: 2998 - protein, 10 aa, Homo sapiens
  heavy chain complementarity determining region 3 for antibody 1499
ARHYNWHFDY

SEQ ID NO: 2999 - protein, 9 aa, Homo sapiens
  light chain complementarity determining region 3 for antibody 1500
MQGTHWPNT

SEQ ID NO: 3000 - protein, 11 aa, Homo sapiens
  heavy chain complementarity determining region 3 for antibody 1500
ATFGQQWRLAH

SEQ ID NO: 3001 - protein, 9 aa, Homo sapiens
  light chain complementarity determining region 3 for antibody 1501
LQYKTYPRT

SEQ ID NO: 3002 - protein, 12 aa, Homo sapiens
  heavy chain complementarity determining region 3 for antibody 1501
VRDPAGRDTFDL

SEQ ID NO: 3003 - protein, 9 aa, Homo sapiens
  light chain complementarity determining region 3 for antibody 1502
LQHSSDPRT

SEQ ID NO: 3004 - protein, 14 aa, Homo sapiens
  heavy chain complementarity determining region 3 for antibody 1502
ARDPSYGVTGAFDA

SEQ ID NO: 3005 - protein, 9 aa, Homo sapiens
  light chain complementarity determining region 3 for antibody 1503
LQDYNYSYT

SEQ ID NO: 3006 - protein, 23 aa, Homo sapiens
  heavy chain complementarity determining region 3 for antibody 1503
AHSFNYDLLSGEYVSPARYYFDY

SEQ ID NO: 3007 - protein, 9 aa, Homo sapiens
  light chain complementarity determining region 3 for antibody 1504
HQYANTPWT

SEQ ID NO: 3008 - protein, 11 aa, Homo sapiens
  heavy chain complementarity determining region 3 for antibody 1504
ARGRDQSKLGY

SEQ ID NO: 3009 - protein, 9 aa, Homo sapiens
  light chain complementarity determining region 3 for antibody 1505
QQYYSFPPT

SEQ ID NO: 3010 - protein, 13 aa, Homo sapiens
  heavy chain complementarity determining region 3 for antibody 1505
TTGAADSGSVFDN

SEQ ID NO: 3011 - protein, 9 aa, Homo sapiens
  light chain complementarity determining region 3 for antibody 1506
QQYYSAPIT

SEQ ID NO: 3012 - protein, 14 aa, Homo sapiens
  heavy chain complementarity determining region 3 for antibody 1506
AKGESTSCDFIIDY

SEQ ID NO: 3013 - protein, 9 aa, Homo sapiens
  light chain complementarity determining region 3 for antibody 1507
QQYYNAPIT

SEQ ID NO: 3014 - protein, 14 aa, Homo sapiens
  heavy chain complementarity determining region 3 for antibody 1507
ARGESSSCDFIFDF

SEQ ID NO: 3015 - protein, 9 aa, Homo sapiens
  light chain complementarity determining region 3 for antibody 1508
QQYSSYPWT

SEQ ID NO: 3016 - protein, 15 aa, Homo sapiens
  heavy chain complementarity determining region 3 for antibody 1508
GKEGPGSSGWLTGHY

SEQ ID NO: 3017 - protein, 7 aa, Homo sapiens
  light chain complementarity determining region 3 for antibody 1509
QQYNTWT

SEQ ID NO: 3018 - protein, 12 aa, Homo sapiens
  heavy chain complementarity determining region 3 for antibody 1509
ARDKGGRSGMDV

SEQ ID NO: 3019 - protein, 7 aa, Homo sapiens
  light chain complementarity determining region 3 for antibody 1510
QQYNTLT

SEQ ID NO: 3020 - protein, 12 aa, Homo sapiens
  heavy chain complementarity determining region 3 for antibody 1510
ARDKGGRNGMDV

SEQ ID NO: 3021 - protein, 9 aa, Homo sapiens
  light chain complementarity determining region 3 for antibody 1511
QQYNSYPWT

SEQ ID NO: 3022 - protein, 14 aa, Homo sapiens
  heavy chain complementarity determining region 3 for antibody 1511
VREEGSGWYRTADY

SEQ ID NO: 3023 - protein, 9 aa, Homo sapiens
  light chain complementarity determining region 3 for antibody 1512
QQYNSYPRT

SEQ ID NO: 3024 - protein, 15 aa, Homo sapiens
  heavy chain complementarity determining region 3 for antibody 1512
VRSGGSSGWYGDFDY

SEQ ID NO: 3025 - protein, 9 aa, Homo sapiens
  light chain complementarity determining region 3 for antibody 1513
QQYNNWPRT

SEQ ID NO: 3026 - protein, 10 aa, Homo sapiens
  heavy chain complementarity determining region 3 for antibody 1513
ARDYYARVDY

SEQ ID NO: 3027 - protein, 9 aa, Homo sapiens
  light chain complementarity determining region 3 for antibody 1514
QQYNFYPWT

SEQ ID NO: 3028 - protein, 15 aa, Homo sapiens
  heavy chain complementarity determining region 3 for antibody 1514
ARIRGEQQTGGPFDY

SEQ ID NO: 3029 - protein, 9 aa, Homo sapiens
  light chain complementarity determining region 3 for antibody 1515
QQYGSSPWT

SEQ ID NO: 3030 - protein, 10 aa, Homo sapiens
  heavy chain complementarity determining region 3 for antibody 1515
LISPYYGLDV

SEQ ID NO: 3031 - protein, 9 aa, Homo sapiens
  light chain complementarity determining region 3 for antibody 1516
QQYGNSPFT

SEQ ID NO: 3032 - protein, 13 aa, Homo sapiens
  heavy chain complementarity determining region 3 for antibody 1516
GRGMYDRSGSIGY

SEQ ID NO: 3033 - protein, 9 aa, Homo sapiens
  light chain complementarity determining region 3 for antibody 1517
QQYASWPIT

SEQ ID NO: 3034 - protein, 15 aa, Homo sapiens
  heavy chain complementarity determining region 3 for antibody 1517
AKDVFGSGWYNYFDP

SEQ ID NO: 3035 - protein, 9 aa, Homo sapiens
  light chain complementarity determining region 3 for antibody 1518
QQTYSSPWT

SEQ ID NO: 3036 - protein, 15 aa, Homo sapiens
  heavy chain complementarity determining region 3 for antibody 1518
ARIWTSSTSCRYMDV

SEQ ID NO: 3037 - protein, 9 aa, Homo sapiens
  light chain complementarity determining region 3 for antibody 1519
QQTYSSPWT

SEQ ID NO: 3038 - protein, 15 aa, Homo sapiens
  heavy chain complementarity determining region 3 for antibody 1519
ARIWTSGTNCRYMDV

SEQ ID NO: 3039 - protein, 9 aa, Homo sapiens
  light chain complementarity determining region 3 for antibody 1520
QQTNNIPWT

SEQ ID NO: 3040 - protein, 12 aa, Homo sapiens
  heavy chain complementarity determining region 3 for antibody 1520
ARLTWRPKGMDV

SEQ ID NO: 3041 - protein, 9 aa, Homo sapiens
  light chain complementarity determining region 3 for antibody 1521
QQSYSTPWT

SEQ ID NO: 3042 - protein, 19 aa, Homo sapiens
  heavy chain complementarity determining region 3 for antibody 1521
ATQNYAYIWGSRRYYYMDV

SEQ ID NO: 3043 - protein, 9 aa, Homo sapiens
  light chain complementarity determining region 3 for antibody 1522
QQSYSTPPT

SEQ ID NO: 3044 - protein, 12 aa, Homo sapiens
  heavy chain complementarity determining region 3 for antibody 1522
AGSRSWGGSVDY

SEQ ID NO: 3045 - protein, 8 aa, Homo sapiens
  light chain complementarity determining region 3 for antibody 1523
QQSYSTLT

SEQ ID NO: 3046 - protein, 13 aa, Homo sapiens
  heavy chain complementarity determining region 3 for antibody 1523
ARAVAGTRDAFDI

SEQ ID NO: 3047 - protein, 9 aa, Homo sapiens
  light chain complementarity determining region 3 for antibody 1524
QQSSNTPLP

SEQ ID NO: 3048 - protein, 16 aa, Homo sapiens
  heavy chain complementarity determining region 3 for antibody 1524
VRDLAGFTRGGSTFDY

SEQ ID NO: 3049 - protein, 9 aa, Homo sapiens
  light chain complementarity determining region 3 for antibody 1525
QQLSNAPLT

SEQ ID NO: 3050 - protein, 17 aa, Homo sapiens
  heavy chain complementarity determining region 3 for antibody 1525
AKRLPGLLGGGHHYIDV

SEQ ID NO: 3051 - protein, 9 aa, Homo sapiens
  light chain complementarity determining region 3 for antibody 1526
QQLSNAPLT

SEQ ID NO: 3052 - protein, 17 aa, Homo sapiens
  heavy chain complementarity determining region 3 for antibody 1526
AKRLPDLRGGGHHYIDV

SEQ ID NO: 3053 - protein, 10 aa, Homo sapiens
  light chain complementarity determining region 3 for antibody 1527
QQHNNWPTIT

SEQ ID NO: 3054 - protein, 13 aa, Homo sapiens
  heavy chain complementarity determining region 3 for antibody 1527
AKPHYSGSGSGDY

SEQ ID NO: 3055 - protein, 9 aa, Homo sapiens
  light chain complementarity determining region 3 for antibody 1528
QQFRDLPRT

SEQ ID NO: 3056 - protein, 9 aa, Homo sapiens
  heavy chain complementarity determining region 3 for antibody 1528
ARGRSNFRF

SEQ ID NO: 3057 - protein, 10 aa, Homo sapiens
  light chain complementarity determining region 3 for antibody 1529
QQFNNYLLFT

SEQ ID NO: 3058 - protein, 12 aa, Homo sapiens
  heavy chain complementarity determining region 3 for antibody 1529
ARGFTYSRGWYL

SEQ ID NO: 3059 - protein, 9 aa, Homo sapiens
  light chain complementarity determining region 3 for antibody 1530
QQCSSSPLT

SEQ ID NO: 3060 - protein, 16 aa, Homo sapiens
  heavy chain complementarity determining region 3 for antibody 1530
AKWAGSGPYYVVSLDY

SEQ ID NO: 3061 - protein, 9 aa, Homo sapiens
  light chain complementarity determining region 3 for antibody 1531
QKYYTVPLT

SEQ ID NO: 3062 - protein, 10 aa, Homo sapiens
  heavy chain complementarity determining region 3 for antibody 1531
GGGEGWLTDF

SEQ ID NO: 3063 - protein, 9 aa, Homo sapiens
  light chain complementarity determining region 3 for antibody 1532
QKYYSVPLT

SEQ ID NO: 3064 - protein, 16 aa, Homo sapiens
  heavy chain complementarity determining region 3 for antibody 1532
AKERGYSSGWYGELDS

SEQ ID NO: 3065 - protein, 10 aa, Homo sapiens
  light chain complementarity determining region 3 for antibody 1533
QESYSTPLFT

SEQ ID NO: 3066 - protein, 17 aa, Homo sapiens
  heavy chain complementarity determining region 3 for antibody 1533
ARNTMVGTWQRQGNLDH

SEQ ID NO: 3067 - protein, 9 aa, Homo sapiens
  light chain complementarity determining region 3 for antibody 1534
PQYGSSPWT

SEQ ID NO: 3068 - protein, 11 aa, Homo sapiens
  heavy chain complementarity determining region 3 for antibody 1534
ALKIAAFPFDY

SEQ ID NO: 3069 - protein, 9 aa, Homo sapiens
  light chain complementarity determining region 3 for antibody 1535
MQNLQTPWT

SEQ ID NO: 3070 - protein, 12 aa, Homo sapiens
  heavy chain complementarity determining region 3 for antibody 1535
ARLDWNYRAFDI

SEQ ID NO: 3071 - protein, 9 aa, Homo sapiens
  light chain complementarity determining region 3 for antibody 1536
MQGTHWPPT

SEQ ID NO: 3072 - protein, 13 aa, Homo sapiens
  heavy chain complementarity determining region 3 for antibody 1536
ATGAWGSSWWGDY

SEQ ID NO: 3073 - protein, 10 aa, Homo sapiens
  light chain complementarity determining region 3 for antibody 1537
MQGTHWPPLT

SEQ ID NO: 3074 - protein, 12 aa, Homo sapiens
  heavy chain complementarity determining region 3 for antibody 1537
AIVVPGRWDLDD

SEQ ID NO: 3075 - protein, 9 aa, Homo sapiens
  light chain complementarity determining region 3 for antibody 1538
MQGTHWPIT

SEQ ID NO: 3076 - protein, 11 aa, Homo sapiens
  heavy chain complementarity determining region 3 for antibody 1538
ARRSLGGAFDY

SEQ ID NO: 3077 - protein, 9 aa, Homo sapiens
  light chain complementarity determining region 3 for antibody 1539
MQGTHWPHP

SEQ ID NO: 3078 - protein, 11 aa, Homo sapiens
  heavy chain complementarity determining region 3 for antibody 1539
ATFGQQWRLAH

SEQ ID NO: 3079 - protein, 9 aa, Homo sapiens
  light chain complementarity determining region 3 for antibody 1540
MQGIHWPWT

SEQ ID NO: 3080 - protein, 12 aa, Homo sapiens
  heavy chain complementarity determining region 3 for antibody 1540
TRDPEGDEDFDY

SEQ ID NO: 3081 - protein, 9 aa, Homo sapiens
  light chain complementarity determining region 3 for antibody 1541
MQALQTPMT

SEQ ID NO: 3082 - protein, 14 aa, Homo sapiens
  heavy chain complementarity determining region 3 for antibody 1541
AKGESTSCDYIIDY

SEQ ID NO: 3083 - protein, 9 aa, Homo sapiens
  light chain complementarity determining region 3 for antibody 1542
MQALLTEYT

SEQ ID NO: 3084 - protein, 13 aa, Homo sapiens
  heavy chain complementarity determining region 3 for antibody 1542
ARDGEARMVEFDY

SEQ ID NO: 3085 - protein, 9 aa, Homo sapiens
  light chain complementarity determining region 3 for antibody 1543
MEGLQPLYT

SEQ ID NO: 3086 - protein, 18 aa, Homo sapiens
  heavy chain complementarity determining region 3 for antibody 1543
ARSRYYASGGTSYSGLDV

SEQ ID NO: 3087 - protein, 9 aa, Homo sapiens
  light chain complementarity determining region 3 for antibody 1544
LQHNSYPWT

SEQ ID NO: 3088 - protein, 18 aa, Homo sapiens
  heavy chain complementarity determining region 3 for antibody 1544
TRGPSGAPGAMAYYYLDV

SEQ ID NO: 3089 - protein, 9 aa, Homo sapiens
  light chain complementarity determining region 3 for antibody 1545
LQFYTAPWT

SEQ ID NO: 3090 - protein, 17 aa, Homo sapiens
  heavy chain complementarity determining region 3 for antibody 1545
SRDGRITWPGSQGSLDS

SEQ ID NO: 3091 - protein, 9 aa, Homo sapiens
  light chain complementarity determining region 3 for antibody 1546
LQDYNYPYS

SEQ ID NO: 3092 - protein, 12 aa, Homo sapiens
  heavy chain complementarity determining region 3 for antibody 1546
ARDYSCCHGFDP

SEQ ID NO: 3093 - protein, 10 aa, Homo sapiens
  light chain complementarity determining region 3 for antibody 1547
LPVTQWPPWT

SEQ ID NO: 3094 - protein, 11 aa, Homo sapiens
  heavy chain complementarity determining region 3 for antibody 1547
SRGRAWNDGDY

SEQ ID NO: 3095 - protein, 9 aa, Homo sapiens
  light chain complementarity determining region 3 for antibody 1548
HQSSNWPRT

SEQ ID NO: 3096 - protein, 21 aa, Homo sapiens
  heavy chain complementarity determining region 3 for antibody 1548
ARDAWRPVAGSTSFYYYGMDV

SEQ ID NO: 3097 - protein, 8 aa, Homo sapiens
  light chain complementarity determining region 3 for antibody 1549
HQSDDLPT

SEQ ID NO: 3098 - protein, 14 aa, Homo sapiens
  heavy chain complementarity determining region 3 for antibody 1549
ARRLDTYTGNYIDF

SEQ ID NO: 3099 - protein, 9 aa, Homo sapiens
  light chain complementarity determining region 3 for antibody 1550
HQHGTTPGT

SEQ ID NO: 3100 - protein, 18 aa, Homo sapiens
  heavy chain complementarity determining region 3 for antibody 1550
ASWAGYCGGDCASVSLDY

SEQ ID NO: 3101 - protein, 9 aa, Homo sapiens
  light chain complementarity determining region 3 for antibody 1551
AQGSYWPAT

SEQ ID NO: 3102 - protein, 13 aa, Homo sapiens
  heavy chain complementarity determining region 3 for antibody 1551
AKEGSSPGPDFEY

SEQ ID NO: 3103 - protein, 9 aa, Homo sapiens
  light chain complementarity determining region 3 for antibody 1552
QQYYNSPES

SEQ ID NO: 3104 - protein, 14 aa, Homo sapiens
  heavy chain complementarity determining region 3 for antibody 1552
ARDMYSGSYWGDDF

SEQ ID NO: 3105 - protein, 9 aa, Homo sapiens
  light chain complementarity determining region 3 for antibody 1553
QQYNSYPWT

SEQ ID NO: 3106 - protein, 15 aa, Homo sapiens
  heavy chain complementarity determining region 3 for antibody 1553
GKEGPGGSGWLTGHY

SEQ ID NO: 3107 - protein, 10 aa, Homo sapiens
  light chain complementarity determining region 3 for antibody 1554
QQYNNWRGFT

SEQ ID NO: 3108 - protein, 11 aa, Homo sapiens
  heavy chain complementarity determining region 3 for antibody 1554
ARVAGPQLFDY

SEQ ID NO: 3109 - protein, 9 aa, Homo sapiens
  light chain complementarity determining region 3 for antibody 1555
QQYGTSSGT

SEQ ID NO: 3110 - protein, 15 aa, Homo sapiens
  heavy chain complementarity determining region 3 for antibody 1555
ARQEDNSGLWGPEKY

SEQ ID NO: 3111 - protein, 9 aa, Homo sapiens
  light chain complementarity determining region 3 for antibody 1556
QQYDNLPPA

SEQ ID NO: 3112 - protein, 13 aa, Homo sapiens
  heavy chain complementarity determining region 3 for antibody 1556
TKEGSAAGPDFVY

SEQ ID NO: 3113 - protein, 9 aa, Homo sapiens
  light chain complementarity determining region 3 for antibody 1557
QQSYSTPWT

SEQ ID NO: 3114 - protein, 15 aa, Homo sapiens
  heavy chain complementarity determining region 3 for antibody 1557
ARIWISSKRVRYFDL

SEQ ID NO: 3115 - protein, 9 aa, Homo sapiens
  light chain complementarity determining region 3 for antibody 1558
QQSYSTLWT

SEQ ID NO: 3116 - protein, 17 aa, Homo sapiens
  heavy chain complementarity determining region 3 for antibody 1558
ARNTMVGTWQRQGNLDH

SEQ ID NO: 3117 - protein, 9 aa, Homo sapiens
  light chain complementarity determining region 3 for antibody 1559
QQSYSAPRT

SEQ ID NO: 3118 - protein, 14 aa, Homo sapiens
  heavy chain complementarity determining region 3 for antibody 1559
TRSMLSSMTTPFDY

SEQ ID NO: 3119 - protein, 8 aa, Homo sapiens
  light chain complementarity determining region 3 for antibody 1560
QQSWSRPT

SEQ ID NO: 3120 - protein, 12 aa, Homo sapiens
  heavy chain complementarity determining region 3 for antibody 1560
AKWRGGQSEFEH

SEQ ID NO: 3121 - protein, 9 aa, Homo sapiens
  light chain complementarity determining region 3 for antibody 1561
QQSFNWPRT

SEQ ID NO: 3122 - protein, 14 aa, Homo sapiens
  heavy chain complementarity determining region 3 for antibody 1561
ATCPGYYDACPFDY

SEQ ID NO: 3123 - protein, 9 aa, Homo sapiens
  light chain complementarity determining region 3 for antibody 1562
QQRSNWPRT

SEQ ID NO: 3124 - protein, 12 aa, Homo sapiens
  heavy chain complementarity determining region 3 for antibody 1562
ARDFTANYCPDY

SEQ ID NO: 3125 - protein, 10 aa, Homo sapiens
  light chain complementarity determining region 3 for antibody 1563
QQRSNWPPIT

SEQ ID NO: 3126 - protein, 15 aa, Homo sapiens
  heavy chain complementarity determining region 3 for antibody 1563
ARAEVRGQLSYYMNV

SEQ ID NO: 3127 - protein, 10 aa, Homo sapiens
  light chain complementarity determining region 3 for antibody 1564
QQRFNWPPIT

SEQ ID NO: 3128 - protein, 13 aa, Homo sapiens
  heavy chain complementarity determining region 3 for antibody 1564
VRVGATNSGYYDY

SEQ ID NO: 3129 - protein, 9 aa, Homo sapiens
  light chain complementarity determining region 3 for antibody 1565
QQLNSYPLT

SEQ ID NO: 3130 - protein, 11 aa, Homo sapiens
  heavy chain complementarity determining region 3 for antibody 1565
ARIVARKPDDY

SEQ ID NO: 3131 - protein, 9 aa, Homo sapiens
  light chain complementarity determining region 3 for antibody 1566
QQGNSFPIT

SEQ ID NO: 3132 - protein, 11 aa, Homo sapiens
  heavy chain complementarity determining region 3 for antibody 1566
TGRSGPRRFDL

SEQ ID NO: 3133 - protein, 9 aa, Homo sapiens
  light chain complementarity determining region 3 for antibody 1567
QQFYNTPYT

SEQ ID NO: 3134 - protein, 10 aa, Homo sapiens
  heavy chain complementarity determining region 3 for antibody 1567
SRSGNGYLDY

SEQ ID NO: 3135 - protein, 9 aa, Homo sapiens
  light chain complementarity determining region 3 for antibody 1568
QQFSNLPRT

SEQ ID NO: 3136 - protein, 13 aa, Homo sapiens
  heavy chain complementarity determining region 3 for antibody 1568
AKEGSSPGPDLDS

SEQ ID NO: 3137 - protein, 9 aa, Homo sapiens
  light chain complementarity determining region 3 for antibody 1569
QQCGSSVWT

SEQ ID NO: 3138 - protein, 21 aa, Homo sapiens
  heavy chain complementarity determining region 3 for antibody 1569
AADPGEHFGSGSPQIVDAFDL

SEQ ID NO: 3139 - protein, 9 aa, Homo sapiens
  light chain complementarity determining region 3 for antibody 1570
QQANSFSLT

SEQ ID NO: 3140 - protein, 12 aa, Homo sapiens
  heavy chain complementarity determining region 3 for antibody 1570
ALDEWHPSWYKY

SEQ ID NO: 3141 - protein, 9 aa, Homo sapiens
  light chain complementarity determining region 3 for antibody 1571
QKYGSSPGP

SEQ ID NO: 3142 - protein, 18 aa, Homo sapiens
  heavy chain complementarity determining region 3 for antibody 1571
ARGDYPEARTGYFLDFDY

SEQ ID NO: 3143 - protein, 9 aa, Homo sapiens
  light chain complementarity determining region 3 for antibody 1572
QHYNGYPIT

SEQ ID NO: 3144 - protein, 17 aa, Homo sapiens
  heavy chain complementarity determining region 3 for antibody 1572
TRGGTEATSKYFHHMDV

SEQ ID NO: 3145 - protein, 10 aa, Homo sapiens
  light chain complementarity determining region 3 for antibody 1573
QHYGSSPPVT

SEQ ID NO: 3146 - protein, 17 aa, Homo sapiens
  heavy chain complementarity determining region 3 for antibody 1573
ARGSHYGSGSYYADFDH

SEQ ID NO: 3147 - protein, 9 aa, Homo sapiens
  light chain complementarity determining region 3 for antibody 1574
QHFNGYPYT

SEQ ID NO: 3148 - protein, 9 aa, Homo sapiens
  heavy chain complementarity determining region 3 for antibody 1574
ARFWTYGRK

SEQ ID NO: 3149 - protein, 9 aa, Homo sapiens
  light chain complementarity determining region 3 for antibody 1575
QEYNNWPRT

SEQ ID NO: 3150 - protein, 15 aa, Homo sapiens
  heavy chain complementarity determining region 3 for antibody 1575
ARHDGAVAGTGVFDF

SEQ ID NO: 3151 - protein, 9 aa, Homo sapiens
  light chain complementarity determining region 3 for antibody 1576
QEYKTVPWT

SEQ ID NO: 3152 - protein, 10 aa, Homo sapiens
  heavy chain complementarity determining region 3 for antibody 1576
CRDREGFGDV

SEQ ID NO: 3153 - protein, 9 aa, Homo sapiens
  light chain complementarity determining region 3 for antibody 1577
MQGTYWPHT

SEQ ID NO: 3154 - protein, 11 aa, Homo sapiens
  heavy chain complementarity determining region 3 for antibody 1577
VTFGQQWGLSY

SEQ ID NO: 3155 - protein, 9 aa, Homo sapiens
  light chain complementarity determining region 3 for antibody 1578
MQGTHWPWT

SEQ ID NO: 3156 - protein, 8 aa, Homo sapiens
  heavy chain complementarity determining region 3 for antibody 1578
ARGRWWSG

SEQ ID NO: 3157 - protein, 9 aa, Homo sapiens
  light chain complementarity determining region 3 for antibody 1579
MQATYWPNT

SEQ ID NO: 3158 - protein, 10 aa, Homo sapiens
  heavy chain complementarity determining region 3 for antibody 1579
ANVEWSRSAG

SEQ ID NO: 3159 - protein, 9 aa, Homo sapiens
  light chain complementarity determining region 3 for antibody 1580
LQYYTAPWA

SEQ ID NO: 3160 - protein, 17 aa, Homo sapiens
  heavy chain complementarity determining region 3 for antibody 1580
ARDGRIIWPGSQGTLDS

SEQ ID NO: 3161 - protein, 9 aa, Homo sapiens
  light chain complementarity determining region 3 for antibody 1581
LQYVHWPHT

SEQ ID NO: 3162 - protein, 9 aa, Homo sapiens
  heavy chain complementarity determining region 3 for antibody 1581
AGWGGTSNY

SEQ ID NO: 3163 - protein, 9 aa, Homo sapiens
  light chain complementarity determining region 3 for antibody 1582
LQHSSYPWT

SEQ ID NO: 3164 - protein, 18 aa, Homo sapiens
  heavy chain complementarity determining region 3 for antibody 1582
VRGPSGAPGAMAYYYLDV

SEQ ID NO: 3165 - protein, 9 aa, Homo sapiens
  light chain complementarity determining region 3 for antibody 1583
LQHRSYPWT

SEQ ID NO: 3166 - protein, 9 aa, Homo sapiens
  heavy chain complementarity determining region 3 for antibody 1583
TTVTPPDPA

SEQ ID NO: 3167 - protein, 9 aa, Homo sapiens
  light chain complementarity determining region 3 for antibody 1584
LQHNSYPYT

SEQ ID NO: 3168 - protein, 21 aa, Homo sapiens
  heavy chain complementarity determining region 3 for antibody 1584
ARDVILMYSSGWTPASDAFDI

SEQ ID NO: 3169 - protein, 9 aa, Homo sapiens
  light chain complementarity determining region 3 for antibody 1585
LQHNSYPWT

SEQ ID NO: 3170 - protein, 18 aa, Homo sapiens
  heavy chain complementarity determining region 3 for antibody 1585
TRGPSGVPGAMAYYYLDV

SEQ ID NO: 3171 - protein, 9 aa, Homo sapiens
  light chain complementarity determining region 3 for antibody 1586
LQDHKYPFT

SEQ ID NO: 3172 - protein, 14 aa, Homo sapiens
  heavy chain complementarity determining region 3 for antibody 1586
ANYRASIGANCFDP

SEQ ID NO: 3173 - protein, 9 aa, Homo sapiens
  light chain complementarity determining region 3 for antibody 1587
HQYYGAPRT

SEQ ID NO: 3174 - protein, 15 aa, Homo sapiens
  heavy chain complementarity determining region 3 for antibody 1587
ARDRRDNWNGDAFDI

SEQ ID NO: 3175 - protein, 9 aa, Homo sapiens
  light chain complementarity determining region 3 for antibody 1588
QRLNSYPYT

SEQ ID NO: 3176 - protein, 14 aa, Homo sapiens
  heavy chain complementarity determining region 3 for antibody 1588
ARGHFDSTGFRLDY

SEQ ID NO: 3177 - protein, 9 aa, Homo sapiens
  light chain complementarity determining region 3 for antibody 1589
QQYYNWPRT

SEQ ID NO: 3178 - protein, 14 aa, Homo sapiens
  heavy chain complementarity determining region 3 for antibody 1589
ATAPGFWDNSPFDY

SEQ ID NO: 3179 - protein, 9 aa, Homo sapiens
  light chain complementarity determining region 3 for antibody 1590
QQYYGTPIT

SEQ ID NO: 3180 - protein, 16 aa, Homo sapiens
  heavy chain complementarity determining region 3 for antibody 1590
ATDSFSLTSAVGHTDH

SEQ ID NO: 3181 - protein, 9 aa, Homo sapiens
  light chain complementarity determining region 3 for antibody 1591
QQYYGSPLT

SEQ ID NO: 3182 - protein, 16 aa, Homo sapiens
  heavy chain complementarity determining region 3 for antibody 1591
ARARYCSGGYCFIIDS

SEQ ID NO: 3183 - protein, 7 aa, Homo sapiens
  light chain complementarity determining region 3 for antibody 1592
QQYNTWK

SEQ ID NO: 3184 - protein, 12 aa, Homo sapiens
  heavy chain complementarity determining region 3 for antibody 1592
ARDKGGRNGMDV

SEQ ID NO: 3185 - protein, 9 aa, Homo sapiens
  light chain complementarity determining region 3 for antibody 1593
QQYNNWPRT

SEQ ID NO: 3186 - protein, 11 aa, Homo sapiens
  heavy chain complementarity determining region 3 for antibody 1593
VSSFISVFGVV

SEQ ID NO: 3187 - protein, 8 aa, Homo sapiens
  light chain complementarity determining region 3 for antibody 1594
QQYGSSLP

SEQ ID NO: 3188 - protein, 19 aa, Homo sapiens
  heavy chain complementarity determining region 3 for antibody 1594
ARWNGIRVQNNFWSGPFDH

SEQ ID NO: 3189 - protein, 10 aa, Homo sapiens
  light chain complementarity determining region 3 for antibody 1595
QQYGNSPPLT

SEQ ID NO: 3190 - protein, 14 aa, Homo sapiens
  heavy chain complementarity determining region 3 for antibody 1595
VRDSRLGAARLFDY

SEQ ID NO: 3191 - protein, 9 aa, Homo sapiens
  light chain complementarity determining region 3 for antibody 1596
QQYDNLPLT

SEQ ID NO: 3192 - protein, 17 aa, Homo sapiens
  heavy chain complementarity determining region 3 for antibody 1596
ARNTMVGTWQRQGNLDH

SEQ ID NO: 3193 - protein, 10 aa, Homo sapiens
  light chain complementarity determining region 3 for antibody 1597
QQYDNLASLT

SEQ ID NO: 3194 - protein, 13 aa, Homo sapiens
  heavy chain complementarity determining region 3 for antibody 1597
AKEGASPGPDFEY

SEQ ID NO: 3195 - protein, 9 aa, Homo sapiens
  light chain complementarity determining region 3 for antibody 1598
QQSYTSPRT

SEQ ID NO: 3196 - protein, 18 aa, Homo sapiens
  heavy chain complementarity determining region 3 for antibody 1598
TTILSHLLAGSWYLYFQH

SEQ ID NO: 3197 - protein, 9 aa, Homo sapiens
  light chain complementarity determining region 3 for antibody 1599
QQSYSTPPA

SEQ ID NO: 3198 - protein, 13 aa, Homo sapiens
  heavy chain complementarity determining region 3 for antibody 1599
AKEGSSPGPDFEY

SEQ ID NO: 3199 - protein, 10 aa, Homo sapiens
  light chain complementarity determining region 3 for antibody 1600
QQSYSSPLYT

SEQ ID NO: 3200 - protein, 18 aa, Homo sapiens
  heavy chain complementarity determining region 3 for antibody 1600
ARDLGYCSSTGCYHWFDP

SEQ ID NO: 3201 - protein, 8 aa, Homo sapiens
  light chain complementarity determining region 3 for antibody 1601
QQSYSIPT

SEQ ID NO: 3202 - protein, 17 aa, Homo sapiens
  heavy chain complementarity determining region 3 for antibody 1601
ARNTMVGAWQRQGNLDH

SEQ ID NO: 3203 - protein, 9 aa, Homo sapiens
  light chain complementarity determining region 3 for antibody 1602
QQSYSAPAT

SEQ ID NO: 3204 - protein, 12 aa, Homo sapiens
  heavy chain complementarity determining region 3 for antibody 1602
ATVDSGGNYFDP

SEQ ID NO: 3205 - protein, 9 aa, Homo sapiens
  light chain complementarity determining region 3 for antibody 1603
QQSYNPPLT

SEQ ID NO: 3206 - protein, 11 aa, Homo sapiens
  heavy chain complementarity determining region 3 for antibody 1603
ARGGTLAWFDP

SEQ ID NO: 3207 - protein, 9 aa, Homo sapiens
  light chain complementarity determining region 3 for antibody 1604
QQRYSWPIT

SEQ ID NO: 3208 - protein, 14 aa, Homo sapiens
  heavy chain complementarity determining region 3 for antibody 1604
ARERQEVTFRGVDY

SEQ ID NO: 3209 - protein, 9 aa, Homo sapiens
  light chain complementarity determining region 3 for antibody 1605
QQRSNWPWT

SEQ ID NO: 3210 - protein, 13 aa, Homo sapiens
  heavy chain complementarity determining region 3 for antibody 1605
ARDRASSGWFWDC

SEQ ID NO: 3211 - protein, 9 aa, Homo sapiens
  light chain complementarity determining region 3 for antibody 1606
QQRSNWPET

SEQ ID NO: 3212 - protein, 12 aa, Homo sapiens
  heavy chain complementarity determining region 3 for antibody 1606
AIVVPGRWDLDD

SEQ ID NO: 3213 - protein, 9 aa, Homo sapiens
  light chain complementarity determining region 3 for antibody 1607
QQRAHWPLT

SEQ ID NO: 3214 - protein, 14 aa, Homo sapiens
  heavy chain complementarity determining region 3 for antibody 1607
ARTYVYYDGSGSFP

SEQ ID NO: 3215 - protein, 9 aa, Homo sapiens
  light chain complementarity determining region 3 for antibody 1608
QQLSNAPLT

SEQ ID NO: 3216 - protein, 13 aa, Homo sapiens
  heavy chain complementarity determining region 3 for antibody 1608
AKEGSAPGPDFEY

SEQ ID NO: 3217 - protein, 9 aa, Homo sapiens
  light chain complementarity determining region 3 for antibody 1609
QQLNSFPLT

SEQ ID NO: 3218 - protein, 11 aa, Homo sapiens
  heavy chain complementarity determining region 3 for antibody 1609
VKERRGYYGDY

SEQ ID NO: 3219 - protein, 11 aa, Homo sapiens
  light chain complementarity determining region 3 for antibody 1610
QQHSNWPRSIT

SEQ ID NO: 3220 - protein, 23 aa, Homo sapiens
  heavy chain complementarity determining region 3 for antibody 1610
AKVLRKERVLPPIQSYVFDSFDV

SEQ ID NO: 3221 - protein, 9 aa, Homo sapiens
  light chain complementarity determining region 3 for antibody 1611
QQFSNLPRT

SEQ ID NO: 3222 - protein, 13 aa, Homo sapiens
  heavy chain complementarity determining region 3 for antibody 1611
AKEGSAPGPDFDS

SEQ ID NO: 3223 - protein, 10 aa, Homo sapiens
  light chain complementarity determining region 3 for antibody 1612
QKYKTAPPLT

SEQ ID NO: 3224 - protein, 12 aa, Homo sapiens
  heavy chain complementarity determining region 3 for antibody 1612
TRGDKYGDYAVY

SEQ ID NO: 3225 - protein, 10 aa, Homo sapiens
  light chain complementarity determining region 3 for antibody 1613
QHRTNWPQLT

SEQ ID NO: 3226 - protein, 13 aa, Homo sapiens
  heavy chain complementarity determining region 3 for antibody 1613
AREPIEATIYFDY

SEQ ID NO: 3227 - protein, 9 aa, Homo sapiens
  light chain complementarity determining region 3 for antibody 1614
MQTLQTPWR

SEQ ID NO: 3228 - protein, 12 aa, Homo sapiens
  heavy chain complementarity determining region 3 for antibody 1614
ARLDWNYRAFDI

SEQ ID NO: 3229 - protein, 9 aa, Homo sapiens
  light chain complementarity determining region 3 for antibody 1615
MQTLQPPWT

SEQ ID NO: 3230 - protein, 12 aa, Homo sapiens
  heavy chain complementarity determining region 3 for antibody 1615
ARLDWNYRAFDI

SEQ ID NO: 3231 - protein, 9 aa, Homo sapiens
  light chain complementarity determining region 3 for antibody 1616
MQSTHWPWT

SEQ ID NO: 3232 - protein, 11 aa, Homo sapiens
  heavy chain complementarity determining region 3 for antibody 1616
ATAEGVATRGY

SEQ ID NO: 3233 - protein, 9 aa, Homo sapiens
  light chain complementarity determining region 3 for antibody 1617
MQGTPWPHT

SEQ ID NO: 3234 - protein, 11 aa, Homo sapiens
  heavy chain complementarity determining region 3 for antibody 1617
ATFGQQWRLAH

SEQ ID NO: 3235 - protein, 9 aa, Homo sapiens
  light chain complementarity determining region 3 for antibody 1618
MQGTHGPHT

SEQ ID NO: 3236 - protein, 11 aa, Homo sapiens
  heavy chain complementarity determining region 3 for antibody 1618
ATFGQQWRLAH

SEQ ID NO: 3237 - protein, 8 aa, Homo sapiens
  light chain complementarity determining region 3 for antibody 1619
HHYGDSFT

SEQ ID NO: 3238 - protein, 17 aa, Homo sapiens
  heavy chain complementarity determining region 3 for antibody 1619
ARMTKYPYDSSSYYPDY

SEQ ID NO: 3239 - protein, 9 aa, Homo sapiens
  light chain complementarity determining region 3 for antibody 1620
VQYTNYPRT

SEQ ID NO: 3240 - protein, 13 aa, Homo sapiens
  heavy chain complementarity determining region 3 for antibody 1620
ATGAWASSWWGDF

SEQ ID NO: 3241 - protein, 9 aa, Homo sapiens
  light chain complementarity determining region 3 for antibody 1621
TQTTHWPWT

SEQ ID NO: 3242 - protein, 11 aa, Homo sapiens
  heavy chain complementarity determining region 3 for antibody 1621
TRDLSGSAGAY

SEQ ID NO: 3243 - protein, 7 aa, Homo sapiens
  light chain complementarity determining region 3 for antibody 1622
QYRSNWG

SEQ ID NO: 3244 - protein, 10 aa, Homo sapiens
  heavy chain complementarity determining region 3 for antibody 1622
ARERSGSYDI

SEQ ID NO: 3245 - protein, 9 aa, Homo sapiens
  light chain complementarity determining region 3 for antibody 1623
QQYYSSPQT

SEQ ID NO: 3246 - protein, 10 aa, Homo sapiens
  heavy chain complementarity determining region 3 for antibody 1623
ATEYSSGWSD

SEQ ID NO: 3247 - protein, 9 aa, Homo sapiens
  light chain complementarity determining region 3 for antibody 1624
QQYYSAPIT

SEQ ID NO: 3248 - protein, 14 aa, Homo sapiens
  heavy chain complementarity determining region 3 for antibody 1624
AKGESTSCDFIFDY

SEQ ID NO: 3249 - protein, 9 aa, Homo sapiens
  light chain complementarity determining region 3 for antibody 1625
QQYSVSPIT

SEQ ID NO: 3250 - protein, 12 aa, Homo sapiens
  heavy chain complementarity determining region 3 for antibody 1625
AGSRSVGGSVDF

SEQ ID NO: 3251 - protein, 9 aa, Homo sapiens
  light chain complementarity determining region 3 for antibody 1626
QQYNSYPRT

SEQ ID NO: 3252 - protein, 11 aa, Homo sapiens
  heavy chain complementarity determining region 3 for antibody 1626
VRVSTGWNFDY

SEQ ID NO: 3253 - protein, 9 aa, Homo sapiens
  light chain complementarity determining region 3 for antibody 1627
QQYNSYPLT

SEQ ID NO: 3254 - protein, 12 aa, Homo sapiens
  heavy chain complementarity determining region 3 for antibody 1627
NADHGYVDGFDI

SEQ ID NO: 3255 - protein, 9 aa, Homo sapiens
  light chain complementarity determining region 3 for antibody 1628
QQYNNWPLT

SEQ ID NO: 3256 - protein, 16 aa, Homo sapiens
  heavy chain complementarity determining region 3 for antibody 1628
AKAPSDLYQYYYGMDV

SEQ ID NO: 3257 - protein, 9 aa, Homo sapiens
  light chain complementarity determining region 3 for antibody 1629
QQYNGYPLT

SEQ ID NO: 3258 - protein, 18 aa, Homo sapiens
  heavy chain complementarity determining region 3 for antibody 1629
ANLRGCAFSDCYFLDGHS

SEQ ID NO: 3259 - protein, 9 aa, Homo sapiens
  light chain complementarity determining region 3 for antibody 1630
QQYGTSPVT

SEQ ID NO: 3260 - protein, 13 aa, Homo sapiens
  heavy chain complementarity determining region 3 for antibody 1630
AKDRADGWFAWGY

SEQ ID NO: 3261 - protein, 9 aa, Homo sapiens
  light chain complementarity determining region 3 for antibody 1631
QQYGSSPLT

SEQ ID NO: 3262 - protein, 17 aa, Homo sapiens
  heavy chain complementarity determining region 3 for antibody 1631
AKHPAYSGGWFQYPFEY

SEQ ID NO: 3263 - protein, 9 aa, Homo sapiens
  light chain complementarity determining region 3 for antibody 1632
QQYFISPLT

SEQ ID NO: 3264 - protein, 10 aa, Homo sapiens
  heavy chain complementarity determining region 3 for antibody 1632
TRGFGWLPDN

SEQ ID NO: 3265 - protein, 9 aa, Homo sapiens
  light chain complementarity determining region 3 for antibody 1633
QQYDTLPIT

SEQ ID NO: 3266 - protein, 18 aa, Homo sapiens
  heavy chain complementarity determining region 3 for antibody 1633
ASRRLTIFHRLWNDGFTE

SEQ ID NO: 3267 - protein, 9 aa, Homo sapiens
  light chain complementarity determining region 3 for antibody 1634
QQYDSYPYT

SEQ ID NO: 3268 - protein, 13 aa, Homo sapiens
  heavy chain complementarity determining region 3 for antibody 1634
VRGRDGYNGIFEF

SEQ ID NO: 3269 - protein, 9 aa, Homo sapiens
  light chain complementarity determining region 3 for antibody 1635
QQYDNLPLT

SEQ ID NO: 3270 - protein, 10 aa, Homo sapiens
  heavy chain complementarity determining region 3 for antibody 1635
ARETSGAYDI

SEQ ID NO: 3271 - protein, 9 aa, Homo sapiens
  light chain complementarity determining region 3 for antibody 1636
QQVNSFPHT

SEQ ID NO: 3272 - protein, 16 aa, Homo sapiens
  heavy chain complementarity determining region 3 for antibody 1636
ARRRDGYNLDEIYFDY

SEQ ID NO: 3273 - protein, 9 aa, Homo sapiens
  light chain complementarity determining region 3 for antibody 1637
QQTYSSPWP

SEQ ID NO: 3274 - protein, 15 aa, Homo sapiens
  heavy chain complementarity determining region 3 for antibody 1637
ARIWTSSTNCRYMDV

SEQ ID NO: 3275 - protein, 9 aa, Homo sapiens
  light chain complementarity determining region 3 for antibody 1638
QQSYSTPYT

SEQ ID NO: 3276 - protein, 14 aa, Homo sapiens
  heavy chain complementarity determining region 3 for antibody 1638
ANYRASIGANCFDP

SEQ ID NO: 3277 - protein, 8 aa, Homo sapiens
  light chain complementarity determining region 3 for antibody 1639
QQSYSTLT

SEQ ID NO: 3278 - protein, 12 aa, Homo sapiens
  heavy chain complementarity determining region 3 for antibody 1639
AIVVPGRWDLDD

SEQ ID NO: 3279 - protein, 9 aa, Homo sapiens
  light chain complementarity determining region 3 for antibody 1640
QQSFSTPFT

SEQ ID NO: 3280 - protein, 15 aa, Homo sapiens
  heavy chain complementarity determining region 3 for antibody 1640
AKRHSSSRNYPYMDV

SEQ ID NO: 3281 - protein, 9 aa, Homo sapiens
  light chain complementarity determining region 3 for antibody 1641
QQRTTWPRT

SEQ ID NO: 3282 - protein, 17 aa, Homo sapiens
  heavy chain complementarity determining region 3 for antibody 1641
ARQGRHCDGGSCHPPEY

SEQ ID NO: 3283 - protein, 9 aa, Homo sapiens
  light chain complementarity determining region 3 for antibody 1642
QQRTNWPPT

SEQ ID NO: 3284 - protein, 17 aa, Homo sapiens
  heavy chain complementarity determining region 3 for antibody 1642
ARDTPLTPATPGGVWGY

SEQ ID NO: 3285 - protein, 9 aa, Homo sapiens
  light chain complementarity determining region 3 for antibody 1643
QQRSNWPPT

SEQ ID NO: 3286 - protein, 17 aa, Homo sapiens
  heavy chain complementarity determining region 3 for antibody 1643
ARNTMVHGWQRQGSVDH

SEQ ID NO: 3287 - protein, 10 aa, Homo sapiens
  light chain complementarity determining region 3 for antibody 1644
QQRGNWPPLT

SEQ ID NO: 3288 - protein, 17 aa, Homo sapiens
  heavy chain complementarity determining region 3 for antibody 1644
ARGFCGGDCSRGRYFDL

SEQ ID NO: 3289 - protein, 9 aa, Homo sapiens
  light chain complementarity determining region 3 for antibody 1645
QQFRDLPRT

SEQ ID NO: 3290 - protein, 9 aa, Homo sapiens
  heavy chain complementarity determining region 3 for antibody 1645
ARGRNNFRY

SEQ ID NO: 3291 - protein, 10 aa, Homo sapiens
  light chain complementarity determining region 3 for antibody 1646
QQFNSYPVIT

SEQ ID NO: 3292 - protein, 17 aa, Homo sapiens
  heavy chain complementarity determining region 3 for antibody 1646
ARDSHKRGIVSPAWFDS

SEQ ID NO: 3293 - protein, 9 aa, Homo sapiens
  light chain complementarity determining region 3 for antibody 1647
QQDYYTPRP

SEQ ID NO: 3294 - protein, 11 aa, Homo sapiens
  heavy chain complementarity determining region 3 for antibody 1647
ARRSLGGAFDY

SEQ ID NO: 3295 - protein, 9 aa, Homo sapiens
  light chain complementarity determining region 3 for antibody 1648
QQANSFPYT

SEQ ID NO: 3296 - protein, 17 aa, Homo sapiens
  heavy chain complementarity determining region 3 for antibody 1648
ARNTMVGTWQRQGNLDH

SEQ ID NO: 3297 - protein, 9 aa, Homo sapiens
  light chain complementarity determining region 3 for antibody 1649
QQADSFPIT

SEQ ID NO: 3298 - protein, 18 aa, Homo sapiens
  heavy chain complementarity determining region 3 for antibody 1649
AHMGCTLPVCPAIPWFAP

SEQ ID NO: 3299 - protein, 9 aa, Homo sapiens
  light chain complementarity determining region 3 for antibody 1650
QNYNTAPFA

SEQ ID NO: 3300 - protein, 10 aa, Homo sapiens
  heavy chain complementarity determining region 3 for antibody 1650
VREGHWSLDH

SEQ ID NO: 3301 - protein, 9 aa, Homo sapiens
  light chain complementarity determining region 3 for antibody 1651
QLSGSSLLT

SEQ ID NO: 3302 - protein, 15 aa, Homo sapiens
  heavy chain complementarity determining region 3 for antibody 1651
ATPLGTITWYNAFDV

SEQ ID NO: 3303 - protein, 9 aa, Homo sapiens
  light chain complementarity determining region 3 for antibody 1652
QKYNSVPWT

SEQ ID NO: 3304 - protein, 17 aa, Homo sapiens
  heavy chain complementarity determining region 3 for antibody 1652
TRDRPDSTWTSANRRDC

SEQ ID NO: 3305 - protein, 9 aa, Homo sapiens
  light chain complementarity determining region 3 for antibody 1653
QKYDSAFLT

SEQ ID NO: 3306 - protein, 18 aa, Homo sapiens
  heavy chain complementarity determining region 3 for antibody 1653
ARWAGYCSGRSCYAPFDF

SEQ ID NO: 3307 - protein, 9 aa, Homo sapiens
  light chain complementarity determining region 3 for antibody 1654
QHYSSSLYT

SEQ ID NO: 3308 - protein, 11 aa, Homo sapiens
  heavy chain complementarity determining region 3 for antibody 1654
AKVNSDLCMDV

SEQ ID NO: 3309 - protein, 7 aa, Homo sapiens
  light chain complementarity determining region 3 for antibody 1655
QCRSDGG

SEQ ID NO: 3310 - protein, 20 aa, Homo sapiens
  heavy chain complementarity determining region 3 for antibody 1655
ATYVPGDCTCTDCFYWYFDF

SEQ ID NO: 3311 - protein, 9 aa, Homo sapiens
  light chain complementarity determining region 3 for antibody 1656
MQTLQTPWT

SEQ ID NO: 3312 - protein, 17 aa, Homo sapiens
  heavy chain complementarity determining region 3 for antibody 1656
ARNTMVGTWQRQGNLDH

SEQ ID NO: 3313 - protein, 9 aa, Homo sapiens
  light chain complementarity determining region 3 for antibody 1657
MQTLQIPWT

SEQ ID NO: 3314 - protein, 12 aa, Homo sapiens
  heavy chain complementarity determining region 3 for antibody 1657
ARLDWNYRAFDI

SEQ ID NO: 3315 - protein, 9 aa, Homo sapiens
  light chain complementarity determining region 3 for antibody 1658
MQTIQTPWT

SEQ ID NO: 3316 - protein, 12 aa, Homo sapiens
  heavy chain complementarity determining region 3 for antibody 1658
ARLDWNYRAFDI

SEQ ID NO: 3317 - protein, 9 aa, Homo sapiens
  light chain complementarity determining region 3 for antibody 1659
MQGTHWPHT

SEQ ID NO: 3318 - protein, 11 aa, Homo sapiens
  heavy chain complementarity determining region 3 for antibody 1659
ATFGQQWRLDH

SEQ ID NO: 3319 - protein, 9 aa, Homo sapiens
  light chain complementarity determining region 3 for antibody 1660
MQGIHWPWT

SEQ ID NO: 3320 - protein, 14 aa, Homo sapiens
  heavy chain complementarity determining region 3 for antibody 1660
ANYRASIGANCFDP

SEQ ID NO: 3321 - protein, 9 aa, Homo sapiens
  light chain complementarity determining region 3 for antibody 1661
MQFLQTPLT

SEQ ID NO: 3322 - protein, 10 aa, Homo sapiens
  heavy chain complementarity determining region 3 for antibody 1661
ARERAGSYDI

SEQ ID NO: 3323 - protein, 9 aa, Homo sapiens
  light chain complementarity determining region 3 for antibody 1662
MQATQFPRT

SEQ ID NO: 3324 - protein, 10 aa, Homo sapiens
  heavy chain complementarity determining region 3 for antibody 1662
ATGGLSGETS

SEQ ID NO: 3325 - protein, 9 aa, Homo sapiens
  light chain complementarity determining region 3 for antibody 1663
MQALQTPRT

SEQ ID NO: 3326 - protein, 15 aa, Homo sapiens
  heavy chain complementarity determining region 3 for antibody 1663
AKPMVGANIPYALHI

SEQ ID NO: 3327 - protein, 9 aa, Homo sapiens
  light chain complementarity determining region 3 for antibody 1664
LQHYTYPYT

SEQ ID NO: 3328 - protein, 12 aa, Homo sapiens
  heavy chain complementarity determining region 3 for antibody 1664
ARDYSCCNGFDP

SEQ ID NO: 3329 - protein, 9 aa, Homo sapiens
  light chain complementarity determining region 3 for antibody 1665
LQHNSYPPT

SEQ ID NO: 3330 - protein, 11 aa, Homo sapiens
  heavy chain complementarity determining region 3 for antibody 1665
VRVSTGWNFDY

SEQ ID NO: 3331 - protein, 9 aa, Homo sapiens
  light chain complementarity determining region 3 for antibody 1666
LQDRKYPFS

SEQ ID NO: 3332 - protein, 16 aa, Homo sapiens
  heavy chain complementarity determining region 3 for antibody 1666
GADLGDHDDAYATLDS

SEQ ID NO: 3333 - protein, 9 aa, Homo sapiens
  light chain complementarity determining region 3 for antibody 1667
HHFGSATGT

SEQ ID NO: 3334 - protein, 13 aa, Homo sapiens
  heavy chain complementarity determining region 3 for antibody 1667
AKEGSAPGPDFEY

SEQ ID NO: 3335 - protein, 9 aa, Homo sapiens
  light chain complementarity determining region 3 for antibody 1668
AQGSYWPAT

SEQ ID NO: 3336 - protein, 10 aa, Homo sapiens
  heavy chain complementarity determining region 3 for antibody 1668
CRDRRGFGDV

SEQ ID NO: 3337 - protein, 9 aa, Homo sapiens
  light chain complementarity determining region 3 for antibody 1669
QQYYNAPQA

SEQ ID NO: 3338 - protein, 9 aa, Homo sapiens
  heavy chain complementarity determining region 3 for antibody 1669
ARDLWPEDC

SEQ ID NO: 3339 - protein, 9 aa, Homo sapiens
  light chain complementarity determining region 3 for antibody 1670
QQYRTVPWT

SEQ ID NO: 3340 - protein, 20 aa, Homo sapiens
  heavy chain complementarity determining region 3 for antibody 1670
VKDGRGTTDYHSAGGGGMDV

SEQ ID NO: 3341 - protein, 9 aa, Homo sapiens
  light chain complementarity determining region 3 for antibody 1671
QQYNTYSRT

SEQ ID NO: 3342 - protein, 18 aa, Homo sapiens
  heavy chain complementarity determining region 3 for antibody 1671
ARSAPYCSSNACYYLFDS

SEQ ID NO: 3343 - protein, 9 aa, Homo sapiens
  light chain complementarity determining region 3 for antibody 1672
QQYNSYSYT

SEQ ID NO: 3344 - protein, 13 aa, Homo sapiens
  heavy chain complementarity determining region 3 for antibody 1672
AKEGSSAGPDFVY

SEQ ID NO: 3345 - protein, 9 aa, Homo sapiens
  light chain complementarity determining region 3 for antibody 1673
QQYNNWPWT

SEQ ID NO: 3346 - protein, 10 aa, Homo sapiens
  heavy chain complementarity determining region 3 for antibody 1673
CRDREGFGDV

SEQ ID NO: 3347 - protein, 9 aa, Homo sapiens
  light chain complementarity determining region 3 for antibody 1674
QQYNGYSFP

SEQ ID NO: 3348 - protein, 14 aa, Homo sapiens
  heavy chain complementarity determining region 3 for antibody 1674
VRNRYSSGYYLFDN

SEQ ID NO: 3349 - protein, 8 aa, Homo sapiens
  light chain complementarity determining region 3 for antibody 1675
QQYGSSRT

SEQ ID NO: 3350 - protein, 10 aa, Homo sapiens
  heavy chain complementarity determining region 3 for antibody 1675
AHRVNRAFHI

SEQ ID NO: 3351 - protein, 9 aa, Homo sapiens
  light chain complementarity determining region 3 for antibody 1676
QQYGSSPRT

SEQ ID NO: 3352 - protein, 13 aa, Homo sapiens
  heavy chain complementarity determining region 3 for antibody 1676
TKEGSSAGPDFVY

SEQ ID NO: 3353 - protein, 9 aa, Homo sapiens
  light chain complementarity determining region 3 for antibody 1677
QQYGSSPRT

SEQ ID NO: 3354 - protein, 19 aa, Homo sapiens
  heavy chain complementarity determining region 3 for antibody 1677
AREAGCDRGCRYYYYYMAV

SEQ ID NO: 3355 - protein, 10 aa, Homo sapiens
  light chain complementarity determining region 3 for antibody 1678
QQYGSSPPYT

SEQ ID NO: 3356 - protein, 12 aa, Homo sapiens
  heavy chain complementarity determining region 3 for antibody 1678
AGSRSWGGSVDY

SEQ ID NO: 3357 - protein, 9 aa, Homo sapiens
  light chain complementarity determining region 3 for antibody 1679
QQYGSSHWT

SEQ ID NO: 3358 - protein, 13 aa, Homo sapiens
  heavy chain complementarity determining region 3 for antibody 1679
AREADIAMDEFDF

SEQ ID NO: 3359 - protein, 9 aa, Homo sapiens
  light chain complementarity determining region 3 for antibody 1680
QQYGRSSWT

SEQ ID NO: 3360 - protein, 14 aa, Homo sapiens
  heavy chain complementarity determining region 3 for antibody 1680
ARNHFSGTYPAFDI

SEQ ID NO: 3361 - protein, 8 aa, Homo sapiens
  light chain complementarity determining region 3 for antibody 1681
QQYGNSFT

SEQ ID NO: 3362 - protein, 16 aa, Homo sapiens
  heavy chain complementarity determining region 3 for antibody 1681
GSWAGVSSDWSGPFDY

SEQ ID NO: 3363 - protein, 9 aa, Homo sapiens
  light chain complementarity determining region 3 for antibody 1682
QQYDDLPLT

SEQ ID NO: 3364 - protein, 11 aa, Homo sapiens
  heavy chain complementarity determining region 3 for antibody 1682
ARDRADDYFDS

SEQ ID NO: 3365 - protein, 9 aa, Homo sapiens
  light chain complementarity determining region 3 for antibody 1683
QQTYSSPWT

SEQ ID NO: 3366 - protein, 15 aa, Homo sapiens
  heavy chain complementarity determining region 3 for antibody 1683
ARIWASSTNCRYMDV

SEQ ID NO: 3367 - protein, 9 aa, Homo sapiens
  light chain complementarity determining region 3 for antibody 1684
QQTYSSPRT

SEQ ID NO: 3368 - protein, 15 aa, Homo sapiens
  heavy chain complementarity determining region 3 for antibody 1684
ARIWTSSTNCRYMDV

SEQ ID NO: 3369 - protein, 9 aa, Homo sapiens
  light chain complementarity determining region 3 for antibody 1685
QQSYTTPYT

SEQ ID NO: 3370 - protein, 21 aa, Homo sapiens
  heavy chain complementarity determining region 3 for antibody 1685
ARVKVVPAPTRGYQYYTYMDV

SEQ ID NO: 3371 - protein, 9 aa, Homo sapiens
  light chain complementarity determining region 3 for antibody 1686
QQSYSVPFT

SEQ ID NO: 3372 - protein, 17 aa, Homo sapiens
  heavy chain complementarity determining region 3 for antibody 1686
VRENCATTSCWPGWFDP

SEQ ID NO: 3373 - protein, 9 aa, Homo sapiens
  light chain complementarity determining region 3 for antibody 1687
QQSYSTPRT

SEQ ID NO: 3374 - protein, 15 aa, Homo sapiens
  heavy chain complementarity determining region 3 for antibody 1687
AKDHRSSRGYYYMDV

SEQ ID NO: 3375 - protein, 10 aa, Homo sapiens
  light chain complementarity determining region 3 for antibody 1688
QQSYSAPLFT

SEQ ID NO: 3376 - protein, 11 aa, Homo sapiens
  heavy chain complementarity determining region 3 for antibody 1688
ARDTGNFYVDY

SEQ ID NO: 3377 - protein, 9 aa, Homo sapiens
  light chain complementarity determining region 3 for antibody 1689
QQSFSVPRT

SEQ ID NO: 3378 - protein, 19 aa, Homo sapiens
  heavy chain complementarity determining region 3 for antibody 1689
SHVQRLCRIGGICYYYMAV

SEQ ID NO: 3379 - protein, 9 aa, Homo sapiens
  light chain complementarity determining region 3 for antibody 1690
QQRNNWPWT

SEQ ID NO: 3380 - protein, 12 aa, Homo sapiens
  heavy chain complementarity determining region 3 for antibody 1690
ARIKASGGYMDV

SEQ ID NO: 3381 - protein, 9 aa, Homo sapiens
  light chain complementarity determining region 3 for antibody 1691
QQLSNAPLT

SEQ ID NO: 3382 - protein, 17 aa, Homo sapiens
  heavy chain complementarity determining region 3 for antibody 1691
AKRFPDLLGGGHHYIDV

SEQ ID NO: 3383 - protein, 9 aa, Homo sapiens
  light chain complementarity determining region 3 for antibody 1692
QQGLIIPFT

SEQ ID NO: 3384 - protein, 11 aa, Homo sapiens
  heavy chain complementarity determining region 3 for antibody 1692
TTYNQNDGLDY

SEQ ID NO: 3385 - protein, 9 aa, Homo sapiens
  light chain complementarity determining region 3 for antibody 1693
QQAYYTPRT

SEQ ID NO: 3386 - protein, 11 aa, Homo sapiens
  heavy chain complementarity determining region 3 for antibody 1693
ARRSLGGAFDY

SEQ ID NO: 3387 - protein, 9 aa, Homo sapiens
  light chain complementarity determining region 3 for antibody 1694
QQAYNLPLT

SEQ ID NO: 3388 - protein, 15 aa, Homo sapiens
  heavy chain complementarity determining region 3 for antibody 1694
ATPMYSSTWFNAFDI

SEQ ID NO: 3389 - protein, 9 aa, Homo sapiens
  light chain complementarity determining region 3 for antibody 1695
QQAKSFPFT

SEQ ID NO: 3390 - protein, 22 aa, Homo sapiens
  heavy chain complementarity determining region 3 for antibody 1695
ARRRIRGGITFGEVPPFYGLDV

SEQ ID NO: 3391 - protein, 9 aa, Homo sapiens
  light chain complementarity determining region 3 for antibody 1696
QLSGSSLLT

SEQ ID NO: 3392 - protein, 16 aa, Homo sapiens
  heavy chain complementarity determining region 3 for antibody 1696
AKERGYSSAWYGELDY

SEQ ID NO: 3393 - protein, 9 aa, Homo sapiens
  light chain complementarity determining region 3 for antibody 1697
QKYKNAPFT

SEQ ID NO: 3394 - protein, 10 aa, Homo sapiens
  heavy chain complementarity determining region 3 for antibody 1697
VREGNWNLDY

SEQ ID NO: 3395 - protein, 9 aa, Homo sapiens
  light chain complementarity determining region 3 for antibody 1698
QHYGPSSYT

SEQ ID NO: 3396 - protein, 8 aa, Homo sapiens
  heavy chain complementarity determining region 3 for antibody 1698
AETYRLGR

SEQ ID NO: 3397 - protein, 9 aa, Homo sapiens
  light chain complementarity determining region 3 for antibody 1699
QHYDSYPET

SEQ ID NO: 3398 - protein, 18 aa, Homo sapiens
  heavy chain complementarity determining region 3 for antibody 1699
TRFRGKWLQIAGYYGMDV

SEQ ID NO: 3399 - protein, 9 aa, Homo sapiens
  light chain complementarity determining region 3 for antibody 1700
QHFRDLPRT

SEQ ID NO: 3400 - protein, 9 aa, Homo sapiens
  heavy chain complementarity determining region 3 for antibody 1700
ARGRSNFRY

SEQ ID NO: 3401 - protein, 9 aa, Homo sapiens
  light chain complementarity determining region 3 for antibody 1701
QEDKTVPWT

SEQ ID NO: 3402 - protein, 20 aa, Homo sapiens
  heavy chain complementarity determining region 3 for antibody 1701
AKDGRGTAFYHGAGGGGLDV

SEQ ID NO: 3403 - protein, 9 aa, Homo sapiens
  light chain complementarity determining region 3 for antibody 1702
MQYAHWPHT

SEQ ID NO: 3404 - protein, 8 aa, Homo sapiens
  heavy chain complementarity determining region 3 for antibody 1702
ADWSDANY

SEQ ID NO: 3405 - protein, 9 aa, Homo sapiens
  light chain complementarity determining region 3 for antibody 1703
MQTLQTPWT

SEQ ID NO: 3406 - protein, 12 aa, Homo sapiens
  heavy chain complementarity determining region 3 for antibody 1703
ARLDWSYRAFDI

SEQ ID NO: 3407 - protein, 8 aa, Homo sapiens
  light chain complementarity determining region 3 for antibody 1704
MQGTYWPT

SEQ ID NO: 3408 - protein, 11 aa, Homo sapiens
  heavy chain complementarity determining region 3 for antibody 1704
VRGLEPNNIDD

SEQ ID NO: 3409 - protein, 10 aa, Homo sapiens
  light chain complementarity determining region 3 for antibody 1705
MQGTYWPPIT

SEQ ID NO: 3410 - protein, 11 aa, Homo sapiens
  heavy chain complementarity determining region 3 for antibody 1705
TGGGAGTKIDS

SEQ ID NO: 3411 - protein, 9 aa, Homo sapiens
  light chain complementarity determining region 3 for antibody 1706
MQGTHWPPP

SEQ ID NO: 3412 - protein, 13 aa, Homo sapiens
  heavy chain complementarity determining region 3 for antibody 1706
ARDTVTNKMGSDY

SEQ ID NO: 3413 - protein, 10 aa, Homo sapiens
  light chain complementarity determining region 3 for antibody 1707
MQGTHWPAWT

SEQ ID NO: 3414 - protein, 12 aa, Homo sapiens
  heavy chain complementarity determining region 3 for antibody 1707
TAWIKTSGWLDY

SEQ ID NO: 3415 - protein, 9 aa, Homo sapiens
  light chain complementarity determining region 3 for antibody 1708
MQGLQTPVT

SEQ ID NO: 3416 - protein, 13 aa, Homo sapiens
  heavy chain complementarity determining region 3 for antibody 1708
ARGHCSTTYCLTP

SEQ ID NO: 3417 - protein, 9 aa, Homo sapiens
  light chain complementarity determining region 3 for antibody 1709
MQFLQTPLT

SEQ ID NO: 3418 - protein, 10 aa, Homo sapiens
  heavy chain complementarity determining region 3 for antibody 1709
ARERSGSYDL

SEQ ID NO: 3419 - protein, 9 aa, Homo sapiens
  light chain complementarity determining region 3 for antibody 1710
MQALQTPQT

SEQ ID NO: 3420 - protein, 16 aa, Homo sapiens
  heavy chain complementarity determining region 3 for antibody 1710
ALKWEILLRVPCAFNV

SEQ ID NO: 3421 - protein, 9 aa, Homo sapiens
  light chain complementarity determining region 3 for antibody 1711
MEGLQPLYT

SEQ ID NO: 3422 - protein, 18 aa, Homo sapiens
  heavy chain complementarity determining region 3 for antibody 1711
ARSRYSRSGGTSYSGVDV

SEQ ID NO: 3423 - protein, 9 aa, Homo sapiens
  light chain complementarity determining region 3 for antibody 1712
LQSNTYPLT

SEQ ID NO: 3424 - protein, 12 aa, Homo sapiens
  heavy chain complementarity determining region 3 for antibody 1712
ARADPQTRPFDY

SEQ ID NO: 3425 - protein, 9 aa, Homo sapiens
  light chain complementarity determining region 3 for antibody 1713
LQHNSYPLP

SEQ ID NO: 3426 - protein, 11 aa, Homo sapiens
  heavy chain complementarity determining region 3 for antibody 1713
VRVSTGWNFDY

SEQ ID NO: 3427 - protein, 9 aa, Homo sapiens
  light chain complementarity determining region 3 for antibody 1714
LQGTYWPKT

SEQ ID NO: 3428 - protein, 15 aa, Homo sapiens
  heavy chain complementarity determining region 3 for antibody 1714
TRDQHTGSLIESFDI

SEQ ID NO: 3429 - protein, 9 aa, Homo sapiens
  light chain complementarity determining region 3 for antibody 1715
HQYAIPPWT

SEQ ID NO: 3430 - protein, 11 aa, Homo sapiens
  heavy chain complementarity determining region 3 for antibody 1715
ARGRDQSKLGY

SEQ ID NO: 3431 - protein, 9 aa, Homo sapiens
  light chain complementarity determining region 3 for antibody 1716
AQGSYWPAS

SEQ ID NO: 3432 - protein, 10 aa, Homo sapiens
  heavy chain complementarity determining region 3 for antibody 1716
CRDREGFVDV

SEQ ID NO: 3433 - protein, 9 aa, Homo sapiens
  light chain complementarity determining region 3 for antibody 1717
AQGSFWPAT

SEQ ID NO: 3434 - protein, 11 aa, Homo sapiens
  heavy chain complementarity determining region 3 for antibody 1717
ARRSLGGAFDY

SEQ ID NO: 3435 - protein, 9 aa, Homo sapiens
  light chain complementarity determining region 3 for antibody 1718
QRYNSHPYT

SEQ ID NO: 3436 - protein, 13 aa, Homo sapiens
  heavy chain complementarity determining region 3 for antibody 1718
TREGDSSGPDFHL

SEQ ID NO: 3437 - protein, 9 aa, Homo sapiens
  light chain complementarity determining region 3 for antibody 1719
QQYYSTHYT

SEQ ID NO: 3438 - protein, 12 aa, Homo sapiens
  heavy chain complementarity determining region 3 for antibody 1719
ARESVSGSYLDY

SEQ ID NO: 3439 - protein, 9 aa, Homo sapiens
  light chain complementarity determining region 3 for antibody 1720
QQYYGIPYN

SEQ ID NO: 3440 - protein, 14 aa, Homo sapiens
  heavy chain complementarity determining region 3 for antibody 1720
ATLSSAADEGGFDY

SEQ ID NO: 3441 - protein, 10 aa, Homo sapiens
  light chain complementarity determining region 3 for antibody 1721
QQYYDYSPCT

SEQ ID NO: 3442 - protein, 18 aa, Homo sapiens
  heavy chain complementarity determining region 3 for antibody 1721
ARWQVTVARGDVGNGIDV

SEQ ID NO: 3443 - protein, 9 aa, Homo sapiens
  light chain complementarity determining region 3 for antibody 1722
QQYSSYSYT

SEQ ID NO: 3444 - protein, 9 aa, Homo sapiens
  heavy chain complementarity determining region 3 for antibody 1722
ARFGTYGRC

SEQ ID NO: 3445 - protein, 9 aa, Homo sapiens
  light chain complementarity determining region 3 for antibody 1723
QQYRTVPWT

SEQ ID NO: 3446 - protein, 20 aa, Homo sapiens
  heavy chain complementarity determining region 3 for antibody 1723
VKDGRGTADYHSAGGGGMDV

SEQ ID NO: 3447 - protein, 9 aa, Homo sapiens
  light chain complementarity determining region 3 for antibody 1724
QQYNSYPWT

SEQ ID NO: 3448 - protein, 15 aa, Homo sapiens
  heavy chain complementarity determining region 3 for antibody 1724
GKEGPGSSGWLPGHY

SEQ ID NO: 3449 - protein, 7 aa, Homo sapiens
  light chain complementarity determining region 3 for antibody 1725
QQYNSWT

SEQ ID NO: 3450 - protein, 13 aa, Homo sapiens
  heavy chain complementarity determining region 3 for antibody 1725
AKEGSSPGPDFEY

SEQ ID NO: 3451 - protein, 9 aa, Homo sapiens
  light chain complementarity determining region 3 for antibody 1726
QQYNKWPGG

SEQ ID NO: 3452 - protein, 10 aa, Homo sapiens
  heavy chain complementarity determining region 3 for antibody 1726
ARAGWHQVDW

SEQ ID NO: 3453 - protein, 9 aa, Homo sapiens
  light chain complementarity determining region 3 for antibody 1727
QQYKTFPLK

SEQ ID NO: 3454 - protein, 16 aa, Homo sapiens
  heavy chain complementarity determining region 3 for antibody 1727
GKDAGIVGHSVDYIGD

SEQ ID NO: 3455 - protein, 9 aa, Homo sapiens
  light chain complementarity determining region 3 for antibody 1728
QQYHTTPYT

SEQ ID NO: 3456 - protein, 11 aa, Homo sapiens
  heavy chain complementarity determining region 3 for antibody 1728
GREAPAGWVDH

SEQ ID NO: 3457 - protein, 10 aa, Homo sapiens
  light chain complementarity determining region 3 for antibody 1729
QQYGSSPLYT

SEQ ID NO: 3458 - protein, 12 aa, Homo sapiens
  heavy chain complementarity determining region 3 for antibody 1729
AIVVPGRWDLDD

SEQ ID NO: 3459 - protein, 9 aa, Homo sapiens
  light chain complementarity determining region 3 for antibody 1730
QQYGSSPLT

SEQ ID NO: 3460 - protein, 17 aa, Homo sapiens
  heavy chain complementarity determining region 3 for antibody 1730
ARNTMVGTWQRQGNLDH

SEQ ID NO: 3461 - protein, 9 aa, Homo sapiens
  light chain complementarity determining region 3 for antibody 1731
QQYGSSPLT

SEQ ID NO: 3462 - protein, 14 aa, Homo sapiens
  heavy chain complementarity determining region 3 for antibody 1731
ARGYSDWLFYAFDI

SEQ ID NO: 3463 - protein, 9 aa, Homo sapiens
  light chain complementarity determining region 3 for antibody 1732
QQYGSSPHI

SEQ ID NO: 3464 - protein, 6 aa, Homo sapiens
  heavy chain complementarity determining region 3 for antibody 1732
ARISAY

SEQ ID NO: 3465 - protein, 9 aa, Homo sapiens
  light chain complementarity determining region 3 for antibody 1733
QQYEALPPT

SEQ ID NO: 3466 - protein, 13 aa, Homo sapiens
  heavy chain complementarity determining region 3 for antibody 1733
AKEGSSPGPDFDY

SEQ ID NO: 3467 - protein, 9 aa, Homo sapiens
  light chain complementarity determining region 3 for antibody 1734
QQYDNLPLT

SEQ ID NO: 3468 - protein, 17 aa, Homo sapiens
  heavy chain complementarity determining region 3 for antibody 1734
ARNTMVDGWQRQGSVDH

SEQ ID NO: 3469 - protein, 8 aa, Homo sapiens
  light chain complementarity determining region 3 for antibody 1735
QQYDNLLT

SEQ ID NO: 3470 - protein, 17 aa, Homo sapiens
  heavy chain complementarity determining region 3 for antibody 1735
AKRLPDLLGGGHHYIDV

SEQ ID NO: 3471 - protein, 9 aa, Homo sapiens
  light chain complementarity determining region 3 for antibody 1736
QQTYSSPWT

SEQ ID NO: 3472 - protein, 15 aa, Homo sapiens
  heavy chain complementarity determining region 3 for antibody 1736
ARIWTRSTNCRYMDV

SEQ ID NO: 3473 - protein, 9 aa, Homo sapiens
  light chain complementarity determining region 3 for antibody 1737
QQSYTTPYT

SEQ ID NO: 3474 - protein, 12 aa, Homo sapiens
  heavy chain complementarity determining region 3 for antibody 1737
AIVVPGRWDLDD

SEQ ID NO: 3475 - protein, 10 aa, Homo sapiens
  light chain complementarity determining region 3 for antibody 1738
QQSYSTLMYT

SEQ ID NO: 3476 - protein, 13 aa, Homo sapiens
  heavy chain complementarity determining region 3 for antibody 1738
AKEGSSAGPDFDY

SEQ ID NO: 3477 - protein, 8 aa, Homo sapiens
  light chain complementarity determining region 3 for antibody 1739
QQSYSSPT

SEQ ID NO: 3478 - protein, 13 aa, Homo sapiens
  heavy chain complementarity determining region 3 for antibody 1739
AKEGSAPGPDFEY

SEQ ID NO: 3479 - protein, 9 aa, Homo sapiens
  light chain complementarity determining region 3 for antibody 1740
QQSYGIPRA

SEQ ID NO: 3480 - protein, 18 aa, Homo sapiens
  heavy chain complementarity determining region 3 for antibody 1740
ASWAGSCSSTSCYAVYDY

SEQ ID NO: 3481 - protein, 9 aa, Homo sapiens
  light chain complementarity determining region 3 for antibody 1741
QQSSNTPLT

SEQ ID NO: 3482 - protein, 16 aa, Homo sapiens
  heavy chain complementarity determining region 3 for antibody 1741
VRDLAGFTRGGSAFDY

SEQ ID NO: 3483 - protein, 9 aa, Homo sapiens
  light chain complementarity determining region 3 for antibody 1742
QQSSNTPLT

SEQ ID NO: 3484 - protein, 10 aa, Homo sapiens
  heavy chain complementarity determining region 3 for antibody 1742
CRDREGFGDV

SEQ ID NO: 3485 - protein, 9 aa, Homo sapiens
  light chain complementarity determining region 3 for antibody 1743
QQSSNTPLT

SEQ ID NO: 3486 - protein, 17 aa, Homo sapiens
  heavy chain complementarity determining region 3 for antibody 1743
ARQGRHCDGGSCHPPEY

SEQ ID NO: 3487 - protein, 10 aa, Homo sapiens
  light chain complementarity determining region 3 for antibody 1744
QQSNSTLGGT

SEQ ID NO: 3488 - protein, 15 aa, Homo sapiens
  heavy chain complementarity determining region 3 for antibody 1744
AKVHRSSKGCYYMDV

SEQ ID NO: 3489 - protein, 9 aa, Homo sapiens
  light chain complementarity determining region 3 for antibody 1745
QQSFWTPVT

SEQ ID NO: 3490 - protein, 17 aa, Homo sapiens
  heavy chain complementarity determining region 3 for antibody 1745
AKDPTFGSEKYLDSLHI

SEQ ID NO: 3491 - protein, 9 aa, Homo sapiens
  light chain complementarity determining region 3 for antibody 1746
QQRTTWPPT

SEQ ID NO: 3492 - protein, 15 aa, Homo sapiens
  heavy chain complementarity determining region 3 for antibody 1746
ARDFCSSSTCYWFDP

SEQ ID NO: 3493 - protein, 8 aa, Homo sapiens
  light chain complementarity determining region 3 for antibody 1747
QQRTNWPT

SEQ ID NO: 3494 - protein, 18 aa, Homo sapiens
  heavy chain complementarity determining region 3 for antibody 1747
ARDGVPWRGRKVVWWFDP

SEQ ID NO: 3495 - protein, 10 aa, Homo sapiens
  light chain complementarity determining region 3 for antibody 1748
QQRSDWPPFT

SEQ ID NO: 3496 - protein, 17 aa, Homo sapiens
  heavy chain complementarity determining region 3 for antibody 1748
ARDIRTDGHTPIGAFDI

SEQ ID NO: 3497 - protein, 10 aa, Homo sapiens
  light chain complementarity determining region 3 for antibody 1749
QQRGNWPPIT

SEQ ID NO: 3498 - protein, 16 aa, Homo sapiens
  heavy chain complementarity determining region 3 for antibody 1749
AREGTWGSATHWYFDL

SEQ ID NO: 3499 - protein, 9 aa, Homo sapiens
  light chain complementarity determining region 3 for antibody 1750
QQLMVYPYT

SEQ ID NO: 3500 - protein, 14 aa, Homo sapiens
  heavy chain complementarity determining region 3 for antibody 1750
TRGHVDSTGFRLDY

SEQ ID NO: 3501 - protein, 9 aa, Homo sapiens
  light chain complementarity determining region 3 for antibody 1751
QQLHSFPYT

SEQ ID NO: 3502 - protein, 14 aa, Homo sapiens
  heavy chain complementarity determining region 3 for antibody 1751
ARGHFDSTGFRLDY

SEQ ID NO: 3503 - protein, 9 aa, Homo sapiens
  light chain complementarity determining region 3 for antibody 1752
QQHSSYPRT

SEQ ID NO: 3504 - protein, 21 aa, Homo sapiens
  heavy chain complementarity determining region 3 for antibody 1752
ARGIGAYAWGDFRSSDKDFDF

SEQ ID NO: 3505 - protein, 9 aa, Homo sapiens
  light chain complementarity determining region 3 for antibody 1753
QQGHSFPLT

SEQ ID NO: 3506 - protein, 11 aa, Homo sapiens
  heavy chain complementarity determining region 3 for antibody 1753
ARDRADDYLDS

SEQ ID NO: 3507 - protein, 9 aa, Homo sapiens
  light chain complementarity determining region 3 for antibody 1754
QQFSNFPRT

SEQ ID NO: 3508 - protein, 9 aa, Homo sapiens
  heavy chain complementarity determining region 3 for antibody 1754
ARGRSNFRY

SEQ ID NO: 3509 - protein, 9 aa, Homo sapiens
  light chain complementarity determining region 3 for antibody 1755
QKYKHVPWT

SEQ ID NO: 3510 - protein, 20 aa, Homo sapiens
  heavy chain complementarity determining region 3 for antibody 1755
ARDQRSIHLWSFSEGGGMDV

SEQ ID NO: 3511 - protein, 9 aa, Homo sapiens
  light chain complementarity determining region 3 for antibody 1756
QHYNDWWWT

SEQ ID NO: 3512 - protein, 10 aa, Homo sapiens
  heavy chain complementarity determining region 3 for antibody 1756
AQSNSGRFYN

SEQ ID NO: 3513 - protein, 9 aa, Homo sapiens
  light chain complementarity determining region 3 for antibody 1757
MQGTHWPWT

SEQ ID NO: 3514 - protein, 17 aa, Homo sapiens
  heavy chain complementarity determining region 3 for antibody 1757
ARNTMVGAWQRQGNLDH

SEQ ID NO: 3515 - protein, 10 aa, Homo sapiens
  light chain complementarity determining region 3 for antibody 1758
MQGTHWPAWT

SEQ ID NO: 3516 - protein, 13 aa, Homo sapiens
  heavy chain complementarity determining region 3 for antibody 1758
VTWVESNSGWLDY

SEQ ID NO: 3517 - protein, 10 aa, Homo sapiens
  light chain complementarity determining region 3 for antibody 1759
MQGTHWPAWT

SEQ ID NO: 3518 - protein, 10 aa, Homo sapiens
  heavy chain complementarity determining region 3 for antibody 1759
VKSRSGHFDD

SEQ ID NO: 3519 - protein, 9 aa, Homo sapiens
  light chain complementarity determining region 3 for antibody 1760
MQGLQTPFT

SEQ ID NO: 3520 - protein, 11 aa, Homo sapiens
  heavy chain complementarity determining region 3 for antibody 1760
ARDGGRFSDDY

SEQ ID NO: 3521 - protein, 9 aa, Homo sapiens
  light chain complementarity determining region 3 for antibody 1761
MQGIHWPGT

SEQ ID NO: 3522 - protein, 11 aa, Homo sapiens
  heavy chain complementarity determining region 3 for antibody 1761
ARSPATGTTDY

SEQ ID NO: 3523 - protein, 9 aa, Homo sapiens
  light chain complementarity determining region 3 for antibody 1762
MQATHWPPT

SEQ ID NO: 3524 - protein, 10 aa, Homo sapiens
  heavy chain complementarity determining region 3 for antibody 1762
ARGSAWGGDV

SEQ ID NO: 3525 - protein, 9 aa, Homo sapiens
  light chain complementarity determining region 3 for antibody 1763
MQALQTPYT

SEQ ID NO: 3526 - protein, 10 aa, Homo sapiens
  heavy chain complementarity determining region 3 for antibody 1763
AKDRSGGGGY

SEQ ID NO: 3527 - protein, 9 aa, Homo sapiens
  light chain complementarity determining region 3 for antibody 1764
MQALQTPRT

SEQ ID NO: 3528 - protein, 19 aa, Homo sapiens
  heavy chain complementarity determining region 3 for antibody 1764
ARGRGVELSGGTFYHGLGV

SEQ ID NO: 3529 - protein, 9 aa, Homo sapiens
  light chain complementarity determining region 3 for antibody 1765
MQALQTPNT

SEQ ID NO: 3530 - protein, 10 aa, Homo sapiens
  heavy chain complementarity determining region 3 for antibody 1765
AKDLSGGGGY

SEQ ID NO: 3531 - protein, 9 aa, Homo sapiens
  light chain complementarity determining region 3 for antibody 1766
LQYGKPPHT

SEQ ID NO: 3532 - protein, 5 aa, Homo sapiens
  heavy chain complementarity determining region 3 for antibody 1766
SGDYQ

SEQ ID NO: 3533 - protein, 9 aa, Homo sapiens
  light chain complementarity determining region 3 for antibody 1767
LQYDTYPWT

SEQ ID NO: 3534 - protein, 12 aa, Homo sapiens
  heavy chain complementarity determining region 3 for antibody 1767
ARERSADYWFGP

SEQ ID NO: 3535 - protein, 9 aa, Homo sapiens
  light chain complementarity determining region 3 for antibody 1768
LQYAHWPHT

SEQ ID NO: 3536 - protein, 15 aa, Homo sapiens
  heavy chain complementarity determining region 3 for antibody 1768
ARVGRPYHNAWYFGN

SEQ ID NO: 3537 - protein, 9 aa, Homo sapiens
  light chain complementarity determining region 3 for antibody 1769
LQTLQTPWT

SEQ ID NO: 3538 - protein, 12 aa, Homo sapiens
  heavy chain complementarity determining region 3 for antibody 1769
ARLDWNYRAFDI

SEQ ID NO: 3539 - protein, 9 aa, Homo sapiens
  light chain complementarity determining region 3 for antibody 1770
LQHNSYPLT

SEQ ID NO: 3540 - protein, 11 aa, Homo sapiens
  heavy chain complementarity determining region 3 for antibody 1770
VRVSTGWNFGY

SEQ ID NO: 3541 - protein, 9 aa, Homo sapiens
  light chain complementarity determining region 3 for antibody 1771
LQHNSYPLT

SEQ ID NO: 3542 - protein, 10 aa, Homo sapiens
  heavy chain complementarity determining region 3 for antibody 1771
CRDREGFGDV

SEQ ID NO: 3543 - protein, 9 aa, Homo sapiens
  light chain complementarity determining region 3 for antibody 1772
LQHNSYPFT

SEQ ID NO: 3544 - protein, 11 aa, Homo sapiens
  heavy chain complementarity determining region 3 for antibody 1772
VRVSTGWNFDY

SEQ ID NO: 3545 - protein, 9 aa, Homo sapiens
  light chain complementarity determining region 3 for antibody 1773
LQHHSYPWT

SEQ ID NO: 3546 - protein, 12 aa, Homo sapiens
  heavy chain complementarity determining region 3 for antibody 1773
SRNAAGYHYLDS

SEQ ID NO: 3547 - protein, 9 aa, Homo sapiens
  light chain complementarity determining region 3 for antibody 1774
LQFAPWPHT

SEQ ID NO: 3548 - protein, 9 aa, Homo sapiens
  heavy chain complementarity determining region 3 for antibody 1774
AGWGGLSNY

SEQ ID NO: 3549 - protein, 9 aa, Homo sapiens
  light chain complementarity determining region 3 for antibody 1775
LQANSFPRT

SEQ ID NO: 3550 - protein, 15 aa, Homo sapiens
  heavy chain complementarity determining region 3 for antibody 1775
ARDAAGDGYTSRWEY

SEQ ID NO: 3551 - protein, 7 aa, Homo sapiens
  light chain complementarity determining region 3 for antibody 1776
HYRSNWG

SEQ ID NO: 3552 - protein, 20 aa, Homo sapiens
  heavy chain complementarity determining region 3 for antibody 1776
ATFLPGDCSCTGCYYWYFDF

SEQ ID NO: 3553 - protein, 9 aa, Homo sapiens
  light chain complementarity determining region 3 for antibody 1777
HQSSSLPPT

SEQ ID NO: 3554 - protein, 12 aa, Homo sapiens
  heavy chain complementarity determining region 3 for antibody 1777
AIVVPGRWDLDD

SEQ ID NO: 3555 - protein, 9 aa, Homo sapiens
  light chain complementarity determining region 3 for antibody 1778
HQANSFPPT

SEQ ID NO: 3556 - protein, 15 aa, Homo sapiens
  heavy chain complementarity determining region 3 for antibody 1778
VRPITIFGENNWFDP

SEQ ID NO: 3557 - protein, 9 aa, Homo sapiens
  light chain complementarity determining region 3 for antibody 1779
HHFGSAPGT

SEQ ID NO: 3558 - protein, 13 aa, Homo sapiens
  heavy chain complementarity determining region 3 for antibody 1779
AKEGSSPGPDFEY

SEQ ID NO: 3559 - protein, 9 aa, Homo sapiens
  light chain complementarity determining region 3 for antibody 1780
AQGSYWPAS

SEQ ID NO: 3560 - protein, 12 aa, Homo sapiens
  heavy chain complementarity determining region 3 for antibody 1780
ARLDWNYRAFDI

SEQ ID NO: 3561 - protein, 10 aa, Homo sapiens
  light chain complementarity determining region 3 for antibody 1781
QQYYSSPPGA

SEQ ID NO: 3562 - protein, 16 aa, Homo sapiens
  heavy chain complementarity determining region 3 for antibody 1781
ASLNRGDKEFGVPPAL

SEQ ID NO: 3563 - protein, 9 aa, Homo sapiens
  light chain complementarity determining region 3 for antibody 1782
QQYYSSPFT

SEQ ID NO: 3564 - protein, 15 aa, Homo sapiens
  heavy chain complementarity determining region 3 for antibody 1782
ARGDYGGQIVGAFDL

SEQ ID NO: 3565 - protein, 9 aa, Homo sapiens
  light chain complementarity determining region 3 for antibody 1783
QQYYNSPLT

SEQ ID NO: 3566 - protein, 14 aa, Homo sapiens
  heavy chain complementarity determining region 3 for antibody 1783
AKARSGGVSFLIDY

SEQ ID NO: 3567 - protein, 7 aa, Homo sapiens
  light chain complementarity determining region 3 for antibody 1784
QQYNTWT

SEQ ID NO: 3568 - protein, 16 aa, Homo sapiens
  heavy chain complementarity determining region 3 for antibody 1784
SADLGDHVDYYATLDY

SEQ ID NO: 3569 - protein, 8 aa, Homo sapiens
  light chain complementarity determining region 3 for antibody 1785
QQYNTFST

SEQ ID NO: 3570 - protein, 19 aa, Homo sapiens
  heavy chain complementarity determining region 3 for antibody 1785
ARDCGGDCFSPRDWGIFDY

SEQ ID NO: 3571 - protein, 8 aa, Homo sapiens
  light chain complementarity determining region 3 for antibody 1786
QQYNSYWT

SEQ ID NO: 3572 - protein, 12 aa, Homo sapiens
  heavy chain complementarity determining region 3 for antibody 1786
AIVVPGRWDLDD

SEQ ID NO: 3573 - protein, 9 aa, Homo sapiens
  light chain complementarity determining region 3 for antibody 1787
QQYNSYPYT

SEQ ID NO: 3574 - protein, 10 aa, Homo sapiens
  heavy chain complementarity determining region 3 for antibody 1787
CRDREGFGDV

SEQ ID NO: 3575 - protein, 9 aa, Homo sapiens
  light chain complementarity determining region 3 for antibody 1788
QQYNSYPYT

SEQ ID NO: 3576 - protein, 12 aa, Homo sapiens
  heavy chain complementarity determining region 3 for antibody 1788
ARLDWNYRAFDI

SEQ ID NO: 3577 - protein, 10 aa, Homo sapiens
  light chain complementarity determining region 3 for antibody 1789
QQYNNWPPLT

SEQ ID NO: 3578 - protein, 13 aa, Homo sapiens
  heavy chain complementarity determining region 3 for antibody 1789
ARGRPELPEQIDH

SEQ ID NO: 3579 - protein, 9 aa, Homo sapiens
  light chain complementarity determining region 3 for antibody 1790
QQYNDWPGG

SEQ ID NO: 3580 - protein, 10 aa, Homo sapiens
  heavy chain complementarity determining region 3 for antibody 1790
ARAGWHQVDY

SEQ ID NO: 3581 - protein, 8 aa, Homo sapiens
  light chain complementarity determining region 3 for antibody 1791
QQYKSYWT

SEQ ID NO: 3582 - protein, 10 aa, Homo sapiens
  heavy chain complementarity determining region 3 for antibody 1791
ARERSSSYDI

SEQ ID NO: 3583 - protein, 9 aa, Homo sapiens
  light chain complementarity determining region 3 for antibody 1792
QQYKSAPFT

SEQ ID NO: 3584 - protein, 13 aa, Homo sapiens
  heavy chain complementarity determining region 3 for antibody 1792
AKEGSSPGPDFEY

SEQ ID NO: 3585 - protein, 8 aa, Homo sapiens
  light chain complementarity determining region 3 for antibody 1793
QQYHYQVS

SEQ ID NO: 3586 - protein, 6 aa, Homo sapiens
  heavy chain complementarity determining region 3 for antibody 1793
ARHTGS

SEQ ID NO: 3587 - protein, 9 aa, Homo sapiens
  light chain complementarity determining region 3 for antibody 1794
QQYGTSPVP

SEQ ID NO: 3588 - protein, 13 aa, Homo sapiens
  heavy chain complementarity determining region 3 for antibody 1794
AKDRGSGWFAWGY

SEQ ID NO: 3589 - protein, 9 aa, Homo sapiens
  light chain complementarity determining region 3 for antibody 1795
QQYGSSPIT

SEQ ID NO: 3590 - protein, 13 aa, Homo sapiens
  heavy chain complementarity determining region 3 for antibody 1795
AKEGSAPGPDFEY

SEQ ID NO: 3591 - protein, 9 aa, Homo sapiens
  light chain complementarity determining region 3 for antibody 1796
QQYFGAPYT

SEQ ID NO: 3592 - protein, 13 aa, Homo sapiens
  heavy chain complementarity determining region 3 for antibody 1796
VPGSGYHPELFQY

SEQ ID NO: 3593 - protein, 11 aa, Homo sapiens
  light chain complementarity determining region 3 for antibody 1797
QQYDNLPPMYT

SEQ ID NO: 3594 - protein, 11 aa, Homo sapiens
  heavy chain complementarity determining region 3 for antibody 1797
TRGGYSVGYDY

SEQ ID NO: 3595 - protein, 10 aa, Homo sapiens
  light chain complementarity determining region 3 for antibody 1798
QQYDNLASLP

SEQ ID NO: 3596 - protein, 13 aa, Homo sapiens
  heavy chain complementarity determining region 3 for antibody 1798
AKEGSSPGPDFEY

SEQ ID NO: 3597 - protein, 10 aa, Homo sapiens
  light chain complementarity determining region 3 for antibody 1799
QQYDISPPGT

SEQ ID NO: 3598 - protein, 16 aa, Homo sapiens
  heavy chain complementarity determining region 3 for antibody 1799
ASPNTLGRLVGVAFDY

SEQ ID NO: 3599 - protein, 9 aa, Homo sapiens
  light chain complementarity determining region 3 for antibody 1800
QQSYTMPRT

SEQ ID NO: 3600 - protein, 18 aa, Homo sapiens
  heavy chain complementarity determining region 3 for antibody 1800
TTVLSQLLAGDWHLYCQH

SEQ ID NO: 3601 - protein, 9 aa, Homo sapiens
  light chain complementarity determining region 3 for antibody 1801
QQSYSTPWT

SEQ ID NO: 3602 - protein, 15 aa, Homo sapiens
  heavy chain complementarity determining region 3 for antibody 1801
ARIWTSSKGVRYFDH

SEQ ID NO: 3603 - protein, 10 aa, Homo sapiens
  light chain complementarity determining region 3 for antibody 1802
QQSYSTPPDT

SEQ ID NO: 3604 - protein, 14 aa, Homo sapiens
  heavy chain complementarity determining region 3 for antibody 1802
ARVDGGGGVPHYDY

SEQ ID NO: 3605 - protein, 9 aa, Homo sapiens
  light chain complementarity determining region 3 for antibody 1803
QQSYSGPPA

SEQ ID NO: 3606 - protein, 21 aa, Homo sapiens
  heavy chain complementarity determining region 3 for antibody 1803
ARPLRVGLRLVLMWHSPRTDY

SEQ ID NO: 3607 - protein, 9 aa, Homo sapiens
  light chain complementarity determining region 3 for antibody 1804
QQSYNTPFT

SEQ ID NO: 3608 - protein, 15 aa, Homo sapiens
  heavy chain complementarity determining region 3 for antibody 1804
ARVRSSGGHYYGMDV

SEQ ID NO: 3609 - protein, 8 aa, Homo sapiens
  light chain complementarity determining region 3 for antibody 1805
QQSFSSPT

SEQ ID NO: 3610 - protein, 12 aa, Homo sapiens
  heavy chain complementarity determining region 3 for antibody 1805
ARWRWLQSEFDY

SEQ ID NO: 3611 - protein, 9 aa, Homo sapiens
  light chain complementarity determining region 3 for antibody 1806
QQRSNWPPT

SEQ ID NO: 3612 - protein, 15 aa, Homo sapiens
  heavy chain complementarity determining region 3 for antibody 1806
ARAGRGYKYGSAFDI

SEQ ID NO: 3613 - protein, 10 aa, Homo sapiens
  light chain complementarity determining region 3 for antibody 1807
QQRSNWPPLT

SEQ ID NO: 3614 - protein, 17 aa, Homo sapiens
  heavy chain complementarity determining region 3 for antibody 1807
ARNTMVGTWQRQGNLDH

SEQ ID NO: 3615 - protein, 10 aa, Homo sapiens
  light chain complementarity determining region 3 for antibody 1808
QQRSNWPALT

SEQ ID NO: 3616 - protein, 20 aa, Homo sapiens
  heavy chain complementarity determining region 3 for antibody 1808
ARQGRSDYLGPPHYYYYMDV

SEQ ID NO: 3617 - protein, 11 aa, Homo sapiens
  light chain complementarity determining region 3 for antibody 1809
QQLNLYPRGFT

SEQ ID NO: 3618 - protein, 11 aa, Homo sapiens
  heavy chain complementarity determining region 3 for antibody 1809
AREQHGQAPDY

SEQ ID NO: 3619 - protein, 9 aa, Homo sapiens
  light chain complementarity determining region 3 for antibody 1810
QQLKSYPLT

SEQ ID NO: 3620 - protein, 13 aa, Homo sapiens
  heavy chain complementarity determining region 3 for antibody 1810
ARDRKNGGFDHDY

SEQ ID NO: 3621 - protein, 9 aa, Homo sapiens
  light chain complementarity determining region 3 for antibody 1811
QQLKSYPLT

SEQ ID NO: 3622 - protein, 19 aa, Homo sapiens
  heavy chain complementarity determining region 3 for antibody 1811
AKGLYFYDSSGYNCEYLQD

SEQ ID NO: 3623 - protein, 10 aa, Homo sapiens
  light chain complementarity determining region 3 for antibody 1812
QQANSFPRLT

SEQ ID NO: 3624 - protein, 15 aa, Homo sapiens
  heavy chain complementarity determining region 3 for antibody 1812
AKVDCSSPNCYFVDS

SEQ ID NO: 3625 - protein, 9 aa, Homo sapiens
  light chain complementarity determining region 3 for antibody 1813
QKYDIIPWT

SEQ ID NO: 3626 - protein, 14 aa, Homo sapiens
  heavy chain complementarity determining region 3 for antibody 1813
ANYRASIGANCFDP

SEQ ID NO: 3627 - protein, 9 aa, Homo sapiens
  light chain complementarity determining region 3 for antibody 1814
QHYNNYPWT

SEQ ID NO: 3628 - protein, 12 aa, Homo sapiens
  heavy chain complementarity determining region 3 for antibody 1814
AKDRGRGRYFQH

SEQ ID NO: 3629 - protein, 9 aa, Homo sapiens
  light chain complementarity determining region 3 for antibody 1815
QHYNDWWWT

SEQ ID NO: 3630 - protein, 13 aa, Homo sapiens
  heavy chain complementarity determining region 3 for antibody 1815
AKEGSSPGPDFEY

SEQ ID NO: 3631 - protein, 8 aa, Homo sapiens
  light chain complementarity determining region 3 for antibody 1816
QHRVNGPT

SEQ ID NO: 3632 - protein, 11 aa, Homo sapiens
  heavy chain complementarity determining region 3 for antibody 1816
AREQHGQAPDY

SEQ ID NO: 3633 - protein, 11 aa, Homo sapiens
  light chain complementarity determining region 3 for antibody 1817
QHRSNWPPGAT

SEQ ID NO: 3634 - protein, 13 aa, Homo sapiens
  heavy chain complementarity determining region 3 for antibody 1817
AKEGDSSRWAFDY

SEQ ID NO: 3635 - protein, 9 aa, Homo sapiens
  light chain complementarity determining region 3 for antibody 1818
QHHNTWWWT

SEQ ID NO: 3636 - protein, 10 aa, Homo sapiens
  heavy chain complementarity determining region 3 for antibody 1818
AQSSSGRFDN

SEQ ID NO: 3637 - protein, 8 aa, Homo sapiens
  light chain complementarity determining region 3 for antibody 1819
QESFRLYT

SEQ ID NO: 3638 - protein, 19 aa, Homo sapiens
  heavy chain complementarity determining region 3 for antibody 1819
ARREAYFSGAPTHYYYFDY

SEQ ID NO: 3639 - protein, 9 aa, Homo sapiens
  light chain complementarity determining region 3 for antibody 1820
MQTLQTPWT

SEQ ID NO: 3640 - protein, 12 aa, Homo sapiens
  heavy chain complementarity determining region 3 for antibody 1820
ARLDWNYRALDI

SEQ ID NO: 3641 - protein, 9 aa, Homo sapiens
  light chain complementarity determining region 3 for antibody 1821
MQTLQTPWA

SEQ ID NO: 3642 - protein, 12 aa, Homo sapiens
  heavy chain complementarity determining region 3 for antibody 1821
ARLDWNYRAFDI

SEQ ID NO: 3643 - protein, 9 aa, Homo sapiens
  light chain complementarity determining region 3 for antibody 1822
MQTLQTPVT

SEQ ID NO: 3644 - protein, 16 aa, Homo sapiens
  heavy chain complementarity determining region 3 for antibody 1822
ATDSFSLTSAVGHTDH

SEQ ID NO: 3645 - protein, 9 aa, Homo sapiens
  light chain complementarity determining region 3 for antibody 1823
MQTLQIPPT

SEQ ID NO: 3646 - protein, 14 aa, Homo sapiens
  heavy chain complementarity determining region 3 for antibody 1823
AKARYTAGWHVFDS

SEQ ID NO: 3647 - protein, 10 aa, Homo sapiens
  light chain complementarity determining region 3 for antibody 1824
MQGTYWPPIT

SEQ ID NO: 3648 - protein, 11 aa, Homo sapiens
  heavy chain complementarity determining region 3 for antibody 1824
AGGGAGTKVDS

SEQ ID NO: 3649 - protein, 9 aa, Homo sapiens
  light chain complementarity determining region 3 for antibody 1825
MQGRHWPYT

SEQ ID NO: 3650 - protein, 11 aa, Homo sapiens
  heavy chain complementarity determining region 3 for antibody 1825
ATTVTTWLLDS

SEQ ID NO: 3651 - protein, 9 aa, Homo sapiens
  light chain complementarity determining region 3 for antibody 1826
MQGLQIPWT

SEQ ID NO: 3652 - protein, 10 aa, Homo sapiens
  heavy chain complementarity determining region 3 for antibody 1826
ARGPYWGLDY

SEQ ID NO: 3653 - protein, 10 aa, Homo sapiens
  light chain complementarity determining region 3 for antibody 1827
LQYNNWPPRT

SEQ ID NO: 3654 - protein, 19 aa, Homo sapiens
  heavy chain complementarity determining region 3 for antibody 1827
VHPTQHCSGTFCKLPIFDY

SEQ ID NO: 3655 - protein, 9 aa, Homo sapiens
  light chain complementarity determining region 3 for antibody 1828
LQYAHWPPT

SEQ ID NO: 3656 - protein, 15 aa, Homo sapiens
  heavy chain complementarity determining region 3 for antibody 1828
ARVGRPYHNAWYFDN

SEQ ID NO: 3657 - protein, 9 aa, Homo sapiens
  light chain complementarity determining region 3 for antibody 1829
LQHNSYPLT

SEQ ID NO: 3658 - protein, 11 aa, Homo sapiens
  heavy chain complementarity determining region 3 for antibody 1829
VRGSTGWNFDY

SEQ ID NO: 3659 - protein, 9 aa, Homo sapiens
  light chain complementarity determining region 3 for antibody 1830
LQHNSYPLT

SEQ ID NO: 3660 - protein, 10 aa, Homo sapiens
  heavy chain complementarity determining region 3 for antibody 1830
CRERWGFGDV

SEQ ID NO: 3661 - protein, 9 aa, Homo sapiens
  light chain complementarity determining region 3 for antibody 1831
LQHNSYPLT

SEQ ID NO: 3662 - protein, 10 aa, Homo sapiens
  heavy chain complementarity determining region 3 for antibody 1831
AKYLARAFDV

SEQ ID NO: 3663 - protein, 9 aa, Homo sapiens
  light chain complementarity determining region 3 for antibody 1832
LQHNSSPLT

SEQ ID NO: 3664 - protein, 11 aa, Homo sapiens
  heavy chain complementarity determining region 3 for antibody 1832
VRVSTGWNFDY

SEQ ID NO: 3665 - protein, 9 aa, Homo sapiens
  light chain complementarity determining region 3 for antibody 1833
LQHNSHPLT

SEQ ID NO: 3666 - protein, 11 aa, Homo sapiens
  heavy chain complementarity determining region 3 for antibody 1833
VRVSTGWNFDY

SEQ ID NO: 3667 - protein, 9 aa, Homo sapiens
  light chain complementarity determining region 3 for antibody 1834
LQHNNYPLS

SEQ ID NO: 3668 - protein, 17 aa, Homo sapiens
  heavy chain complementarity determining region 3 for antibody 1834
ARNTMVGTWQRQGNLDH

SEQ ID NO: 3669 - protein, 9 aa, Homo sapiens
  light chain complementarity determining region 3 for antibody 1835
LQHDSFPWT

SEQ ID NO: 3670 - protein, 14 aa, Homo sapiens
  heavy chain complementarity determining region 3 for antibody 1835
VRIARYNAYDANDF

SEQ ID NO: 3671 - protein, 9 aa, Homo sapiens
  light chain complementarity determining region 3 for antibody 1836
LQDHKYPFT

SEQ ID NO: 3672 - protein, 16 aa, Homo sapiens
  heavy chain complementarity determining region 3 for antibody 1836
AADLGDHTDAYAALDN

SEQ ID NO: 3673 - protein, 10 aa, Homo sapiens
  light chain complementarity determining region 3 for antibody 1837
HQYYSWPPYT

SEQ ID NO: 3674 - protein, 20 aa, Homo sapiens
  heavy chain complementarity determining region 3 for antibody 1837
ATRSPYDSGGYDVFSAAIEI

SEQ ID NO: 3675 - protein, 9 aa, Homo sapiens
  light chain complementarity determining region 3 for antibody 1838
HQYATTPWT

SEQ ID NO: 3676 - protein, 11 aa, Homo sapiens
  heavy chain complementarity determining region 3 for antibody 1838
ARGRDQSKLGY

SEQ ID NO: 3677 - protein, 9 aa, Homo sapiens
  light chain complementarity determining region 3 for antibody 1839
HQYASTPWT

SEQ ID NO: 3678 - protein, 11 aa, Homo sapiens
  heavy chain complementarity determining region 3 for antibody 1839
ARGRDQSKLGY

SEQ ID NO: 3679 - protein, 9 aa, Homo sapiens
  light chain complementarity determining region 3 for antibody 1840
QWHGSSPYT

SEQ ID NO: 3680 - protein, 7 aa, Homo sapiens
  heavy chain complementarity determining region 3 for antibody 1840
TSSGFVS

SEQ ID NO: 3681 - protein, 9 aa, Homo sapiens
  light chain complementarity determining region 3 for antibody 1841
QVFHNSYYT

SEQ ID NO: 3682 - protein, 10 aa, Homo sapiens
  heavy chain complementarity determining region 3 for antibody 1841
AKNRGYAQGD

SEQ ID NO: 3683 - protein, 9 aa, Homo sapiens
  light chain complementarity determining region 3 for antibody 1842
QQYYSVPYT

SEQ ID NO: 3684 - protein, 13 aa, Homo sapiens
  heavy chain complementarity determining region 3 for antibody 1842
TREGDSSGPDFHL

SEQ ID NO: 3685 - protein, 10 aa, Homo sapiens
  light chain complementarity determining region 3 for antibody 1843
QQYYSSPPWA

SEQ ID NO: 3686 - protein, 10 aa, Homo sapiens
  heavy chain complementarity determining region 3 for antibody 1843
ARESSGAYDI

SEQ ID NO: 3687 - protein, 9 aa, Homo sapiens
  light chain complementarity determining region 3 for antibody 1844
QQYYSFPPT

SEQ ID NO: 3688 - protein, 13 aa, Homo sapiens
  heavy chain complementarity determining region 3 for antibody 1844
ATGAPSSGSLFDN

SEQ ID NO: 3689 - protein, 9 aa, Homo sapiens
  light chain complementarity determining region 3 for antibody 1845
QQYYSAPLT

SEQ ID NO: 3690 - protein, 13 aa, Homo sapiens
  heavy chain complementarity determining region 3 for antibody 1845
ARGRASGSFLIDY

SEQ ID NO: 3691 - protein, 9 aa, Homo sapiens
  light chain complementarity determining region 3 for antibody 1846
QQYYNTFPT

SEQ ID NO: 3692 - protein, 12 aa, Homo sapiens
  heavy chain complementarity determining region 3 for antibody 1846
ARGGASSKFFDY

SEQ ID NO: 3693 - protein, 10 aa, Homo sapiens
  light chain complementarity determining region 3 for antibody 1847
QQYYNRPPNT

SEQ ID NO: 3694 - protein, 17 aa, Homo sapiens
  heavy chain complementarity determining region 3 for antibody 1847
ATTERYYDRSGYHPFEY

SEQ ID NO: 3695 - protein, 9 aa, Homo sapiens
  light chain complementarity determining region 3 for antibody 1848
QQYSVSPIT

SEQ ID NO: 3696 - protein, 8 aa, Homo sapiens
  heavy chain complementarity determining region 3 for antibody 1848
ARRNDFDH

SEQ ID NO: 3697 - protein, 7 aa, Homo sapiens
  light chain complementarity determining region 3 for antibody 1849
QQYSTWT

SEQ ID NO: 3698 - protein, 12 aa, Homo sapiens
  heavy chain complementarity determining region 3 for antibody 1849
ARDKGGRNGMDV

SEQ ID NO: 3699 - protein, 7 aa, Homo sapiens
  light chain complementarity determining region 3 for antibody 1850
QQYNTWT

SEQ ID NO: 3700 - protein, 12 aa, Homo sapiens
  heavy chain complementarity determining region 3 for antibody 1850
ARDKGGRNGIDV

SEQ ID NO: 3701 - protein, 7 aa, Homo sapiens
  light chain complementarity determining region 3 for antibody 1851
QQYNTWT

SEQ ID NO: 3702 - protein, 12 aa, Homo sapiens
  heavy chain complementarity determining region 3 for antibody 1851
ALDEWHPSWYKY

SEQ ID NO: 3703 - protein, 10 aa, Homo sapiens
  light chain complementarity determining region 3 for antibody 1852
QQYNSYSGYT

SEQ ID NO: 3704 - protein, 10 aa, Homo sapiens
  heavy chain complementarity determining region 3 for antibody 1852
ARETSGSYDI

SEQ ID NO: 3705 - protein, 8 aa, Homo sapiens
  light chain complementarity determining region 3 for antibody 1853
QQYNSYSA

SEQ ID NO: 3706 - protein, 12 aa, Homo sapiens
  heavy chain complementarity determining region 3 for antibody 1853
ARLDWNYRAFDI

SEQ ID NO: 3707 - protein, 9 aa, Homo sapiens
  light chain complementarity determining region 3 for antibody 1854
QQYNSYRGT

SEQ ID NO: 3708 - protein, 18 aa, Homo sapiens
  heavy chain complementarity determining region 3 for antibody 1854
AKQAPGYYHNEETRQFDC

SEQ ID NO: 3709 - protein, 9 aa, Homo sapiens
  light chain complementarity determining region 3 for antibody 1855
QQYNSYPWT

SEQ ID NO: 3710 - protein, 9 aa, Homo sapiens
  heavy chain complementarity determining region 3 for antibody 1855
ARDFWGSPQ

SEQ ID NO: 3711 - protein, 10 aa, Homo sapiens
  light chain complementarity determining region 3 for antibody 1856
QQYNNWPPIT

SEQ ID NO: 3712 - protein, 12 aa, Homo sapiens
  heavy chain complementarity determining region 3 for antibody 1856
ARAYGVSHPFDY

SEQ ID NO: 3713 - protein, 9 aa, Homo sapiens
  light chain complementarity determining region 3 for antibody 1857
QQYKIYPWT

SEQ ID NO: 3714 - protein, 10 aa, Homo sapiens
  heavy chain complementarity determining region 3 for antibody 1857
ARETSGSYDV

SEQ ID NO: 3715 - protein, 9 aa, Homo sapiens
  light chain complementarity determining region 3 for antibody 1858
QQYIQWPLT

SEQ ID NO: 3716 - protein, 17 aa, Homo sapiens
  heavy chain complementarity determining region 3 for antibody 1858
ARVGCPTSNRCSNYFDP

SEQ ID NO: 3717 - protein, 9 aa, Homo sapiens
  light chain complementarity determining region 3 for antibody 1859
QQYHSTPWT

SEQ ID NO: 3718 - protein, 11 aa, Homo sapiens
  heavy chain complementarity determining region 3 for antibody 1859
ATGQDNAKTGY

SEQ ID NO: 3719 - protein, 9 aa, Homo sapiens
  light chain complementarity determining region 3 for antibody 1860
QQYHNWPGT

SEQ ID NO: 3720 - protein, 11 aa, Homo sapiens
  heavy chain complementarity determining region 3 for antibody 1860
AKGGFYFLPGD

SEQ ID NO: 3721 - protein, 8 aa, Homo sapiens
  light chain complementarity determining region 3 for antibody 1861
QQYGYSHT

SEQ ID NO: 3722 - protein, 15 aa, Homo sapiens
  heavy chain complementarity determining region 3 for antibody 1861
ARGILAAGGWYYFDY

SEQ ID NO: 3723 - protein, 10 aa, Homo sapiens
  light chain complementarity determining region 3 for antibody 1862
QQYGNSPSVT

SEQ ID NO: 3724 - protein, 18 aa, Homo sapiens
  heavy chain complementarity determining region 3 for antibody 1862
ATPQKYYDAWKGFPPFDY

SEQ ID NO: 3725 - protein, 8 aa, Homo sapiens
  light chain complementarity determining region 3 for antibody 1863
QQYFTYWT

SEQ ID NO: 3726 - protein, 14 aa, Homo sapiens
  heavy chain complementarity determining region 3 for antibody 1863
ARGGDGDNGLPFDY

SEQ ID NO: 3727 - protein, 9 aa, Homo sapiens
  light chain complementarity determining region 3 for antibody 1864
QQYDNLPLT

SEQ ID NO: 3728 - protein, 9 aa, Homo sapiens
  heavy chain complementarity determining region 3 for antibody 1864
VRGRNNFRY

SEQ ID NO: 3729 - protein, 9 aa, Homo sapiens
  light chain complementarity determining region 3 for antibody 1865
QQSYSTPQT

SEQ ID NO: 3730 - protein, 17 aa, Homo sapiens
  heavy chain complementarity determining region 3 for antibody 1865
ARNTMVGTWQRQGNLDH

SEQ ID NO: 3731 - protein, 10 aa, Homo sapiens
  light chain complementarity determining region 3 for antibody 1866
QQSYSTPPST

SEQ ID NO: 3732 - protein, 13 aa, Homo sapiens
  heavy chain complementarity determining region 3 for antibody 1866
TKVAAGTSLDFDY

SEQ ID NO: 3733 - protein, 10 aa, Homo sapiens
  light chain complementarity determining region 3 for antibody 1867
QQSYSTLTWT

SEQ ID NO: 3734 - protein, 11 aa, Homo sapiens
  heavy chain complementarity determining region 3 for antibody 1867
AGSSGYYTIDN

SEQ ID NO: 3735 - protein, 9 aa, Homo sapiens
  light chain complementarity determining region 3 for antibody 1868
QQSLTYPPT

SEQ ID NO: 3736 - protein, 13 aa, Homo sapiens
  heavy chain complementarity determining region 3 for antibody 1868
TRYGAAPNTNRDY

SEQ ID NO: 3737 - protein, 9 aa, Homo sapiens
  light chain complementarity determining region 3 for antibody 1869
QQDYYTPRK

SEQ ID NO: 3738 - protein, 11 aa, Homo sapiens
  heavy chain complementarity determining region 3 for antibody 1869
ARRSLGGAFDY

SEQ ID NO: 3739 - protein, 9 aa, Homo sapiens
  light chain complementarity determining region 3 for antibody 1870
QQCGSSPLT

SEQ ID NO: 3740 - protein, 19 aa, Homo sapiens
  heavy chain complementarity determining region 3 for antibody 1870
ASWAGYCPSANCHTTTFDY

SEQ ID NO: 3741 - protein, 9 aa, Homo sapiens
  light chain complementarity determining region 3 for antibody 1871
QQANSFPPT

SEQ ID NO: 3742 - protein, 15 aa, Homo sapiens
  heavy chain complementarity determining region 3 for antibody 1871
IRPITIFGVVNWFDP

SEQ ID NO: 3743 - protein, 9 aa, Homo sapiens
  light chain complementarity determining region 3 for antibody 1872
QNYNTAPFT

SEQ ID NO: 3744 - protein, 17 aa, Homo sapiens
  heavy chain complementarity determining region 3 for antibody 1872
ARQSLYSSGWYVGWFDP

SEQ ID NO: 3745 - protein, 9 aa, Homo sapiens
  light chain complementarity determining region 3 for antibody 1873
QLSGSSLLT

SEQ ID NO: 3746 - protein, 6 aa, Homo sapiens
  heavy chain complementarity determining region 3 for antibody 1873
TTGYHA

SEQ ID NO: 3747 - protein, 9 aa, Homo sapiens
  light chain complementarity determining region 3 for antibody 1874
QKYGSSPVP

SEQ ID NO: 3748 - protein, 18 aa, Homo sapiens
  heavy chain complementarity determining region 3 for antibody 1874
ARGDCPEARTGYFLDFDY

SEQ ID NO: 3749 - protein, 10 aa, Homo sapiens
  light chain complementarity determining region 3 for antibody 1875
QHYGGSPAFT

SEQ ID NO: 3750 - protein, 17 aa, Homo sapiens
  heavy chain complementarity determining region 3 for antibody 1875
ARGPFYGGNSEERCFDY

SEQ ID NO: 3751 - protein, 9 aa, Homo sapiens
  light chain complementarity determining region 3 for antibody 1876
QHYESYPYT

SEQ ID NO: 3752 - protein, 9 aa, Homo sapiens
  heavy chain complementarity determining region 3 for antibody 1876
ARFWTYGRK

SEQ ID NO: 3753 - protein, 11 aa, Homo sapiens
  light chain complementarity determining region 3 for antibody 1877
QHYDSSPPLLT

SEQ ID NO: 3754 - protein, 19 aa, Homo sapiens
  heavy chain complementarity determining region 3 for antibody 1877
ATAIKDFWSGYYVYWYFDL

SEQ ID NO: 3755 - protein, 9 aa, Homo sapiens
  light chain complementarity determining region 3 for antibody 1878
QEYSSYPWT

SEQ ID NO: 3756 - protein, 17 aa, Homo sapiens
  heavy chain complementarity determining region 3 for antibody 1878
ARDATQLYDFWSGPIDS

SEQ ID NO: 3757 - protein, 9 aa, Homo sapiens
  light chain complementarity determining region 3 for antibody 1879
MQTLQTPWT

SEQ ID NO: 3758 - protein, 12 aa, Homo sapiens
  heavy chain complementarity determining region 3 for antibody 1879
ARLGWNYRAFDI

SEQ ID NO: 3759 - protein, 9 aa, Homo sapiens
  light chain complementarity determining region 3 for antibody 1880
MQTLQTPVT

SEQ ID NO: 3760 - protein, 15 aa, Homo sapiens
  heavy chain complementarity determining region 3 for antibody 1880
ARIWTSSTNCRYMDV

SEQ ID NO: 3761 - protein, 9 aa, Homo sapiens
  light chain complementarity determining region 3 for antibody 1881
MQSTHWPYT

SEQ ID NO: 3762 - protein, 14 aa, Homo sapiens
  heavy chain complementarity determining region 3 for antibody 1881
VRDSYFDWPASGDY

SEQ ID NO: 3763 - protein, 10 aa, Homo sapiens
  light chain complementarity determining region 3 for antibody 1882
MQPFHTPIFT

SEQ ID NO: 3764 - protein, 14 aa, Homo sapiens
  heavy chain complementarity determining region 3 for antibody 1882
VRPFWSGYYDSFEM

SEQ ID NO: 3765 - protein, 9 aa, Homo sapiens
  light chain complementarity determining region 3 for antibody 1883
MQGTHWPPS

SEQ ID NO: 3766 - protein, 15 aa, Homo sapiens
  heavy chain complementarity determining region 3 for antibody 1883
TTSRTASAWYNAFDI

SEQ ID NO: 3767 - protein, 9 aa, Homo sapiens
  light chain complementarity determining region 3 for antibody 1884
MQGTHWPIT

SEQ ID NO: 3768 - protein, 10 aa, Homo sapiens
  heavy chain complementarity determining region 3 for antibody 1884
ARDTSRHMDV

SEQ ID NO: 3769 - protein, 9 aa, Homo sapiens
  light chain complementarity determining region 3 for antibody 1885
MQGLQSPVT

SEQ ID NO: 3770 - protein, 12 aa, Homo sapiens
  heavy chain complementarity determining region 3 for antibody 1885
ARHLQWLVGLEY

SEQ ID NO: 3771 - protein, 10 aa, Homo sapiens
  light chain complementarity determining region 3 for antibody 1886
MQALQTPLIT

SEQ ID NO: 3772 - protein, 15 aa, Homo sapiens
  heavy chain complementarity determining region 3 for antibody 1886
VRGFSGFDSYFGMDV

SEQ ID NO: 3773 - protein, 9 aa, Homo sapiens
  light chain complementarity determining region 3 for antibody 1887
LQYTHWPHT

SEQ ID NO: 3774 - protein, 9 aa, Homo sapiens
  heavy chain complementarity determining region 3 for antibody 1887
ATWGGNSNY

SEQ ID NO: 3775 - protein, 10 aa, Homo sapiens
  light chain complementarity determining region 3 for antibody 1888
LQYGNSPLWT

SEQ ID NO: 3776 - protein, 10 aa, Homo sapiens
  heavy chain complementarity determining region 3 for antibody 1888
ARETEKIFVF

SEQ ID NO: 3777 - protein, 9 aa, Homo sapiens
  light chain complementarity determining region 3 for antibody 1889
LQHSSDPRT

SEQ ID NO: 3778 - protein, 14 aa, Homo sapiens
  heavy chain complementarity determining region 3 for antibody 1889
ARDPSFGVTGAFDT

SEQ ID NO: 3779 - protein, 10 aa, Homo sapiens
  light chain complementarity determining region 3 for antibody 1890
LQHNTYPTWT

SEQ ID NO: 3780 - protein, 18 aa, Homo sapiens
  heavy chain complementarity determining region 3 for antibody 1890
ARDWRNYYESSGYPIFDL

SEQ ID NO: 3781 - protein, 9 aa, Homo sapiens
  light chain complementarity determining region 3 for antibody 1891
LQHNSYPLT

SEQ ID NO: 3782 - protein, 11 aa, Homo sapiens
  heavy chain complementarity determining region 3 for antibody 1891
VRVSTGRNFDY

SEQ ID NO: 3783 - protein, 9 aa, Homo sapiens
  light chain complementarity determining region 3 for antibody 1892
LQHNSYPLT

SEQ ID NO: 3784 - protein, 10 aa, Homo sapiens
  heavy chain complementarity determining region 3 for antibody 1892
ARGGLAGDVS

SEQ ID NO: 3785 - protein, 9 aa, Homo sapiens
  light chain complementarity determining region 3 for antibody 1893
LQDYNHAGT

SEQ ID NO: 3786 - protein, 9 aa, Homo sapiens
  heavy chain complementarity determining region 3 for antibody 1893
GSRRPYFDS

SEQ ID NO: 3787 - protein, 9 aa, Homo sapiens
  light chain complementarity determining region 3 for antibody 1894
LQDHIYPFS

SEQ ID NO: 3788 - protein, 16 aa, Homo sapiens
  heavy chain complementarity determining region 3 for antibody 1894
AADLGVHSDVYATLDD

SEQ ID NO: 3789 - protein, 11 aa, Homo sapiens
  light chain complementarity determining region 3 for antibody 1895
LHYDNLPPYLT

SEQ ID NO: 3790 - protein, 16 aa, Homo sapiens
  heavy chain complementarity determining region 3 for antibody 1895
AKCPASSSCFGLRLES

SEQ ID NO: 3791 - protein, 9 aa, Homo sapiens
  light chain complementarity determining region 3 for antibody 1896
HQYNDWPWT

SEQ ID NO: 3792 - protein, 16 aa, Homo sapiens
  heavy chain complementarity determining region 3 for antibody 1896
VKDQHFGQSLNGPFGS

SEQ ID NO: 3793 - protein, 10 aa, Homo sapiens
  light chain complementarity determining region 3 for antibody 1897
QRTYNAPPVT

SEQ ID NO: 3794 - protein, 12 aa, Homo sapiens
  heavy chain complementarity determining region 3 for antibody 1897
AIVVPGRWDLDD

SEQ ID NO: 3795 - protein, 9 aa, Homo sapiens
  light chain complementarity determining region 3 for antibody 1898
QRRGTWPST

SEQ ID NO: 3796 - protein, 11 aa, Homo sapiens
  heavy chain complementarity determining region 3 for antibody 1898
ARDLNIGYLDY

SEQ ID NO: 3797 - protein, 9 aa, Homo sapiens
  light chain complementarity determining region 3 for antibody 1899
QQYYTPPYT

SEQ ID NO: 3798 - protein, 10 aa, Homo sapiens
  heavy chain complementarity determining region 3 for antibody 1899
CRDHEGFGDV

SEQ ID NO: 3799 - protein, 9 aa, Homo sapiens
  light chain complementarity determining region 3 for antibody 1900
QQYYSFPPT

SEQ ID NO: 3800 - protein, 14 aa, Homo sapiens
  heavy chain complementarity determining region 3 for antibody 1900
ARPRSAKSTYYFDY

SEQ ID NO: 3801 - protein, 9 aa, Homo sapiens
  light chain complementarity determining region 3 for antibody 1901
QQYYSAPIT

SEQ ID NO: 3802 - protein, 14 aa, Homo sapiens
  heavy chain complementarity determining region 3 for antibody 1901
ARGESTSCDYIFDF

SEQ ID NO: 3803 - protein, 9 aa, Homo sapiens
  light chain complementarity determining region 3 for antibody 1902
QQYYKAPVT

SEQ ID NO: 3804 - protein, 17 aa, Homo sapiens
  heavy chain complementarity determining region 3 for antibody 1902
ASMRGWSDSYGFGVSEY

SEQ ID NO: 3805 - protein, 9 aa, Homo sapiens
  light chain complementarity determining region 3 for antibody 1903
QQYYGTPQT

SEQ ID NO: 3806 - protein, 14 aa, Homo sapiens
  heavy chain complementarity determining region 3 for antibody 1903
ARDLFSGSYLGDDY

SEQ ID NO: 3807 - protein, 8 aa, Homo sapiens
  light chain complementarity determining region 3 for antibody 1904
QQYTSPKT

SEQ ID NO: 3808 - protein, 14 aa, Homo sapiens
  heavy chain complementarity determining region 3 for antibody 1904
ARDNVHYGDYSLDL

SEQ ID NO: 3809 - protein, 10 aa, Homo sapiens
  light chain complementarity determining region 3 for antibody 1905
QQYRDWAPRT

SEQ ID NO: 3810 - protein, 10 aa, Homo sapiens
  heavy chain complementarity determining region 3 for antibody 1905
AREQNHFFEY

SEQ ID NO: 3811 - protein, 7 aa, Homo sapiens
  light chain complementarity determining region 3 for antibody 1906
QQYNTWT

SEQ ID NO: 3812 - protein, 16 aa, Homo sapiens
  heavy chain complementarity determining region 3 for antibody 1906
VRDLAGFTRGGSTFDY

SEQ ID NO: 3813 - protein, 8 aa, Homo sapiens
  light chain complementarity determining region 3 for antibody 1907
QQYNSYRT

SEQ ID NO: 3814 - protein, 11 aa, Homo sapiens
  heavy chain complementarity determining region 3 for antibody 1907
AREQHGQAPDY

SEQ ID NO: 3815 - protein, 9 aa, Homo sapiens
  light chain complementarity determining region 3 for antibody 1908
QQYKIYPWT

SEQ ID NO: 3816 - protein, 12 aa, Homo sapiens
  heavy chain complementarity determining region 3 for antibody 1908
AGSRSWGGSIDY

SEQ ID NO: 3817 - protein, 9 aa, Homo sapiens
  light chain complementarity determining region 3 for antibody 1909
QQYGSSPWT

SEQ ID NO: 3818 - protein, 12 aa, Homo sapiens
  heavy chain complementarity determining region 3 for antibody 1909
TRDPDTSSKVDY

SEQ ID NO: 3819 - protein, 9 aa, Homo sapiens
  light chain complementarity determining region 3 for antibody 1910
QQYGSSPWT

SEQ ID NO: 3820 - protein, 15 aa, Homo sapiens
  heavy chain complementarity determining region 3 for antibody 1910
ARRYIISGAFDSLDI

SEQ ID NO: 3821 - protein, 9 aa, Homo sapiens
  light chain complementarity determining region 3 for antibody 1911
QQYDSYPWT

SEQ ID NO: 3822 - protein, 14 aa, Homo sapiens
  heavy chain complementarity determining region 3 for antibody 1911
AREQDYGYYRTADY

SEQ ID NO: 3823 - protein, 9 aa, Homo sapiens
  light chain complementarity determining region 3 for antibody 1912
QQYDNLPIT

SEQ ID NO: 3824 - protein, 10 aa, Homo sapiens
  heavy chain complementarity determining region 3 for antibody 1912
CRDRRGFGDV

SEQ ID NO: 3825 - protein, 9 aa, Homo sapiens
  light chain complementarity determining region 3 for antibody 1913
QQSYSTPYT

SEQ ID NO: 3826 - protein, 16 aa, Homo sapiens
  heavy chain complementarity determining region 3 for antibody 1913
ARDHCSSSSCSNWFDP

SEQ ID NO: 3827 - protein, 9 aa, Homo sapiens
  light chain complementarity determining region 3 for antibody 1914
QQSYSTPWT

SEQ ID NO: 3828 - protein, 18 aa, Homo sapiens
  heavy chain complementarity determining region 3 for antibody 1914
ARDLGITLVQGVTTSFDY

SEQ ID NO: 3829 - protein, 9 aa, Homo sapiens
  light chain complementarity determining region 3 for antibody 1915
QQSYSTPLT

SEQ ID NO: 3830 - protein, 16 aa, Homo sapiens
  heavy chain complementarity determining region 3 for antibody 1915
VGEPKRSSGYDRFFEF

SEQ ID NO: 3831 - protein, 10 aa, Homo sapiens
  light chain complementarity determining region 3 for antibody 1916
QQSYSTPLFT

SEQ ID NO: 3832 - protein, 10 aa, Homo sapiens
  heavy chain complementarity determining region 3 for antibody 1916
CRDRWGFGDV

SEQ ID NO: 3833 - protein, 9 aa, Homo sapiens
  light chain complementarity determining region 3 for antibody 1917
QQSNNWPRT

SEQ ID NO: 3834 - protein, 14 aa, Homo sapiens
  heavy chain complementarity determining region 3 for antibody 1917
ATSPGYYESSPFDY

SEQ ID NO: 3835 - protein, 9 aa, Homo sapiens
  light chain complementarity determining region 3 for antibody 1918
QQRSNWPRT

SEQ ID NO: 3836 - protein, 9 aa, Homo sapiens
  heavy chain complementarity determining region 3 for antibody 1918
AKGWTACDS

SEQ ID NO: 3837 - protein, 11 aa, Homo sapiens
  light chain complementarity determining region 3 for antibody 1919
QQRNDWPPVYT

SEQ ID NO: 3838 - protein, 13 aa, Homo sapiens
  heavy chain complementarity determining region 3 for antibody 1919
ATLTVSTLWAFDY

SEQ ID NO: 3839 - protein, 9 aa, Homo sapiens
  light chain complementarity determining region 3 for antibody 1920
QQLNSYPYT

SEQ ID NO: 3840 - protein, 14 aa, Homo sapiens
  heavy chain complementarity determining region 3 for antibody 1920
ARGHFDSTGCRLDY

SEQ ID NO: 3841 - protein, 9 aa, Homo sapiens
  light chain complementarity determining region 3 for antibody 1921
QQLNSYPLT

SEQ ID NO: 3842 - protein, 23 aa, Homo sapiens
  heavy chain complementarity determining region 3 for antibody 1921
ARVPRSYFYDSSSQGGASRAFDI

SEQ ID NO: 3843 - protein, 10 aa, Homo sapiens
  light chain complementarity determining region 3 for antibody 1922
QQFGGSPPYS

SEQ ID NO: 3844 - protein, 11 aa, Homo sapiens
  heavy chain complementarity determining region 3 for antibody 1922
TAIGSSGDFRY

SEQ ID NO: 3845 - protein, 9 aa, Homo sapiens
  light chain complementarity determining region 3 for antibody 1923
QQFENLPIT

SEQ ID NO: 3846 - protein, 15 aa, Homo sapiens
  heavy chain complementarity determining region 3 for antibody 1923
ARGKDYDFWRGYPDY

SEQ ID NO: 3847 - protein, 10 aa, Homo sapiens
  light chain complementarity determining region 3 for antibody 1924
QQCSNWPALT

SEQ ID NO: 3848 - protein, 13 aa, Homo sapiens
  heavy chain complementarity determining region 3 for antibody 1924
AKEGSAPGPDFEY

SEQ ID NO: 3849 - protein, 9 aa, Homo sapiens
  light chain complementarity determining region 3 for antibody 1925
QKYYSAPFT

SEQ ID NO: 3850 - protein, 10 aa, Homo sapiens
  heavy chain complementarity determining region 3 for antibody 1925
VREGNWNLDY

SEQ ID NO: 3851 - protein, 9 aa, Homo sapiens
  light chain complementarity determining region 3 for antibody 1926
QKYNTPPFT

SEQ ID NO: 3852 - protein, 10 aa, Homo sapiens
  heavy chain complementarity determining region 3 for antibody 1926
ARGGLAGDND

SEQ ID NO: 3853 - protein, 8 aa, Homo sapiens
  light chain complementarity determining region 3 for antibody 1927
QHYQGYPA

SEQ ID NO: 3854 - protein, 12 aa, Homo sapiens
  heavy chain complementarity determining region 3 for antibody 1927
ARDFTANYCPDY

SEQ ID NO: 3855 - protein, 9 aa, Homo sapiens
  light chain complementarity determining region 3 for antibody 1928
QHFGGSPFT

SEQ ID NO: 3856 - protein, 11 aa, Homo sapiens
  heavy chain complementarity determining region 3 for antibody 1928
ASDTVFYGFNV

SEQ ID NO: 3857 - protein, 9 aa, Homo sapiens
  light chain complementarity determining region 3 for antibody 1929
QEYKNVPWT

SEQ ID NO: 3858 - protein, 20 aa, Homo sapiens
  heavy chain complementarity determining region 3 for antibody 1929
AKDGRGTAFYHGAGGGGLDV

SEQ ID NO: 3859 - protein, 9 aa, Homo sapiens
  light chain complementarity determining region 3 for antibody 1930
MQTLQTPVT

SEQ ID NO: 3860 - protein, 15 aa, Homo sapiens
  heavy chain complementarity determining region 3 for antibody 1930
ARRYIISGVFDSLDV

SEQ ID NO: 3861 - protein, 9 aa, Homo sapiens
  light chain complementarity determining region 3 for antibody 1931
MQGTHWPIT

SEQ ID NO: 3862 - protein, 13 aa, Homo sapiens
  heavy chain complementarity determining region 3 for antibody 1931
AKEGSSPGPDFDS

SEQ ID NO: 3863 - protein, 9 aa, Homo sapiens
  light chain complementarity determining region 3 for antibody 1932
MQGTHWPHT

SEQ ID NO: 3864 - protein, 11 aa, Homo sapiens
  heavy chain complementarity determining region 3 for antibody 1932
AREQHGQAPDY

SEQ ID NO: 3865 - protein, 9 aa, Homo sapiens
  light chain complementarity determining region 3 for antibody 1933
MQFLQPPLT

SEQ ID NO: 3866 - protein, 10 aa, Homo sapiens
  heavy chain complementarity determining region 3 for antibody 1933
ARERSGSYDI

SEQ ID NO: 3867 - protein, 9 aa, Homo sapiens
  light chain complementarity determining region 3 for antibody 1934
MQATHWPWT

SEQ ID NO: 3868 - protein, 13 aa, Homo sapiens
  heavy chain complementarity determining region 3 for antibody 1934
ARGHGPGSFLIDY

SEQ ID NO: 3869 - protein, 8 aa, Homo sapiens
  light chain complementarity determining region 3 for antibody 1935
MQALQGGT

SEQ ID NO: 3870 - protein, 17 aa, Homo sapiens
  heavy chain complementarity determining region 3 for antibody 1935
ARVTYCNGGTCSYGMDV

SEQ ID NO: 3871 - protein, 9 aa, Homo sapiens
  light chain complementarity determining region 3 for antibody 1936
LQHNSYPYT

SEQ ID NO: 3872 - protein, 13 aa, Homo sapiens
  heavy chain complementarity determining region 3 for antibody 1936
AKDDLVVPGAMES

SEQ ID NO: 3873 - protein, 9 aa, Homo sapiens
  light chain complementarity determining region 3 for antibody 1937
LQGVEAPFT

SEQ ID NO: 3874 - protein, 11 aa, Homo sapiens
  heavy chain complementarity determining region 3 for antibody 1937
GRDVDFSTPAF

SEQ ID NO: 3875 - protein, 9 aa, Homo sapiens
  light chain complementarity determining region 3 for antibody 1938
LQFAHWPPT

SEQ ID NO: 3876 - protein, 9 aa, Homo sapiens
  heavy chain complementarity determining region 3 for antibody 1938
AGWGGLSNY

SEQ ID NO: 3877 - protein, 9 aa, Homo sapiens
  light chain complementarity determining region 3 for antibody 1939
LQDYNHSAV

SEQ ID NO: 3878 - protein, 12 aa, Homo sapiens
  heavy chain complementarity determining region 3 for antibody 1939
ARGHIIGYKGDY

SEQ ID NO: 3879 - protein, 9 aa, Homo sapiens
  light chain complementarity determining region 3 for antibody 1940
LQDHNYPFT

SEQ ID NO: 3880 - protein, 16 aa, Homo sapiens
  heavy chain complementarity determining region 3 for antibody 1940
AADLGDHSDVYATLDS

SEQ ID NO: 3881 - protein, 9 aa, Homo sapiens
  light chain complementarity determining region 3 for antibody 1941
LQATQWPLT

SEQ ID NO: 3882 - protein, 13 aa, Homo sapiens
  heavy chain complementarity determining region 3 for antibody 1941
TREGDSSGPDFHH

SEQ ID NO: 3883 - protein, 9 aa, Homo sapiens
  light chain complementarity determining region 3 for antibody 1942
HQSAKSPRT

SEQ ID NO: 3884 - protein, 17 aa, Homo sapiens
  heavy chain complementarity determining region 3 for antibody 1942
AKGTGYFDNTGDDAFDS

SEQ ID NO: 3885 - protein, 9 aa, Homo sapiens
  light chain complementarity determining region 3 for antibody 1943
GQGSYWPAS

SEQ ID NO: 3886 - protein, 10 aa, Homo sapiens
  heavy chain complementarity determining region 3 for antibody 1943
CRDREGFGDV

SEQ ID NO: 3887 - protein, 9 aa, Homo sapiens
  light chain complementarity determining region 3 for antibody 1944
FQYSHRPHT

SEQ ID NO: 3888 - protein, 9 aa, Homo sapiens
  heavy chain complementarity determining region 3 for antibody 1944
AAWGGTSNY

SEQ ID NO: 3889 - protein, 9 aa, Homo sapiens
  light chain complementarity determining region 3 for antibody 1945
VQGVHWPWT

SEQ ID NO: 3890 - protein, 13 aa, Homo sapiens
  heavy chain complementarity determining region 3 for antibody 1945
ARLDNTVPGVIDY

SEQ ID NO: 3891 - protein, 9 aa, Homo sapiens
  light chain complementarity determining region 3 for antibody 1946
TQTTHWPWT

SEQ ID NO: 3892 - protein, 11 aa, Homo sapiens
  heavy chain complementarity determining region 3 for antibody 1946
TRDLSGSAAGY

SEQ ID NO: 3893 - protein, 9 aa, Homo sapiens
  light chain complementarity determining region 3 for antibody 1947
QQYYSTPIT

SEQ ID NO: 3894 - protein, 18 aa, Homo sapiens
  heavy chain complementarity determining region 3 for antibody 1947
ARDISAHSLGGTRGAFDI

SEQ ID NO: 3895 - protein, 9 aa, Homo sapiens
  light chain complementarity determining region 3 for antibody 1948
QQYYSNSPT

SEQ ID NO: 3896 - protein, 12 aa, Homo sapiens
  heavy chain complementarity determining region 3 for antibody 1948
AREGQQLVPIDY

SEQ ID NO: 3897 - protein, 9 aa, Homo sapiens
  light chain complementarity determining region 3 for antibody 1949
QQYYSNPHT

SEQ ID NO: 3898 - protein, 17 aa, Homo sapiens
  heavy chain complementarity determining region 3 for antibody 1949
VKDNSRLQGYTYDAFDI

SEQ ID NO: 3899 - protein, 9 aa, Homo sapiens
  light chain complementarity determining region 3 for antibody 1950
QQYYSAPIT

SEQ ID NO: 3900 - protein, 14 aa, Homo sapiens
  heavy chain complementarity determining region 3 for antibody 1950
AKGESTSCDYIIDY

SEQ ID NO: 3901 - protein, 9 aa, Homo sapiens
  light chain complementarity determining region 3 for antibody 1951
QQYYRSPLT

SEQ ID NO: 3902 - protein, 14 aa, Homo sapiens
  heavy chain complementarity determining region 3 for antibody 1951
ARHNQGVVMREFDS

SEQ ID NO: 3903 - protein, 9 aa, Homo sapiens
  light chain complementarity determining region 3 for antibody 1952
QQYVSSPLT

SEQ ID NO: 3904 - protein, 21 aa, Homo sapiens
  heavy chain complementarity determining region 3 for antibody 1952
VRNLEPWWDSSWHEGHYYFDY

SEQ ID NO: 3905 - protein, 9 aa, Homo sapiens
  light chain complementarity determining region 3 for antibody 1953
QQYRSGPYT

SEQ ID NO: 3906 - protein, 12 aa, Homo sapiens
  heavy chain complementarity determining region 3 for antibody 1953
AKDAARGGDADY

SEQ ID NO: 3907 - protein, 7 aa, Homo sapiens
  light chain complementarity determining region 3 for antibody 1954
QQYNTWT

SEQ ID NO: 3908 - protein, 7 aa, Homo sapiens
  heavy chain complementarity determining region 3 for antibody 1954
TTGDLRN

SEQ ID NO: 3909 - protein, 7 aa, Homo sapiens
  light chain complementarity determining region 3 for antibody 1955
QQYNTWT

SEQ ID NO: 3910 - protein, 12 aa, Homo sapiens
  heavy chain complementarity determining region 3 for antibody 1955
ASDKGGRNGMDV

SEQ ID NO: 3911 - protein, 7 aa, Homo sapiens
  light chain complementarity determining region 3 for antibody 1956
QQYNTWT

SEQ ID NO: 3912 - protein, 12 aa, Homo sapiens
  heavy chain complementarity determining region 3 for antibody 1956
ARDNGGRNGMDV

SEQ ID NO: 3913 - protein, 9 aa, Homo sapiens
  light chain complementarity determining region 3 for antibody 1957
QQYNSYSHT

SEQ ID NO: 3914 - protein, 14 aa, Homo sapiens
  heavy chain complementarity determining region 3 for antibody 1957
ARDVHTSGWTLGGY

SEQ ID NO: 3915 - protein, 10 aa, Homo sapiens
  light chain complementarity determining region 3 for antibody 1958
QQYNNWPPIT

SEQ ID NO: 3916 - protein, 21 aa, Homo sapiens
  heavy chain complementarity determining region 3 for antibody 1958
ARVVRVNMVRGVINYFYFMDV

SEQ ID NO: 3917 - protein, 10 aa, Homo sapiens
  light chain complementarity determining region 3 for antibody 1959
QQYNNWPPFT

SEQ ID NO: 3918 - protein, 10 aa, Homo sapiens
  heavy chain complementarity determining region 3 for antibody 1959
ARGGLAGDIQ

SEQ ID NO: 3919 - protein, 9 aa, Homo sapiens
  light chain complementarity determining region 3 for antibody 1960
QQYNIYPWT

SEQ ID NO: 3920 - protein, 15 aa, Homo sapiens
  heavy chain complementarity determining region 3 for antibody 1960
VRIRGEQQTGGPFDY

SEQ ID NO: 3921 - protein, 10 aa, Homo sapiens
  light chain complementarity determining region 3 for antibody 1961
QQYNDRPPWT

SEQ ID NO: 3922 - protein, 17 aa, Homo sapiens
  heavy chain complementarity determining region 3 for antibody 1961
AKGTGYFDSTGYDPFDS

SEQ ID NO: 3923 - protein, 9 aa, Homo sapiens
  light chain complementarity determining region 3 for antibody 1962
QQYGTGMYT

SEQ ID NO: 3924 - protein, 11 aa, Homo sapiens
  heavy chain complementarity determining region 3 for antibody 1962
ARDRADDYFDS

SEQ ID NO: 3925 - protein, 10 aa, Homo sapiens
  light chain complementarity determining region 3 for antibody 1963
QQYGSSPMYT

SEQ ID NO: 3926 - protein, 14 aa, Homo sapiens
  heavy chain complementarity determining region 3 for antibody 1963
ARDVHTTGWTLGGY

SEQ ID NO: 3927 - protein, 9 aa, Homo sapiens
  light chain complementarity determining region 3 for antibody 1964
QQYGSSLRT

SEQ ID NO: 3928 - protein, 9 aa, Homo sapiens
  heavy chain complementarity determining region 3 for antibody 1964
VKGERGVDY

SEQ ID NO: 3929 - protein, 9 aa, Homo sapiens
  light chain complementarity determining region 3 for antibody 1965
QQYGNPGYT

SEQ ID NO: 3930 - protein, 11 aa, Homo sapiens
  heavy chain complementarity determining region 3 for antibody 1965
AAVDSWGTLVY

SEQ ID NO: 3931 - protein, 9 aa, Homo sapiens
  light chain complementarity determining region 3 for antibody 1966
QQYGGSLLT

SEQ ID NO: 3932 - protein, 15 aa, Homo sapiens
  heavy chain complementarity determining region 3 for antibody 1966
ARQVTGATKVRHFDS

SEQ ID NO: 3933 - protein, 9 aa, Homo sapiens
  light chain complementarity determining region 3 for antibody 1967
QQYDTLPYT

SEQ ID NO: 3934 - protein, 10 aa, Homo sapiens
  heavy chain complementarity determining region 3 for antibody 1967
ARESFWVFDF

SEQ ID NO: 3935 - protein, 9 aa, Homo sapiens
  light chain complementarity determining region 3 for antibody 1968
QQYDNWPRT

SEQ ID NO: 3936 - protein, 24 aa, Homo sapiens
  heavy chain complementarity determining region 3 for antibody 1968
ARRGKFWSGFNVARVPYYYYGFDV

SEQ ID NO: 3937 - protein, 10 aa, Homo sapiens
  light chain complementarity determining region 3 for antibody 1969
QQYDNLASLT

SEQ ID NO: 3938 - protein, 10 aa, Homo sapiens
  heavy chain complementarity determining region 3 for antibody 1969
ARERSGSYDI

SEQ ID NO: 3939 - protein, 10 aa, Homo sapiens
  light chain complementarity determining region 3 for antibody 1970
QQYDNLASLT

SEQ ID NO: 3940 - protein, 12 aa, Homo sapiens
  heavy chain complementarity determining region 3 for antibody 1970
AIVVPGRWDLDD

SEQ ID NO: 3941 - protein, 11 aa, Homo sapiens
  light chain complementarity determining region 3 for antibody 1971
QQYDGSPRMYS

SEQ ID NO: 3942 - protein, 14 aa, Homo sapiens
  heavy chain complementarity determining region 3 for antibody 1971
AQHKTVPRTRGFDI

SEQ ID NO: 3943 - protein, 9 aa, Homo sapiens
  light chain complementarity determining region 3 for antibody 1972
QQYATSPLT

SEQ ID NO: 3944 - protein, 13 aa, Homo sapiens
  heavy chain complementarity determining region 3 for antibody 1972
AKEGSSPGPDFDY

SEQ ID NO: 3945 - protein, 9 aa, Homo sapiens
  light chain complementarity determining region 3 for antibody 1973
QQVNNYPVT

SEQ ID NO: 3946 - protein, 18 aa, Homo sapiens
  heavy chain complementarity determining region 3 for antibody 1973
ARSSRFFGVLKGPYAMDV

SEQ ID NO: 3947 - protein, 9 aa, Homo sapiens
  light chain complementarity determining region 3 for antibody 1974
QQTYSSPWT

SEQ ID NO: 3948 - protein, 14 aa, Homo sapiens
  heavy chain complementarity determining region 3 for antibody 1974
CRGWLDPATPHYDF

SEQ ID NO: 3949 - protein, 9 aa, Homo sapiens
  light chain complementarity determining region 3 for antibody 1975
QQTYRTPFT

SEQ ID NO: 3950 - protein, 14 aa, Homo sapiens
  heavy chain complementarity determining region 3 for antibody 1975
ARDIRSGAGIWFDP

SEQ ID NO: 3951 - protein, 9 aa, Homo sapiens
  light chain complementarity determining region 3 for antibody 1976
QQTFSTPHT

SEQ ID NO: 3952 - protein, 12 aa, Homo sapiens
  heavy chain complementarity determining region 3 for antibody 1976
ARQVGWSGWLDS

SEQ ID NO: 3953 - protein, 9 aa, Homo sapiens
  light chain complementarity determining region 3 for antibody 1977
QQTDTFPLT

SEQ ID NO: 3954 - protein, 12 aa, Homo sapiens
  heavy chain complementarity determining region 3 for antibody 1977
AKGSSWTNWFDP

SEQ ID NO: 3955 - protein, 9 aa, Homo sapiens
  light chain complementarity determining region 3 for antibody 1978
QQSYTMPRT

SEQ ID NO: 3956 - protein, 17 aa, Homo sapiens
  heavy chain complementarity determining region 3 for antibody 1978
ARAPGIPVAGTPAYFDY

SEQ ID NO: 3957 - protein, 9 aa, Homo sapiens
  light chain complementarity determining region 3 for antibody 1979
QQSYSTPST

SEQ ID NO: 3958 - protein, 16 aa, Homo sapiens
  heavy chain complementarity determining region 3 for antibody 1979
ARWFSHSSTGVSYMDV

SEQ ID NO: 3959 - protein, 9 aa, Homo sapiens
  light chain complementarity determining region 3 for antibody 1980
QQSYSTPQT

SEQ ID NO: 3960 - protein, 16 aa, Homo sapiens
  heavy chain complementarity determining region 3 for antibody 1980
AREAAMATQVYDAFDI

SEQ ID NO: 3961 - protein, 10 aa, Homo sapiens
  light chain complementarity determining region 3 for antibody 1981
QQSYSTPPWT

SEQ ID NO: 3962 - protein, 14 aa, Homo sapiens
  heavy chain complementarity determining region 3 for antibody 1981
TRALPSMGDYYFDY

SEQ ID NO: 3963 - protein, 10 aa, Homo sapiens
  light chain complementarity determining region 3 for antibody 1982
QQSYSTPLFT

SEQ ID NO: 3964 - protein, 15 aa, Homo sapiens
  heavy chain complementarity determining region 3 for antibody 1982
ARVGRPYHNAWYFGN

SEQ ID NO: 3965 - protein, 10 aa, Homo sapiens
  light chain complementarity determining region 3 for antibody 1983
QQSYSTLALT

SEQ ID NO: 3966 - protein, 15 aa, Homo sapiens
  heavy chain complementarity determining region 3 for antibody 1983
ARRGVYGSGPVLFPD

SEQ ID NO: 3967 - protein, 9 aa, Homo sapiens
  light chain complementarity determining region 3 for antibody 1984
QQSYSIPYT

SEQ ID NO: 3968 - protein, 14 aa, Homo sapiens
  heavy chain complementarity determining region 3 for antibody 1984
TTEGLLWFDNAMDV

SEQ ID NO: 3969 - protein, 7 aa, Homo sapiens
  light chain complementarity determining region 3 for antibody 1985
QQSNTWT

SEQ ID NO: 3970 - protein, 12 aa, Homo sapiens
  heavy chain complementarity determining region 3 for antibody 1985
ARDKGGRNGMDV

SEQ ID NO: 3971 - protein, 9 aa, Homo sapiens
  light chain complementarity determining region 3 for antibody 1986
QQSENLPLT

SEQ ID NO: 3972 - protein, 22 aa, Homo sapiens
  heavy chain complementarity determining region 3 for antibody 1986
ASRSITIFGVVNKRLHYYGMDV

SEQ ID NO: 3973 - protein, 9 aa, Homo sapiens
  light chain complementarity determining region 3 for antibody 1987
QQRSNWPRT

SEQ ID NO: 3974 - protein, 17 aa, Homo sapiens
  heavy chain complementarity determining region 3 for antibody 1987
ARDARVDGVGPDFWFDL

SEQ ID NO: 3975 - protein, 10 aa, Homo sapiens
  light chain complementarity determining region 3 for antibody 1988
QQRSNWPPFT

SEQ ID NO: 3976 - protein, 11 aa, Homo sapiens
  heavy chain complementarity determining region 3 for antibody 1988
AREQHGQAPDY

SEQ ID NO: 3977 - protein, 9 aa, Homo sapiens
  light chain complementarity determining region 3 for antibody 1989
QQRSNWGYT

SEQ ID NO: 3978 - protein, 10 aa, Homo sapiens
  heavy chain complementarity determining region 3 for antibody 1989
ARETSGSYDI

SEQ ID NO: 3979 - protein, 10 aa, Homo sapiens
  light chain complementarity determining region 3 for antibody 1990
QQRISWPLIT

SEQ ID NO: 3980 - protein, 21 aa, Homo sapiens
  heavy chain complementarity determining region 3 for antibody 1990
AAGRPGYFGAGGYHPGYYFDY

SEQ ID NO: 3981 - protein, 9 aa, Homo sapiens
  light chain complementarity determining region 3 for antibody 1991
QQLYSYPRT

SEQ ID NO: 3982 - protein, 13 aa, Homo sapiens
  heavy chain complementarity determining region 3 for antibody 1991
AKEGSSPGPDFDY

SEQ ID NO: 3983 - protein, 9 aa, Homo sapiens
  light chain complementarity determining region 3 for antibody 1992
QQLNSYPYT

SEQ ID NO: 3984 - protein, 14 aa, Homo sapiens
  heavy chain complementarity determining region 3 for antibody 1992
ARGHCDSTGFRLDY

SEQ ID NO: 3985 - protein, 9 aa, Homo sapiens
  light chain complementarity determining region 3 for antibody 1993
QQHYDVPLT

SEQ ID NO: 3986 - protein, 14 aa, Homo sapiens
  heavy chain complementarity determining region 3 for antibody 1993
ARPLNGWDNYPFDI

SEQ ID NO: 3987 - protein, 9 aa, Homo sapiens
  light chain complementarity determining region 3 for antibody 1994
QQGYYTPRT

SEQ ID NO: 3988 - protein, 11 aa, Homo sapiens
  heavy chain complementarity determining region 3 for antibody 1994
ARRSLGGAFDY

SEQ ID NO: 3989 - protein, 9 aa, Homo sapiens
  light chain complementarity determining region 3 for antibody 1995
QQFNSYSRT

SEQ ID NO: 3990 - protein, 26 aa, Homo sapiens
  heavy chain complementarity determining region 3 for antibody 1995
ARLDDVRYYDIMTGQRSNAYPGAVDV

SEQ ID NO: 3991 - protein, 9 aa, Homo sapiens
  light chain complementarity determining region 3 for antibody 1996
QQFNNLPRT

SEQ ID NO: 3992 - protein, 9 aa, Homo sapiens
  heavy chain complementarity determining region 3 for antibody 1996
ARGRSNFRY

SEQ ID NO: 3993 - protein, 9 aa, Homo sapiens
  light chain complementarity determining region 3 for antibody 1997
QQFNIYPLT

SEQ ID NO: 3994 - protein, 17 aa, Homo sapiens
  heavy chain complementarity determining region 3 for antibody 1997
AKDLSGVHYDIHHGMDG

SEQ ID NO: 3995 - protein, 9 aa, Homo sapiens
  light chain complementarity determining region 3 for antibody 1998
QQFANLPRT

SEQ ID NO: 3996 - protein, 9 aa, Homo sapiens
  heavy chain complementarity determining region 3 for antibody 1998
VRGRSNFSY

SEQ ID NO: 3997 - protein, 9 aa, Homo sapiens
  light chain complementarity determining region 3 for antibody 1999
QQCDNLPLT

SEQ ID NO: 3998 - protein, 21 aa, Homo sapiens
  heavy chain complementarity determining region 3 for antibody 1999
ARLLLRVDYVSAVARAHAFDF

SEQ ID NO: 3999 - protein, 9 aa, Homo sapiens
  light chain complementarity determining region 3 for antibody 2000
QKYNSGPFT

SEQ ID NO: 4000 - protein, 11 aa, Homo sapiens
  heavy chain complementarity determining region 3 for antibody 2000
ARGYGYRPGDY

SEQ ID NO: 4001 - protein, 9 aa, Homo sapiens
  light chain complementarity determining region 3 for antibody 2001
QKYGSSPVP

SEQ ID NO: 4002 - protein, 18 aa, Homo sapiens
  heavy chain complementarity determining region 3 for antibody 2001
ARGDYPEARTGYFRDFDY

SEQ ID NO: 4003 - protein, 9 aa, Homo sapiens
  light chain complementarity determining region 3 for antibody 2002
QKHNSAPWT

SEQ ID NO: 4004 - protein, 12 aa, Homo sapiens
  heavy chain complementarity determining region 3 for antibody 2002
ARDDGSRCPFEY

SEQ ID NO: 4005 - protein, 9 aa, Homo sapiens
  light chain complementarity determining region 3 for antibody 2003
QHYNDWWWT

SEQ ID NO: 4006 - protein, 10 aa, Homo sapiens
  heavy chain complementarity determining region 3 for antibody 2003
AQSSSGRFDN

SEQ ID NO: 4007 - protein, 9 aa, Homo sapiens
  light chain complementarity determining region 3 for antibody 2004
QHYDNSPRT

SEQ ID NO: 4008 - protein, 11 aa, Homo sapiens
  heavy chain complementarity determining region 3 for antibody 2004
ASPQGGYRADY

SEQ ID NO: 4009 - protein, 9 aa, Homo sapiens
  light chain complementarity determining region 3 for antibody 2005
QHLDTYPAS

SEQ ID NO: 4010 - protein, 17 aa, Homo sapiens
  heavy chain complementarity determining region 3 for antibody 2005
ARNTMVGSWQRQGNLDH

SEQ ID NO: 4011 - protein, 9 aa, Homo sapiens
  light chain complementarity determining region 3 for antibody 2006
QEYKTPPWT

SEQ ID NO: 4012 - protein, 20 aa, Homo sapiens
  heavy chain complementarity determining region 3 for antibody 2006
ARDGRGTVEYDNAWGGGLDV

SEQ ID NO: 4013 - protein, 9 aa, Homo sapiens
  light chain complementarity determining region 3 for antibody 2007
MQTLQTPWT

SEQ ID NO: 4014 - protein, 12 aa, Homo sapiens
  heavy chain complementarity determining region 3 for antibody 2007
ARLDWNYRASDI

SEQ ID NO: 4015 - protein, 9 aa, Homo sapiens
  light chain complementarity determining region 3 for antibody 2008
MQTLQTPWT

SEQ ID NO: 4016 - protein, 12 aa, Homo sapiens
  heavy chain complementarity determining region 3 for antibody 2008
ARLDWNYRAFDL

SEQ ID NO: 4017 - protein, 9 aa, Homo sapiens
  light chain complementarity determining region 3 for antibody 2009
MQTLQTPVT

SEQ ID NO: 4018 - protein, 15 aa, Homo sapiens
  heavy chain complementarity determining region 3 for antibody 2009
ARDWGSSGWYNWFDP

SEQ ID NO: 4019 - protein, 9 aa, Homo sapiens
  light chain complementarity determining region 3 for antibody 2010
MQTLQNPRT

SEQ ID NO: 4020 - protein, 17 aa, Homo sapiens
  heavy chain complementarity determining region 3 for antibody 2010
ARQLGWCDDWSCPGMDV

SEQ ID NO: 4021 - protein, 9 aa, Homo sapiens
  light chain complementarity determining region 3 for antibody 2011
MQGTYWPDT

SEQ ID NO: 4022 - protein, 11 aa, Homo sapiens
  heavy chain complementarity determining region 3 for antibody 2011
AREGWGSLLDY

SEQ ID NO: 4023 - protein, 10 aa, Homo sapiens
  light chain complementarity determining region 3 for antibody 2012
MQGTRWPPLT

SEQ ID NO: 4024 - protein, 9 aa, Homo sapiens
  heavy chain complementarity determining region 3 for antibody 2012
ARSEYQPTY

SEQ ID NO: 4025 - protein, 10 aa, Homo sapiens
  light chain complementarity determining region 3 for antibody 2013
MQGTHWPPIT

SEQ ID NO: 4026 - protein, 21 aa, Homo sapiens
  heavy chain complementarity determining region 3 for antibody 2013
ARLNGRYCDTSGSTCGLWFDP

SEQ ID NO: 4027 - protein, 9 aa, Homo sapiens
  light chain complementarity determining region 3 for antibody 2014
MQGTHWPHT

SEQ ID NO: 4028 - protein, 11 aa, Homo sapiens
  heavy chain complementarity determining region 3 for antibody 2014
ATFGQQWRLAP

SEQ ID NO: 4029 - protein, 9 aa, Homo sapiens
  light chain complementarity determining region 3 for antibody 2015
MQGPHWPHT

SEQ ID NO: 4030 - protein, 11 aa, Homo sapiens
  heavy chain complementarity determining region 3 for antibody 2015
ATFGQQWRLAH

SEQ ID NO: 4031 - protein, 9 aa, Homo sapiens
  light chain complementarity determining region 3 for antibody 2016
MQALQTPYT

SEQ ID NO: 4032 - protein, 10 aa, Homo sapiens
  heavy chain complementarity determining region 3 for antibody 2016
AKDLAGGGGY

SEQ ID NO: 4033 - protein, 9 aa, Homo sapiens
  light chain complementarity determining region 3 for antibody 2017
MQALQTPWT

SEQ ID NO: 4034 - protein, 20 aa, Homo sapiens
  heavy chain complementarity determining region 3 for antibody 2017
AKAGGQYYESSGSHSGGMDV

SEQ ID NO: 4035 - protein, 9 aa, Homo sapiens
  light chain complementarity determining region 3 for antibody 2018
MQALQTPVT

SEQ ID NO: 4036 - protein, 16 aa, Homo sapiens
  heavy chain complementarity determining region 3 for antibody 2018
VRGRSREHTSPYYLDH

SEQ ID NO: 4037 - protein, 9 aa, Homo sapiens
  light chain complementarity determining region 3 for antibody 2019
MPFLQTPLT

SEQ ID NO: 4038 - protein, 10 aa, Homo sapiens
  heavy chain complementarity determining region 3 for antibody 2019
ARERSGSYDI

SEQ ID NO: 4039 - protein, 9 aa, Homo sapiens
  light chain complementarity determining region 3 for antibody 2020
LQYAHWPHP

SEQ ID NO: 4040 - protein, 15 aa, Homo sapiens
  heavy chain complementarity determining region 3 for antibody 2020
ARVGRPYHNAWYFDN

SEQ ID NO: 4041 - protein, 9 aa, Homo sapiens
  light chain complementarity determining region 3 for antibody 2021
LQHNTYPWT

SEQ ID NO: 4042 - protein, 9 aa, Homo sapiens
  heavy chain complementarity determining region 3 for antibody 2021
ARSEYQPTY

SEQ ID NO: 4043 - protein, 9 aa, Homo sapiens
  light chain complementarity determining region 3 for antibody 2022
LQHNTYPWT

SEQ ID NO: 4044 - protein, 12 aa, Homo sapiens
  heavy chain complementarity determining region 3 for antibody 2022
ARDLAGAPYIDS

SEQ ID NO: 4045 - protein, 9 aa, Homo sapiens
  light chain complementarity determining region 3 for antibody 2023
LQHDYFPWT

SEQ ID NO: 4046 - protein, 19 aa, Homo sapiens
  heavy chain complementarity determining region 3 for antibody 2023
ASRAGYCPSANCHTTTFDY

SEQ ID NO: 4047 - protein, 9 aa, Homo sapiens
  light chain complementarity determining region 3 for antibody 2024
LQGVQVPFT

SEQ ID NO: 4048 - protein, 11 aa, Homo sapiens
  heavy chain complementarity determining region 3 for antibody 2024
GRDVDYSTPGF

SEQ ID NO: 4049 - protein, 9 aa, Homo sapiens
  light chain complementarity determining region 3 for antibody 2025
LQDYNYPFS

SEQ ID NO: 4050 - protein, 16 aa, Homo sapiens
  heavy chain complementarity determining region 3 for antibody 2025
AADLGDHADAYATLDS

SEQ ID NO: 4051 - protein, 9 aa, Homo sapiens
  light chain complementarity determining region 3 for antibody 2026
LQDYKYPFS

SEQ ID NO: 4052 - protein, 16 aa, Homo sapiens
  heavy chain complementarity determining region 3 for antibody 2026
AADLGDHADAYAPLDS

SEQ ID NO: 4053 - protein, 9 aa, Homo sapiens
  light chain complementarity determining region 3 for antibody 2027
LQDDDYPFT

SEQ ID NO: 4054 - protein, 15 aa, Homo sapiens
  heavy chain complementarity determining region 3 for antibody 2027
TKDEYPGSQIEAFDI

SEQ ID NO: 4055 - protein, 9 aa, Homo sapiens
  light chain complementarity determining region 3 for antibody 2028
LQAYRTPYT

SEQ ID NO: 4056 - protein, 14 aa, Homo sapiens
  heavy chain complementarity determining region 3 for antibody 2028
ARLHGSGLGRWLDP

SEQ ID NO: 4057 - protein, 9 aa, Homo sapiens
  light chain complementarity determining region 3 for antibody 2029
HQCGTSPKT

SEQ ID NO: 4058 - protein, 13 aa, Homo sapiens
  heavy chain complementarity determining region 3 for antibody 2029
ARDGSSDWYELAH

SEQ ID NO: 4059 - protein, 7 aa, Homo sapiens
  light chain complementarity determining region 3 for antibody 2030
RQYNTWT

SEQ ID NO: 4060 - protein, 12 aa, Homo sapiens
  heavy chain complementarity determining region 3 for antibody 2030
ARDKGGRNGMDV

SEQ ID NO: 4061 - protein, 7 aa, Homo sapiens
  light chain complementarity determining region 3 for antibody 2031
QSRSNWG

SEQ ID NO: 4062 - protein, 20 aa, Homo sapiens
  heavy chain complementarity determining region 3 for antibody 2031
ATYFPGDCTCTGCFYWYFDF

SEQ ID NO: 4063 - protein, 9 aa, Homo sapiens
  light chain complementarity determining region 3 for antibody 2032
QRYNGASET

SEQ ID NO: 4064 - protein, 8 aa, Homo sapiens
  heavy chain complementarity determining region 3 for antibody 2032
ATSPSRAS

SEQ ID NO: 4065 - protein, 9 aa, Homo sapiens
  light chain complementarity determining region 3 for antibody 2033
QQYYSTPNT

SEQ ID NO: 4066 - protein, 18 aa, Homo sapiens
  heavy chain complementarity determining region 3 for antibody 2033
ARLRDSSSPRYYYYGMDV

SEQ ID NO: 4067 - protein, 9 aa, Homo sapiens
  light chain complementarity determining region 3 for antibody 2034
QQYYSSPPT

SEQ ID NO: 4068 - protein, 15 aa, Homo sapiens
  heavy chain complementarity determining region 3 for antibody 2034
AKRHSSSRNYPYMDV

SEQ ID NO: 4069 - protein, 9 aa, Homo sapiens
  light chain complementarity determining region 3 for antibody 2035
QQYYSSPLT

SEQ ID NO: 4070 - protein, 15 aa, Homo sapiens
  heavy chain complementarity determining region 3 for antibody 2035
AKASCGTCYALSGDY

SEQ ID NO: 4071 - protein, 9 aa, Homo sapiens
  light chain complementarity determining region 3 for antibody 2036
QQYYSLPLT

SEQ ID NO: 4072 - protein, 13 aa, Homo sapiens
  heavy chain complementarity determining region 3 for antibody 2036
AKAYCTSCYQIVY

SEQ ID NO: 4073 - protein, 9 aa, Homo sapiens
  light chain complementarity determining region 3 for antibody 2037
QQYYGAPIT

SEQ ID NO: 4074 - protein, 14 aa, Homo sapiens
  heavy chain complementarity determining region 3 for antibody 2037
AKGQSTSCDYIIDY

SEQ ID NO: 4075 - protein, 9 aa, Homo sapiens
  light chain complementarity determining region 3 for antibody 2038
QQYNSYPWT

SEQ ID NO: 4076 - protein, 15 aa, Homo sapiens
  heavy chain complementarity determining region 3 for antibody 2038
GKEGPGSSGWLAGHY

SEQ ID NO: 4077 - protein, 9 aa, Homo sapiens
  light chain complementarity determining region 3 for antibody 2039
QQYNSYPWT

SEQ ID NO: 4078 - protein, 15 aa, Homo sapiens
  heavy chain complementarity determining region 3 for antibody 2039
AKEGPGSSGWLTGHY

SEQ ID NO: 4079 - protein, 9 aa, Homo sapiens
  light chain complementarity determining region 3 for antibody 2040
QQYNSYPFT

SEQ ID NO: 4080 - protein, 14 aa, Homo sapiens
  heavy chain complementarity determining region 3 for antibody 2040
ARASVAATAYYFDY

SEQ ID NO: 4081 - protein, 9 aa, Homo sapiens
  light chain complementarity determining region 3 for antibody 2041
QQYNDWPQT

SEQ ID NO: 4082 - protein, 16 aa, Homo sapiens
  heavy chain complementarity determining region 3 for antibody 2041
ARDLWVAAWYPGALDV

SEQ ID NO: 4083 - protein, 9 aa, Homo sapiens
  light chain complementarity determining region 3 for antibody 2042
QQYKIYPWT

SEQ ID NO: 4084 - protein, 10 aa, Homo sapiens
  heavy chain complementarity determining region 3 for antibody 2042
ARGLSLRLVL

SEQ ID NO: 4085 - protein, 9 aa, Homo sapiens
  light chain complementarity determining region 3 for antibody 2043
QQYGTPPLT

SEQ ID NO: 4086 - protein, 6 aa, Homo sapiens
  heavy chain complementarity determining region 3 for antibody 2043
TTGYHA

SEQ ID NO: 4087 - protein, 9 aa, Homo sapiens
  light chain complementarity determining region 3 for antibody 2044
QQYGSSTWT

SEQ ID NO: 4088 - protein, 17 aa, Homo sapiens
  heavy chain complementarity determining region 3 for antibody 2044
AKGRGSVAMALRYYLDL

SEQ ID NO: 4089 - protein, 9 aa, Homo sapiens
  light chain complementarity determining region 3 for antibody 2045
QQYGSSTWT

SEQ ID NO: 4090 - protein, 17 aa, Homo sapiens
  heavy chain complementarity determining region 3 for antibody 2045
AKGRGSVAMALIYCLDL

SEQ ID NO: 4091 - protein, 9 aa, Homo sapiens
  light chain complementarity determining region 3 for antibody 2046
QQYGSSPRT

SEQ ID NO: 4092 - protein, 20 aa, Homo sapiens
  heavy chain complementarity determining region 3 for antibody 2046
AKDEQNDLWSGLSHKYFMDV

SEQ ID NO: 4093 - protein, 11 aa, Homo sapiens
  light chain complementarity determining region 3 for antibody 2047
QQYGSSPPMYP

SEQ ID NO: 4094 - protein, 13 aa, Homo sapiens
  heavy chain complementarity determining region 3 for antibody 2047
AKEGSAPGPDFEY

SEQ ID NO: 4095 - protein, 9 aa, Homo sapiens
  light chain complementarity determining region 3 for antibody 2048
QQYGSPWLT

SEQ ID NO: 4096 - protein, 18 aa, Homo sapiens
  heavy chain complementarity determining region 3 for antibody 2048
ARVDTSTGEVTDGGPFDL

SEQ ID NO: 4097 - protein, 9 aa, Homo sapiens
  light chain complementarity determining region 3 for antibody 2049
QQYFNAPVA

SEQ ID NO: 4098 - protein, 17 aa, Homo sapiens
  heavy chain complementarity determining region 3 for antibody 2049
ASLRGWSYSYGFGVSEY

SEQ ID NO: 4099 - protein, 9 aa, Homo sapiens
  light chain complementarity determining region 3 for antibody 2050
QQYDSYSWT

SEQ ID NO: 4100 - protein, 13 aa, Homo sapiens
  heavy chain complementarity determining region 3 for antibody 2050
VKDAGIAARFPDY

SEQ ID NO: 4101 - protein, 9 aa, Homo sapiens
  light chain complementarity determining region 3 for antibody 2051
QQYDNLLLT

SEQ ID NO: 4102 - protein, 20 aa, Homo sapiens
  heavy chain complementarity determining region 3 for antibody 2051
ARQIGVRREGEDFWTGYLDF

SEQ ID NO: 4103 - protein, 10 aa, Homo sapiens
  light chain complementarity determining region 3 for antibody 2052
QQYDNLASLT

SEQ ID NO: 4104 - protein, 13 aa, Homo sapiens
  heavy chain complementarity determining region 3 for antibody 2052
AKEGSSPGPDLEY

SEQ ID NO: 4105 - protein, 10 aa, Homo sapiens
  light chain complementarity determining region 3 for antibody 2053
QQYDISPPWP

SEQ ID NO: 4106 - protein, 16 aa, Homo sapiens
  heavy chain complementarity determining region 3 for antibody 2053
ASPNTLGRLVGVAFDY

SEQ ID NO: 4107 - protein, 9 aa, Homo sapiens
  light chain complementarity determining region 3 for antibody 2054
QQYATSPLP

SEQ ID NO: 4108 - protein, 14 aa, Homo sapiens
  heavy chain complementarity determining region 3 for antibody 2054
ARASGGDTDFLIDF

SEQ ID NO: 4109 - protein, 9 aa, Homo sapiens
  light chain complementarity determining region 3 for antibody 2055
QQYARSPST

SEQ ID NO: 4110 - protein, 16 aa, Homo sapiens
  heavy chain complementarity determining region 3 for antibody 2055
ARGPDRYSGYTLAFDQ

SEQ ID NO: 4111 - protein, 8 aa, Homo sapiens
  light chain complementarity determining region 3 for antibody 2056
QQYANSRT

SEQ ID NO: 4112 - protein, 13 aa, Homo sapiens
  heavy chain complementarity determining region 3 for antibody 2056
AAQAYSDWNVGDY

SEQ ID NO: 4113 - protein, 9 aa, Homo sapiens
  light chain complementarity determining region 3 for antibody 2057
QQWDDLPFT

SEQ ID NO: 4114 - protein, 11 aa, Homo sapiens
  heavy chain complementarity determining region 3 for antibody 2057
ARDGDQNAFDI

SEQ ID NO: 4115 - protein, 9 aa, Homo sapiens
  light chain complementarity determining region 3 for antibody 2058
QQTSSAPPT

SEQ ID NO: 4116 - protein, 18 aa, Homo sapiens
  heavy chain complementarity determining region 3 for antibody 2058
ARWLSSSSGRWARGHFDY

SEQ ID NO: 4117 - protein, 9 aa, Homo sapiens
  light chain complementarity determining region 3 for antibody 2059
QQSYSTPRG

SEQ ID NO: 4118 - protein, 17 aa, Homo sapiens
  heavy chain complementarity determining region 3 for antibody 2059
AKGTGYFDNTGDDAFDS

SEQ ID NO: 4119 - protein, 9 aa, Homo sapiens
  light chain complementarity determining region 3 for antibody 2060
QQSYSTPLT

SEQ ID NO: 4120 - protein, 11 aa, Homo sapiens
  heavy chain complementarity determining region 3 for antibody 2060
ARGGPLNWLDP

SEQ ID NO: 4121 - protein, 10 aa, Homo sapiens
  light chain complementarity determining region 3 for antibody 2061
QQSYSTPLFT

SEQ ID NO: 4122 - protein, 10 aa, Homo sapiens
  heavy chain complementarity determining region 3 for antibody 2061
ATSADWTFPN

SEQ ID NO: 4123 - protein, 10 aa, Homo sapiens
  light chain complementarity determining region 3 for antibody 2062
QQSYSTLPYT

SEQ ID NO: 4124 - protein, 22 aa, Homo sapiens
  heavy chain complementarity determining region 3 for antibody 2062
AKDKGTPYSYGPYYYYYYGMDV

SEQ ID NO: 4125 - protein, 10 aa, Homo sapiens
  light chain complementarity determining region 3 for antibody 2063
QQSYSIPMYT

SEQ ID NO: 4126 - protein, 15 aa, Homo sapiens
  heavy chain complementarity determining region 3 for antibody 2063
ARARLSSGGCWHFDL

SEQ ID NO: 4127 - protein, 8 aa, Homo sapiens
  light chain complementarity determining region 3 for antibody 2064
QQSYRRPT

SEQ ID NO: 4128 - protein, 12 aa, Homo sapiens
  heavy chain complementarity determining region 3 for antibody 2064
AKWRGGQSEFDH

SEQ ID NO: 4129 - protein, 9 aa, Homo sapiens
  light chain complementarity determining region 3 for antibody 2065
QQSYNTPRT

SEQ ID NO: 4130 - protein, 15 aa, Homo sapiens
  heavy chain complementarity determining region 3 for antibody 2065
ARDGDGSGYYFAMDV

SEQ ID NO: 4131 - protein, 8 aa, Homo sapiens
  light chain complementarity determining region 3 for antibody 2066
QQSSSRPT

SEQ ID NO: 4132 - protein, 12 aa, Homo sapiens
  heavy chain complementarity determining region 3 for antibody 2066
AKWRWLQSEFDY

SEQ ID NO: 4133 - protein, 9 aa, Homo sapiens
  light chain complementarity determining region 3 for antibody 2067
QQSNDWPRT

SEQ ID NO: 4134 - protein, 14 aa, Homo sapiens
  heavy chain complementarity determining region 3 for antibody 2067
ATSPGYYDSSPYDY

SEQ ID NO: 4135 - protein, 8 aa, Homo sapiens
  light chain complementarity determining region 3 for antibody 2068
QQRSNWLT

SEQ ID NO: 4136 - protein, 17 aa, Homo sapiens
  heavy chain complementarity determining region 3 for antibody 2068
ARPLLCNITTCYTGLGY

SEQ ID NO: 4137 - protein, 9 aa, Homo sapiens
  light chain complementarity determining region 3 for antibody 2069
QQPYSSPWT

SEQ ID NO: 4138 - protein, 15 aa, Homo sapiens
  heavy chain complementarity determining region 3 for antibody 2069
ARIWTSSTNCRYMDV

SEQ ID NO: 4139 - protein, 9 aa, Homo sapiens
  light chain complementarity determining region 3 for antibody 2070
QQLNSYPST

SEQ ID NO: 4140 - protein, 14 aa, Homo sapiens
  heavy chain complementarity determining region 3 for antibody 2070
ARGHFDSTGFRLDY

SEQ ID NO: 4141 - protein, 9 aa, Homo sapiens
  light chain complementarity determining region 3 for antibody 2071
QQLNSSPYT

SEQ ID NO: 4142 - protein, 14 aa, Homo sapiens
  heavy chain complementarity determining region 3 for antibody 2071
ARGHFDSAGFRLDY

SEQ ID NO: 4143 - protein, 9 aa, Homo sapiens
  light chain complementarity determining region 3 for antibody 2072
QQLNEYPIT

SEQ ID NO: 4144 - protein, 18 aa, Homo sapiens
  heavy chain complementarity determining region 3 for antibody 2072
TRPDCSSHGCQGRDQFDP

SEQ ID NO: 4145 - protein, 9 aa, Homo sapiens
  light chain complementarity determining region 3 for antibody 2073
QQLMGYPYT

SEQ ID NO: 4146 - protein, 14 aa, Homo sapiens
  heavy chain complementarity determining region 3 for antibody 2073
TRGHFDSTGFRLDY

SEQ ID NO: 4147 - protein, 9 aa, Homo sapiens
  light chain complementarity determining region 3 for antibody 2074
QQFDNFPRT

SEQ ID NO: 4148 - protein, 9 aa, Homo sapiens
  heavy chain complementarity determining region 3 for antibody 2074
VRGRNNYRY

SEQ ID NO: 4149 - protein, 9 aa, Homo sapiens
  light chain complementarity determining region 3 for antibody 2075
QQARSFPYT

SEQ ID NO: 4150 - protein, 16 aa, Homo sapiens
  heavy chain complementarity determining region 3 for antibody 2075
AIWAAVSSGWSGPFDF

SEQ ID NO: 4151 - protein, 9 aa, Homo sapiens
  light chain complementarity determining region 3 for antibody 2076
QQANSFPWT

SEQ ID NO: 4152 - protein, 15 aa, Homo sapiens
  heavy chain complementarity determining region 3 for antibody 2076
ARSGYCSGASCYVDC

SEQ ID NO: 4153 - protein, 9 aa, Homo sapiens
  light chain complementarity determining region 3 for antibody 2077
QQANSFPFT

SEQ ID NO: 4154 - protein, 13 aa, Homo sapiens
  heavy chain complementarity determining region 3 for antibody 2077
AKEGSAPGPDFEY

SEQ ID NO: 4155 - protein, 10 aa, Homo sapiens
  light chain complementarity determining region 3 for antibody 2078
QPYYSSPPWA

SEQ ID NO: 4156 - protein, 16 aa, Homo sapiens
  heavy chain complementarity determining region 3 for antibody 2078
ASLNRGDKEFGVPPAL

SEQ ID NO: 4157 - protein, 9 aa, Homo sapiens
  light chain complementarity determining region 3 for antibody 2079
QKYYNVPWT

SEQ ID NO: 4158 - protein, 14 aa, Homo sapiens
  heavy chain complementarity determining region 3 for antibody 2079
TRDPMVGGRRGMDV

SEQ ID NO: 4159 - protein, 9 aa, Homo sapiens
  light chain complementarity determining region 3 for antibody 2080
QKYNSAPVI

SEQ ID NO: 4160 - protein, 16 aa, Homo sapiens
  heavy chain complementarity determining region 3 for antibody 2080
VRGLSFYNRAWGVLDY

SEQ ID NO: 4161 - protein, 9 aa, Homo sapiens
  light chain complementarity determining region 3 for antibody 2081
QKYNSAPFT

SEQ ID NO: 4162 - protein, 13 aa, Homo sapiens
  heavy chain complementarity determining region 3 for antibody 2081
AKEGSSPGPDFDS

SEQ ID NO: 4163 - protein, 9 aa, Homo sapiens
  light chain complementarity determining region 3 for antibody 2082
QKYNNAPWT

SEQ ID NO: 4164 - protein, 13 aa, Homo sapiens
  heavy chain complementarity determining region 3 for antibody 2082
ARAYSKFYYYMDV

SEQ ID NO: 4165 - protein, 10 aa, Homo sapiens
  light chain complementarity determining region 3 for antibody 2083
QHYNNWRGFT

SEQ ID NO: 4166 - protein, 11 aa, Homo sapiens
  heavy chain complementarity determining region 3 for antibody 2083
ARVAGPQLFDY

SEQ ID NO: 4167 - protein, 10 aa, Homo sapiens
  light chain complementarity determining region 3 for antibody 2084
QHYNNWLSWT

SEQ ID NO: 4168 - protein, 13 aa, Homo sapiens
  heavy chain complementarity determining region 3 for antibody 2084
ARPYPGHLAPMDV

SEQ ID NO: 4169 - protein, 10 aa, Homo sapiens
  light chain complementarity determining region 3 for antibody 2085
QHYGSSQGLT

SEQ ID NO: 4170 - protein, 17 aa, Homo sapiens
  heavy chain complementarity determining region 3 for antibody 2085
ARGTGIGSGSYYADFDY

SEQ ID NO: 4171 - protein, 10 aa, Homo sapiens
  light chain complementarity determining region 3 for antibody 2086
QHYGSSPPYS

SEQ ID NO: 4172 - protein, 11 aa, Homo sapiens
  heavy chain complementarity determining region 3 for antibody 2086
TAIGSFGEFCY

SEQ ID NO: 4173 - protein, 9 aa, Homo sapiens
  light chain complementarity determining region 3 for antibody 2087
QHSYNTPRT

SEQ ID NO: 4174 - protein, 20 aa, Homo sapiens
  heavy chain complementarity determining region 3 for antibody 2087
ARERAIAAAGKGYYYYGMDV

SEQ ID NO: 4175 - protein, 9 aa, Homo sapiens
  light chain complementarity determining region 3 for antibody 2088
QHHYTTPWT

SEQ ID NO: 4176 - protein, 10 aa, Homo sapiens
  heavy chain complementarity determining region 3 for antibody 2088
ARSRNGYFDY

SEQ ID NO: 4177 - protein, 9 aa, Homo sapiens
  light chain complementarity determining region 3 for antibody 2089
QHFNNYPFT

SEQ ID NO: 4178 - protein, 17 aa, Homo sapiens
  heavy chain complementarity determining region 3 for antibody 2089
ARDYNWGPNYFYFGMDV

SEQ ID NO: 4179 - protein, 9 aa, Homo sapiens
  light chain complementarity determining region 3 for antibody 2090
MQTVQTPWT

SEQ ID NO: 4180 - protein, 12 aa, Homo sapiens
  heavy chain complementarity determining region 3 for antibody 2090
ARLDLNYRAFDI

SEQ ID NO: 4181 - protein, 9 aa, Homo sapiens
  light chain complementarity determining region 3 for antibody 2091
MQTLQTQWT

SEQ ID NO: 4182 - protein, 12 aa, Homo sapiens
  heavy chain complementarity determining region 3 for antibody 2091
ARLDWNYRAFDI

SEQ ID NO: 4183 - protein, 9 aa, Homo sapiens
  light chain complementarity determining region 3 for antibody 2092
MQTLQTPWT

SEQ ID NO: 4184 - protein, 12 aa, Homo sapiens
  heavy chain complementarity determining region 3 for antibody 2092
ARLDWNYSAFDI

SEQ ID NO: 4185 - protein, 9 aa, Homo sapiens
  light chain complementarity determining region 3 for antibody 2093
MQTLQTPWT

SEQ ID NO: 4186 - protein, 12 aa, Homo sapiens
  heavy chain complementarity determining region 3 for antibody 2093
ARLDWDYRAFDI

SEQ ID NO: 4187 - protein, 9 aa, Homo sapiens
  light chain complementarity determining region 3 for antibody 2094
MQGTHWPWT

SEQ ID NO: 4188 - protein, 16 aa, Homo sapiens
  heavy chain complementarity determining region 3 for antibody 2094
ARGHANPGERRGGSDF

SEQ ID NO: 4189 - protein, 10 aa, Homo sapiens
  light chain complementarity determining region 3 for antibody 2095
MQGTHWPPVT

SEQ ID NO: 4190 - protein, 10 aa, Homo sapiens
  heavy chain complementarity determining region 3 for antibody 2095
AKGGLAGEND

SEQ ID NO: 4191 - protein, 9 aa, Homo sapiens
  light chain complementarity determining region 3 for antibody 2096
MQGTHWPIT

SEQ ID NO: 4192 - protein, 11 aa, Homo sapiens
  heavy chain complementarity determining region 3 for antibody 2096
TRGGYSVGYDY

SEQ ID NO: 4193 - protein, 9 aa, Homo sapiens
  light chain complementarity determining region 3 for antibody 2097
MQGLRDLPV

SEQ ID NO: 4194 - protein, 15 aa, Homo sapiens
  heavy chain complementarity determining region 3 for antibody 2097
SRDASADSYPDAFDV

SEQ ID NO: 4195 - protein, 9 aa, Homo sapiens
  light chain complementarity determining region 3 for antibody 2098
MQGLHLPCT

SEQ ID NO: 4196 - protein, 13 aa, Homo sapiens
  heavy chain complementarity determining region 3 for antibody 2098
TGGPNCSAGGCLA

SEQ ID NO: 4197 - protein, 9 aa, Homo sapiens
  light chain complementarity determining region 3 for antibody 2099
MQGIHWPWT

SEQ ID NO: 4198 - protein, 11 aa, Homo sapiens
  heavy chain complementarity determining region 3 for antibody 2099
ARSPATGTVDS

SEQ ID NO: 4199 - protein, 9 aa, Homo sapiens
  light chain complementarity determining region 3 for antibody 2100
MQGIHWPWT

SEQ ID NO: 4200 - protein, 10 aa, Homo sapiens
  heavy chain complementarity determining region 3 for antibody 2100
AHRINRAFDI

SEQ ID NO: 4201 - protein, 9 aa, Homo sapiens
  light chain complementarity determining region 3 for antibody 2101
MQFLQTPLT

SEQ ID NO: 4202 - protein, 10 aa, Homo sapiens
  heavy chain complementarity determining region 3 for antibody 2101
ARERYGSYDI

SEQ ID NO: 4203 - protein, 9 aa, Homo sapiens
  light chain complementarity determining region 3 for antibody 2102
MQALQTPPT

SEQ ID NO: 4204 - protein, 10 aa, Homo sapiens
  heavy chain complementarity determining region 3 for antibody 2102
TRHYNWHFDF

SEQ ID NO: 4205 - protein, 9 aa, Homo sapiens
  light chain complementarity determining region 3 for antibody 2103
MQALQTPPT

SEQ ID NO: 4206 - protein, 15 aa, Homo sapiens
  heavy chain complementarity determining region 3 for antibody 2103
ATEIYFGESIYGMDV

SEQ ID NO: 4207 - protein, 9 aa, Homo sapiens
  light chain complementarity determining region 3 for antibody 2104
LRYAHWPHT

SEQ ID NO: 4208 - protein, 15 aa, Homo sapiens
  heavy chain complementarity determining region 3 for antibody 2104
ARVGRPYHNAWYFDN

SEQ ID NO: 4209 - protein, 9 aa, Homo sapiens
  light chain complementarity determining region 3 for antibody 2105
LQHNSYPLT

SEQ ID NO: 4210 - protein, 11 aa, Homo sapiens
  heavy chain complementarity determining region 3 for antibody 2105
VRVSTGWDFDY

SEQ ID NO: 4211 - protein, 9 aa, Homo sapiens
  light chain complementarity determining region 3 for antibody 2106
LQHNSYPLT

SEQ ID NO: 4212 - protein, 11 aa, Homo sapiens
  heavy chain complementarity determining region 3 for antibody 2106
ARDRADDYLDS

SEQ ID NO: 4213 - protein, 9 aa, Homo sapiens
  light chain complementarity determining region 3 for antibody 2107
LQFANWPHT

SEQ ID NO: 4214 - protein, 9 aa, Homo sapiens
  heavy chain complementarity determining region 3 for antibody 2107
AGWGGLSNY

SEQ ID NO: 4215 - protein, 8 aa, Homo sapiens
  light chain complementarity determining region 3 for antibody 2108
LQDYIYAS

SEQ ID NO: 4216 - protein, 7 aa, Homo sapiens
  heavy chain complementarity determining region 3 for antibody 2108
LWITKDY

SEQ ID NO: 4217 - protein, 9 aa, Homo sapiens
  light chain complementarity determining region 3 for antibody 2109
LQDYDYPWT

SEQ ID NO: 4218 - protein, 14 aa, Homo sapiens
  heavy chain complementarity determining region 3 for antibody 2109
ARLIASSGRFGLDY

SEQ ID NO: 4219 - protein, 9 aa, Homo sapiens
  light chain complementarity determining region 3 for antibody 2110
LQDFSYPFS

SEQ ID NO: 4220 - protein, 16 aa, Homo sapiens
  heavy chain complementarity determining region 3 for antibody 2110
VSDVGDHRDTYTTLDY

SEQ ID NO: 4221 - protein, 9 aa, Homo sapiens
  light chain complementarity determining region 3 for antibody 2111
LQDFSYPFS

SEQ ID NO: 4222 - protein, 16 aa, Homo sapiens
  heavy chain complementarity determining region 3 for antibody 2111
VKDVGDHRDTYTTLDY

SEQ ID NO: 4223 - protein, 9 aa, Homo sapiens
  light chain complementarity determining region 3 for antibody 2112
HQYYTSPLP

SEQ ID NO: 4224 - protein, 10 aa, Homo sapiens
  heavy chain complementarity determining region 3 for antibody 2112
AAGSGWLIEY

SEQ ID NO: 4225 - protein, 9 aa, Homo sapiens
  light chain complementarity determining region 3 for antibody 2113
AQGSYCPAS

SEQ ID NO: 4226 - protein, 10 aa, Homo sapiens
  heavy chain complementarity determining region 3 for antibody 2113
CRDREGFGDV

SEQ ID NO: 4227 - protein, 9 aa, Homo sapiens
  light chain complementarity determining region 3 for antibody 2114
QRYNSYSYT

SEQ ID NO: 4228 - protein, 11 aa, Homo sapiens
  heavy chain complementarity determining region 3 for antibody 2114
ARDPGWGACDY

SEQ ID NO: 4229 - protein, 9 aa, Homo sapiens
  light chain complementarity determining region 3 for antibody 2115
QQYYTGPLT

SEQ ID NO: 4230 - protein, 15 aa, Homo sapiens
  heavy chain complementarity determining region 3 for antibody 2115
STHEGMAAAGLVFDF

SEQ ID NO: 4231 - protein, 9 aa, Homo sapiens
  light chain complementarity determining region 3 for antibody 2116
QQYYSSPLT

SEQ ID NO: 4232 - protein, 14 aa, Homo sapiens
  heavy chain complementarity determining region 3 for antibody 2116
AKPTPGSGSFLIDY

SEQ ID NO: 4233 - protein, 9 aa, Homo sapiens
  light chain complementarity determining region 3 for antibody 2117
QQYYSAPYT

SEQ ID NO: 4234 - protein, 17 aa, Homo sapiens
  heavy chain complementarity determining region 3 for antibody 2117
VRQGHHCDGGSCFPANY

SEQ ID NO: 4235 - protein, 9 aa, Homo sapiens
  light chain complementarity determining region 3 for antibody 2118
QQYYETPYT

SEQ ID NO: 4236 - protein, 18 aa, Homo sapiens
  heavy chain complementarity determining region 3 for antibody 2118
ARAAGCIGDKCYQSYFDL

SEQ ID NO: 4237 - protein, 11 aa, Homo sapiens
  light chain complementarity determining region 3 for antibody 2119
QQYSTSPPMYT

SEQ ID NO: 4238 - protein, 11 aa, Homo sapiens
  heavy chain complementarity determining region 3 for antibody 2119
TRGGYSVGYDY

SEQ ID NO: 4239 - protein, 7 aa, Homo sapiens
  light chain complementarity determining region 3 for antibody 2120
QQYNTWT

SEQ ID NO: 4240 - protein, 12 aa, Homo sapiens
  heavy chain complementarity determining region 3 for antibody 2120
ARDKGGRNGTDV

SEQ ID NO: 4241 - protein, 7 aa, Homo sapiens
  light chain complementarity determining region 3 for antibody 2121
QQYNTWA

SEQ ID NO: 4242 - protein, 12 aa, Homo sapiens
  heavy chain complementarity determining region 3 for antibody 2121
ARDKGGRNGMDV

SEQ ID NO: 4243 - protein, 7 aa, Homo sapiens
  light chain complementarity determining region 3 for antibody 2122
QQYNTRT

SEQ ID NO: 4244 - protein, 12 aa, Homo sapiens
  heavy chain complementarity determining region 3 for antibody 2122
ARDKGGRNGMDV

SEQ ID NO: 4245 - protein, 9 aa, Homo sapiens
  light chain complementarity determining region 3 for antibody 2123
QQYNSYSYT

SEQ ID NO: 4246 - protein, 13 aa, Homo sapiens
  heavy chain complementarity determining region 3 for antibody 2123
AKSRDAYNSKNDC

SEQ ID NO: 4247 - protein, 9 aa, Homo sapiens
  light chain complementarity determining region 3 for antibody 2124
QQYNSYSHT

SEQ ID NO: 4248 - protein, 14 aa, Homo sapiens
  heavy chain complementarity determining region 3 for antibody 2124
ARDVQTTGWTLGGY

SEQ ID NO: 4249 - protein, 9 aa, Homo sapiens
  light chain complementarity determining region 3 for antibody 2125
QQYNSYSHT

SEQ ID NO: 4250 - protein, 14 aa, Homo sapiens
  heavy chain complementarity determining region 3 for antibody 2125
ARDVHTPGWTLGGY

SEQ ID NO: 4251 - protein, 9 aa, Homo sapiens
  light chain complementarity determining region 3 for antibody 2126
QQYNSYSHT

SEQ ID NO: 4252 - protein, 14 aa, Homo sapiens
  heavy chain complementarity determining region 3 for antibody 2126
ARDVHATGWTLGGY

SEQ ID NO: 4253 - protein, 9 aa, Homo sapiens
  light chain complementarity determining region 3 for antibody 2127
QQYNSYPLT

SEQ ID NO: 4254 - protein, 16 aa, Homo sapiens
  heavy chain complementarity determining region 3 for antibody 2127
ARFIVEAQYSYYAMDA

SEQ ID NO: 4255 - protein, 9 aa, Homo sapiens
  light chain complementarity determining region 3 for antibody 2128
QQYNSYPLT

SEQ ID NO: 4256 - protein, 13 aa, Homo sapiens
  heavy chain complementarity determining region 3 for antibody 2128
ARDGKIGPYAYDY

SEQ ID NO: 4257 - protein, 9 aa, Homo sapiens
  light chain complementarity determining region 3 for antibody 2129
QQYNSYPLT

SEQ ID NO: 4258 - protein, 14 aa, Homo sapiens
  heavy chain complementarity determining region 3 for antibody 2129
ANYRASIGANCFDP

SEQ ID NO: 4259 - protein, 8 aa, Homo sapiens
  light chain complementarity determining region 3 for antibody 2130
QQYNFYWT

SEQ ID NO: 4260 - protein, 20 aa, Homo sapiens
  heavy chain complementarity determining region 3 for antibody 2130
ARGGIAVAGDVQSGENWFDP

SEQ ID NO: 4261 - protein, 9 aa, Homo sapiens
  light chain complementarity determining region 3 for antibody 2131
QQYKSFPWT

SEQ ID NO: 4262 - protein, 16 aa, Homo sapiens
  heavy chain complementarity determining region 3 for antibody 2131
ARGGGCFGDNCYYPDY

SEQ ID NO: 4263 - protein, 8 aa, Homo sapiens
  light chain complementarity determining region 3 for antibody 2132
QQYGSSVT

SEQ ID NO: 4264 - protein, 12 aa, Homo sapiens
  heavy chain complementarity determining region 3 for antibody 2132
AIVVPGRWDLDD

SEQ ID NO: 4265 - protein, 9 aa, Homo sapiens
  light chain complementarity determining region 3 for antibody 2133
QQYGSSTWT

SEQ ID NO: 4266 - protein, 17 aa, Homo sapiens
  heavy chain complementarity determining region 3 for antibody 2133
AKGRGSVAMALIYFLDL

SEQ ID NO: 4267 - protein, 9 aa, Homo sapiens
  light chain complementarity determining region 3 for antibody 2134
QQYGSSTWT

SEQ ID NO: 4268 - protein, 17 aa, Homo sapiens
  heavy chain complementarity determining region 3 for antibody 2134
AKGRGSVAMALIYDLDL

SEQ ID NO: 4269 - protein, 10 aa, Homo sapiens
  light chain complementarity determining region 3 for antibody 2135
QQYGSSSTWT

SEQ ID NO: 4270 - protein, 20 aa, Homo sapiens
  heavy chain complementarity determining region 3 for antibody 2135
TRDARGSISYAYGGGGGLGV

SEQ ID NO: 4271 - protein, 10 aa, Homo sapiens
  light chain complementarity determining region 3 for antibody 2136
QQYGSSPPFT

SEQ ID NO: 4272 - protein, 11 aa, Homo sapiens
  heavy chain complementarity determining region 3 for antibody 2136
ARDVVYGVSDS

SEQ ID NO: 4273 - protein, 9 aa, Homo sapiens
  light chain complementarity determining region 3 for antibody 2137
QQYGGSLIT

SEQ ID NO: 4274 - protein, 10 aa, Homo sapiens
  heavy chain complementarity determining region 3 for antibody 2137
CRDRWGFGDV

SEQ ID NO: 4275 - protein, 9 aa, Homo sapiens
  light chain complementarity determining region 3 for antibody 2138
QQYGDSPRT

SEQ ID NO: 4276 - protein, 17 aa, Homo sapiens
  heavy chain complementarity determining region 3 for antibody 2138
AKDRGVSVAPGAYFSDS

SEQ ID NO: 4277 - protein, 9 aa, Homo sapiens
  light chain complementarity determining region 3 for antibody 2139
QQYFSIPLT

SEQ ID NO: 4278 - protein, 7 aa, Homo sapiens
  heavy chain complementarity determining region 3 for antibody 2139
TTGDLRN

SEQ ID NO: 4279 - protein, 9 aa, Homo sapiens
  light chain complementarity determining region 3 for antibody 2140
QQYFNTPLT

SEQ ID NO: 4280 - protein, 17 aa, Homo sapiens
  heavy chain complementarity determining region 3 for antibody 2140
ARKSYYYDSSDFGWFGP

SEQ ID NO: 4281 - protein, 9 aa, Homo sapiens
  light chain complementarity determining region 3 for antibody 2141
QQYDTSPRT

SEQ ID NO: 4282 - protein, 11 aa, Homo sapiens
  heavy chain complementarity determining region 3 for antibody 2141
TRGGYSVGYDY

SEQ ID NO: 4283 - protein, 9 aa, Homo sapiens
  light chain complementarity determining region 3 for antibody 2142
QQYDNLPYT

SEQ ID NO: 4284 - protein, 22 aa, Homo sapiens
  heavy chain complementarity determining region 3 for antibody 2142
ASRSITIFGVVNKRLHYYGMDV

SEQ ID NO: 4285 - protein, 9 aa, Homo sapiens
  light chain complementarity determining region 3 for antibody 2143
QQYDNLPLT

SEQ ID NO: 4286 - protein, 13 aa, Homo sapiens
  heavy chain complementarity determining region 3 for antibody 2143
TREGDSSGPDFHL

SEQ ID NO: 4287 - protein, 10 aa, Homo sapiens
  light chain complementarity determining region 3 for antibody 2144
QQYDNLASLT

SEQ ID NO: 4288 - protein, 15 aa, Homo sapiens
  heavy chain complementarity determining region 3 for antibody 2144
ARVGRPYHNAWYFDN

SEQ ID NO: 4289 - protein, 9 aa, Homo sapiens
  light chain complementarity determining region 3 for antibody 2145
QQYASEPFT

SEQ ID NO: 4290 - protein, 11 aa, Homo sapiens
  heavy chain complementarity determining region 3 for antibody 2145
ATGYDNVKVGY

SEQ ID NO: 4291 - protein, 9 aa, Homo sapiens
  light chain complementarity determining region 3 for antibody 2146
QQTYSTTWT

SEQ ID NO: 4292 - protein, 23 aa, Homo sapiens
  heavy chain complementarity determining region 3 for antibody 2146
ARDFPKGGYSGYENKYSYYYMDV

SEQ ID NO: 4293 - protein, 9 aa, Homo sapiens
  light chain complementarity determining region 3 for antibody 2147
QQTYSSPWT

SEQ ID NO: 4294 - protein, 15 aa, Homo sapiens
  heavy chain complementarity determining region 3 for antibody 2147
ARIWTSSTNCQYMDV

SEQ ID NO: 4295 - protein, 8 aa, Homo sapiens
  light chain complementarity determining region 3 for antibody 2148
QQSYSTWT

SEQ ID NO: 4296 - protein, 11 aa, Homo sapiens
  heavy chain complementarity determining region 3 for antibody 2148
ARDRADRYFDS

SEQ ID NO: 4297 - protein, 8 aa, Homo sapiens
  light chain complementarity determining region 3 for antibody 2149
QQSYSTPT

SEQ ID NO: 4298 - protein, 12 aa, Homo sapiens
  heavy chain complementarity determining region 3 for antibody 2149
ARDLGASTPLDP

SEQ ID NO: 4299 - protein, 9 aa, Homo sapiens
  light chain complementarity determining region 3 for antibody 2150
QQSYSTPST

SEQ ID NO: 4300 - protein, 15 aa, Homo sapiens
  heavy chain complementarity determining region 3 for antibody 2150
ARWFSRSTGVSYMDV

SEQ ID NO: 4301 - protein, 9 aa, Homo sapiens
  light chain complementarity determining region 3 for antibody 2151
QQSYSTPSP

SEQ ID NO: 4302 - protein, 16 aa, Homo sapiens
  heavy chain complementarity determining region 3 for antibody 2151
ARWFSRSSTGVSYMDV

SEQ ID NO: 4303 - protein, 10 aa, Homo sapiens
  light chain complementarity determining region 3 for antibody 2152
QQSYSTPQFT

SEQ ID NO: 4304 - protein, 11 aa, Homo sapiens
  heavy chain complementarity determining region 3 for antibody 2152
VRVSTGWYFDY

SEQ ID NO: 4305 - protein, 11 aa, Homo sapiens
  light chain complementarity determining region 3 for antibody 2153
QQSYSTPPSYT

SEQ ID NO: 4306 - protein, 10 aa, Homo sapiens
  heavy chain complementarity determining region 3 for antibody 2153
ARGKYSPGVY

SEQ ID NO: 4307 - protein, 9 aa, Homo sapiens
  light chain complementarity determining region 3 for antibody 2154
QQSYSTPLT

SEQ ID NO: 4308 - protein, 18 aa, Homo sapiens
  heavy chain complementarity determining region 3 for antibody 2154
ARGDYPEARTGYFLDFDY

SEQ ID NO: 4309 - protein, 10 aa, Homo sapiens
  light chain complementarity determining region 3 for antibody 2155
QQSYSTPLFT

SEQ ID NO: 4310 - protein, 19 aa, Homo sapiens
  heavy chain complementarity determining region 3 for antibody 2155
ARETGGWYTTSQGYWYFDL

SEQ ID NO: 4311 - protein, 10 aa, Homo sapiens
  light chain complementarity determining region 3 for antibody 2156
QQSYSTPLFT

SEQ ID NO: 4312 - protein, 13 aa, Homo sapiens
  heavy chain complementarity determining region 3 for antibody 2156
AKEGSSPGPDFEY

SEQ ID NO: 4313 - protein, 10 aa, Homo sapiens
  light chain complementarity determining region 3 for antibody 2157
QQSYSTPLFP

SEQ ID NO: 4314 - protein, 23 aa, Homo sapiens
  heavy chain complementarity determining region 3 for antibody 2157
ARHFPMGGSTVTGTQSLLYYMDV

SEQ ID NO: 4315 - protein, 9 aa, Homo sapiens
  light chain complementarity determining region 3 for antibody 2158
QQSYSTPHT

SEQ ID NO: 4316 - protein, 19 aa, Homo sapiens
  heavy chain complementarity determining region 3 for antibody 2158
AREVVYYLAVAGGYDAFDI

SEQ ID NO: 4317 - protein, 9 aa, Homo sapiens
  light chain complementarity determining region 3 for antibody 2159
QQSYDTPPT

SEQ ID NO: 4318 - protein, 14 aa, Homo sapiens
  heavy chain complementarity determining region 3 for antibody 2159
ARPRSAKSTYYFDY

SEQ ID NO: 4319 - protein, 9 aa, Homo sapiens
  light chain complementarity determining region 3 for antibody 2160
QQRSNWSWT

SEQ ID NO: 4320 - protein, 12 aa, Homo sapiens
  heavy chain complementarity determining region 3 for antibody 2160
AGPFDSRVLPSI

SEQ ID NO: 4321 - protein, 10 aa, Homo sapiens
  light chain complementarity determining region 3 for antibody 2161
QQRSNWPRVT

SEQ ID NO: 4322 - protein, 17 aa, Homo sapiens
  heavy chain complementarity determining region 3 for antibody 2161
ARELGFWSGYAYNWFDP

SEQ ID NO: 4323 - protein, 10 aa, Homo sapiens
  light chain complementarity determining region 3 for antibody 2162
QQRSNWPPYT

SEQ ID NO: 4324 - protein, 12 aa, Homo sapiens
  heavy chain complementarity determining region 3 for antibody 2162
TREYSRGWYPGY

SEQ ID NO: 4325 - protein, 9 aa, Homo sapiens
  light chain complementarity determining region 3 for antibody 2163
QQRSNWPLT

SEQ ID NO: 4326 - protein, 16 aa, Homo sapiens
  heavy chain complementarity determining region 3 for antibody 2163
ASLPTRGYYYYYGMDV

SEQ ID NO: 4327 - protein, 11 aa, Homo sapiens
  light chain complementarity determining region 3 for antibody 2164
QQLNKYPRGFT

SEQ ID NO: 4328 - protein, 27 aa, Homo sapiens
  heavy chain complementarity determining region 3 for antibody 2164
APQYEIVVVGDVSLVSPRIYYNCYMDV

SEQ ID NO: 4329 - protein, 9 aa, Homo sapiens
  light chain complementarity determining region 3 for antibody 2165
QQLNFYPFT

SEQ ID NO: 4330 - protein, 17 aa, Homo sapiens
  heavy chain complementarity determining region 3 for antibody 2165
ARNFYDSSGYYWEALDI

SEQ ID NO: 4331 - protein, 9 aa, Homo sapiens
  light chain complementarity determining region 3 for antibody 2166
QQIHTYPLT

SEQ ID NO: 4332 - protein, 14 aa, Homo sapiens
  heavy chain complementarity determining region 3 for antibody 2166
SHPTRAARLPIFDY

SEQ ID NO: 4333 - protein, 9 aa, Homo sapiens
  light chain complementarity determining region 3 for antibody 2167
QQGSNTPLT

SEQ ID NO: 4334 - protein, 16 aa, Homo sapiens
  heavy chain complementarity determining region 3 for antibody 2167
VRDLAGFTRGGSTFDY

SEQ ID NO: 4335 - protein, 9 aa, Homo sapiens
  light chain complementarity determining region 3 for antibody 2168
QQGNSFPPT

SEQ ID NO: 4336 - protein, 12 aa, Homo sapiens
  heavy chain complementarity determining region 3 for antibody 2168
ARDKGGRNGMDV

SEQ ID NO: 4337 - protein, 9 aa, Homo sapiens
  light chain complementarity determining region 3 for antibody 2169
QQFSNLPRT

SEQ ID NO: 4338 - protein, 13 aa, Homo sapiens
  heavy chain complementarity determining region 3 for antibody 2169
AKEGASPGPDFDS

SEQ ID NO: 4339 - protein, 9 aa, Homo sapiens
  light chain complementarity determining region 3 for antibody 2170
QQFNSYPYT

SEQ ID NO: 4340 - protein, 8 aa, Homo sapiens
  heavy chain complementarity determining region 3 for antibody 2170
ASQTLVVN

SEQ ID NO: 4341 - protein, 9 aa, Homo sapiens
  light chain complementarity determining region 3 for antibody 2171
QQFNSYPYT

SEQ ID NO: 4342 - protein, 20 aa, Homo sapiens
  heavy chain complementarity determining region 3 for antibody 2171
ARDFRSVYYDSSGHKRYLDP

SEQ ID NO: 4343 - protein, 9 aa, Homo sapiens
  light chain complementarity determining region 3 for antibody 2172
QQFGRLPWT

SEQ ID NO: 4344 - protein, 21 aa, Homo sapiens
  heavy chain complementarity determining region 3 for antibody 2172
AREIGYYGSGTSGTYHYTFDV

SEQ ID NO: 4345 - protein, 9 aa, Homo sapiens
  light chain complementarity determining region 3 for antibody 2173
QQFANFPRT

SEQ ID NO: 4346 - protein, 9 aa, Homo sapiens
  heavy chain complementarity determining region 3 for antibody 2173
VRGRSNFRF

SEQ ID NO: 4347 - protein, 9 aa, Homo sapiens
  light chain complementarity determining region 3 for antibody 2174
QQANSLPLT

SEQ ID NO: 4348 - protein, 19 aa, Homo sapiens
  heavy chain complementarity determining region 3 for antibody 2174
ARGLGYCTPSACRADAFDI

SEQ ID NO: 4349 - protein, 9 aa, Homo sapiens
  light chain complementarity determining region 3 for antibody 2175
QNYNSVPLT

SEQ ID NO: 4350 - protein, 11 aa, Homo sapiens
  heavy chain complementarity determining region 3 for antibody 2175
ARDTGNFYVDF

SEQ ID NO: 4351 - protein, 9 aa, Homo sapiens
  light chain complementarity determining region 3 for antibody 2176
QKYNTAPFT

SEQ ID NO: 4352 - protein, 15 aa, Homo sapiens
  heavy chain complementarity determining region 3 for antibody 2176
TTVQCTDGWYNAFDI

SEQ ID NO: 4353 - protein, 9 aa, Homo sapiens
  light chain complementarity determining region 3 for antibody 2177
QKYNSASWT

SEQ ID NO: 4354 - protein, 12 aa, Homo sapiens
  heavy chain complementarity determining region 3 for antibody 2177
AGSRSGGGSVDY

SEQ ID NO: 4355 - protein, 10 aa, Homo sapiens
  light chain complementarity determining region 3 for antibody 2178
QKYNSAPRVT

SEQ ID NO: 4356 - protein, 11 aa, Homo sapiens
  heavy chain complementarity determining region 3 for antibody 2178
ATFGQQWRLAH

SEQ ID NO: 4357 - protein, 9 aa, Homo sapiens
  light chain complementarity determining region 3 for antibody 2179
QKYKSAPFT

SEQ ID NO: 4358 - protein, 13 aa, Homo sapiens
  heavy chain complementarity determining region 3 for antibody 2179
AKEGSAPGPDFEY

SEQ ID NO: 4359 - protein, 9 aa, Homo sapiens
  light chain complementarity determining region 3 for antibody 2180
QKYKSAPFT

SEQ ID NO: 4360 - protein, 13 aa, Homo sapiens
  heavy chain complementarity determining region 3 for antibody 2180
AKEGASPGPDFEY

SEQ ID NO: 4361 - protein, 9 aa, Homo sapiens
  light chain complementarity determining region 3 for antibody 2181
QKYGSSPVP

SEQ ID NO: 4362 - protein, 6 aa, Homo sapiens
  heavy chain complementarity determining region 3 for antibody 2181
ARISAY

SEQ ID NO: 4363 - protein, 9 aa, Homo sapiens
  light chain complementarity determining region 3 for antibody 2182
QEYRTPPWT

SEQ ID NO: 4364 - protein, 20 aa, Homo sapiens
  heavy chain complementarity determining region 3 for antibody 2182
ARDGRGTVYYHNAGGGGLDV

SEQ ID NO: 4365 - protein, 9 aa, Homo sapiens
  light chain complementarity determining region 3 for antibody 2183
MQYTHWPHT

SEQ ID NO: 4366 - protein, 9 aa, Homo sapiens
  heavy chain complementarity determining region 3 for antibody 2183
AGWGGISNI

SEQ ID NO: 4367 - protein, 9 aa, Homo sapiens
  light chain complementarity determining region 3 for antibody 2184
MQVTHWPRT

SEQ ID NO: 4368 - protein, 17 aa, Homo sapiens
  heavy chain complementarity determining region 3 for antibody 2184
ARNTMVGTWQRQGNLDH

SEQ ID NO: 4369 - protein, 9 aa, Homo sapiens
  light chain complementarity determining region 3 for antibody 2185
MQTLQTPWT

SEQ ID NO: 4370 - protein, 12 aa, Homo sapiens
  heavy chain complementarity determining region 3 for antibody 2185
ARLDWNYRAFDT

SEQ ID NO: 4371 - protein, 9 aa, Homo sapiens
  light chain complementarity determining region 3 for antibody 2186
MQTLQTPGT

SEQ ID NO: 4372 - protein, 13 aa, Homo sapiens
  heavy chain complementarity determining region 3 for antibody 2186
AKRYSTNWGHFDY

SEQ ID NO: 4373 - protein, 9 aa, Homo sapiens
  light chain complementarity determining region 3 for antibody 2187
MQNTHWPWT

SEQ ID NO: 4374 - protein, 16 aa, Homo sapiens
  heavy chain complementarity determining region 3 for antibody 2187
SADLGDHVDYYATLDY

SEQ ID NO: 4375 - protein, 9 aa, Homo sapiens
  light chain complementarity determining region 3 for antibody 2188
MQGTHWPYT

SEQ ID NO: 4376 - protein, 19 aa, Homo sapiens
  heavy chain complementarity determining region 3 for antibody 2188
TRFAAYYFDSSGFYSSFDY

SEQ ID NO: 4377 - protein, 9 aa, Homo sapiens
  light chain complementarity determining region 3 for antibody 2189
MQGTHWPPT

SEQ ID NO: 4378 - protein, 19 aa, Homo sapiens
  heavy chain complementarity determining region 3 for antibody 2189
VRGSVVVTATIGHNDAFDI

SEQ ID NO: 4379 - protein, 9 aa, Homo sapiens
  light chain complementarity determining region 3 for antibody 2190
MQGTHWPPA

SEQ ID NO: 4380 - protein, 13 aa, Homo sapiens
  heavy chain complementarity determining region 3 for antibody 2190
ARDTVTNKMGSDY

SEQ ID NO: 4381 - protein, 9 aa, Homo sapiens
  light chain complementarity determining region 3 for antibody 2191
MQGLQIPRT

SEQ ID NO: 4382 - protein, 13 aa, Homo sapiens
  heavy chain complementarity determining region 3 for antibody 2191
ARDHTYSVPGGGY

SEQ ID NO: 4383 - protein, 9 aa, Homo sapiens
  light chain complementarity determining region 3 for antibody 2192
MQFLKTPLT

SEQ ID NO: 4384 - protein, 10 aa, Homo sapiens
  heavy chain complementarity determining region 3 for antibody 2192
ARERSGSYDI

SEQ ID NO: 4385 - protein, 9 aa, Homo sapiens
  light chain complementarity determining region 3 for antibody 2193
MQATHWPHT

SEQ ID NO: 4386 - protein, 8 aa, Homo sapiens
  heavy chain complementarity determining region 3 for antibody 2193
VRSLSLAA

SEQ ID NO: 4387 - protein, 9 aa, Homo sapiens
  light chain complementarity determining region 3 for antibody 2194
LQYYTAPWT

SEQ ID NO: 4388 - protein, 17 aa, Homo sapiens
  heavy chain complementarity determining region 3 for antibody 2194
SRDGRIIWPGSQGSLDF

SEQ ID NO: 4389 - protein, 9 aa, Homo sapiens
  light chain complementarity determining region 3 for antibody 2195
LQYSYWPHT

SEQ ID NO: 4390 - protein, 9 aa, Homo sapiens
  heavy chain complementarity determining region 3 for antibody 2195
AGWGGTSNP

SEQ ID NO: 4391 - protein, 9 aa, Homo sapiens
  light chain complementarity determining region 3 for antibody 2196
LQYNDYPWT

SEQ ID NO: 4392 - protein, 13 aa, Homo sapiens
  heavy chain complementarity determining region 3 for antibody 2196
AKEGSAPGPDFEY

SEQ ID NO: 4393 - protein, 9 aa, Homo sapiens
  light chain complementarity determining region 3 for antibody 2197
LQNNSYPLT

SEQ ID NO: 4394 - protein, 11 aa, Homo sapiens
  heavy chain complementarity determining region 3 for antibody 2197
VRVSTGWNFDY

SEQ ID NO: 4395 - protein, 9 aa, Homo sapiens
  light chain complementarity determining region 3 for antibody 2198
LQHNSYPLT

SEQ ID NO: 4396 - protein, 10 aa, Homo sapiens
  heavy chain complementarity determining region 3 for antibody 2198
CRDRGGFGDV

SEQ ID NO: 4397 - protein, 9 aa, Homo sapiens
  light chain complementarity determining region 3 for antibody 2199
LQHDSYPLT

SEQ ID NO: 4398 - protein, 12 aa, Homo sapiens
  heavy chain complementarity determining region 3 for antibody 2199
GRVEFCGGDCPE

SEQ ID NO: 4399 - protein, 9 aa, Homo sapiens
  light chain complementarity determining region 3 for antibody 2200
LQFLQTPLT

SEQ ID NO: 4400 - protein, 10 aa, Homo sapiens
  heavy chain complementarity determining region 3 for antibody 2200
ARERSGSYDI

SEQ ID NO: 4401 - protein, 9 aa, Homo sapiens
  light chain complementarity determining region 3 for antibody 2201
LQDYSYPRT

SEQ ID NO: 4402 - protein, 13 aa, Homo sapiens
  heavy chain complementarity determining region 3 for antibody 2201
TKEGSSAGPDFVY

SEQ ID NO: 4403 - protein, 9 aa, Homo sapiens
  light chain complementarity determining region 3 for antibody 2202
LQDYNHVGT

SEQ ID NO: 4404 - protein, 14 aa, Homo sapiens
  heavy chain complementarity determining region 3 for antibody 2202
VSQSRSAVNGGGVY

SEQ ID NO: 4405 - protein, 9 aa, Homo sapiens
  light chain complementarity determining region 3 for antibody 2203
LQDYNHVGT

SEQ ID NO: 4406 - protein, 10 aa, Homo sapiens
  heavy chain complementarity determining region 3 for antibody 2203
CRDREGFGDV

SEQ ID NO: 4407 - protein, 9 aa, Homo sapiens
  light chain complementarity determining region 3 for antibody 2204
LQDHKYPFT

SEQ ID NO: 4408 - protein, 10 aa, Homo sapiens
  heavy chain complementarity determining region 3 for antibody 2204
TRHYNWHFDF

SEQ ID NO: 4409 - protein, 9 aa, Homo sapiens
  light chain complementarity determining region 3 for antibody 2205
LPFAHWPHT

SEQ ID NO: 4410 - protein, 9 aa, Homo sapiens
  heavy chain complementarity determining region 3 for antibody 2205
AGWGGLSNY

SEQ ID NO: 4411 - protein, 9 aa, Homo sapiens
  light chain complementarity determining region 3 for antibody 2206
HQYYSTPLT

SEQ ID NO: 4412 - protein, 15 aa, Homo sapiens
  heavy chain complementarity determining region 3 for antibody 2206
ARQVTGATKTRHFDY

SEQ ID NO: 4413 - protein, 9 aa, Homo sapiens
  light chain complementarity determining region 3 for antibody 2207
HQYLYSPRT

SEQ ID NO: 4414 - protein, 16 aa, Homo sapiens
  heavy chain complementarity determining region 3 for antibody 2207
TADVGDHRDRYVTLDH

SEQ ID NO: 4415 - protein, 9 aa, Homo sapiens
  light chain complementarity determining region 3 for antibody 2208
HHFGSATGT

SEQ ID NO: 4416 - protein, 10 aa, Homo sapiens
  heavy chain complementarity determining region 3 for antibody 2208
CRDRWGFGDV

SEQ ID NO: 4417 - protein, 9 aa, Homo sapiens
  light chain complementarity determining region 3 for antibody 2209
AQGSYWPAS

SEQ ID NO: 4418 - protein, 10 aa, Homo sapiens
  heavy chain complementarity determining region 3 for antibody 2209
CRDRGGFGDV

SEQ ID NO: 4419 - protein, 9 aa, Homo sapiens
  light chain complementarity determining region 3 for antibody 2210
AQGSFWPAT

SEQ ID NO: 4420 - protein, 14 aa, Homo sapiens
  heavy chain complementarity determining region 3 for antibody 2210
ARENCYGTGSCFDI

SEQ ID NO: 4421 - protein, 9 aa, Homo sapiens
  light chain complementarity determining region 3 for antibody 2211
WQGTHWPGT

SEQ ID NO: 4422 - protein, 11 aa, Homo sapiens
  heavy chain complementarity determining region 3 for antibody 2211
TKDHDGARAGH

SEQ ID NO: 4423 - protein, 9 aa, Homo sapiens
  light chain complementarity determining region 3 for antibody 2212
RQTLQTPWT

SEQ ID NO: 4424 - protein, 12 aa, Homo sapiens
  heavy chain complementarity determining region 3 for antibody 2212
ARLDWNYRAFDI

SEQ ID NO: 4425 - protein, 9 aa, Homo sapiens
  light chain complementarity determining region 3 for antibody 2213
QYHNNVPRT

SEQ ID NO: 4426 - protein, 11 aa, Homo sapiens
  heavy chain complementarity determining region 3 for antibody 2213
ARDFDGAGYDY

SEQ ID NO: 4427 - protein, 9 aa, Homo sapiens
  light chain complementarity determining region 3 for antibody 2214
QRYNTVPWT

SEQ ID NO: 4428 - protein, 20 aa, Homo sapiens
  heavy chain complementarity determining region 3 for antibody 2214
TRDQRSINLWSLAEGGGMDV

SEQ ID NO: 4429 - protein, 9 aa, Homo sapiens
  light chain complementarity determining region 3 for antibody 2215
QQYYTTLWT

SEQ ID NO: 4430 - protein, 11 aa, Homo sapiens
  heavy chain complementarity determining region 3 for antibody 2215
TATRHEPFFDY

SEQ ID NO: 4431 - protein, 9 aa, Homo sapiens
  light chain complementarity determining region 3 for antibody 2216
QQYYTSPLT

SEQ ID NO: 4432 - protein, 10 aa, Homo sapiens
  heavy chain complementarity determining region 3 for antibody 2216
AKDAYSRPDN

SEQ ID NO: 4433 - protein, 9 aa, Homo sapiens
  light chain complementarity determining region 3 for antibody 2217
QQYYSSPLT

SEQ ID NO: 4434 - protein, 14 aa, Homo sapiens
  heavy chain complementarity determining region 3 for antibody 2217
AKPTRGSGSFLIDY

SEQ ID NO: 4435 - protein, 9 aa, Homo sapiens
  light chain complementarity determining region 3 for antibody 2218
QQYYSFPPT

SEQ ID NO: 4436 - protein, 15 aa, Homo sapiens
  heavy chain complementarity determining region 3 for antibody 2218
TTSRRYGGNSFLCDW

SEQ ID NO: 4437 - protein, 9 aa, Homo sapiens
  light chain complementarity determining region 3 for antibody 2219
QQYYSAPQT

SEQ ID NO: 4438 - protein, 9 aa, Homo sapiens
  heavy chain complementarity determining region 3 for antibody 2219
ARDVWPEDY

SEQ ID NO: 4439 - protein, 9 aa, Homo sapiens
  light chain complementarity determining region 3 for antibody 2220
QQYYSAPIT

SEQ ID NO: 4440 - protein, 14 aa, Homo sapiens
  heavy chain complementarity determining region 3 for antibody 2220
SRGESPSCDFILDY

SEQ ID NO: 4441 - protein, 9 aa, Homo sapiens
  light chain complementarity determining region 3 for antibody 2221
QQYYGTPLT

SEQ ID NO: 4442 - protein, 17 aa, Homo sapiens
  heavy chain complementarity determining region 3 for antibody 2221
TTGLGFCGDTSATCSDS

SEQ ID NO: 4443 - protein, 9 aa, Homo sapiens
  light chain complementarity determining region 3 for antibody 2222
QQYYGAPLT

SEQ ID NO: 4444 - protein, 14 aa, Homo sapiens
  heavy chain complementarity determining region 3 for antibody 2222
ARPTFGPGSFLIEY

SEQ ID NO: 4445 - protein, 7 aa, Homo sapiens
  light chain complementarity determining region 3 for antibody 2223
QQYSTWT

SEQ ID NO: 4446 - protein, 12 aa, Homo sapiens
  heavy chain complementarity determining region 3 for antibody 2223
VKDRGGRTGMDL

SEQ ID NO: 4447 - protein, 9 aa, Homo sapiens
  light chain complementarity determining region 3 for antibody 2224
QQYSNWPIT

SEQ ID NO: 4448 - protein, 15 aa, Homo sapiens
  heavy chain complementarity determining region 3 for antibody 2224
AKDVFTNGWYNFFDP

SEQ ID NO: 4449 - protein, 9 aa, Homo sapiens
  light chain complementarity determining region 3 for antibody 2225
QQYNYYPLT

SEQ ID NO: 4450 - protein, 15 aa, Homo sapiens
  heavy chain complementarity determining region 3 for antibody 2225
ARGDYGDYIGVPFDY

SEQ ID NO: 4451 - protein, 7 aa, Homo sapiens
  light chain complementarity determining region 3 for antibody 2226
QQYNTWT

SEQ ID NO: 4452 - protein, 10 aa, Homo sapiens
  heavy chain complementarity determining region 3 for antibody 2226
CRDREGFGDV

SEQ ID NO: 4453 - protein, 7 aa, Homo sapiens
  light chain complementarity determining region 3 for antibody 2227
QQYNTWT

SEQ ID NO: 4454 - protein, 11 aa, Homo sapiens
  heavy chain complementarity determining region 3 for antibody 2227
ARRSLGGAFDY

SEQ ID NO: 4455 - protein, 7 aa, Homo sapiens
  light chain complementarity determining region 3 for antibody 2228
QQYNTWT

SEQ ID NO: 4456 - protein, 12 aa, Homo sapiens
  heavy chain complementarity determining region 3 for antibody 2228
ARGKGGRNGMDV

SEQ ID NO: 4457 - protein, 7 aa, Homo sapiens
  light chain complementarity determining region 3 for antibody 2229
QQYNTWT

SEQ ID NO: 4458 - protein, 13 aa, Homo sapiens
  heavy chain complementarity determining region 3 for antibody 2229
AKEGSSPGPDFEY

SEQ ID NO: 4459 - protein, 8 aa, Homo sapiens
  light chain complementarity determining region 3 for antibody 2230
QQYNTWLT

SEQ ID NO: 4460 - protein, 13 aa, Homo sapiens
  heavy chain complementarity determining region 3 for antibody 2230
ARNSGSGTYSLAY

SEQ ID NO: 4461 - protein, 8 aa, Homo sapiens
  light chain complementarity determining region 3 for antibody 2231
QQYNSYSS

SEQ ID NO: 4462 - protein, 12 aa, Homo sapiens
  heavy chain complementarity determining region 3 for antibody 2231
AGSRSGGGFSDY

SEQ ID NO: 4463 - protein, 8 aa, Homo sapiens
  light chain complementarity determining region 3 for antibody 2232
QQYNSYSN

SEQ ID NO: 4464 - protein, 17 aa, Homo sapiens
  heavy chain complementarity determining region 3 for antibody 2232
VKGNSAGVGSTLATFDF

SEQ ID NO: 4465 - protein, 9 aa, Homo sapiens
  light chain complementarity determining region 3 for antibody 2233
QQYNSYSHT

SEQ ID NO: 4466 - protein, 14 aa, Homo sapiens
  heavy chain complementarity determining region 3 for antibody 2233
ARDVHTTGWPLGGY

SEQ ID NO: 4467 - protein, 9 aa, Homo sapiens
  light chain complementarity determining region 3 for antibody 2234
QQYNNWPWT

SEQ ID NO: 4468 - protein, 9 aa, Homo sapiens
  heavy chain complementarity determining region 3 for antibody 2234
VRGSPVWDA

SEQ ID NO: 4469 - protein, 9 aa, Homo sapiens
  light chain complementarity determining region 3 for antibody 2235
QQYNNWPGT

SEQ ID NO: 4470 - protein, 17 aa, Homo sapiens
  heavy chain complementarity determining region 3 for antibody 2235
AKSADIVVVPGATEFDP

SEQ ID NO: 4471 - protein, 9 aa, Homo sapiens
  light chain complementarity determining region 3 for antibody 2236
QQYKSYPLT

SEQ ID NO: 4472 - protein, 16 aa, Homo sapiens
  heavy chain complementarity determining region 3 for antibody 2236
ARGNPPNCGAGSCYDQ

SEQ ID NO: 4473 - protein, 9 aa, Homo sapiens
  light chain complementarity determining region 3 for antibody 2237
QQYHNWPGT

SEQ ID NO: 4474 - protein, 11 aa, Homo sapiens
  heavy chain complementarity determining region 3 for antibody 2237
AKGGFYLLTGD

SEQ ID NO: 4475 - protein, 8 aa, Homo sapiens
  light chain complementarity determining region 3 for antibody 2238
QQYGTSFT

SEQ ID NO: 4476 - protein, 16 aa, Homo sapiens
  heavy chain complementarity determining region 3 for antibody 2238
SRWAGVASGWSGLFDN

SEQ ID NO: 4477 - protein, 9 aa, Homo sapiens
  light chain complementarity determining region 3 for antibody 2239
QQYGSSVWT

SEQ ID NO: 4478 - protein, 17 aa, Homo sapiens
  heavy chain complementarity determining region 3 for antibody 2239
ARNTMVGTWQRQGNLDH

SEQ ID NO: 4479 - protein, 9 aa, Homo sapiens
  light chain complementarity determining region 3 for antibody 2240
QQYGSSTWT

SEQ ID NO: 4480 - protein, 17 aa, Homo sapiens
  heavy chain complementarity determining region 3 for antibody 2240
AKGRGSVAMARIYYLDL

SEQ ID NO: 4481 - protein, 9 aa, Homo sapiens
  light chain complementarity determining region 3 for antibody 2241
QQYGSSPWT

SEQ ID NO: 4482 - protein, 12 aa, Homo sapiens
  heavy chain complementarity determining region 3 for antibody 2241
TRDPEGDEDFDY

SEQ ID NO: 4483 - protein, 10 aa, Homo sapiens
  light chain complementarity determining region 3 for antibody 2242
QQYGSSPTWT

SEQ ID NO: 4484 - protein, 15 aa, Homo sapiens
  heavy chain complementarity determining region 3 for antibody 2242
ATVTCTNGWYNAFDI

SEQ ID NO: 4485 - protein, 9 aa, Homo sapiens
  light chain complementarity determining region 3 for antibody 2243
QQYGSSPRT

SEQ ID NO: 4486 - protein, 19 aa, Homo sapiens
  heavy chain complementarity determining region 3 for antibody 2243
ARDRGYCSSGSCFPWWFDP

SEQ ID NO: 4487 - protein, 10 aa, Homo sapiens
  light chain complementarity determining region 3 for antibody 2244
QQYGSSPPGT

SEQ ID NO: 4488 - protein, 19 aa, Homo sapiens
  heavy chain complementarity determining region 3 for antibody 2244
AREAVRCRDGVCYNATFDI

SEQ ID NO: 4489 - protein, 8 aa, Homo sapiens
  light chain complementarity determining region 3 for antibody 2245
QQYGSSFT

SEQ ID NO: 4490 - protein, 18 aa, Homo sapiens
  heavy chain complementarity determining region 3 for antibody 2245
AWWAGTANHDFWSGPFDY

SEQ ID NO: 4491 - protein, 9 aa, Homo sapiens
  light chain complementarity determining region 3 for antibody 2246
QQYFSIPLT

SEQ ID NO: 4492 - protein, 6 aa, Homo sapiens
  heavy chain complementarity determining region 3 for antibody 2246
ARISAY

SEQ ID NO: 4493 - protein, 9 aa, Homo sapiens
  light chain complementarity determining region 3 for antibody 2247
QQYDNLPYT

SEQ ID NO: 4494 - protein, 13 aa, Homo sapiens
  heavy chain complementarity determining region 3 for antibody 2247
AKEGAAPGPDFEY

SEQ ID NO: 4495 - protein, 9 aa, Homo sapiens
  light chain complementarity determining region 3 for antibody 2248
QQYDNLPYT

SEQ ID NO: 4496 - protein, 10 aa, Homo sapiens
  heavy chain complementarity determining region 3 for antibody 2248
AHRINRAFDI

SEQ ID NO: 4497 - protein, 10 aa, Homo sapiens
  light chain complementarity determining region 3 for antibody 2249
QQYDNLASPT

SEQ ID NO: 4498 - protein, 13 aa, Homo sapiens
  heavy chain complementarity determining region 3 for antibody 2249
AKEGSSPGPDFEY

SEQ ID NO: 4499 - protein, 10 aa, Homo sapiens
  light chain complementarity determining region 3 for antibody 2250
QQYDNLASLT

SEQ ID NO: 4500 - protein, 13 aa, Homo sapiens
  heavy chain complementarity determining region 3 for antibody 2250
TKEGSSAGPDFVY

SEQ ID NO: 4501 - protein, 10 aa, Homo sapiens
  light chain complementarity determining region 3 for antibody 2251
QQYDNLASLT

SEQ ID NO: 4502 - protein, 13 aa, Homo sapiens
  heavy chain complementarity determining region 3 for antibody 2251
AKEGSPPGPDFEY

SEQ ID NO: 4503 - protein, 9 aa, Homo sapiens
  light chain complementarity determining region 3 for antibody 2252
QQTYRTPYP

SEQ ID NO: 4504 - protein, 14 aa, Homo sapiens
  heavy chain complementarity determining region 3 for antibody 2252
ARLHGSGLGRWLDP

SEQ ID NO: 4505 - protein, 9 aa, Homo sapiens
  light chain complementarity determining region 3 for antibody 2253
QQTFSVPHT

SEQ ID NO: 4506 - protein, 16 aa, Homo sapiens
  heavy chain complementarity determining region 3 for antibody 2253
ARDPSRGWSLIRFLDY

SEQ ID NO: 4507 - protein, 9 aa, Homo sapiens
  light chain complementarity determining region 3 for antibody 2254
QQSYTMPRT

SEQ ID NO: 4508 - protein, 18 aa, Homo sapiens
  heavy chain complementarity determining region 3 for antibody 2254
TTVVSQLLAGDWHLYFQH

SEQ ID NO: 4509 - protein, 9 aa, Homo sapiens
  light chain complementarity determining region 3 for antibody 2255
QQSYSTPRT

SEQ ID NO: 4510 - protein, 18 aa, Homo sapiens
  heavy chain complementarity determining region 3 for antibody 2255
ARGLHQLILGGYFYGLDV

SEQ ID NO: 4511 - protein, 10 aa, Homo sapiens
  light chain complementarity determining region 3 for antibody 2256
QQSYSTPPLT

SEQ ID NO: 4512 - protein, 15 aa, Homo sapiens
  heavy chain complementarity determining region 3 for antibody 2256
ARQTSLGTTHYYFDY

SEQ ID NO: 4513 - protein, 10 aa, Homo sapiens
  light chain complementarity determining region 3 for antibody 2257
QQSYSTPLFT

SEQ ID NO: 4514 - protein, 15 aa, Homo sapiens
  heavy chain complementarity determining region 3 for antibody 2257
ARVGRPYPNAWYFDN

SEQ ID NO: 4515 - protein, 9 aa, Homo sapiens
  light chain complementarity determining region 3 for antibody 2258
QQSYSTPFT

SEQ ID NO: 4516 - protein, 12 aa, Homo sapiens
  heavy chain complementarity determining region 3 for antibody 2258
AKSVEMATEFDY

SEQ ID NO: 4517 - protein, 10 aa, Homo sapiens
  light chain complementarity determining region 3 for antibody 2259
QQSYSSLGGT

SEQ ID NO: 4518 - protein, 15 aa, Homo sapiens
  heavy chain complementarity determining region 3 for antibody 2259
AKVHRSSKGCYYMDV

SEQ ID NO: 4519 - protein, 9 aa, Homo sapiens
  light chain complementarity determining region 3 for antibody 2260
QQSYNTPTI

SEQ ID NO: 4520 - protein, 10 aa, Homo sapiens
  heavy chain complementarity determining region 3 for antibody 2260
TTAPDDDRDY

SEQ ID NO: 4521 - protein, 9 aa, Homo sapiens
  light chain complementarity determining region 3 for antibody 2261
QQSYNTPFT

SEQ ID NO: 4522 - protein, 15 aa, Homo sapiens
  heavy chain complementarity determining region 3 for antibody 2261
ARVHSRSKYYYGMDV

SEQ ID NO: 4523 - protein, 9 aa, Homo sapiens
  light chain complementarity determining region 3 for antibody 2262
QQSSNTPPT

SEQ ID NO: 4524 - protein, 16 aa, Homo sapiens
  heavy chain complementarity determining region 3 for antibody 2262
VRDLAGFTRGGSTFDY

SEQ ID NO: 4525 - protein, 9 aa, Homo sapiens
  light chain complementarity determining region 3 for antibody 2263
QQSSNTPLT

SEQ ID NO: 4526 - protein, 16 aa, Homo sapiens
  heavy chain complementarity determining region 3 for antibody 2263
VRDLAGFTRGGSSFDY

SEQ ID NO: 4527 - protein, 9 aa, Homo sapiens
  light chain complementarity determining region 3 for antibody 2264
QQSRSPPWT

SEQ ID NO: 4528 - protein, 13 aa, Homo sapiens
  heavy chain complementarity determining region 3 for antibody 2264
ATSSRSGDRRFRY

SEQ ID NO: 4529 - protein, 10 aa, Homo sapiens
  light chain complementarity determining region 3 for antibody 2265
QQRTNWPALT

SEQ ID NO: 4530 - protein, 16 aa, Homo sapiens
  heavy chain complementarity determining region 3 for antibody 2265
AKPVFCISANCRVMDV

SEQ ID NO: 4531 - protein, 8 aa, Homo sapiens
  light chain complementarity determining region 3 for antibody 2266
QQRSNWPS

SEQ ID NO: 4532 - protein, 10 aa, Homo sapiens
  heavy chain complementarity determining region 3 for antibody 2266
ARETSGAYDI

SEQ ID NO: 4533 - protein, 10 aa, Homo sapiens
  light chain complementarity determining region 3 for antibody 2267
QQRSNWPPIT

SEQ ID NO: 4534 - protein, 13 aa, Homo sapiens
  heavy chain complementarity determining region 3 for antibody 2267
TKEGSSAGPDFVY

SEQ ID NO: 4535 - protein, 9 aa, Homo sapiens
  light chain complementarity determining region 3 for antibody 2268
QQRSDWPRT

SEQ ID NO: 4536 - protein, 9 aa, Homo sapiens
  heavy chain complementarity determining region 3 for antibody 2268
VKGWAGFDS

SEQ ID NO: 4537 - protein, 9 aa, Homo sapiens
  light chain complementarity determining region 3 for antibody 2269
QQLSNAPLP

SEQ ID NO: 4538 - protein, 17 aa, Homo sapiens
  heavy chain complementarity determining region 3 for antibody 2269
AKRLPDLLGGGHHYIDV

SEQ ID NO: 4539 - protein, 11 aa, Homo sapiens
  light chain complementarity determining region 3 for antibody 2270
QQLNTYPRGFT

SEQ ID NO: 4540 - protein, 10 aa, Homo sapiens
  heavy chain complementarity determining region 3 for antibody 2270
ARGGLAGDIQ

SEQ ID NO: 4541 - protein, 9 aa, Homo sapiens
  light chain complementarity determining region 3 for antibody 2271
QQLMVYPYT

SEQ ID NO: 4542 - protein, 14 aa, Homo sapiens
  heavy chain complementarity determining region 3 for antibody 2271
TRGHCDSTGFRLDY

SEQ ID NO: 4543 - protein, 9 aa, Homo sapiens
  light chain complementarity determining region 3 for antibody 2272
QQHYNIPFT

SEQ ID NO: 4544 - protein, 11 aa, Homo sapiens
  heavy chain complementarity determining region 3 for antibody 2272
VKEGDWFLGDP

SEQ ID NO: 4545 - protein, 9 aa, Homo sapiens
  light chain complementarity determining region 3 for antibody 2273
QQFNSYPRT

SEQ ID NO: 4546 - protein, 13 aa, Homo sapiens
  heavy chain complementarity determining region 3 for antibody 2273
AADGPYGSGAFDY

SEQ ID NO: 4547 - protein, 9 aa, Homo sapiens
  light chain complementarity determining region 3 for antibody 2274
QLYSTSLYT

SEQ ID NO: 4548 - protein, 15 aa, Homo sapiens
  heavy chain complementarity determining region 3 for antibody 2274
ARVGRPYHNAWYFDN

SEQ ID NO: 4549 - protein, 9 aa, Homo sapiens
  light chain complementarity determining region 3 for antibody 2275
QLYGSSLLT

SEQ ID NO: 4550 - protein, 12 aa, Homo sapiens
  heavy chain complementarity determining region 3 for antibody 2275
ALDEWHPSWYKY

SEQ ID NO: 4551 - protein, 9 aa, Homo sapiens
  light chain complementarity determining region 3 for antibody 2276
QLSGSSLLT

SEQ ID NO: 4552 - protein, 12 aa, Homo sapiens
  heavy chain complementarity determining region 3 for antibody 2276
ALDEWHPSWFKY

SEQ ID NO: 4553 - protein, 9 aa, Homo sapiens
  light chain complementarity determining region 3 for antibody 2277
QKYNSAPQT

SEQ ID NO: 4554 - protein, 15 aa, Homo sapiens
  heavy chain complementarity determining region 3 for antibody 2277
TTDYVDKSVLMAFDS

SEQ ID NO: 4555 - protein, 9 aa, Homo sapiens
  light chain complementarity determining region 3 for antibody 2278
QKCNSAPFT

SEQ ID NO: 4556 - protein, 10 aa, Homo sapiens
  heavy chain complementarity determining region 3 for antibody 2278
VREGHWSLDH

SEQ ID NO: 4557 - protein, 9 aa, Homo sapiens
  light chain complementarity determining region 3 for antibody 2279
QHYGGSVLP

SEQ ID NO: 4558 - protein, 17 aa, Homo sapiens
  heavy chain complementarity determining region 3 for antibody 2279
GRWGGRTSSDWSGPIDF

SEQ ID NO: 4559 - protein, 9 aa, Homo sapiens
  light chain complementarity determining region 3 for antibody 2280
QHRSSWPWT

SEQ ID NO: 4560 - protein, 11 aa, Homo sapiens
  heavy chain complementarity determining region 3 for antibody 2280
ARDLSLGFLDR

SEQ ID NO: 4561 - protein, 9 aa, Homo sapiens
  light chain complementarity determining region 3 for antibody 2281
QHRGNWPIT

SEQ ID NO: 4562 - protein, 17 aa, Homo sapiens
  heavy chain complementarity determining region 3 for antibody 2281
ATAWGNSGWYEQYYFDY

SEQ ID NO: 4563 - protein, 9 aa, Homo sapiens
  light chain complementarity determining region 3 for antibody 2282
QGYGTSRGT

SEQ ID NO: 4564 - protein, 15 aa, Homo sapiens
  heavy chain complementarity determining region 3 for antibody 2282
AKPRSNMFAHDAFDI

SEQ ID NO: 4565 - protein, 9 aa, Homo sapiens
  light chain complementarity determining region 3 for antibody 2283
MQYAHWPHT

SEQ ID NO: 4566 - protein, 16 aa, Homo sapiens
  heavy chain complementarity determining region 3 for antibody 2283
ASLNRGDKEFGVPPAL

SEQ ID NO: 4567 - protein, 9 aa, Homo sapiens
  light chain complementarity determining region 3 for antibody 2284
MQVTHWPRT

SEQ ID NO: 4568 - protein, 16 aa, Homo sapiens
  heavy chain complementarity determining region 3 for antibody 2284
SADVGDHRDRYVTLDH

SEQ ID NO: 4569 - protein, 9 aa, Homo sapiens
  light chain complementarity determining region 3 for antibody 2285
MQTLQTPWT

SEQ ID NO: 4570 - protein, 11 aa, Homo sapiens
  heavy chain complementarity determining region 3 for antibody 2285
VRVSTGWNFDY

SEQ ID NO: 4571 - protein, 9 aa, Homo sapiens
  light chain complementarity determining region 3 for antibody 2286
MQTLQTPWT

SEQ ID NO: 4572 - protein, 12 aa, Homo sapiens
  heavy chain complementarity determining region 3 for antibody 2286
ARLDRNYRAFDI

SEQ ID NO: 4573 - protein, 9 aa, Homo sapiens
  light chain complementarity determining region 3 for antibody 2287
MQSTHWPYT

SEQ ID NO: 4574 - protein, 14 aa, Homo sapiens
  heavy chain complementarity determining region 3 for antibody 2287
ARDSYFDWPASGDY

SEQ ID NO: 4575 - protein, 9 aa, Homo sapiens
  light chain complementarity determining region 3 for antibody 2288
MQGVQSAVT

SEQ ID NO: 4576 - protein, 12 aa, Homo sapiens
  heavy chain complementarity determining region 3 for antibody 2288
ARQGLWLTRQEY

SEQ ID NO: 4577 - protein, 9 aa, Homo sapiens
  light chain complementarity determining region 3 for antibody 2289
MQGTHWPWT

SEQ ID NO: 4578 - protein, 16 aa, Homo sapiens
  heavy chain complementarity determining region 3 for antibody 2289
ARGHTIHWERRGGSDF

SEQ ID NO: 4579 - protein, 9 aa, Homo sapiens
  light chain complementarity determining region 3 for antibody 2290
MQGTHWPST

SEQ ID NO: 4580 - protein, 12 aa, Homo sapiens
  heavy chain complementarity determining region 3 for antibody 2290
ARGQKLLWFGEL

SEQ ID NO: 4581 - protein, 9 aa, Homo sapiens
  light chain complementarity determining region 3 for antibody 2291
MQGIHWPWT

SEQ ID NO: 4582 - protein, 11 aa, Homo sapiens
  heavy chain complementarity determining region 3 for antibody 2291
ARAPAPGTVDC

SEQ ID NO: 4583 - protein, 9 aa, Homo sapiens
  light chain complementarity determining region 3 for antibody 2292
MQFLQTPLT

SEQ ID NO: 4584 - protein, 10 aa, Homo sapiens
  heavy chain complementarity determining region 3 for antibody 2292
ARERSGSYGI

SEQ ID NO: 4585 - protein, 9 aa, Homo sapiens
  light chain complementarity determining region 3 for antibody 2293
MQATHWPRT

SEQ ID NO: 4586 - protein, 12 aa, Homo sapiens
  heavy chain complementarity determining region 3 for antibody 2293
ATDVETTFPSVS

SEQ ID NO: 4587 - protein, 9 aa, Homo sapiens
  light chain complementarity determining region 3 for antibody 2294
MQALQTPYT

SEQ ID NO: 4588 - protein, 14 aa, Homo sapiens
  heavy chain complementarity determining region 3 for antibody 2294
ATSPGYYESSPFDY

SEQ ID NO: 4589 - protein, 9 aa, Homo sapiens
  light chain complementarity determining region 3 for antibody 2295
MQALQTPQT

SEQ ID NO: 4590 - protein, 16 aa, Homo sapiens
  heavy chain complementarity determining region 3 for antibody 2295
ARETDYDTSGPDAFDF

SEQ ID NO: 4591 - protein, 9 aa, Homo sapiens
  light chain complementarity determining region 3 for antibody 2296
MQALQTPLT

SEQ ID NO: 4592 - protein, 14 aa, Homo sapiens
  heavy chain complementarity determining region 3 for antibody 2296
ARDRSCSGNSCKGA

SEQ ID NO: 4593 - protein, 9 aa, Homo sapiens
  light chain complementarity determining region 3 for antibody 2297
MHATQWPPT

SEQ ID NO: 4594 - protein, 10 aa, Homo sapiens
  heavy chain complementarity determining region 3 for antibody 2297
VKDFWSNFHY

SEQ ID NO: 4595 - protein, 9 aa, Homo sapiens
  light chain complementarity determining region 3 for antibody 2298
LQYYTAPWT

SEQ ID NO: 4596 - protein, 17 aa, Homo sapiens
  heavy chain complementarity determining region 3 for antibody 2298
ARDGRIIWPGSQGSLDS

SEQ ID NO: 4597 - protein, 9 aa, Homo sapiens
  light chain complementarity determining region 3 for antibody 2299
LQLYRYPIT

SEQ ID NO: 4598 - protein, 14 aa, Homo sapiens
  heavy chain complementarity determining region 3 for antibody 2299
GRDTTHDWSDGGIY

SEQ ID NO: 4599 - protein, 9 aa, Homo sapiens
  light chain complementarity determining region 3 for antibody 2300
LQHYRYPYT

SEQ ID NO: 4600 - protein, 12 aa, Homo sapiens
  heavy chain complementarity determining region 3 for antibody 2300
ARDYSCCNGFDP

SEQ ID NO: 4601 - protein, 9 aa, Homo sapiens
  light chain complementarity determining region 3 for antibody 2301
LQHTTYPWT

SEQ ID NO: 4602 - protein, 12 aa, Homo sapiens
  heavy chain complementarity determining region 3 for antibody 2301
ARDLGGAPNIDS

SEQ ID NO: 4603 - protein, 9 aa, Homo sapiens
  light chain complementarity determining region 3 for antibody 2302
LQHNSYPWT

SEQ ID NO: 4604 - protein, 10 aa, Homo sapiens
  heavy chain complementarity determining region 3 for antibody 2302
ARDNYWNFDL

SEQ ID NO: 4605 - protein, 9 aa, Homo sapiens
  light chain complementarity determining region 3 for antibody 2303
LQHNSYPRT

SEQ ID NO: 4606 - protein, 15 aa, Homo sapiens
  heavy chain complementarity determining region 3 for antibody 2303
TTPSYSSAWYNAFDI

SEQ ID NO: 4607 - protein, 9 aa, Homo sapiens
  light chain complementarity determining region 3 for antibody 2304
LQHNSYPLT

SEQ ID NO: 4608 - protein, 11 aa, Homo sapiens
  heavy chain complementarity determining region 3 for antibody 2304
VRVSTGWNLDY

SEQ ID NO: 4609 - protein, 9 aa, Homo sapiens
  light chain complementarity determining region 3 for antibody 2305
LQHNSYHLT

SEQ ID NO: 4610 - protein, 11 aa, Homo sapiens
  heavy chain complementarity determining region 3 for antibody 2305
VRVSTGWNFDY

SEQ ID NO: 4611 - protein, 9 aa, Homo sapiens
  light chain complementarity determining region 3 for antibody 2306
LQDYSYPLS

SEQ ID NO: 4612 - protein, 16 aa, Homo sapiens
  heavy chain complementarity determining region 3 for antibody 2306
TEDVGDHRDRYVTLDH

SEQ ID NO: 4613 - protein, 9 aa, Homo sapiens
  light chain complementarity determining region 3 for antibody 2307
IQTLQTPWT

SEQ ID NO: 4614 - protein, 12 aa, Homo sapiens
  heavy chain complementarity determining region 3 for antibody 2307
ARLDWNYRAFDI

SEQ ID NO: 4615 - protein, 9 aa, Homo sapiens
  light chain complementarity determining region 3 for antibody 2308
HQYYSIPYT

SEQ ID NO: 4616 - protein, 15 aa, Homo sapiens
  heavy chain complementarity determining region 3 for antibody 2308
ARQVTGATKVRHFDS

SEQ ID NO: 4617 - protein, 9 aa, Homo sapiens
  light chain complementarity determining region 3 for antibody 2309
HQYGSSALT

SEQ ID NO: 4618 - protein, 13 aa, Homo sapiens
  heavy chain complementarity determining region 3 for antibody 2309
AKDRSSGWYAWGY

SEQ ID NO: 4619 - protein, 9 aa, Homo sapiens
  light chain complementarity determining region 3 for antibody 2310
HQYGSLPLT

SEQ ID NO: 4620 - protein, 13 aa, Homo sapiens
  heavy chain complementarity determining region 3 for antibody 2310
AKDRASGRYAWGY

SEQ ID NO: 4621 - protein, 9 aa, Homo sapiens
  light chain complementarity determining region 3 for antibody 2311
HQSSSLPWT

SEQ ID NO: 4622 - protein, 10 aa, Homo sapiens
  heavy chain complementarity determining region 3 for antibody 2311
AHRVDRAFHI

SEQ ID NO: 4623 - protein, 9 aa, Homo sapiens
  light chain complementarity determining region 3 for antibody 2312
HQSDNLPWT

SEQ ID NO: 4624 - protein, 13 aa, Homo sapiens
  heavy chain complementarity determining region 3 for antibody 2312
AKEGSSPGPDFDY

SEQ ID NO: 4625 - protein, 9 aa, Homo sapiens
  light chain complementarity determining region 3 for antibody 2313
HQSAHSPRT

SEQ ID NO: 4626 - protein, 12 aa, Homo sapiens
  heavy chain complementarity determining region 3 for antibody 2313
ARGTATSWNIDY

SEQ ID NO: 4627 - protein, 9 aa, Homo sapiens
  light chain complementarity determining region 3 for antibody 2314
HHFGSATGP

SEQ ID NO: 4628 - protein, 13 aa, Homo sapiens
  heavy chain complementarity determining region 3 for antibody 2314
AKEGSSPGPDFEY

SEQ ID NO: 4629 - protein, 9 aa, Homo sapiens
  light chain complementarity determining region 3 for antibody 2315
FQRNAWPLT

SEQ ID NO: 4630 - protein, 10 aa, Homo sapiens
  heavy chain complementarity determining region 3 for antibody 2315
GRDRQRAYDI

SEQ ID NO: 4631 - protein, 9 aa, Homo sapiens
  light chain complementarity determining region 3 for antibody 2316
AQGSYWPAS

SEQ ID NO: 4632 - protein, 12 aa, Homo sapiens
  heavy chain complementarity determining region 3 for antibody 2316
AIVVPGRWDLDD

SEQ ID NO: 4633 - protein, 9 aa, Homo sapiens
  light chain complementarity determining region 3 for antibody 2317
VQTLQTPWT

SEQ ID NO: 4634 - protein, 12 aa, Homo sapiens
  heavy chain complementarity determining region 3 for antibody 2317
ARLDWNYRAFDI

SEQ ID NO: 4635 - protein, 9 aa, Homo sapiens
  light chain complementarity determining region 3 for antibody 2318
QQYYTPPYT

SEQ ID NO: 4636 - protein, 17 aa, Homo sapiens
  heavy chain complementarity determining region 3 for antibody 2318
ARNTMVGTWQRQGNLDH

SEQ ID NO: 4637 - protein, 9 aa, Homo sapiens
  light chain complementarity determining region 3 for antibody 2319
QQYYSTPFT

SEQ ID NO: 4638 - protein, 14 aa, Homo sapiens
  heavy chain complementarity determining region 3 for antibody 2319
AASYSSGWLEYFQH

SEQ ID NO: 4639 - protein, 9 aa, Homo sapiens
  light chain complementarity determining region 3 for antibody 2320
QQYYSSPFT

SEQ ID NO: 4640 - protein, 13 aa, Homo sapiens
  heavy chain complementarity determining region 3 for antibody 2320
TSGCSGWCEWFDS

SEQ ID NO: 4641 - protein, 9 aa, Homo sapiens
  light chain complementarity determining region 3 for antibody 2321
QQYYSAPIT

SEQ ID NO: 4642 - protein, 14 aa, Homo sapiens
  heavy chain complementarity determining region 3 for antibody 2321
ARGESTPCDFIFDF

SEQ ID NO: 4643 - protein, 9 aa, Homo sapiens
  light chain complementarity determining region 3 for antibody 2322
QQYYSAPIT

SEQ ID NO: 4644 - protein, 14 aa, Homo sapiens
  heavy chain complementarity determining region 3 for antibody 2322
AKGESTPCDYIFDF

SEQ ID NO: 4645 - protein, 9 aa, Homo sapiens
  light chain complementarity determining region 3 for antibody 2323
QQYYNTPYT

SEQ ID NO: 4646 - protein, 12 aa, Homo sapiens
  heavy chain complementarity determining region 3 for antibody 2323
ARGGGSSSWYGF

SEQ ID NO: 4647 - protein, 9 aa, Homo sapiens
  light chain complementarity determining region 3 for antibody 2324
QQYYNSPLT

SEQ ID NO: 4648 - protein, 13 aa, Homo sapiens
  heavy chain complementarity determining region 3 for antibody 2324
ASAPHSLGFELDY

SEQ ID NO: 4649 - protein, 9 aa, Homo sapiens
  light chain complementarity determining region 3 for antibody 2325
QQYYNSPLT

SEQ ID NO: 4650 - protein, 6 aa, Homo sapiens
  heavy chain complementarity determining region 3 for antibody 2325
ARATLM

SEQ ID NO: 4651 - protein, 9 aa, Homo sapiens
  light chain complementarity determining region 3 for antibody 2326
QQYRTVPWT

SEQ ID NO: 4652 - protein, 20 aa, Homo sapiens
  heavy chain complementarity determining region 3 for antibody 2326
AKDGRGIDTYHSAGGGGLDV

SEQ ID NO: 4653 - protein, 9 aa, Homo sapiens
  light chain complementarity determining region 3 for antibody 2327
QQYNYYPLT

SEQ ID NO: 4654 - protein, 15 aa, Homo sapiens
  heavy chain complementarity determining region 3 for antibody 2327
SRGDYGDFKGVPFDY

SEQ ID NO: 4655 - protein, 7 aa, Homo sapiens
  light chain complementarity determining region 3 for antibody 2328
QQYNTWT

SEQ ID NO: 4656 - protein, 12 aa, Homo sapiens
  heavy chain complementarity determining region 3 for antibody 2328
ARYKGGRNGMDV

SEQ ID NO: 4657 - protein, 7 aa, Homo sapiens
  light chain complementarity determining region 3 for antibody 2329
QQYNTWT

SEQ ID NO: 4658 - protein, 12 aa, Homo sapiens
  heavy chain complementarity determining region 3 for antibody 2329
ARDKGGRNVMDV

SEQ ID NO: 4659 - protein, 7 aa, Homo sapiens
  light chain complementarity determining region 3 for antibody 2330
QQYNTWT

SEQ ID NO: 4660 - protein, 12 aa, Homo sapiens
  heavy chain complementarity determining region 3 for antibody 2330
ARDKGGRNGMGV

SEQ ID NO: 4661 - protein, 7 aa, Homo sapiens
  light chain complementarity determining region 3 for antibody 2331
QQYNTWT

SEQ ID NO: 4662 - protein, 12 aa, Homo sapiens
  heavy chain complementarity determining region 3 for antibody 2331
ARDKGGQNGMDV

SEQ ID NO: 4663 - protein, 7 aa, Homo sapiens
  light chain complementarity determining region 3 for antibody 2332
QQYNTWT

SEQ ID NO: 4664 - protein, 12 aa, Homo sapiens
  heavy chain complementarity determining region 3 for antibody 2332
AGDKGGRNGMDV

SEQ ID NO: 4665 - protein, 9 aa, Homo sapiens
  light chain complementarity determining region 3 for antibody 2333
QQYNSYSRT

SEQ ID NO: 4666 - protein, 12 aa, Homo sapiens
  heavy chain complementarity determining region 3 for antibody 2333
TTSRFGGGSCDY

SEQ ID NO: 4667 - protein, 9 aa, Homo sapiens
  light chain complementarity determining region 3 for antibody 2334
QQYNSYPWT

SEQ ID NO: 4668 - protein, 16 aa, Homo sapiens
  heavy chain complementarity determining region 3 for antibody 2334
VRDLAGFTRGGSTFDY

SEQ ID NO: 4669 - protein, 9 aa, Homo sapiens
  light chain complementarity determining region 3 for antibody 2335
QQYNSYPWT

SEQ ID NO: 4670 - protein, 14 aa, Homo sapiens
  heavy chain complementarity determining region 3 for antibody 2335
AREQGSGYYRTSDY

SEQ ID NO: 4671 - protein, 9 aa, Homo sapiens
  light chain complementarity determining region 3 for antibody 2336
QQYNSYPRT

SEQ ID NO: 4672 - protein, 15 aa, Homo sapiens
  heavy chain complementarity determining region 3 for antibody 2336
GKEGPGSSGWLTGHY

SEQ ID NO: 4673 - protein, 9 aa, Homo sapiens
  light chain complementarity determining region 3 for antibody 2337
QQYNSYPIT

SEQ ID NO: 4674 - protein, 15 aa, Homo sapiens
  heavy chain complementarity determining region 3 for antibody 2337
ARGIASTLMRTPFDY

SEQ ID NO: 4675 - protein, 10 aa, Homo sapiens
  light chain complementarity determining region 3 for antibody 2338
QQYNFHSTLT

SEQ ID NO: 4676 - protein, 16 aa, Homo sapiens
  heavy chain complementarity determining region 3 for antibody 2338
GRQVISATKWPNRLDY

SEQ ID NO: 4677 - protein, 9 aa, Homo sapiens
  light chain complementarity determining region 3 for antibody 2339
QQYLVTLRT

SEQ ID NO: 4678 - protein, 19 aa, Homo sapiens
  heavy chain complementarity determining region 3 for antibody 2339
ARARSDCGSSGCYEGFFDS

SEQ ID NO: 4679 - protein, 9 aa, Homo sapiens
  light chain complementarity determining region 3 for antibody 2340
QQYKNYPLT

SEQ ID NO: 4680 - protein, 14 aa, Homo sapiens
  heavy chain complementarity determining region 3 for antibody 2340
VRAGVEATAYYFEN

SEQ ID NO: 4681 - protein, 8 aa, Homo sapiens
  light chain complementarity determining region 3 for antibody 2341
QQYGTSFT

SEQ ID NO: 4682 - protein, 10 aa, Homo sapiens
  heavy chain complementarity determining region 3 for antibody 2341
CRDRWGFGDV

SEQ ID NO: 4683 - protein, 9 aa, Homo sapiens
  light chain complementarity determining region 3 for antibody 2342
QQYGSSTWT

SEQ ID NO: 4684 - protein, 17 aa, Homo sapiens
  heavy chain complementarity determining region 3 for antibody 2342
AKGRGSVAMALIYYRDL

SEQ ID NO: 4685 - protein, 9 aa, Homo sapiens
  light chain complementarity determining region 3 for antibody 2343
QQYGSSPVP

SEQ ID NO: 4686 - protein, 18 aa, Homo sapiens
  heavy chain complementarity determining region 3 for antibody 2343
ARGDYPEARTGYFLDFDY

SEQ ID NO: 4687 - protein, 9 aa, Homo sapiens
  light chain complementarity determining region 3 for antibody 2344
QQYGSSPQT

SEQ ID NO: 4688 - protein, 14 aa, Homo sapiens
  heavy chain complementarity determining region 3 for antibody 2344
VHPTKGARVPIHDY

SEQ ID NO: 4689 - protein, 9 aa, Homo sapiens
  light chain complementarity determining region 3 for antibody 2345
QQYGRSLVT

SEQ ID NO: 4690 - protein, 10 aa, Homo sapiens
  heavy chain complementarity determining region 3 for antibody 2345
ARETSGAYDI

SEQ ID NO: 4691 - protein, 9 aa, Homo sapiens
  light chain complementarity determining region 3 for antibody 2346
QQYGGPLLT

SEQ ID NO: 4692 - protein, 10 aa, Homo sapiens
  heavy chain complementarity determining region 3 for antibody 2346
CRDRWGFGDV

SEQ ID NO: 4693 - protein, 9 aa, Homo sapiens
  light chain complementarity determining region 3 for antibody 2347
QQYGDVIVT

SEQ ID NO: 4694 - protein, 6 aa, Homo sapiens
  heavy chain complementarity determining region 3 for antibody 2347
ARDYSL

SEQ ID NO: 4695 - protein, 9 aa, Homo sapiens
  light chain complementarity determining region 3 for antibody 2348
QQYDNWPWT

SEQ ID NO: 4696 - protein, 17 aa, Homo sapiens
  heavy chain complementarity determining region 3 for antibody 2348
VTHYYHDGGIYHDFFNY

SEQ ID NO: 4697 - protein, 10 aa, Homo sapiens
  light chain complementarity determining region 3 for antibody 2349
QQYDNLSSLT

SEQ ID NO: 4698 - protein, 13 aa, Homo sapiens
  heavy chain complementarity determining region 3 for antibody 2349
AKEGSSPGPDFEY

SEQ ID NO: 4699 - protein, 9 aa, Homo sapiens
  light chain complementarity determining region 3 for antibody 2350
QQYDNLPPA

SEQ ID NO: 4700 - protein, 13 aa, Homo sapiens
  heavy chain complementarity determining region 3 for antibody 2350
AKEGSSPGPDFEY

SEQ ID NO: 4701 - protein, 10 aa, Homo sapiens
  light chain complementarity determining region 3 for antibody 2351
QQYDNLASLT

SEQ ID NO: 4702 - protein, 13 aa, Homo sapiens
  heavy chain complementarity determining region 3 for antibody 2351
AKEGSSPGPGFEY

SEQ ID NO: 4703 - protein, 10 aa, Homo sapiens
  light chain complementarity determining region 3 for antibody 2352
QQYDNLASIT

SEQ ID NO: 4704 - protein, 13 aa, Homo sapiens
  heavy chain complementarity determining region 3 for antibody 2352
AKEGSSPGPDFEY

SEQ ID NO: 4705 - protein, 10 aa, Homo sapiens
  light chain complementarity determining region 3 for antibody 2353
QQYDNLAPLT

SEQ ID NO: 4706 - protein, 13 aa, Homo sapiens
  heavy chain complementarity determining region 3 for antibody 2353
AKEGSSPGPDFEY

SEQ ID NO: 4707 - protein, 9 aa, Homo sapiens
  light chain complementarity determining region 3 for antibody 2354
QQYAGSPST

SEQ ID NO: 4708 - protein, 17 aa, Homo sapiens
  heavy chain complementarity determining region 3 for antibody 2354
ASKHCGYTNCHLAELDY

SEQ ID NO: 4709 - protein, 9 aa, Homo sapiens
  light chain complementarity determining region 3 for antibody 2355
QQTYSTPYT

SEQ ID NO: 4710 - protein, 14 aa, Homo sapiens
  heavy chain complementarity determining region 3 for antibody 2355
ARLHGSGLGRWLDP

SEQ ID NO: 4711 - protein, 9 aa, Homo sapiens
  light chain complementarity determining region 3 for antibody 2356
QQTYSSPWT

SEQ ID NO: 4712 - protein, 15 aa, Homo sapiens
  heavy chain complementarity determining region 3 for antibody 2356
ARTWTSSTNCRYMDV

SEQ ID NO: 4713 - protein, 9 aa, Homo sapiens
  light chain complementarity determining region 3 for antibody 2357
QQTYSSPWT

SEQ ID NO: 4714 - protein, 15 aa, Homo sapiens
  heavy chain complementarity determining region 3 for antibody 2357
ARIWTSRTNCRYMDV

SEQ ID NO: 4715 - protein, 9 aa, Homo sapiens
  light chain complementarity determining region 3 for antibody 2358
QQTYSSPWT

SEQ ID NO: 4716 - protein, 15 aa, Homo sapiens
  heavy chain complementarity determining region 3 for antibody 2358
ARIWNSSTNCRYMDV

SEQ ID NO: 4717 - protein, 9 aa, Homo sapiens
  light chain complementarity determining region 3 for antibody 2359
QQTYSSPWT

SEQ ID NO: 4718 - protein, 15 aa, Homo sapiens
  heavy chain complementarity determining region 3 for antibody 2359
AGIWTSSTNCRYMDV

SEQ ID NO: 4719 - protein, 9 aa, Homo sapiens
  light chain complementarity determining region 3 for antibody 2360
QQTYRTPYT

SEQ ID NO: 4720 - protein, 14 aa, Homo sapiens
  heavy chain complementarity determining region 3 for antibody 2360
ARRHGSGLGRWLDP

SEQ ID NO: 4721 - protein, 9 aa, Homo sapiens
  light chain complementarity determining region 3 for antibody 2361
QQTYRTPYT

SEQ ID NO: 4722 - protein, 14 aa, Homo sapiens
  heavy chain complementarity determining region 3 for antibody 2361
ARLRGSGLGRWLDP

SEQ ID NO: 4723 - protein, 9 aa, Homo sapiens
  light chain complementarity determining region 3 for antibody 2362
QQTYRTPYT

SEQ ID NO: 4724 - protein, 14 aa, Homo sapiens
  heavy chain complementarity determining region 3 for antibody 2362
ARLHGSGIGRWLDP

SEQ ID NO: 4725 - protein, 9 aa, Homo sapiens
  light chain complementarity determining region 3 for antibody 2363
QQTYRTPST

SEQ ID NO: 4726 - protein, 14 aa, Homo sapiens
  heavy chain complementarity determining region 3 for antibody 2363
ARLHGSGLGRWLDP

SEQ ID NO: 4727 - protein, 8 aa, Homo sapiens
  light chain complementarity determining region 3 for antibody 2364
QQSYTTPT

SEQ ID NO: 4728 - protein, 17 aa, Homo sapiens
  heavy chain complementarity determining region 3 for antibody 2364
ARNTMVGTWQRQGNLDH

SEQ ID NO: 4729 - protein, 9 aa, Homo sapiens
  light chain complementarity determining region 3 for antibody 2365
QQSYSTPST

SEQ ID NO: 4730 - protein, 16 aa, Homo sapiens
  heavy chain complementarity determining region 3 for antibody 2365
ARWFARSSTGVSYMDV

SEQ ID NO: 4731 - protein, 9 aa, Homo sapiens
  light chain complementarity determining region 3 for antibody 2366
QQSYSTPST

SEQ ID NO: 4732 - protein, 12 aa, Homo sapiens
  heavy chain complementarity determining region 3 for antibody 2366
ARLDWNYRAFDI

SEQ ID NO: 4733 - protein, 9 aa, Homo sapiens
  light chain complementarity determining region 3 for antibody 2367
QQSYSTPST

SEQ ID NO: 4734 - protein, 16 aa, Homo sapiens
  heavy chain complementarity determining region 3 for antibody 2367
AGWFSRSSTGVSYMDV

SEQ ID NO: 4735 - protein, 10 aa, Homo sapiens
  light chain complementarity determining region 3 for antibody 2368
QQSYSTPLFT

SEQ ID NO: 4736 - protein, 15 aa, Homo sapiens
  heavy chain complementarity determining region 3 for antibody 2368
AGVGRPYHNAWYFDN

SEQ ID NO: 4737 - protein, 11 aa, Homo sapiens
  light chain complementarity determining region 3 for antibody 2369
QQSYSNPLNPT

SEQ ID NO: 4738 - protein, 19 aa, Homo sapiens
  heavy chain complementarity determining region 3 for antibody 2369
ARVPPGSSGFFNYYYYMDV

SEQ ID NO: 4739 - protein, 10 aa, Homo sapiens
  light chain complementarity determining region 3 for antibody 2370
QQSNNWPMYT

SEQ ID NO: 4740 - protein, 16 aa, Homo sapiens
  heavy chain complementarity determining region 3 for antibody 2370
ARAWHCTSTRCSTYDP

SEQ ID NO: 4741 - protein, 10 aa, Homo sapiens
  light chain complementarity determining region 3 for antibody 2371
QQSHTTPALT

SEQ ID NO: 4742 - protein, 14 aa, Homo sapiens
  heavy chain complementarity determining region 3 for antibody 2371
ARDNVHYGDYSLDL

SEQ ID NO: 4743 - protein, 9 aa, Homo sapiens
  light chain complementarity determining region 3 for antibody 2372
QQRYDYPLT

SEQ ID NO: 4744 - protein, 18 aa, Homo sapiens
  heavy chain complementarity determining region 3 for antibody 2372
ARPYCGSPGCQGRDWFDP

SEQ ID NO: 4745 - protein, 9 aa, Homo sapiens
  light chain complementarity determining region 3 for antibody 2373
QQNYSSPWT

SEQ ID NO: 4746 - protein, 15 aa, Homo sapiens
  heavy chain complementarity determining region 3 for antibody 2373
ARIWTSSTNCRYMDV

SEQ ID NO: 4747 - protein, 10 aa, Homo sapiens
  light chain complementarity determining region 3 for antibody 2374
QQNYSSPPWA

SEQ ID NO: 4748 - protein, 16 aa, Homo sapiens
  heavy chain complementarity determining region 3 for antibody 2374
ASLNRGDKEFGVPPAL

SEQ ID NO: 4749 - protein, 9 aa, Homo sapiens
  light chain complementarity determining region 3 for antibody 2375
QQLNSYPYT

SEQ ID NO: 4750 - protein, 14 aa, Homo sapiens
  heavy chain complementarity determining region 3 for antibody 2375
ARGRFDSTGFRLDY

SEQ ID NO: 4751 - protein, 9 aa, Homo sapiens
  light chain complementarity determining region 3 for antibody 2376
QQLNSYPQT

SEQ ID NO: 4752 - protein, 14 aa, Homo sapiens
  heavy chain complementarity determining region 3 for antibody 2376
ARLLIVWPPIHFDY

SEQ ID NO: 4753 - protein, 9 aa, Homo sapiens
  light chain complementarity determining region 3 for antibody 2377
QQLNSSPYT

SEQ ID NO: 4754 - protein, 14 aa, Homo sapiens
  heavy chain complementarity determining region 3 for antibody 2377
ARGHVDSTGFRLDY

SEQ ID NO: 4755 - protein, 9 aa, Homo sapiens
  light chain complementarity determining region 3 for antibody 2378
QQHDSYPWT

SEQ ID NO: 4756 - protein, 14 aa, Homo sapiens
  heavy chain complementarity determining region 3 for antibody 2378
AKGRGPGTNYYMDV

SEQ ID NO: 4757 - protein, 8 aa, Homo sapiens
  light chain complementarity determining region 3 for antibody 2379
QQGHSFST

SEQ ID NO: 4758 - protein, 9 aa, Homo sapiens
  heavy chain complementarity determining region 3 for antibody 2379
ATGDRTLDQ

SEQ ID NO: 4759 - protein, 9 aa, Homo sapiens
  light chain complementarity determining region 3 for antibody 2380
QQFNSYPRP

SEQ ID NO: 4760 - protein, 13 aa, Homo sapiens
  heavy chain complementarity determining region 3 for antibody 2380
AADGPYGSSAFDY

SEQ ID NO: 4761 - protein, 9 aa, Homo sapiens
  light chain complementarity determining region 3 for antibody 2381
QQFNNYPIT

SEQ ID NO: 4762 - protein, 13 aa, Homo sapiens
  heavy chain complementarity determining region 3 for antibody 2381
AKEGSSPGPDFDY

SEQ ID NO: 4763 - protein, 9 aa, Homo sapiens
  light chain complementarity determining region 3 for antibody 2382
QQFDSLPRT

SEQ ID NO: 4764 - protein, 9 aa, Homo sapiens
  heavy chain complementarity determining region 3 for antibody 2382
ARGRSNFRY

SEQ ID NO: 4765 - protein, 9 aa, Homo sapiens
  light chain complementarity determining region 3 for antibody 2383
QQDYYTPRT

SEQ ID NO: 4766 - protein, 11 aa, Homo sapiens
  heavy chain complementarity determining region 3 for antibody 2383
TRRSLGGAFDY

SEQ ID NO: 4767 - protein, 9 aa, Homo sapiens
  light chain complementarity determining region 3 for antibody 2384
QQDYYPPRT

SEQ ID NO: 4768 - protein, 11 aa, Homo sapiens
  heavy chain complementarity determining region 3 for antibody 2384
ARRSLGGAFDY

SEQ ID NO: 4769 - protein, 9 aa, Homo sapiens
  light chain complementarity determining region 3 for antibody 2385
QQANSLPLT

SEQ ID NO: 4770 - protein, 10 aa, Homo sapiens
  heavy chain complementarity determining region 3 for antibody 2385
CRDREGFGDV

SEQ ID NO: 4771 - protein, 9 aa, Homo sapiens
  light chain complementarity determining region 3 for antibody 2386
QPDYYTPRT

SEQ ID NO: 4772 - protein, 11 aa, Homo sapiens
  heavy chain complementarity determining region 3 for antibody 2386
ARRSLGGAFDY

SEQ ID NO: 4773 - protein, 9 aa, Homo sapiens
  light chain complementarity determining region 3 for antibody 2387
QKYYSVPLT

SEQ ID NO: 4774 - protein, 13 aa, Homo sapiens
  heavy chain complementarity determining region 3 for antibody 2387
TREGDSSGPDFHH

SEQ ID NO: 4775 - protein, 9 aa, Homo sapiens
  light chain complementarity determining region 3 for antibody 2388
QKNKSAPFT

SEQ ID NO: 4776 - protein, 13 aa, Homo sapiens
  heavy chain complementarity determining region 3 for antibody 2388
AKEGSSPGPDFEY

SEQ ID NO: 4777 - protein, 9 aa, Homo sapiens
  light chain complementarity determining region 3 for antibody 2389
QHYKSYPLT

SEQ ID NO: 4778 - protein, 10 aa, Homo sapiens
  heavy chain complementarity determining region 3 for antibody 2389
ARGGLAGDVS

SEQ ID NO: 4779 - protein, 9 aa, Homo sapiens
  light chain complementarity determining region 3 for antibody 2390
QEYRTPPWT

SEQ ID NO: 4780 - protein, 20 aa, Homo sapiens
  heavy chain complementarity determining region 3 for antibody 2390
ARDGRGTVEYDYGGGGGLDV

SEQ ID NO: 4781 - protein, 9 aa, Homo sapiens
  light chain complementarity determining region 3 for antibody 2391
QERSNWPGS

SEQ ID NO: 4782 - protein, 17 aa, Homo sapiens
  heavy chain complementarity determining region 3 for antibody 2391
ARNTMVGAWQRQGNLDH

SEQ ID NO: 4783 - protein, 9 aa, Homo sapiens
  light chain complementarity determining region 3 for antibody 2392
QEAKSFPRT

SEQ ID NO: 4784 - protein, 13 aa, Homo sapiens
  heavy chain complementarity determining region 3 for antibody 2392
AKEGSSPGPDFEY

SEQ ID NO: 4785 - protein, 9 aa, Homo sapiens
  light chain complementarity determining region 3 for antibody 2393
MQTVHTPWT

SEQ ID NO: 4786 - protein, 12 aa, Homo sapiens
  heavy chain complementarity determining region 3 for antibody 2393
ARLDWNYRAFDI

SEQ ID NO: 4787 - protein, 9 aa, Homo sapiens
  light chain complementarity determining region 3 for antibody 2394
MQTLQTPWT

SEQ ID NO: 4788 - protein, 12 aa, Homo sapiens
  heavy chain complementarity determining region 3 for antibody 2394
ARLEWNYRAFDI

SEQ ID NO: 4789 - protein, 9 aa, Homo sapiens
  light chain complementarity determining region 3 for antibody 2395
MQTLQTPWT

SEQ ID NO: 4790 - protein, 12 aa, Homo sapiens
  heavy chain complementarity determining region 3 for antibody 2395
ARLDWNYRAFDV

SEQ ID NO: 4791 - protein, 9 aa, Homo sapiens
  light chain complementarity determining region 3 for antibody 2396
MQTLQTPWT

SEQ ID NO: 4792 - protein, 12 aa, Homo sapiens
  heavy chain complementarity determining region 3 for antibody 2396
ARLDWKNRAFDI

SEQ ID NO: 4793 - protein, 9 aa, Homo sapiens
  light chain complementarity determining region 3 for antibody 2397
MQTLQTPWT

SEQ ID NO: 4794 - protein, 12 aa, Homo sapiens
  heavy chain complementarity determining region 3 for antibody 2397
ARDKGGRNGMDV

SEQ ID NO: 4795 - protein, 9 aa, Homo sapiens
  light chain complementarity determining region 3 for antibody 2398
MQTLQTPVT

SEQ ID NO: 4796 - protein, 11 aa, Homo sapiens
  heavy chain complementarity determining region 3 for antibody 2398
TRGGYSVGYDY

SEQ ID NO: 4797 - protein, 9 aa, Homo sapiens
  light chain complementarity determining region 3 for antibody 2399
MQTLQTPVT

SEQ ID NO: 4798 - protein, 10 aa, Homo sapiens
  heavy chain complementarity determining region 3 for antibody 2399
ARDRDYALDL

SEQ ID NO: 4799 - protein, 9 aa, Homo sapiens
  light chain complementarity determining region 3 for antibody 2400
MQTLQTPGT

SEQ ID NO: 4800 - protein, 12 aa, Homo sapiens
  heavy chain complementarity determining region 3 for antibody 2400
ARDADYDEEFDY

SEQ ID NO: 4801 - protein, 9 aa, Homo sapiens
  light chain complementarity determining region 3 for antibody 2401
MQTLQTLWT

SEQ ID NO: 4802 - protein, 12 aa, Homo sapiens
  heavy chain complementarity determining region 3 for antibody 2401
ARLDWNYRAFDI

SEQ ID NO: 4803 - protein, 9 aa, Homo sapiens
  light chain complementarity determining region 3 for antibody 2402
MQGTHWPWA

SEQ ID NO: 4804 - protein, 10 aa, Homo sapiens
  heavy chain complementarity determining region 3 for antibody 2402
ARETSGSYDI

SEQ ID NO: 4805 - protein, 8 aa, Homo sapiens
  light chain complementarity determining region 3 for antibody 2403
MQGTHWPT

SEQ ID NO: 4806 - protein, 17 aa, Homo sapiens
  heavy chain complementarity determining region 3 for antibody 2403
AKPPPRPVVVPAASFDY

SEQ ID NO: 4807 - protein, 10 aa, Homo sapiens
  light chain complementarity determining region 3 for antibody 2404
MQGTHWPPIT

SEQ ID NO: 4808 - protein, 12 aa, Homo sapiens
  heavy chain complementarity determining region 3 for antibody 2404
ARGGSHTAMDFY

SEQ ID NO: 4809 - protein, 9 aa, Homo sapiens
  light chain complementarity determining region 3 for antibody 2405
MQGTHWPHT

SEQ ID NO: 4810 - protein, 11 aa, Homo sapiens
  heavy chain complementarity determining region 3 for antibody 2405
ATFWQQWRLAH

SEQ ID NO: 4811 - protein, 9 aa, Homo sapiens
  light chain complementarity determining region 3 for antibody 2406
MQGTHWPHT

SEQ ID NO: 4812 - protein, 11 aa, Homo sapiens
  heavy chain complementarity determining region 3 for antibody 2406
ATFGQQWSLAY

SEQ ID NO: 4813 - protein, 9 aa, Homo sapiens
  light chain complementarity determining region 3 for antibody 2407
MQGTHWPHT

SEQ ID NO: 4814 - protein, 15 aa, Homo sapiens
  heavy chain complementarity determining region 3 for antibody 2407
AKDHRSSRGYYYMDV

SEQ ID NO: 4815 - protein, 9 aa, Homo sapiens
  light chain complementarity determining region 3 for antibody 2408
MQGTHWPGT

SEQ ID NO: 4816 - protein, 16 aa, Homo sapiens
  heavy chain complementarity determining region 3 for antibody 2408
ARGHTNPGERRGGSDF

SEQ ID NO: 4817 - protein, 9 aa, Homo sapiens
  light chain complementarity determining region 3 for antibody 2409
MQGTHWPGT

SEQ ID NO: 4818 - protein, 10 aa, Homo sapiens
  heavy chain complementarity determining region 3 for antibody 2409
ARGGLAGDIY

SEQ ID NO: 4819 - protein, 9 aa, Homo sapiens
  light chain complementarity determining region 3 for antibody 2410
MQGTHWPCT

SEQ ID NO: 4820 - protein, 13 aa, Homo sapiens
  heavy chain complementarity determining region 3 for antibody 2410
TGGPNCFAGGCLA

SEQ ID NO: 4821 - protein, 9 aa, Homo sapiens
  light chain complementarity determining region 3 for antibody 2411
MQGLQTPIT

SEQ ID NO: 4822 - protein, 16 aa, Homo sapiens
  heavy chain complementarity determining region 3 for antibody 2411
TTDWGPHIGHGAKTGY

SEQ ID NO: 4823 - protein, 9 aa, Homo sapiens
  light chain complementarity determining region 3 for antibody 2412
MQGIYWPWT

SEQ ID NO: 4824 - protein, 11 aa, Homo sapiens
  heavy chain complementarity determining region 3 for antibody 2412
ARSPATGTVDS

SEQ ID NO: 4825 - protein, 9 aa, Homo sapiens
  light chain complementarity determining region 3 for antibody 2413
MQFLHTPLT

SEQ ID NO: 4826 - protein, 10 aa, Homo sapiens
  heavy chain complementarity determining region 3 for antibody 2413
ARERSGSYDI

SEQ ID NO: 4827 - protein, 9 aa, Homo sapiens
  light chain complementarity determining region 3 for antibody 2414
MQALQTPRT

SEQ ID NO: 4828 - protein, 17 aa, Homo sapiens
  heavy chain complementarity determining region 3 for antibody 2414
ARTLGYCDAYSCPGMDV

SEQ ID NO: 4829 - protein, 9 aa, Homo sapiens
  light chain complementarity determining region 3 for antibody 2415
MQALQTPDT

SEQ ID NO: 4830 - protein, 10 aa, Homo sapiens
  heavy chain complementarity determining region 3 for antibody 2415
AKDLSGGGGY

SEQ ID NO: 4831 - protein, 9 aa, Homo sapiens
  light chain complementarity determining region 3 for antibody 2416
MQALQAPLA

SEQ ID NO: 4832 - protein, 14 aa, Homo sapiens
  heavy chain complementarity determining region 3 for antibody 2416
ARAAFTGSVYANIY

SEQ ID NO: 4833 - protein, 8 aa, Homo sapiens
  light chain complementarity determining region 3 for antibody 2417
MQALHRLT

SEQ ID NO: 4834 - protein, 8 aa, Homo sapiens
  heavy chain complementarity determining region 3 for antibody 2417
VSQPGHNY

SEQ ID NO: 4835 - protein, 9 aa, Homo sapiens
  light chain complementarity determining region 3 for antibody 2418
LQYAHWPHT

SEQ ID NO: 4836 - protein, 15 aa, Homo sapiens
  heavy chain complementarity determining region 3 for antibody 2418
ARVGRPYPNAWYFDN

SEQ ID NO: 4837 - protein, 9 aa, Homo sapiens
  light chain complementarity determining region 3 for antibody 2419
LQTIHWPGT

SEQ ID NO: 4838 - protein, 10 aa, Homo sapiens
  heavy chain complementarity determining region 3 for antibody 2419
TRLPSRASDF

SEQ ID NO: 4839 - protein, 9 aa, Homo sapiens
  light chain complementarity determining region 3 for antibody 2420
LQHSSDPRT

SEQ ID NO: 4840 - protein, 14 aa, Homo sapiens
  heavy chain complementarity determining region 3 for antibody 2420
ARDPSYGVTGAFDT

SEQ ID NO: 4841 - protein, 9 aa, Homo sapiens
  light chain complementarity determining region 3 for antibody 2421
LQHNSYPWT

SEQ ID NO: 4842 - protein, 18 aa, Homo sapiens
  heavy chain complementarity determining region 3 for antibody 2421
IRGPSGAPGAMAYYYLDV

SEQ ID NO: 4843 - protein, 9 aa, Homo sapiens
  light chain complementarity determining region 3 for antibody 2422
LQHNSYPWT

SEQ ID NO: 4844 - protein, 14 aa, Homo sapiens
  heavy chain complementarity determining region 3 for antibody 2422
ANHRASIGARCFDP

SEQ ID NO: 4845 - protein, 9 aa, Homo sapiens
  light chain complementarity determining region 3 for antibody 2423
LQHNSYPLT

SEQ ID NO: 4846 - protein, 24 aa, Homo sapiens
  heavy chain complementarity determining region 3 for antibody 2423
ARTGDFCDSTSCYNGLDTYYGMDV

SEQ ID NO: 4847 - protein, 9 aa, Homo sapiens
  light chain complementarity determining region 3 for antibody 2424
LQHNSYPLT

SEQ ID NO: 4848 - protein, 13 aa, Homo sapiens
  heavy chain complementarity determining region 3 for antibody 2424
AKEGSSPGPDFEY

SEQ ID NO: 4849 - protein, 9 aa, Homo sapiens
  light chain complementarity determining region 3 for antibody 2425
LQHNSYPLI

SEQ ID NO: 4850 - protein, 11 aa, Homo sapiens
  heavy chain complementarity determining region 3 for antibody 2425
VRVSTGWNFDY

SEQ ID NO: 4851 - protein, 9 aa, Homo sapiens
  light chain complementarity determining region 3 for antibody 2426
LQHNPYPLT

SEQ ID NO: 4852 - protein, 11 aa, Homo sapiens
  heavy chain complementarity determining region 3 for antibody 2426
VRVSTGWNFDY

SEQ ID NO: 4853 - protein, 9 aa, Homo sapiens
  light chain complementarity determining region 3 for antibody 2427
LQHDSYPLT

SEQ ID NO: 4854 - protein, 12 aa, Homo sapiens
  heavy chain complementarity determining region 3 for antibody 2427
GRVEFCCGDCPE

SEQ ID NO: 4855 - protein, 9 aa, Homo sapiens
  light chain complementarity determining region 3 for antibody 2428
LQFYTAPWT

SEQ ID NO: 4856 - protein, 17 aa, Homo sapiens
  heavy chain complementarity determining region 3 for antibody 2428
ARDGRITWPGSEGSLDS

SEQ ID NO: 4857 - protein, 9 aa, Homo sapiens
  light chain complementarity determining region 3 for antibody 2429
LQDYSYPLS

SEQ ID NO: 4858 - protein, 16 aa, Homo sapiens
  heavy chain complementarity determining region 3 for antibody 2429
TADVGDHRDRYVTLDQ

SEQ ID NO: 4859 - protein, 9 aa, Homo sapiens
  light chain complementarity determining region 3 for antibody 2430
LQDYNYPLT

SEQ ID NO: 4860 - protein, 14 aa, Homo sapiens
  heavy chain complementarity determining region 3 for antibody 2430
AKLYCSGGNCYFDY

SEQ ID NO: 4861 - protein, 9 aa, Homo sapiens
  light chain complementarity determining region 3 for antibody 2431
LQDHNYPFT

SEQ ID NO: 4862 - protein, 10 aa, Homo sapiens
  heavy chain complementarity determining region 3 for antibody 2431
CRDREGFGDV

SEQ ID NO: 4863 - protein, 9 aa, Homo sapiens
  light chain complementarity determining region 3 for antibody 2432
LQDFSYPFS

SEQ ID NO: 4864 - protein, 16 aa, Homo sapiens
  heavy chain complementarity determining region 3 for antibody 2432
VTEVGDHRDTYTTLDY

SEQ ID NO: 4865 - protein, 9 aa, Homo sapiens
  light chain complementarity determining region 3 for antibody 2433
LQDFSYPFS

SEQ ID NO: 4866 - protein, 16 aa, Homo sapiens
  heavy chain complementarity determining region 3 for antibody 2433
FTDVGDHRDTYTTLDY

SEQ ID NO: 4867 - protein, 9 aa, Homo sapiens
  light chain complementarity determining region 3 for antibody 2434
LQANGFPRT

SEQ ID NO: 4868 - protein, 15 aa, Homo sapiens
  heavy chain complementarity determining region 3 for antibody 2434
ARDAAGDGYTSRWEY

SEQ ID NO: 4869 - protein, 9 aa, Homo sapiens
  light chain complementarity determining region 3 for antibody 2435
HQYAITPWT

SEQ ID NO: 4870 - protein, 11 aa, Homo sapiens
  heavy chain complementarity determining region 3 for antibody 2435
TRGGYSVGYDY

SEQ ID NO: 4871 - protein, 9 aa, Homo sapiens
  light chain complementarity determining region 3 for antibody 2436
HQSSSLPLT

SEQ ID NO: 4872 - protein, 15 aa, Homo sapiens
  heavy chain complementarity determining region 3 for antibody 2436
ARAGFGSASPNWFDP

SEQ ID NO: 4873 - protein, 9 aa, Homo sapiens
  light chain complementarity determining region 3 for antibody 2437
HPYYTSPLT

SEQ ID NO: 4874 - protein, 10 aa, Homo sapiens
  heavy chain complementarity determining region 3 for antibody 2437
AAGSGWLIEY

SEQ ID NO: 4875 - protein, 9 aa, Homo sapiens
  light chain complementarity determining region 3 for antibody 2438
AQGSYWPAS

SEQ ID NO: 4876 - protein, 10 aa, Homo sapiens
  heavy chain complementarity determining region 3 for antibody 2438
CRDREGFGDA

SEQ ID NO: 4877 - protein, 9 aa, Homo sapiens
  light chain complementarity determining region 3 for antibody 2439
AQGSYWPAS

SEQ ID NO: 4878 - protein, 10 aa, Homo sapiens
  heavy chain complementarity determining region 3 for antibody 2439
CRDREGCGDV

SEQ ID NO: 4879 - protein, 7 aa, Homo sapiens
  light chain complementarity determining region 3 for antibody 2440
YQHDRKK

SEQ ID NO: 4880 - protein, 10 aa, Homo sapiens
  heavy chain complementarity determining region 3 for antibody 2440
AREKLANYDC

SEQ ID NO: 4881 - protein, 8 aa, Homo sapiens
  light chain complementarity determining region 3 for antibody 2441
RQSYTTPT

SEQ ID NO: 4882 - protein, 12 aa, Homo sapiens
  heavy chain complementarity determining region 3 for antibody 2441
ARLDWNYRAFDI

SEQ ID NO: 4883 - protein, 7 aa, Homo sapiens
  light chain complementarity determining region 3 for antibody 2442
QYRSNWG

SEQ ID NO: 4884 - protein, 20 aa, Homo sapiens
  heavy chain complementarity determining region 3 for antibody 2442
ATFLPGDCTCTTCFYWYFDF

SEQ ID NO: 4885 - protein, 9 aa, Homo sapiens
  light chain complementarity determining region 3 for antibody 2443
QVYKSAPPT

SEQ ID NO: 4886 - protein, 14 aa, Homo sapiens
  heavy chain complementarity determining region 3 for antibody 2443
CRGWLDPATPHYDF

SEQ ID NO: 4887 - protein, 9 aa, Homo sapiens
  light chain complementarity determining region 3 for antibody 2444
QQYYTAPFT

SEQ ID NO: 4888 - protein, 12 aa, Homo sapiens
  heavy chain complementarity determining region 3 for antibody 2444
AIAGPWGSYYPH

SEQ ID NO: 4889 - protein, 10 aa, Homo sapiens
  light chain complementarity determining region 3 for antibody 2445
QQYYSSPPWA

SEQ ID NO: 4890 - protein, 16 aa, Homo sapiens
  heavy chain complementarity determining region 3 for antibody 2445
ASLNRGDKECGVPPAL

SEQ ID NO: 4891 - protein, 9 aa, Homo sapiens
  light chain complementarity determining region 3 for antibody 2446
QQYYSSPLT

SEQ ID NO: 4892 - protein, 14 aa, Homo sapiens
  heavy chain complementarity determining region 3 for antibody 2446
AKPTRGPGSFLIDF

SEQ ID NO: 4893 - protein, 9 aa, Homo sapiens
  light chain complementarity determining region 3 for antibody 2447
QQYYSPPYT

SEQ ID NO: 4894 - protein, 17 aa, Homo sapiens
  heavy chain complementarity determining region 3 for antibody 2447
ARQGNHCDGGSCFPANY

SEQ ID NO: 4895 - protein, 9 aa, Homo sapiens
  light chain complementarity determining region 3 for antibody 2448
QQYYGAPIT

SEQ ID NO: 4896 - protein, 14 aa, Homo sapiens
  heavy chain complementarity determining region 3 for antibody 2448
AKGQWSSCDYILDY

SEQ ID NO: 4897 - protein, 9 aa, Homo sapiens
  light chain complementarity determining region 3 for antibody 2449
QQYYDLPQT

SEQ ID NO: 4898 - protein, 22 aa, Homo sapiens
  heavy chain complementarity determining region 3 for antibody 2449
ARGRGYCDTNRCYRSGYYFLDV

SEQ ID NO: 4899 - protein, 7 aa, Homo sapiens
  light chain complementarity determining region 3 for antibody 2450
QQYNTWT

SEQ ID NO: 4900 - protein, 14 aa, Homo sapiens
  heavy chain complementarity determining region 3 for antibody 2450
ARLLIVWPPIHFDY

SEQ ID NO: 4901 - protein, 7 aa, Homo sapiens
  light chain complementarity determining region 3 for antibody 2451
QQYNTWT

SEQ ID NO: 4902 - protein, 12 aa, Homo sapiens
  heavy chain complementarity determining region 3 for antibody 2451
ARDKGGRNGMDF

SEQ ID NO: 4903 - protein, 7 aa, Homo sapiens
  light chain complementarity determining region 3 for antibody 2452
QQYNTWT

SEQ ID NO: 4904 - protein, 12 aa, Homo sapiens
  heavy chain complementarity determining region 3 for antibody 2452
ARDEGGRNGMDV

SEQ ID NO: 4905 - protein, 8 aa, Homo sapiens
  light chain complementarity determining region 3 for antibody 2453
QQYNSYWT

SEQ ID NO: 4906 - protein, 12 aa, Homo sapiens
  heavy chain complementarity determining region 3 for antibody 2453
STDVETTFPSVS

SEQ ID NO: 4907 - protein, 10 aa, Homo sapiens
  light chain complementarity determining region 3 for antibody 2454
QQYNSYSLYT

SEQ ID NO: 4908 - protein, 15 aa, Homo sapiens
  heavy chain complementarity determining region 3 for antibody 2454
ARVGYSSGWYRFFDQ

SEQ ID NO: 4909 - protein, 9 aa, Homo sapiens
  light chain complementarity determining region 3 for antibody 2455
QQYNSYPWT

SEQ ID NO: 4910 - protein, 13 aa, Homo sapiens
  heavy chain complementarity determining region 3 for antibody 2455
AKEGSSPGPDFDS

SEQ ID NO: 4911 - protein, 7 aa, Homo sapiens
  light chain complementarity determining region 3 for antibody 2456
QQYNSWT

SEQ ID NO: 4912 - protein, 12 aa, Homo sapiens
  heavy chain complementarity determining region 3 for antibody 2456
VKDRGGRSGMDY

SEQ ID NO: 4913 - protein, 8 aa, Homo sapiens
  light chain complementarity determining region 3 for antibody 2457
QQYNSLWT

SEQ ID NO: 4914 - protein, 21 aa, Homo sapiens
  heavy chain complementarity determining region 3 for antibody 2457
ARDGEGDYDFWTGYKRNWFDP

SEQ ID NO: 4915 - protein, 9 aa, Homo sapiens
  light chain complementarity determining region 3 for antibody 2458
QQYNNWPET

SEQ ID NO: 4916 - protein, 13 aa, Homo sapiens
  heavy chain complementarity determining region 3 for antibody 2458
AKEGSSPGPDFDY

SEQ ID NO: 4917 - protein, 9 aa, Homo sapiens
  light chain complementarity determining region 3 for antibody 2459
QQYNIYPWT

SEQ ID NO: 4918 - protein, 13 aa, Homo sapiens
  heavy chain complementarity determining region 3 for antibody 2459
AKEGSSPGPDFDY

SEQ ID NO: 4919 - protein, 9 aa, Homo sapiens
  light chain complementarity determining region 3 for antibody 2460
QQYISDSRT

SEQ ID NO: 4920 - protein, 17 aa, Homo sapiens
  heavy chain complementarity determining region 3 for antibody 2460
VRSPKYYDSSGLRYFDL

SEQ ID NO: 4921 - protein, 10 aa, Homo sapiens
  light chain complementarity determining region 3 for antibody 2461
QQYHNWPPFT

SEQ ID NO: 4922 - protein, 14 aa, Homo sapiens
  heavy chain complementarity determining region 3 for antibody 2461
ATNAGRFEVLVVDY

SEQ ID NO: 4923 - protein, 9 aa, Homo sapiens
  light chain complementarity determining region 3 for antibody 2462
QQYGTSPVT

SEQ ID NO: 4924 - protein, 13 aa, Homo sapiens
  heavy chain complementarity determining region 3 for antibody 2462
AKERGSGWFAWGY

SEQ ID NO: 4925 - protein, 9 aa, Homo sapiens
  light chain complementarity determining region 3 for antibody 2463
QQYGSSPWT

SEQ ID NO: 4926 - protein, 10 aa, Homo sapiens
  heavy chain complementarity determining region 3 for antibody 2463
ARERSSSYDI

SEQ ID NO: 4927 - protein, 9 aa, Homo sapiens
  light chain complementarity determining region 3 for antibody 2464
QQYGSSPGT

SEQ ID NO: 4928 - protein, 15 aa, Homo sapiens
  heavy chain complementarity determining region 3 for antibody 2464
ARGGIIGTTDDAFDI

SEQ ID NO: 4929 - protein, 10 aa, Homo sapiens
  light chain complementarity determining region 3 for antibody 2465
QQYGSSLMYT

SEQ ID NO: 4930 - protein, 10 aa, Homo sapiens
  heavy chain complementarity determining region 3 for antibody 2465
ARYGSGSYYY

SEQ ID NO: 4931 - protein, 8 aa, Homo sapiens
  light chain complementarity determining region 3 for antibody 2466
QQYGSLIT

SEQ ID NO: 4932 - protein, 15 aa, Homo sapiens
  heavy chain complementarity determining region 3 for antibody 2466
ARIWTSSTNCRYMDV

SEQ ID NO: 4933 - protein, 10 aa, Homo sapiens
  light chain complementarity determining region 3 for antibody 2467
QQYGRSPPIT

SEQ ID NO: 4934 - protein, 14 aa, Homo sapiens
  heavy chain complementarity determining region 3 for antibody 2467
AREVIIRGIQQFDY

SEQ ID NO: 4935 - protein, 10 aa, Homo sapiens
  light chain complementarity determining region 3 for antibody 2468
QQYGGSPPFT

SEQ ID NO: 4936 - protein, 14 aa, Homo sapiens
  heavy chain complementarity determining region 3 for antibody 2468
AKTALITTAWGMDV

SEQ ID NO: 4937 - protein, 8 aa, Homo sapiens
  light chain complementarity determining region 3 for antibody 2469
QQYGDSFP

SEQ ID NO: 4938 - protein, 17 aa, Homo sapiens
  heavy chain complementarity determining region 3 for antibody 2469
ARGTGIGSGSYYADFDY

SEQ ID NO: 4939 - protein, 9 aa, Homo sapiens
  light chain complementarity determining region 3 for antibody 2470
QQYDTSRWT

SEQ ID NO: 4940 - protein, 19 aa, Homo sapiens
  heavy chain complementarity determining region 3 for antibody 2470
ARGWRSTVRGVWVTQPCDY

SEQ ID NO: 4941 - protein, 10 aa, Homo sapiens
  light chain complementarity determining region 3 for antibody 2471
QQYDSYPEIT

SEQ ID NO: 4942 - protein, 14 aa, Homo sapiens
  heavy chain complementarity determining region 3 for antibody 2471
ARDGSGGAWRYFDY

SEQ ID NO: 4943 - protein, 10 aa, Homo sapiens
  light chain complementarity determining region 3 for antibody 2472
QQYDNPASLT

SEQ ID NO: 4944 - protein, 13 aa, Homo sapiens
  heavy chain complementarity determining region 3 for antibody 2472
AKEGSSPGPDFEY

SEQ ID NO: 4945 - protein, 10 aa, Homo sapiens
  light chain complementarity determining region 3 for antibody 2473
QQYDNLPPFT

SEQ ID NO: 4946 - protein, 12 aa, Homo sapiens
  heavy chain complementarity determining region 3 for antibody 2473
AIVVPGRWDLDD

SEQ ID NO: 4947 - protein, 10 aa, Homo sapiens
  light chain complementarity determining region 3 for antibody 2474
QQYDNLLPYT

SEQ ID NO: 4948 - protein, 10 aa, Homo sapiens
  heavy chain complementarity determining region 3 for antibody 2474
AKYLRRAFDV

SEQ ID NO: 4949 - protein, 10 aa, Homo sapiens
  light chain complementarity determining region 3 for antibody 2475
QQYDNLASLT

SEQ ID NO: 4950 - protein, 13 aa, Homo sapiens
  heavy chain complementarity determining region 3 for antibody 2475
AKEGSSPGPSTQS

SEQ ID NO: 4951 - protein, 10 aa, Homo sapiens
  light chain complementarity determining region 3 for antibody 2476
QQYDNLASLT

SEQ ID NO: 4952 - protein, 13 aa, Homo sapiens
  heavy chain complementarity determining region 3 for antibody 2476
AKEGSSPGPDFGY

SEQ ID NO: 4953 - protein, 10 aa, Homo sapiens
  light chain complementarity determining region 3 for antibody 2477
QQYDNLASLT

SEQ ID NO: 4954 - protein, 13 aa, Homo sapiens
  heavy chain complementarity determining region 3 for antibody 2477
AKEGSSPGPDFEH

SEQ ID NO: 4955 - protein, 10 aa, Homo sapiens
  light chain complementarity determining region 3 for antibody 2478
QQYDNLASLT

SEQ ID NO: 4956 - protein, 13 aa, Homo sapiens
  heavy chain complementarity determining region 3 for antibody 2478
AKEGSSPGPDFEC

SEQ ID NO: 4957 - protein, 9 aa, Homo sapiens
  light chain complementarity determining region 3 for antibody 2479
QQYATSPLT

SEQ ID NO: 4958 - protein, 14 aa, Homo sapiens
  heavy chain complementarity determining region 3 for antibody 2479
ARAPGGDTDFLIDF

SEQ ID NO: 4959 - protein, 9 aa, Homo sapiens
  light chain complementarity determining region 3 for antibody 2480
QQYANEPFT

SEQ ID NO: 4960 - protein, 11 aa, Homo sapiens
  heavy chain complementarity determining region 3 for antibody 2480
ARGYDNVKVGY

SEQ ID NO: 4961 - protein, 9 aa, Homo sapiens
  light chain complementarity determining region 3 for antibody 2481
QQTYSSPWT

SEQ ID NO: 4962 - protein, 15 aa, Homo sapiens
  heavy chain complementarity determining region 3 for antibody 2481
ARVPTLDSGTLGFDY

SEQ ID NO: 4963 - protein, 9 aa, Homo sapiens
  light chain complementarity determining region 3 for antibody 2482
QQTYSSPWT

SEQ ID NO: 4964 - protein, 15 aa, Homo sapiens
  heavy chain complementarity determining region 3 for antibody 2482
ARIWTSSTNCRYVDV

SEQ ID NO: 4965 - protein, 9 aa, Homo sapiens
  light chain complementarity determining region 3 for antibody 2483
QQTYSSPWT

SEQ ID NO: 4966 - protein, 15 aa, Homo sapiens
  heavy chain complementarity determining region 3 for antibody 2483
ARICTSSTNCRYMDV

SEQ ID NO: 4967 - protein, 8 aa, Homo sapiens
  light chain complementarity determining region 3 for antibody 2484
QQTYSKHT

SEQ ID NO: 4968 - protein, 11 aa, Homo sapiens
  heavy chain complementarity determining region 3 for antibody 2484
ARASNSDSFDY

SEQ ID NO: 4969 - protein, 9 aa, Homo sapiens
  light chain complementarity determining region 3 for antibody 2485
QQTYRTPYT

SEQ ID NO: 4970 - protein, 17 aa, Homo sapiens
  heavy chain complementarity determining region 3 for antibody 2485
AKDCCYGDFHPDRYFDL

SEQ ID NO: 4971 - protein, 9 aa, Homo sapiens
  light chain complementarity determining region 3 for antibody 2486
QQTSSSPWT

SEQ ID NO: 4972 - protein, 15 aa, Homo sapiens
  heavy chain complementarity determining region 3 for antibody 2486
ARIWTSSTNCRYMDV

SEQ ID NO: 4973 - protein, 9 aa, Homo sapiens
  light chain complementarity determining region 3 for antibody 2487
QQSYTMPRT

SEQ ID NO: 4974 - protein, 8 aa, Homo sapiens
  heavy chain complementarity determining region 3 for antibody 2487
AGWSDANY

SEQ ID NO: 4975 - protein, 9 aa, Homo sapiens
  light chain complementarity determining region 3 for antibody 2488
QQSYSTPYT

SEQ ID NO: 4976 - protein, 16 aa, Homo sapiens
  heavy chain complementarity determining region 3 for antibody 2488
VKDWEGDNCQAGCLAY

SEQ ID NO: 4977 - protein, 10 aa, Homo sapiens
  light chain complementarity determining region 3 for antibody 2489
QQSYSTPLLT

SEQ ID NO: 4978 - protein, 15 aa, Homo sapiens
  heavy chain complementarity determining region 3 for antibody 2489
ARVGRPYHNAWYFDN

SEQ ID NO: 4979 - protein, 9 aa, Homo sapiens
  light chain complementarity determining region 3 for antibody 2490
QQSYSLPRT

SEQ ID NO: 4980 - protein, 15 aa, Homo sapiens
  heavy chain complementarity determining region 3 for antibody 2490
ARGDYGDYKGVPFDY

SEQ ID NO: 4981 - protein, 9 aa, Homo sapiens
  light chain complementarity determining region 3 for antibody 2491
QQSYSIPYT

SEQ ID NO: 4982 - protein, 10 aa, Homo sapiens
  heavy chain complementarity determining region 3 for antibody 2491
ARSLYSGFDY

SEQ ID NO: 4983 - protein, 9 aa, Homo sapiens
  light chain complementarity determining region 3 for antibody 2492
QQSYSAPRT

SEQ ID NO: 4984 - protein, 12 aa, Homo sapiens
  heavy chain complementarity determining region 3 for antibody 2492
QGGNWGRDGFDV

SEQ ID NO: 4985 - protein, 9 aa, Homo sapiens
  light chain complementarity determining region 3 for antibody 2493
QQSYNTPLT

SEQ ID NO: 4986 - protein, 16 aa, Homo sapiens
  heavy chain complementarity determining region 3 for antibody 2493
VRDLAGFTRGGSTFDY

SEQ ID NO: 4987 - protein, 9 aa, Homo sapiens
  light chain complementarity determining region 3 for antibody 2494
QQSSSTPRT

SEQ ID NO: 4988 - protein, 13 aa, Homo sapiens
  heavy chain complementarity determining region 3 for antibody 2494
ARSHSLWFDWFDP

SEQ ID NO: 4989 - protein, 8 aa, Homo sapiens
  light chain complementarity determining region 3 for antibody 2495
QQSISRPT

SEQ ID NO: 4990 - protein, 12 aa, Homo sapiens
  heavy chain complementarity determining region 3 for antibody 2495
ARWRWRQSEFDY

SEQ ID NO: 4991 - protein, 11 aa, Homo sapiens
  light chain complementarity determining region 3 for antibody 2496
QQRTNWPPIFT

SEQ ID NO: 4992 - protein, 15 aa, Homo sapiens
  heavy chain complementarity determining region 3 for antibody 2496
AKALAGISSWNTPGS

SEQ ID NO: 4993 - protein, 10 aa, Homo sapiens
  light chain complementarity determining region 3 for antibody 2497
QQRSNWPPYT

SEQ ID NO: 4994 - protein, 17 aa, Homo sapiens
  heavy chain complementarity determining region 3 for antibody 2497
ARNTMVGTWQRQGNLDH

SEQ ID NO: 4995 - protein, 10 aa, Homo sapiens
  light chain complementarity determining region 3 for antibody 2498
QQRSNWPPGT

SEQ ID NO: 4996 - protein, 11 aa, Homo sapiens
  heavy chain complementarity determining region 3 for antibody 2498
VRVSTGWNFDY

SEQ ID NO: 4997 - protein, 9 aa, Homo sapiens
  light chain complementarity determining region 3 for antibody 2499
QQRSNWPLT

SEQ ID NO: 4998 - protein, 12 aa, Homo sapiens
  heavy chain complementarity determining region 3 for antibody 2499
ARERSADYWFGP

SEQ ID NO: 4999 - protein, 9 aa, Homo sapiens
  light chain complementarity determining region 3 for antibody 2500
QQRSNWPLS

SEQ ID NO: 5000 - protein, 14 aa, Homo sapiens
  heavy chain complementarity determining region 3 for antibody 2500
ARTRGSGPGGHFDY

SEQ ID NO: 5001 - protein, 9 aa, Homo sapiens
  light chain complementarity determining region 3 for antibody 2501
QQRSNWLWT

SEQ ID NO: 5002 - protein, 17 aa, Homo sapiens
  heavy chain complementarity determining region 3 for antibody 2501
ARNTMVGTWQRQGNLDH

SEQ ID NO: 5003 - protein, 8 aa, Homo sapiens
  light chain complementarity determining region 3 for antibody 2502
QQRSKWRT

SEQ ID NO: 5004 - protein, 9 aa, Homo sapiens
  heavy chain complementarity determining region 3 for antibody 2502
ASGPWELDF

SEQ ID NO: 5005 - protein, 9 aa, Homo sapiens
  light chain complementarity determining region 3 for antibody 2503
QQRAHSPLT

SEQ ID NO: 5006 - protein, 13 aa, Homo sapiens
  heavy chain complementarity determining region 3 for antibody 2503
VGGLYSGTWYGGY

SEQ ID NO: 5007 - protein, 9 aa, Homo sapiens
  light chain complementarity determining region 3 for antibody 2504
QQLYSYPIT

SEQ ID NO: 5008 - protein, 14 aa, Homo sapiens
  heavy chain complementarity determining region 3 for antibody 2504
ARDTTHNWSDGGIY

SEQ ID NO: 5009 - protein, 9 aa, Homo sapiens
  light chain complementarity determining region 3 for antibody 2505
QQLSDYPRS

SEQ ID NO: 5010 - protein, 15 aa, Homo sapiens
  heavy chain complementarity determining region 3 for antibody 2505
TREDYDVLTGYFPGH

SEQ ID NO: 5011 - protein, 9 aa, Homo sapiens
  light chain complementarity determining region 3 for antibody 2506
QQLMSYPYT

SEQ ID NO: 5012 - protein, 17 aa, Homo sapiens
  heavy chain complementarity determining region 3 for antibody 2506
ARNAMVHGWQRQGSVDH

SEQ ID NO: 5013 - protein, 9 aa, Homo sapiens
  light chain complementarity determining region 3 for antibody 2507
QQLHGYPIT

SEQ ID NO: 5014 - protein, 15 aa, Homo sapiens
  heavy chain complementarity determining region 3 for antibody 2507
TTSRTASAWYNAFDI

SEQ ID NO: 5015 - protein, 9 aa, Homo sapiens
  light chain complementarity determining region 3 for antibody 2508
QQFSNLPRT

SEQ ID NO: 5016 - protein, 13 aa, Homo sapiens
  heavy chain complementarity determining region 3 for antibody 2508
AKEGSSPGPDFDA

SEQ ID NO: 5017 - protein, 9 aa, Homo sapiens
  light chain complementarity determining region 3 for antibody 2509
QQANSLPLT

SEQ ID NO: 5018 - protein, 19 aa, Homo sapiens
  heavy chain complementarity determining region 3 for antibody 2509
ARGLGYCTTSACRADAFDI

SEQ ID NO: 5019 - protein, 9 aa, Homo sapiens
  light chain complementarity determining region 3 for antibody 2510
QLSGSPLLT

SEQ ID NO: 5020 - protein, 12 aa, Homo sapiens
  heavy chain complementarity determining region 3 for antibody 2510
ALDEWHPSWYKY

SEQ ID NO: 5021 - protein, 9 aa, Homo sapiens
  light chain complementarity determining region 3 for antibody 2511
QKYYSVPLT

SEQ ID NO: 5022 - protein, 10 aa, Homo sapiens
  heavy chain complementarity determining region 3 for antibody 2511
AKYLARAFDV

SEQ ID NO: 5023 - protein, 9 aa, Homo sapiens
  light chain complementarity determining region 3 for antibody 2512
QKYNSAPRT

SEQ ID NO: 5024 - protein, 15 aa, Homo sapiens
  heavy chain complementarity determining region 3 for antibody 2512
TYDFLVMGYRTPSDY

SEQ ID NO: 5025 - protein, 9 aa, Homo sapiens
  light chain complementarity determining region 3 for antibody 2513
QKYKSAPFT

SEQ ID NO: 5026 - protein, 13 aa, Homo sapiens
  heavy chain complementarity determining region 3 for antibody 2513
AKEGSSPGPDFDY

SEQ ID NO: 5027 - protein, 9 aa, Homo sapiens
  light chain complementarity determining region 3 for antibody 2514
QHYNNWWWT

SEQ ID NO: 5028 - protein, 10 aa, Homo sapiens
  heavy chain complementarity determining region 3 for antibody 2514
VKSSSGHFDD

SEQ ID NO: 5029 - protein, 9 aa, Homo sapiens
  light chain complementarity determining region 3 for antibody 2515
QHYHTYSAT

SEQ ID NO: 5030 - protein, 26 aa, Homo sapiens
  heavy chain complementarity determining region 3 for antibody 2515
AANHTEAHYRGTNCHMRHCYYYGMDV

SEQ ID NO: 5031 - protein, 14 aa, Homo sapiens
  light chain complementarity determining region 3 for antibody 2516
QHYCQQCGSSPRYA

SEQ ID NO: 5032 - protein, 14 aa, Homo sapiens
  heavy chain complementarity determining region 3 for antibody 2516
ARHMSTPGTRGFDS

SEQ ID NO: 5033 - protein, 11 aa, Homo sapiens
  light chain complementarity determining region 3 for antibody 2517
QHRRNWPPLFP

SEQ ID NO: 5034 - protein, 13 aa, Homo sapiens
  heavy chain complementarity determining region 3 for antibody 2517
IADAWIDDLWGSY

SEQ ID NO: 5035 - protein, 9 aa, Homo sapiens
  light chain complementarity determining region 3 for antibody 2518
QHFNNYLGT

SEQ ID NO: 5036 - protein, 25 aa, Homo sapiens
  heavy chain complementarity determining region 3 for antibody 2518
AREICHTAACYEILWFGQTPYYFDS

SEQ ID NO: 5037 - protein, 9 aa, Homo sapiens
  light chain complementarity determining region 3 for antibody 2519
MRFLQTPLT

SEQ ID NO: 5038 - protein, 10 aa, Homo sapiens
  heavy chain complementarity determining region 3 for antibody 2519
ARERSGSYDI

SEQ ID NO: 5039 - protein, 9 aa, Homo sapiens
  light chain complementarity determining region 3 for antibody 2520
MQYTHRPPT

SEQ ID NO: 5040 - protein, 8 aa, Homo sapiens
  heavy chain complementarity determining region 3 for antibody 2520
AGWGYANY

SEQ ID NO: 5041 - protein, 9 aa, Homo sapiens
  light chain complementarity determining region 3 for antibody 2521
MQYAHGPPT

SEQ ID NO: 5042 - protein, 8 aa, Homo sapiens
  heavy chain complementarity determining region 3 for antibody 2521
AGWGYGNY

SEQ ID NO: 5043 - protein, 9 aa, Homo sapiens
  light chain complementarity determining region 3 for antibody 2522
MQYAHGPHT

SEQ ID NO: 5044 - protein, 8 aa, Homo sapiens
  heavy chain complementarity determining region 3 for antibody 2522
AGWGNGNY

SEQ ID NO: 5045 - protein, 9 aa, Homo sapiens
  light chain complementarity determining region 3 for antibody 2523
MQTVQTPWT

SEQ ID NO: 5046 - protein, 12 aa, Homo sapiens
  heavy chain complementarity determining region 3 for antibody 2523
ARLDWNYRAVDI

SEQ ID NO: 5047 - protein, 9 aa, Homo sapiens
  light chain complementarity determining region 3 for antibody 2524
MQTVQTPWP

SEQ ID NO: 5048 - protein, 12 aa, Homo sapiens
  heavy chain complementarity determining region 3 for antibody 2524
ARLDWNYRAFDI

SEQ ID NO: 5049 - protein, 9 aa, Homo sapiens
  light chain complementarity determining region 3 for antibody 2525
MQTLRTPWT

SEQ ID NO: 5050 - protein, 12 aa, Homo sapiens
  heavy chain complementarity determining region 3 for antibody 2525
ARLDWNYRAFDI

SEQ ID NO: 5051 - protein, 9 aa, Homo sapiens
  light chain complementarity determining region 3 for antibody 2526
MQTLQTPWT

SEQ ID NO: 5052 - protein, 10 aa, Homo sapiens
  heavy chain complementarity determining region 3 for antibody 2526
CRGREGFGDV

SEQ ID NO: 5053 - protein, 9 aa, Homo sapiens
  light chain complementarity determining region 3 for antibody 2527
MQTLQTPWT

SEQ ID NO: 5054 - protein, 12 aa, Homo sapiens
  heavy chain complementarity determining region 3 for antibody 2527
ARVDWNYRAFDI

SEQ ID NO: 5055 - protein, 9 aa, Homo sapiens
  light chain complementarity determining region 3 for antibody 2528
MQTLQTPWT

SEQ ID NO: 5056 - protein, 12 aa, Homo sapiens
  heavy chain complementarity determining region 3 for antibody 2528
ARLDWNYRAFGI

SEQ ID NO: 5057 - protein, 9 aa, Homo sapiens
  light chain complementarity determining region 3 for antibody 2529
MQTLQTPWT

SEQ ID NO: 5058 - protein, 12 aa, Homo sapiens
  heavy chain complementarity determining region 3 for antibody 2529
ARLDWNDRAFDI

SEQ ID NO: 5059 - protein, 6 aa, Homo sapiens
  light chain complementarity determining region 3 for antibody 2530
MQSTNW

SEQ ID NO: 5060 - protein, 19 aa, Homo sapiens
  heavy chain complementarity determining region 3 for antibody 2530
ARERVRCRSGICYDAPFDI

SEQ ID NO: 5061 - protein, 9 aa, Homo sapiens
  light chain complementarity determining region 3 for antibody 2531
MQGTNWPWT

SEQ ID NO: 5062 - protein, 16 aa, Homo sapiens
  heavy chain complementarity determining region 3 for antibody 2531
ARGHTNPGERRGGSDF

SEQ ID NO: 5063 - protein, 9 aa, Homo sapiens
  light chain complementarity determining region 3 for antibody 2532
MQGTHWPYT

SEQ ID NO: 5064 - protein, 10 aa, Homo sapiens
  heavy chain complementarity determining region 3 for antibody 2532
VRGSRSGECC

SEQ ID NO: 5065 - protein, 9 aa, Homo sapiens
  light chain complementarity determining region 3 for antibody 2533
MQGTHWPYI

SEQ ID NO: 5066 - protein, 19 aa, Homo sapiens
  heavy chain complementarity determining region 3 for antibody 2533
TRFAAYYFDSGGFYSSYDY

SEQ ID NO: 5067 - protein, 9 aa, Homo sapiens
  light chain complementarity determining region 3 for antibody 2534
MQGTHWPWT

SEQ ID NO: 5068 - protein, 16 aa, Homo sapiens
  heavy chain complementarity determining region 3 for antibody 2534
ARGRTNPGERRGGSDF

SEQ ID NO: 5069 - protein, 9 aa, Homo sapiens
  light chain complementarity determining region 3 for antibody 2535
MQGTHWPPR

SEQ ID NO: 5070 - protein, 12 aa, Homo sapiens
  heavy chain complementarity determining region 3 for antibody 2535
AIVVPGRWDLDD

SEQ ID NO: 5071 - protein, 9 aa, Homo sapiens
  light chain complementarity determining region 3 for antibody 2536
MQGTHWPHT

SEQ ID NO: 5072 - protein, 11 aa, Homo sapiens
  heavy chain complementarity determining region 3 for antibody 2536
ATFGRQWRLAH

SEQ ID NO: 5073 - protein, 9 aa, Homo sapiens
  light chain complementarity determining region 3 for antibody 2537
MQGTHGPWT

SEQ ID NO: 5074 - protein, 16 aa, Homo sapiens
  heavy chain complementarity determining region 3 for antibody 2537
ARGHTNPGERRGGSDF

SEQ ID NO: 5075 - protein, 9 aa, Homo sapiens
  light chain complementarity determining region 3 for antibody 2538
MQFLQTPLT

SEQ ID NO: 5076 - protein, 10 aa, Homo sapiens
  heavy chain complementarity determining region 3 for antibody 2538
ARERSGSYDV

SEQ ID NO: 5077 - protein, 9 aa, Homo sapiens
  light chain complementarity determining region 3 for antibody 2539
MQFLPTPLT

SEQ ID NO: 5078 - protein, 10 aa, Homo sapiens
  heavy chain complementarity determining region 3 for antibody 2539
ARERSGSYDI

SEQ ID NO: 5079 - protein, 9 aa, Homo sapiens
  light chain complementarity determining region 3 for antibody 2540
MQATHWPRT

SEQ ID NO: 5080 - protein, 13 aa, Homo sapiens
  heavy chain complementarity determining region 3 for antibody 2540
AKEGSSPGPDFDY

SEQ ID NO: 5081 - protein, 9 aa, Homo sapiens
  light chain complementarity determining region 3 for antibody 2541
MQASYWPNT

SEQ ID NO: 5082 - protein, 12 aa, Homo sapiens
  heavy chain complementarity determining region 3 for antibody 2541
AIVVPGRWDLDD

SEQ ID NO: 5083 - protein, 9 aa, Homo sapiens
  light chain complementarity determining region 3 for antibody 2542
MQALQIPRT

SEQ ID NO: 5084 - protein, 19 aa, Homo sapiens
  heavy chain complementarity determining region 3 for antibody 2542
VRERKSLVGGATLYYGMDA

SEQ ID NO: 5085 - protein, 7 aa, Homo sapiens
  light chain complementarity determining region 3 for antibody 2543
MQALQFT

SEQ ID NO: 5086 - protein, 14 aa, Homo sapiens
  heavy chain complementarity determining region 3 for antibody 2543
ARRRVNILYCGMDI

SEQ ID NO: 5087 - protein, 9 aa, Homo sapiens
  light chain complementarity determining region 3 for antibody 2544
MPTVQTPWT

SEQ ID NO: 5088 - protein, 12 aa, Homo sapiens
  heavy chain complementarity determining region 3 for antibody 2544
ARLDWNYRAFDI

SEQ ID NO: 5089 - protein, 9 aa, Homo sapiens
  light chain complementarity determining region 3 for antibody 2545
MHARQFPYT

SEQ ID NO: 5090 - protein, 11 aa, Homo sapiens
  heavy chain complementarity determining region 3 for antibody 2545
ATNSNGKGYEY

SEQ ID NO: 5091 - protein, 9 aa, Homo sapiens
  light chain complementarity determining region 3 for antibody 2546
LQYGSSPDT

SEQ ID NO: 5092 - protein, 14 aa, Homo sapiens
  heavy chain complementarity determining region 3 for antibody 2546
AREVWSGDNRGYDP

SEQ ID NO: 5093 - protein, 9 aa, Homo sapiens
  light chain complementarity determining region 3 for antibody 2547
LQYAHWPHT

SEQ ID NO: 5094 - protein, 13 aa, Homo sapiens
  heavy chain complementarity determining region 3 for antibody 2547
AKEGSSPGPDFEY

SEQ ID NO: 5095 - protein, 9 aa, Homo sapiens
  light chain complementarity determining region 3 for antibody 2548
LQYAHWPHT

SEQ ID NO: 5096 - protein, 15 aa, Homo sapiens
  heavy chain complementarity determining region 3 for antibody 2548
AGVGRPYHNAWYFDN

SEQ ID NO: 5097 - protein, 9 aa, Homo sapiens
  light chain complementarity determining region 3 for antibody 2549
LQHNTYPWT

SEQ ID NO: 5098 - protein, 18 aa, Homo sapiens
  heavy chain complementarity determining region 3 for antibody 2549
VRGPSGAPGAMAFYYLDV

SEQ ID NO: 5099 - protein, 9 aa, Homo sapiens
  light chain complementarity determining region 3 for antibody 2550
LQHNSYPWT

SEQ ID NO: 5100 - protein, 11 aa, Homo sapiens
  heavy chain complementarity determining region 3 for antibody 2550
ATFGQQWRLAH

SEQ ID NO: 5101 - protein, 11 aa, Homo sapiens
  light chain complementarity determining region 3 for antibody 2551
LQHNSYPPMYT

SEQ ID NO: 5102 - protein, 13 aa, Homo sapiens
  heavy chain complementarity determining region 3 for antibody 2551
AKEGSAPGPDFEY

SEQ ID NO: 5103 - protein, 9 aa, Homo sapiens
  light chain complementarity determining region 3 for antibody 2552
LQHNSYPLT

SEQ ID NO: 5104 - protein, 11 aa, Homo sapiens
  heavy chain complementarity determining region 3 for antibody 2552
VRVSTGCNFDY

SEQ ID NO: 5105 - protein, 9 aa, Homo sapiens
  light chain complementarity determining region 3 for antibody 2553
LQHNSYPLT

SEQ ID NO: 5106 - protein, 11 aa, Homo sapiens
  heavy chain complementarity determining region 3 for antibody 2553
GRVSTGWNFDY

SEQ ID NO: 5107 - protein, 9 aa, Homo sapiens
  light chain complementarity determining region 3 for antibody 2554
LQHNSYPLT

SEQ ID NO: 5108 - protein, 12 aa, Homo sapiens
  heavy chain complementarity determining region 3 for antibody 2554
AIVVPGRWDLDD

SEQ ID NO: 5109 - protein, 9 aa, Homo sapiens
  light chain complementarity determining region 3 for antibody 2555
LQHNSYPLA

SEQ ID NO: 5110 - protein, 11 aa, Homo sapiens
  heavy chain complementarity determining region 3 for antibody 2555
VRVSTGWNFDY

SEQ ID NO: 5111 - protein, 10 aa, Homo sapiens
  light chain complementarity determining region 3 for antibody 2556
LQDYNYPALT

SEQ ID NO: 5112 - protein, 14 aa, Homo sapiens
  heavy chain complementarity determining region 3 for antibody 2556
AKHTHNWYLGVLDC

SEQ ID NO: 5113 - protein, 9 aa, Homo sapiens
  light chain complementarity determining region 3 for antibody 2557
LQDYNHVGP

SEQ ID NO: 5114 - protein, 9 aa, Homo sapiens
  heavy chain complementarity determining region 3 for antibody 2557
GSRRPYFDS

SEQ ID NO: 5115 - protein, 9 aa, Homo sapiens
  light chain complementarity determining region 3 for antibody 2558
LQDYNHLGT

SEQ ID NO: 5116 - protein, 9 aa, Homo sapiens
  heavy chain complementarity determining region 3 for antibody 2558
ASRRPYVDY

SEQ ID NO: 5117 - protein, 9 aa, Homo sapiens
  light chain complementarity determining region 3 for antibody 2559
LQDYNHLGT

SEQ ID NO: 5118 - protein, 9 aa, Homo sapiens
  heavy chain complementarity determining region 3 for antibody 2559
ASRRPYLDH

SEQ ID NO: 5119 - protein, 9 aa, Homo sapiens
  light chain complementarity determining region 3 for antibody 2560
LQDHNYPFT

SEQ ID NO: 5120 - protein, 13 aa, Homo sapiens
  heavy chain complementarity determining region 3 for antibody 2560
AGEGPAPGPDFDY

SEQ ID NO: 5121 - protein, 9 aa, Homo sapiens
  light chain complementarity determining region 3 for antibody 2561
LQDHNYPFT

SEQ ID NO: 5122 - protein, 16 aa, Homo sapiens
  heavy chain complementarity determining region 3 for antibody 2561
AADLGDHTDAYATLDN

SEQ ID NO: 5123 - protein, 9 aa, Homo sapiens
  light chain complementarity determining region 3 for antibody 2562
LHTFNAPRT

SEQ ID NO: 5124 - protein, 15 aa, Homo sapiens
  heavy chain complementarity determining region 3 for antibody 2562
SRDYIEGSNLLRLEY

SEQ ID NO: 5125 - protein, 9 aa, Homo sapiens
  light chain complementarity determining region 3 for antibody 2563
LHDYIYPFS

SEQ ID NO: 5126 - protein, 16 aa, Homo sapiens
  heavy chain complementarity determining region 3 for antibody 2563
AADVGDHRDSYTTLDH

SEQ ID NO: 5127 - protein, 9 aa, Homo sapiens
  light chain complementarity determining region 3 for antibody 2564
HQYYTSPLT

SEQ ID NO: 5128 - protein, 13 aa, Homo sapiens
  heavy chain complementarity determining region 3 for antibody 2564
TREGDSSGPDFHL

SEQ ID NO: 5129 - protein, 9 aa, Homo sapiens
  light chain complementarity determining region 3 for antibody 2565
HQCGASPKT

SEQ ID NO: 5130 - protein, 13 aa, Homo sapiens
  heavy chain complementarity determining region 3 for antibody 2565
ARDGSSDWYELAH

SEQ ID NO: 5131 - protein, 9 aa, Homo sapiens
  light chain complementarity determining region 3 for antibody 2566
HHYGSSPRP

SEQ ID NO: 5132 - protein, 11 aa, Homo sapiens
  heavy chain complementarity determining region 3 for antibody 2566
ATFGISWYFSG

SEQ ID NO: 5133 - protein, 9 aa, Homo sapiens
  light chain complementarity determining region 3 for antibody 2567
AQGSYWSAS

SEQ ID NO: 5134 - protein, 10 aa, Homo sapiens
  heavy chain complementarity determining region 3 for antibody 2567
CRDREGFGDV

SEQ ID NO: 5135 - protein, 9 aa, Homo sapiens
  light chain complementarity determining region 3 for antibody 2568
AQGSYWPAS

SEQ ID NO: 5136 - protein, 15 aa, Homo sapiens
  heavy chain complementarity determining region 3 for antibody 2568
TTSRTASAWYNAFDI

SEQ ID NO: 5137 - protein, 9 aa, Homo sapiens
  light chain complementarity determining region 3 for antibody 2569
AQGSYWPAS

SEQ ID NO: 5138 - protein, 10 aa, Homo sapiens
  heavy chain complementarity determining region 3 for antibody 2569
CRDRWGFGNV

SEQ ID NO: 5139 - protein, 9 aa, Homo sapiens
  light chain complementarity determining region 3 for antibody 2570
AQGAYWPAS

SEQ ID NO: 5140 - protein, 10 aa, Homo sapiens
  heavy chain complementarity determining region 3 for antibody 2570
CRDREGFGDV

SEQ ID NO: 5141 - protein, 7 aa, Homo sapiens
  light chain complementarity determining region 3 for antibody 2571
QYRSNWG

SEQ ID NO: 5142 - protein, 12 aa, Homo sapiens
  heavy chain complementarity determining region 3 for antibody 2571
ARDKGGRNGMDV

SEQ ID NO: 5143 - protein, 9 aa, Homo sapiens
  light chain complementarity determining region 3 for antibody 2572
QVYNSAPHT

SEQ ID NO: 5144 - protein, 14 aa, Homo sapiens
  heavy chain complementarity determining region 3 for antibody 2572
CRGWLDPATPHYDF

SEQ ID NO: 5145 - protein, 9 aa, Homo sapiens
  light chain complementarity determining region 3 for antibody 2573
QTYKTAPWT

SEQ ID NO: 5146 - protein, 20 aa, Homo sapiens
  heavy chain complementarity determining region 3 for antibody 2573
TRDQRGIDLWSSSVGGGMDV

SEQ ID NO: 5147 - protein, 8 aa, Homo sapiens
  light chain complementarity determining region 3 for antibody 2574
QRYSSSYT

SEQ ID NO: 5148 - protein, 9 aa, Homo sapiens
  heavy chain complementarity determining region 3 for antibody 2574
ARGLHLPYD

SEQ ID NO: 5149 - protein, 9 aa, Homo sapiens
  light chain complementarity determining region 3 for antibody 2575
QQYYSIPYT

SEQ ID NO: 5150 - protein, 21 aa, Homo sapiens
  heavy chain complementarity determining region 3 for antibody 2575
ARGLPLGYCGTTCYPNYYFDY

SEQ ID NO: 5151 - protein, 9 aa, Homo sapiens
  light chain complementarity determining region 3 for antibody 2576
QQYYNSPLT

SEQ ID NO: 5152 - protein, 10 aa, Homo sapiens
  heavy chain complementarity determining region 3 for antibody 2576
ARGTWAPLDY

SEQ ID NO: 5153 - protein, 9 aa, Homo sapiens
  light chain complementarity determining region 3 for antibody 2577
QQYYGTPLT

SEQ ID NO: 5154 - protein, 17 aa, Homo sapiens
  heavy chain complementarity determining region 3 for antibody 2577
TTGLGFCGDSSATCSDS

SEQ ID NO: 5155 - protein, 9 aa, Homo sapiens
  light chain complementarity determining region 3 for antibody 2578
QQYSNSPIT

SEQ ID NO: 5156 - protein, 9 aa, Homo sapiens
  heavy chain complementarity determining region 3 for antibody 2578
VRGHTILGA

SEQ ID NO: 5157 - protein, 7 aa, Homo sapiens
  light chain complementarity determining region 3 for antibody 2579
QQYNTWT

SEQ ID NO: 5158 - protein, 16 aa, Homo sapiens
  heavy chain complementarity determining region 3 for antibody 2579
TGPLLTYNSGWSYFDF

SEQ ID NO: 5159 - protein, 7 aa, Homo sapiens
  light chain complementarity determining region 3 for antibody 2580
QQYNTWT

SEQ ID NO: 5160 - protein, 15 aa, Homo sapiens
  heavy chain complementarity determining region 3 for antibody 2580
GKEGPGSSGWLTGHY

SEQ ID NO: 5161 - protein, 7 aa, Homo sapiens
  light chain complementarity determining region 3 for antibody 2581
QQYNTWT

SEQ ID NO: 5162 - protein, 9 aa, Homo sapiens
  heavy chain complementarity determining region 3 for antibody 2581
ARSEYQPTY

SEQ ID NO: 5163 - protein, 7 aa, Homo sapiens
  light chain complementarity determining region 3 for antibody 2582
QQYNTWT

SEQ ID NO: 5164 - protein, 14 aa, Homo sapiens
  heavy chain complementarity determining region 3 for antibody 2582
ARLHGSGLGRWLDP

SEQ ID NO: 5165 - protein, 7 aa, Homo sapiens
  light chain complementarity determining region 3 for antibody 2583
QQYNTWT

SEQ ID NO: 5166 - protein, 12 aa, Homo sapiens
  heavy chain complementarity determining region 3 for antibody 2583
ARLDWNYRAFDI

SEQ ID NO: 5167 - protein, 7 aa, Homo sapiens
  light chain complementarity determining region 3 for antibody 2584
QQYNTWT

SEQ ID NO: 5168 - protein, 14 aa, Homo sapiens
  heavy chain complementarity determining region 3 for antibody 2584
ARGHFDSTGFRLDY

SEQ ID NO: 5169 - protein, 7 aa, Homo sapiens
  light chain complementarity determining region 3 for antibody 2585
QQYNTWT

SEQ ID NO: 5170 - protein, 10 aa, Homo sapiens
  heavy chain complementarity determining region 3 for antibody 2585
ARERSGSYDI

SEQ ID NO: 5171 - protein, 7 aa, Homo sapiens
  light chain complementarity determining region 3 for antibody 2586
QQYNTWT

SEQ ID NO: 5172 - protein, 12 aa, Homo sapiens
  heavy chain complementarity determining region 3 for antibody 2586
ARDKGGRNSMDV

SEQ ID NO: 5173 - protein, 7 aa, Homo sapiens
  light chain complementarity determining region 3 for antibody 2587
QQYNTWT

SEQ ID NO: 5174 - protein, 12 aa, Homo sapiens
  heavy chain complementarity determining region 3 for antibody 2587
ARDKGGRHGMDV

SEQ ID NO: 5175 - protein, 7 aa, Homo sapiens
  light chain complementarity determining region 3 for antibody 2588
QQYNTWT

SEQ ID NO: 5176 - protein, 12 aa, Homo sapiens
  heavy chain complementarity determining region 3 for antibody 2588
ARDKGERNGMDV

SEQ ID NO: 5177 - protein, 9 aa, Homo sapiens
  light chain complementarity determining region 3 for antibody 2589
QQYNSYSRT

SEQ ID NO: 5178 - protein, 16 aa, Homo sapiens
  heavy chain complementarity determining region 3 for antibody 2589
VGPYLTYNSGWRYFDY

SEQ ID NO: 5179 - protein, 9 aa, Homo sapiens
  light chain complementarity determining region 3 for antibody 2590
QQYNSYSRT

SEQ ID NO: 5180 - protein, 16 aa, Homo sapiens
  heavy chain complementarity determining region 3 for antibody 2590
VGPHLTYNSSWRYFDY

SEQ ID NO: 5181 - protein, 9 aa, Homo sapiens
  light chain complementarity determining region 3 for antibody 2591
QQYNSYSRT

SEQ ID NO: 5182 - protein, 16 aa, Homo sapiens
  heavy chain complementarity determining region 3 for antibody 2591
VGPHLTYNSGRRYFDY

SEQ ID NO: 5183 - protein, 9 aa, Homo sapiens
  light chain complementarity determining region 3 for antibody 2592
QQYNSYSRT

SEQ ID NO: 5184 - protein, 16 aa, Homo sapiens
  heavy chain complementarity determining region 3 for antibody 2592
VGPHLAYNSGWRYFDY

SEQ ID NO: 5185 - protein, 9 aa, Homo sapiens
  light chain complementarity determining region 3 for antibody 2593
QQYNSYPWT

SEQ ID NO: 5186 - protein, 15 aa, Homo sapiens
  heavy chain complementarity determining region 3 for antibody 2593
GREGPGSSGWLTGHY

SEQ ID NO: 5187 - protein, 9 aa, Homo sapiens
  light chain complementarity determining region 3 for antibody 2594
QQYNSYPWT

SEQ ID NO: 5188 - protein, 11 aa, Homo sapiens
  heavy chain complementarity determining region 3 for antibody 2594
ARIVARKPVDY

SEQ ID NO: 5189 - protein, 9 aa, Homo sapiens
  light chain complementarity determining region 3 for antibody 2595
QQYNSYPWT

SEQ ID NO: 5190 - protein, 10 aa, Homo sapiens
  heavy chain complementarity determining region 3 for antibody 2595
AKYLARAFDV

SEQ ID NO: 5191 - protein, 9 aa, Homo sapiens
  light chain complementarity determining region 3 for antibody 2596
QQYNSYPWT

SEQ ID NO: 5192 - protein, 12 aa, Homo sapiens
  heavy chain complementarity determining region 3 for antibody 2596
AIVVPGRWDLDD

SEQ ID NO: 5193 - protein, 9 aa, Homo sapiens
  light chain complementarity determining region 3 for antibody 2597
QQYNSYPGT

SEQ ID NO: 5194 - protein, 21 aa, Homo sapiens
  heavy chain complementarity determining region 3 for antibody 2597
AKLNGRYCSSTSSTCGLWFDP

SEQ ID NO: 5195 - protein, 9 aa, Homo sapiens
  light chain complementarity determining region 3 for antibody 2598
QQYNSYLYT

SEQ ID NO: 5196 - protein, 12 aa, Homo sapiens
  heavy chain complementarity determining region 3 for antibody 2598
ARERGVEDYFDL

SEQ ID NO: 5197 - protein, 7 aa, Homo sapiens
  light chain complementarity determining region 3 for antibody 2599
QQYNSWT

SEQ ID NO: 5198 - protein, 7 aa, Homo sapiens
  heavy chain complementarity determining region 3 for antibody 2599
ASERWND

SEQ ID NO: 5199 - protein, 10 aa, Homo sapiens
  light chain complementarity determining region 3 for antibody 2600
QQYNSHSPRP

SEQ ID NO: 5200 - protein, 15 aa, Homo sapiens
  heavy chain complementarity determining region 3 for antibody 2600
ARVGRPYHNAWYFDN

SEQ ID NO: 5201 - protein, 9 aa, Homo sapiens
  light chain complementarity determining region 3 for antibody 2601
QQYNSESRT

SEQ ID NO: 5202 - protein, 17 aa, Homo sapiens
  heavy chain complementarity determining region 3 for antibody 2601
AKGTGYFDSTGYDPFDS

SEQ ID NO: 5203 - protein, 10 aa, Homo sapiens
  light chain complementarity determining region 3 for antibody 2602
QQYNNWPPFT

SEQ ID NO: 5204 - protein, 15 aa, Homo sapiens
  heavy chain complementarity determining region 3 for antibody 2602
STQEAPGHDSIVFDY

SEQ ID NO: 5205 - protein, 10 aa, Homo sapiens
  light chain complementarity determining region 3 for antibody 2603
QQYNFYSTLT

SEQ ID NO: 5206 - protein, 16 aa, Homo sapiens
  heavy chain complementarity determining region 3 for antibody 2603
GRQVVSGCRWPNRLDY

SEQ ID NO: 5207 - protein, 8 aa, Homo sapiens
  light chain complementarity determining region 3 for antibody 2604
QQYKSYWT

SEQ ID NO: 5208 - protein, 13 aa, Homo sapiens
  heavy chain complementarity determining region 3 for antibody 2604
AKEGSSPGPDFEY

SEQ ID NO: 5209 - protein, 9 aa, Homo sapiens
  light chain complementarity determining region 3 for antibody 2605
QQYKIYPWT

SEQ ID NO: 5210 - protein, 15 aa, Homo sapiens
  heavy chain complementarity determining region 3 for antibody 2605
TREKAAPSERGRFDP

SEQ ID NO: 5211 - protein, 9 aa, Homo sapiens
  light chain complementarity determining region 3 for antibody 2606
QQYGTSPVT

SEQ ID NO: 5212 - protein, 13 aa, Homo sapiens
  heavy chain complementarity determining region 3 for antibody 2606
AKDRGSGWCAWGY

SEQ ID NO: 5213 - protein, 9 aa, Homo sapiens
  light chain complementarity determining region 3 for antibody 2607
QQYGSSPWT

SEQ ID NO: 5214 - protein, 14 aa, Homo sapiens
  heavy chain complementarity determining region 3 for antibody 2607
ARLLIVWPPIHFDY

SEQ ID NO: 5215 - protein, 9 aa, Homo sapiens
  light chain complementarity determining region 3 for antibody 2608
QQYGSSLIT

SEQ ID NO: 5216 - protein, 15 aa, Homo sapiens
  heavy chain complementarity determining region 3 for antibody 2608
ARSYSYGYYYYYMDV

SEQ ID NO: 5217 - protein, 9 aa, Homo sapiens
  light chain complementarity determining region 3 for antibody 2609
QQYGSSHLT

SEQ ID NO: 5218 - protein, 16 aa, Homo sapiens
  heavy chain complementarity determining region 3 for antibody 2609
ARLSGLISFLRGPLDS

SEQ ID NO: 5219 - protein, 9 aa, Homo sapiens
  light chain complementarity determining region 3 for antibody 2610
QQYGNTPFT

SEQ ID NO: 5220 - protein, 21 aa, Homo sapiens
  heavy chain complementarity determining region 3 for antibody 2610
ARAFLYGSGSSRPGPIDGMDV

SEQ ID NO: 5221 - protein, 9 aa, Homo sapiens
  light chain complementarity determining region 3 for antibody 2611
QQYGNSPVP

SEQ ID NO: 5222 - protein, 18 aa, Homo sapiens
  heavy chain complementarity determining region 3 for antibody 2611
ARGDYPEAMTGYFLDFDY

SEQ ID NO: 5223 - protein, 9 aa, Homo sapiens
  light chain complementarity determining region 3 for antibody 2612
QQYGNSPVP

SEQ ID NO: 5224 - protein, 18 aa, Homo sapiens
  heavy chain complementarity determining region 3 for antibody 2612
ARGDSPEARTGYFLDFDY

SEQ ID NO: 5225 - protein, 9 aa, Homo sapiens
  light chain complementarity determining region 3 for antibody 2613
QQYGNSPGP

SEQ ID NO: 5226 - protein, 18 aa, Homo sapiens
  heavy chain complementarity determining region 3 for antibody 2613
ARGDYPEARTGYFLDFDY

SEQ ID NO: 5227 - protein, 9 aa, Homo sapiens
  light chain complementarity determining region 3 for antibody 2614
QQYDNWPWP

SEQ ID NO: 5228 - protein, 17 aa, Homo sapiens
  heavy chain complementarity determining region 3 for antibody 2614
VTHYYHDSGIYHDFFNY

SEQ ID NO: 5229 - protein, 10 aa, Homo sapiens
  light chain complementarity determining region 3 for antibody 2615
QQYDNLPSLT

SEQ ID NO: 5230 - protein, 13 aa, Homo sapiens
  heavy chain complementarity determining region 3 for antibody 2615
AKEGSSPGPDFEY

SEQ ID NO: 5231 - protein, 9 aa, Homo sapiens
  light chain complementarity determining region 3 for antibody 2616
QQYDNLPLT

SEQ ID NO: 5232 - protein, 12 aa, Homo sapiens
  heavy chain complementarity determining region 3 for antibody 2616
AIVVPGRWDFDD

SEQ ID NO: 5233 - protein, 8 aa, Homo sapiens
  light chain complementarity determining region 3 for antibody 2617
QQYDNLHS

SEQ ID NO: 5234 - protein, 10 aa, Homo sapiens
  heavy chain complementarity determining region 3 for antibody 2617
ARDIARDRGF

SEQ ID NO: 5235 - protein, 10 aa, Homo sapiens
  light chain complementarity determining region 3 for antibody 2618
QQYDNLASLT

SEQ ID NO: 5236 - protein, 13 aa, Homo sapiens
  heavy chain complementarity determining region 3 for antibody 2618
AKEGSSPGPDVEY

SEQ ID NO: 5237 - protein, 9 aa, Homo sapiens
  light chain complementarity determining region 3 for antibody 2619
QQYDKYPWT

SEQ ID NO: 5238 - protein, 14 aa, Homo sapiens
  heavy chain complementarity determining region 3 for antibody 2619
AREQDYGYYRTVDF

SEQ ID NO: 5239 - protein, 9 aa, Homo sapiens
  light chain complementarity determining region 3 for antibody 2620
QQYAYSPIT

SEQ ID NO: 5240 - protein, 14 aa, Homo sapiens
  heavy chain complementarity determining region 3 for antibody 2620
ARADSGGVSFLINY

SEQ ID NO: 5241 - protein, 9 aa, Homo sapiens
  light chain complementarity determining region 3 for antibody 2621
QQYATPPLT

SEQ ID NO: 5242 - protein, 10 aa, Homo sapiens
  heavy chain complementarity determining region 3 for antibody 2621
TRGAGWLVDD

SEQ ID NO: 5243 - protein, 9 aa, Homo sapiens
  light chain complementarity determining region 3 for antibody 2622
QQTYTTPLT

SEQ ID NO: 5244 - protein, 14 aa, Homo sapiens
  heavy chain complementarity determining region 3 for antibody 2622
ARLHGSGLGRWFDP

SEQ ID NO: 5245 - protein, 9 aa, Homo sapiens
  light chain complementarity determining region 3 for antibody 2623
QQTYSSPWT

SEQ ID NO: 5246 - protein, 15 aa, Homo sapiens
  heavy chain complementarity determining region 3 for antibody 2623
ARIWTSSTNCRYMDA

SEQ ID NO: 5247 - protein, 9 aa, Homo sapiens
  light chain complementarity determining region 3 for antibody 2624
QQTYSSPWT

SEQ ID NO: 5248 - protein, 15 aa, Homo sapiens
  heavy chain complementarity determining region 3 for antibody 2624
ARIWTSSPTCRYMDV

SEQ ID NO: 5249 - protein, 9 aa, Homo sapiens
  light chain complementarity determining region 3 for antibody 2625
QQTYSSPWT

SEQ ID NO: 5250 - protein, 15 aa, Homo sapiens
  heavy chain complementarity determining region 3 for antibody 2625
ARIWTSNTNCRYMDV

SEQ ID NO: 5251 - protein, 9 aa, Homo sapiens
  light chain complementarity determining region 3 for antibody 2626
QQTYSSPWT

SEQ ID NO: 5252 - protein, 15 aa, Homo sapiens
  heavy chain complementarity determining region 3 for antibody 2626
ARIWTISTNCRYMDV

SEQ ID NO: 5253 - protein, 9 aa, Homo sapiens
  light chain complementarity determining region 3 for antibody 2627
QQTYSSPWT

SEQ ID NO: 5254 - protein, 13 aa, Homo sapiens
  heavy chain complementarity determining region 3 for antibody 2627
AKEGSSPGPDFEY

SEQ ID NO: 5255 - protein, 9 aa, Homo sapiens
  light chain complementarity determining region 3 for antibody 2628
QQTYSSPGT

SEQ ID NO: 5256 - protein, 15 aa, Homo sapiens
  heavy chain complementarity determining region 3 for antibody 2628
ARIWTSSTNCRYMDV

SEQ ID NO: 5257 - protein, 9 aa, Homo sapiens
  light chain complementarity determining region 3 for antibody 2629
QQTYRTPYT

SEQ ID NO: 5258 - protein, 14 aa, Homo sapiens
  heavy chain complementarity determining region 3 for antibody 2629
ARLHGSGVGRWLDP

SEQ ID NO: 5259 - protein, 9 aa, Homo sapiens
  light chain complementarity determining region 3 for antibody 2630
QQSYTTPYT

SEQ ID NO: 5260 - protein, 13 aa, Homo sapiens
  heavy chain complementarity determining region 3 for antibody 2630
AKEGSSPGPDFEY

SEQ ID NO: 5261 - protein, 8 aa, Homo sapiens
  light chain complementarity determining region 3 for antibody 2631
QQSYTTPT

SEQ ID NO: 5262 - protein, 15 aa, Homo sapiens
  heavy chain complementarity determining region 3 for antibody 2631
ARVGRPYHNAWYFDN

SEQ ID NO: 5263 - protein, 9 aa, Homo sapiens
  light chain complementarity determining region 3 for antibody 2632
QQSYTMPRT

SEQ ID NO: 5264 - protein, 14 aa, Homo sapiens
  heavy chain complementarity determining region 3 for antibody 2632
ARPRSAKSTYYFDY

SEQ ID NO: 5265 - protein, 9 aa, Homo sapiens
  light chain complementarity determining region 3 for antibody 2633
QQSYTIPRT

SEQ ID NO: 5266 - protein, 18 aa, Homo sapiens
  heavy chain complementarity determining region 3 for antibody 2633
TTVLSQLLAGDWHLYFQH

SEQ ID NO: 5267 - protein, 9 aa, Homo sapiens
  light chain complementarity determining region 3 for antibody 2634
QQSYTIPLT

SEQ ID NO: 5268 - protein, 20 aa, Homo sapiens
  heavy chain complementarity determining region 3 for antibody 2634
ARGREGGKSLPVFDRYFFDS

SEQ ID NO: 5269 - protein, 9 aa, Homo sapiens
  light chain complementarity determining region 3 for antibody 2635
QQSYSTPYT

SEQ ID NO: 5270 - protein, 17 aa, Homo sapiens
  heavy chain complementarity determining region 3 for antibody 2635
ARNTMVGAWQRQGNLDH

SEQ ID NO: 5271 - protein, 9 aa, Homo sapiens
  light chain complementarity determining region 3 for antibody 2636
QQSYSTPST

SEQ ID NO: 5272 - protein, 12 aa, Homo sapiens
  heavy chain complementarity determining region 3 for antibody 2636
ARNFAGGHYSDY

SEQ ID NO: 5273 - protein, 10 aa, Homo sapiens
  light chain complementarity determining region 3 for antibody 2637
QQSYSTPPWT

SEQ ID NO: 5274 - protein, 15 aa, Homo sapiens
  heavy chain complementarity determining region 3 for antibody 2637
ARMFYDYGDSDAFDI

SEQ ID NO: 5275 - protein, 9 aa, Homo sapiens
  light chain complementarity determining region 3 for antibody 2638
QQSYSTPLT

SEQ ID NO: 5276 - protein, 12 aa, Homo sapiens
  heavy chain complementarity determining region 3 for antibody 2638
ARDYSHLAPGGY

SEQ ID NO: 5277 - protein, 10 aa, Homo sapiens
  light chain complementarity determining region 3 for antibody 2639
QQSYSTPLFT

SEQ ID NO: 5278 - protein, 15 aa, Homo sapiens
  heavy chain complementarity determining region 3 for antibody 2639
ARVGRTYHNAWYFDN

SEQ ID NO: 5279 - protein, 10 aa, Homo sapiens
  light chain complementarity determining region 3 for antibody 2640
QQSYSTPLFT

SEQ ID NO: 5280 - protein, 15 aa, Homo sapiens
  heavy chain complementarity determining region 3 for antibody 2640
ARVGRPYHNAWYCDN

SEQ ID NO: 5281 - protein, 9 aa, Homo sapiens
  light chain complementarity determining region 3 for antibody 2641
QQSYSTPET

SEQ ID NO: 5282 - protein, 15 aa, Homo sapiens
  heavy chain complementarity determining region 3 for antibody 2641
ARVPTLDSGTLGFDY

SEQ ID NO: 5283 - protein, 10 aa, Homo sapiens
  light chain complementarity determining region 3 for antibody 2642
QQSYSTLTWT

SEQ ID NO: 5284 - protein, 11 aa, Homo sapiens
  heavy chain complementarity determining region 3 for antibody 2642
AGSSGHYAIDY

SEQ ID NO: 5285 - protein, 9 aa, Homo sapiens
  light chain complementarity determining region 3 for antibody 2643
QQSYSPPLT

SEQ ID NO: 5286 - protein, 18 aa, Homo sapiens
  heavy chain complementarity determining region 3 for antibody 2643
AKVHLQAPLPIPNYYFDY

SEQ ID NO: 5287 - protein, 9 aa, Homo sapiens
  light chain complementarity determining region 3 for antibody 2644
QQSYSMPRT

SEQ ID NO: 5288 - protein, 18 aa, Homo sapiens
  heavy chain complementarity determining region 3 for antibody 2644
TTVLSHLLAGGWHLYFKH

SEQ ID NO: 5289 - protein, 9 aa, Homo sapiens
  light chain complementarity determining region 3 for antibody 2645
QQSKNAPWT

SEQ ID NO: 5290 - protein, 20 aa, Homo sapiens
  heavy chain complementarity determining region 3 for antibody 2645
ARRQASIVSGVSAHYYYMDV

SEQ ID NO: 5291 - protein, 9 aa, Homo sapiens
  light chain complementarity determining region 3 for antibody 2646
QQSINWPRT

SEQ ID NO: 5292 - protein, 13 aa, Homo sapiens
  heavy chain complementarity determining region 3 for antibody 2646
AKEGSAPGPDFEY

SEQ ID NO: 5293 - protein, 9 aa, Homo sapiens
  light chain complementarity determining region 3 for antibody 2647
QQSFSTPLT

SEQ ID NO: 5294 - protein, 21 aa, Homo sapiens
  heavy chain complementarity determining region 3 for antibody 2647
ASGQNFDWLSTTYYYYYGMDV

SEQ ID NO: 5295 - protein, 10 aa, Homo sapiens
  light chain complementarity determining region 3 for antibody 2648
QQRSNWPPYT

SEQ ID NO: 5296 - protein, 12 aa, Homo sapiens
  heavy chain complementarity determining region 3 for antibody 2648
AIVVPGRWDLDD

SEQ ID NO: 5297 - protein, 10 aa, Homo sapiens
  light chain complementarity determining region 3 for antibody 2649
QQRSNWPPIT

SEQ ID NO: 5298 - protein, 11 aa, Homo sapiens
  heavy chain complementarity determining region 3 for antibody 2649
ARDFDGAGYDY

SEQ ID NO: 5299 - protein, 10 aa, Homo sapiens
  light chain complementarity determining region 3 for antibody 2650
QQRSNWPLYT

SEQ ID NO: 5300 - protein, 18 aa, Homo sapiens
  heavy chain complementarity determining region 3 for antibody 2650
AKDTAIRYCSGTSCYIAS

SEQ ID NO: 5301 - protein, 9 aa, Homo sapiens
  light chain complementarity determining region 3 for antibody 2651
QQRSNWPLT

SEQ ID NO: 5302 - protein, 21 aa, Homo sapiens
  heavy chain complementarity determining region 3 for antibody 2651
ARTRGGDHWSGDYIRTNWFDP

SEQ ID NO: 5303 - protein, 9 aa, Homo sapiens
  light chain complementarity determining region 3 for antibody 2652
QQRSNWPLT

SEQ ID NO: 5304 - protein, 20 aa, Homo sapiens
  heavy chain complementarity determining region 3 for antibody 2652
ARGRATATAPAPQWGVAFDV

SEQ ID NO: 5305 - protein, 11 aa, Homo sapiens
  light chain complementarity determining region 3 for antibody 2653
QQRSNWPLALT

SEQ ID NO: 5306 - protein, 15 aa, Homo sapiens
  heavy chain complementarity determining region 3 for antibody 2653
ARDYGDYSGYYGMDV

SEQ ID NO: 5307 - protein, 9 aa, Homo sapiens
  light chain complementarity determining region 3 for antibody 2654
QQRSNWPIT

SEQ ID NO: 5308 - protein, 12 aa, Homo sapiens
  heavy chain complementarity determining region 3 for antibody 2654
NADHGYVDGFDT

SEQ ID NO: 5309 - protein, 10 aa, Homo sapiens
  light chain complementarity determining region 3 for antibody 2655
QQRRSWPPYT

SEQ ID NO: 5310 - protein, 14 aa, Homo sapiens
  heavy chain complementarity determining region 3 for antibody 2655
ANYRASIGANCFDP

SEQ ID NO: 5311 - protein, 9 aa, Homo sapiens
  light chain complementarity determining region 3 for antibody 2656
QQPYRTPYT

SEQ ID NO: 5312 - protein, 14 aa, Homo sapiens
  heavy chain complementarity determining region 3 for antibody 2656
ARLHGSGLGRWLDP

SEQ ID NO: 5313 - protein, 9 aa, Homo sapiens
  light chain complementarity determining region 3 for antibody 2657
QQLNSYPYT

SEQ ID NO: 5314 - protein, 16 aa, Homo sapiens
  heavy chain complementarity determining region 3 for antibody 2657
VRDLAGFTRGGSTFDY

SEQ ID NO: 5315 - protein, 9 aa, Homo sapiens
  light chain complementarity determining region 3 for antibody 2658
QQLNSSPYP

SEQ ID NO: 5316 - protein, 14 aa, Homo sapiens
  heavy chain complementarity determining region 3 for antibody 2658
ARGHFDSTGFRLDY

SEQ ID NO: 5317 - protein, 9 aa, Homo sapiens
  light chain complementarity determining region 3 for antibody 2659
QQLNSSPST

SEQ ID NO: 5318 - protein, 14 aa, Homo sapiens
  heavy chain complementarity determining region 3 for antibody 2659
ARGHFDSTGFRLDY

SEQ ID NO: 5319 - protein, 9 aa, Homo sapiens
  light chain complementarity determining region 3 for antibody 2660
QQLMVYPYT

SEQ ID NO: 5320 - protein, 14 aa, Homo sapiens
  heavy chain complementarity determining region 3 for antibody 2660
ARGHFDSTGFRLDY

SEQ ID NO: 5321 - protein, 9 aa, Homo sapiens
  light chain complementarity determining region 3 for antibody 2661
QQLMVYPYT

SEQ ID NO: 5322 - protein, 10 aa, Homo sapiens
  heavy chain complementarity determining region 3 for antibody 2661
ARDFQWNYDY

SEQ ID NO: 5323 - protein, 9 aa, Homo sapiens
  light chain complementarity determining region 3 for antibody 2662
QQLMRYPYT

SEQ ID NO: 5324 - protein, 14 aa, Homo sapiens
  heavy chain complementarity determining region 3 for antibody 2662
ARGHFDSTGFRLDY

SEQ ID NO: 5325 - protein, 9 aa, Homo sapiens
  light chain complementarity determining region 3 for antibody 2663
QQLMAYPYT

SEQ ID NO: 5326 - protein, 14 aa, Homo sapiens
  heavy chain complementarity determining region 3 for antibody 2663
TRGHFDSTGFRLDY

SEQ ID NO: 5327 - protein, 9 aa, Homo sapiens
  light chain complementarity determining region 3 for antibody 2664
QQIHTYPLT

SEQ ID NO: 5328 - protein, 10 aa, Homo sapiens
  heavy chain complementarity determining region 3 for antibody 2664
GTGGGRGTIV

SEQ ID NO: 5329 - protein, 10 aa, Homo sapiens
  light chain complementarity determining region 3 for antibody 2665
QQHNSYSPRP

SEQ ID NO: 5330 - protein, 15 aa, Homo sapiens
  heavy chain complementarity determining region 3 for antibody 2665
ARVGRPYHNAWYFDN

SEQ ID NO: 5331 - protein, 9 aa, Homo sapiens
  light chain complementarity determining region 3 for antibody 2666
QQFSNIPRT

SEQ ID NO: 5332 - protein, 13 aa, Homo sapiens
  heavy chain complementarity determining region 3 for antibody 2666
AKEGSSPGPDFDS

SEQ ID NO: 5333 - protein, 9 aa, Homo sapiens
  light chain complementarity determining region 3 for antibody 2667
QQFNTYPLT

SEQ ID NO: 5334 - protein, 19 aa, Homo sapiens
  heavy chain complementarity determining region 3 for antibody 2667
AKGLYYYDNGVWNCEYLQH

SEQ ID NO: 5335 - protein, 9 aa, Homo sapiens
  light chain complementarity determining region 3 for antibody 2668
QQFNSYPYT

SEQ ID NO: 5336 - protein, 14 aa, Homo sapiens
  heavy chain complementarity determining region 3 for antibody 2668
ARGHFDSTGFRLDY

SEQ ID NO: 5337 - protein, 9 aa, Homo sapiens
  light chain complementarity determining region 3 for antibody 2669
QQFHNLPRT

SEQ ID NO: 5338 - protein, 9 aa, Homo sapiens
  heavy chain complementarity determining region 3 for antibody 2669
VRGRNNYRY

SEQ ID NO: 5339 - protein, 9 aa, Homo sapiens
  light chain complementarity determining region 3 for antibody 2670
QQDYYTPRA

SEQ ID NO: 5340 - protein, 11 aa, Homo sapiens
  heavy chain complementarity determining region 3 for antibody 2670
ARRSLGGAFDY

SEQ ID NO: 5341 - protein, 9 aa, Homo sapiens
  light chain complementarity determining region 3 for antibody 2671
QQDYSTPRT

SEQ ID NO: 5342 - protein, 11 aa, Homo sapiens
  heavy chain complementarity determining region 3 for antibody 2671
ARRSLGGAFDY

SEQ ID NO: 5343 - protein, 9 aa, Homo sapiens
  light chain complementarity determining region 3 for antibody 2672
QQDGNSPVP

SEQ ID NO: 5344 - protein, 18 aa, Homo sapiens
  heavy chain complementarity determining region 3 for antibody 2672
ARGDYPEARTGYFLDFDY

SEQ ID NO: 5345 - protein, 9 aa, Homo sapiens
  light chain complementarity determining region 3 for antibody 2673
QQCASSPLT

SEQ ID NO: 5346 - protein, 13 aa, Homo sapiens
  heavy chain complementarity determining region 3 for antibody 2673
VGGLYSGTWYGGY

SEQ ID NO: 5347 - protein, 9 aa, Homo sapiens
  light chain complementarity determining region 3 for antibody 2674
QQANSFPLT

SEQ ID NO: 5348 - protein, 18 aa, Homo sapiens
  heavy chain complementarity determining region 3 for antibody 2674
ARGLGIAAGGTIYDGFDV

SEQ ID NO: 5349 - protein, 9 aa, Homo sapiens
  light chain complementarity determining region 3 for antibody 2675
QLSGSSLLT

SEQ ID NO: 5350 - protein, 12 aa, Homo sapiens
  heavy chain complementarity determining region 3 for antibody 2675
ALDEWRPSWYKY

SEQ ID NO: 5351 - protein, 9 aa, Homo sapiens
  light chain complementarity determining region 3 for antibody 2676
QKYYSVPLT

SEQ ID NO: 5352 - protein, 12 aa, Homo sapiens
  heavy chain complementarity determining region 3 for antibody 2676
AIVVPGRWDLDD

SEQ ID NO: 5353 - protein, 9 aa, Homo sapiens
  light chain complementarity determining region 3 for antibody 2677
QKYNSALGT

SEQ ID NO: 5354 - protein, 10 aa, Homo sapiens
  heavy chain complementarity determining region 3 for antibody 2677
VRSDSPGDDS

SEQ ID NO: 5355 - protein, 10 aa, Homo sapiens
  light chain complementarity determining region 3 for antibody 2678
QKYKTAPPLT

SEQ ID NO: 5356 - protein, 12 aa, Homo sapiens
  heavy chain complementarity determining region 3 for antibody 2678
AIVVPGRWDLDD

SEQ ID NO: 5357 - protein, 9 aa, Homo sapiens
  light chain complementarity determining region 3 for antibody 2679
QKYKHVPWT

SEQ ID NO: 5358 - protein, 10 aa, Homo sapiens
  heavy chain complementarity determining region 3 for antibody 2679
ARERSSSYDI

SEQ ID NO: 5359 - protein, 9 aa, Homo sapiens
  light chain complementarity determining region 3 for antibody 2680
QKYGSSPVP

SEQ ID NO: 5360 - protein, 18 aa, Homo sapiens
  heavy chain complementarity determining region 3 for antibody 2680
ARGDYAEARTGYFLDFDY

SEQ ID NO: 5361 - protein, 9 aa, Homo sapiens
  light chain complementarity determining region 3 for antibody 2681
QKHGSSPVP

SEQ ID NO: 5362 - protein, 18 aa, Homo sapiens
  heavy chain complementarity determining region 3 for antibody 2681
ARGDYPEARTGYFLDFDY

SEQ ID NO: 5363 - protein, 9 aa, Homo sapiens
  light chain complementarity determining region 3 for antibody 2682
QHYSVSPIT

SEQ ID NO: 5364 - protein, 8 aa, Homo sapiens
  heavy chain complementarity determining region 3 for antibody 2682
ARRNDFDY

SEQ ID NO: 5365 - protein, 8 aa, Homo sapiens
  light chain complementarity determining region 3 for antibody 2683
QHYSGFPA

SEQ ID NO: 5366 - protein, 15 aa, Homo sapiens
  heavy chain complementarity determining region 3 for antibody 2683
GRHVFSGSHPDFCDY

SEQ ID NO: 5367 - protein, 7 aa, Homo sapiens
  light chain complementarity determining region 3 for antibody 2684
QHYNTWT

SEQ ID NO: 5368 - protein, 12 aa, Homo sapiens
  heavy chain complementarity determining region 3 for antibody 2684
ARDKGGRNGMDV

SEQ ID NO: 5369 - protein, 9 aa, Homo sapiens
  light chain complementarity determining region 3 for antibody 2685
QHYNGYPIT

SEQ ID NO: 5370 - protein, 8 aa, Homo sapiens
  heavy chain complementarity determining region 3 for antibody 2685
TGGRYWDV

SEQ ID NO: 5371 - protein, 9 aa, Homo sapiens
  light chain complementarity determining region 3 for antibody 2686
QHYLTYSWA

SEQ ID NO: 5372 - protein, 19 aa, Homo sapiens
  heavy chain complementarity determining region 3 for antibody 2686
AKESYNSSRYFDRGDYFDD

SEQ ID NO: 5373 - protein, 10 aa, Homo sapiens
  light chain complementarity determining region 3 for antibody 2687
QHYGSSPPVT

SEQ ID NO: 5374 - protein, 18 aa, Homo sapiens
  heavy chain complementarity determining region 3 for antibody 2687
ARGHGYVSSWNSYPDFDY

SEQ ID NO: 5375 - protein, 9 aa, Homo sapiens
  light chain complementarity determining region 3 for antibody 2688
QHNSGVPWT

SEQ ID NO: 5376 - protein, 10 aa, Homo sapiens
  heavy chain complementarity determining region 3 for antibody 2688
ARDLSGILSV

SEQ ID NO: 5377 - protein, 9 aa, Homo sapiens
  light chain complementarity determining region 3 for antibody 2689
QHFYNYLVT

SEQ ID NO: 5378 - protein, 25 aa, Homo sapiens
  heavy chain complementarity determining region 3 for antibody 2689
AREICHTAACYEILWFGQTPYYFDS

SEQ ID NO: 5379 - protein, 9 aa, Homo sapiens
  light chain complementarity determining region 3 for antibody 2690
QEYSTYSRT

SEQ ID NO: 5380 - protein, 15 aa, Homo sapiens
  heavy chain complementarity determining region 3 for antibody 2690
ARDCISINCYLIFDN

SEQ ID NO: 5381 - protein, 9 aa, Homo sapiens
  light chain complementarity determining region 3 for antibody 2691
QEYKTVPGT

SEQ ID NO: 5382 - protein, 20 aa, Homo sapiens
  heavy chain complementarity determining region 3 for antibody 2691
AKDGRGTAFYHGAGGGGLDV

SEQ ID NO: 5383 - protein, 7 aa, Homo sapiens
  light chain complementarity determining region 3 for antibody 2692
QESYSKT

SEQ ID NO: 5384 - protein, 18 aa, Homo sapiens
  heavy chain complementarity determining region 3 for antibody 2692
ARGLGIAAGGTIYDGFDV

SEQ ID NO: 5385 - protein, 7 aa, Homo sapiens
  light chain complementarity determining region 3 for antibody 2693
PQYNTWT

SEQ ID NO: 5386 - protein, 12 aa, Homo sapiens
  heavy chain complementarity determining region 3 for antibody 2693
ARDKGGRNGMDV

SEQ ID NO: 5387 - protein, 9 aa, Homo sapiens
  light chain complementarity determining region 3 for antibody 2694
MQYTHWPHT

SEQ ID NO: 5388 - protein, 8 aa, Homo sapiens
  heavy chain complementarity determining region 3 for antibody 2694
AGWGDANY

SEQ ID NO: 5389 - protein, 9 aa, Homo sapiens
  light chain complementarity determining region 3 for antibody 2695
MQTLQTPWT

SEQ ID NO: 5390 - protein, 12 aa, Homo sapiens
  heavy chain complementarity determining region 3 for antibody 2695
AGLDWNYRAFDI

SEQ ID NO: 5391 - protein, 9 aa, Homo sapiens
  light chain complementarity determining region 3 for antibody 2696
MQTLQTPGT

SEQ ID NO: 5392 - protein, 10 aa, Homo sapiens
  heavy chain complementarity determining region 3 for antibody 2696
CRDREGFGDV

SEQ ID NO: 5393 - protein, 9 aa, Homo sapiens
  light chain complementarity determining region 3 for antibody 2697
MQTLQTPCT

SEQ ID NO: 5394 - protein, 12 aa, Homo sapiens
  heavy chain complementarity determining region 3 for antibody 2697
ARLDWNYRAFDI

SEQ ID NO: 5395 - protein, 9 aa, Homo sapiens
  light chain complementarity determining region 3 for antibody 2698
MQTLQAPWT

SEQ ID NO: 5396 - protein, 12 aa, Homo sapiens
  heavy chain complementarity determining region 3 for antibody 2698
ARLDWNYRAFDI

SEQ ID NO: 5397 - protein, 9 aa, Homo sapiens
  light chain complementarity determining region 3 for antibody 2699
MQGVQSPIT

SEQ ID NO: 5398 - protein, 13 aa, Homo sapiens
  heavy chain complementarity determining region 3 for antibody 2699
AGFCSGDSCFWGY

SEQ ID NO: 5399 - protein, 9 aa, Homo sapiens
  light chain complementarity determining region 3 for antibody 2700
MQGVQSAVT

SEQ ID NO: 5400 - protein, 12 aa, Homo sapiens
  heavy chain complementarity determining region 3 for antibody 2700
ARQGLWMTRQEY

SEQ ID NO: 5401 - protein, 9 aa, Homo sapiens
  light chain complementarity determining region 3 for antibody 2701
MQGTRWPHT

SEQ ID NO: 5402 - protein, 11 aa, Homo sapiens
  heavy chain complementarity determining region 3 for antibody 2701
ATFGQQWRLAH

SEQ ID NO: 5403 - protein, 9 aa, Homo sapiens
  light chain complementarity determining region 3 for antibody 2702
MQGTPWPWT

SEQ ID NO: 5404 - protein, 16 aa, Homo sapiens
  heavy chain complementarity determining region 3 for antibody 2702
ARGHTNPGERRGGSDF

SEQ ID NO: 5405 - protein, 9 aa, Homo sapiens
  light chain complementarity determining region 3 for antibody 2703
MQGTHWPWT

SEQ ID NO: 5406 - protein, 16 aa, Homo sapiens
  heavy chain complementarity determining region 3 for antibody 2703
ARGHTKPGERRGGSDF

SEQ ID NO: 5407 - protein, 9 aa, Homo sapiens
  light chain complementarity determining region 3 for antibody 2704
MQGTHWPWT

SEQ ID NO: 5408 - protein, 13 aa, Homo sapiens
  heavy chain complementarity determining region 3 for antibody 2704
ALEGSDPGPDFVY

SEQ ID NO: 5409 - protein, 9 aa, Homo sapiens
  light chain complementarity determining region 3 for antibody 2705
MQGTHWPLT

SEQ ID NO: 5410 - protein, 10 aa, Homo sapiens
  heavy chain complementarity determining region 3 for antibody 2705
ARGLRALGAY

SEQ ID NO: 5411 - protein, 9 aa, Homo sapiens
  light chain complementarity determining region 3 for antibody 2706
MQGTHWPLN

SEQ ID NO: 5412 - protein, 17 aa, Homo sapiens
  heavy chain complementarity determining region 3 for antibody 2706
ARNTMVGTWQRQGNLDH

SEQ ID NO: 5413 - protein, 9 aa, Homo sapiens
  light chain complementarity determining region 3 for antibody 2707
MQGTHWPHT

SEQ ID NO: 5414 - protein, 11 aa, Homo sapiens
  heavy chain complementarity determining region 3 for antibody 2707
ATLGQQWRLAH

SEQ ID NO: 5415 - protein, 9 aa, Homo sapiens
  light chain complementarity determining region 3 for antibody 2708
MQGSHWPYT

SEQ ID NO: 5416 - protein, 10 aa, Homo sapiens
  heavy chain complementarity determining region 3 for antibody 2708
ARGGGWTCDY

SEQ ID NO: 5417 - protein, 9 aa, Homo sapiens
  light chain complementarity determining region 3 for antibody 2709
MQGIHWPGT

SEQ ID NO: 5418 - protein, 17 aa, Homo sapiens
  heavy chain complementarity determining region 3 for antibody 2709
AKRLPDLLGGGHHYIDV

SEQ ID NO: 5419 - protein, 8 aa, Homo sapiens
  light chain complementarity determining region 3 for antibody 2710
MQGAQWPT

SEQ ID NO: 5420 - protein, 13 aa, Homo sapiens
  heavy chain complementarity determining region 3 for antibody 2710
VRGPYYGSATEDS

SEQ ID NO: 5421 - protein, 9 aa, Homo sapiens
  light chain complementarity determining region 3 for antibody 2711
MQFLQTPLT

SEQ ID NO: 5422 - protein, 10 aa, Homo sapiens
  heavy chain complementarity determining region 3 for antibody 2711
ARERSGSYDT

SEQ ID NO: 5423 - protein, 9 aa, Homo sapiens
  light chain complementarity determining region 3 for antibody 2712
MQFLQTPLN

SEQ ID NO: 5424 - protein, 10 aa, Homo sapiens
  heavy chain complementarity determining region 3 for antibody 2712
ARERSGSYDI

SEQ ID NO: 5425 - protein, 9 aa, Homo sapiens
  light chain complementarity determining region 3 for antibody 2713
MQALQTPIT

SEQ ID NO: 5426 - protein, 19 aa, Homo sapiens
  heavy chain complementarity determining region 3 for antibody 2713
ARERVRCRTGICYDATFDI

SEQ ID NO: 5427 - protein, 9 aa, Homo sapiens
  light chain complementarity determining region 3 for antibody 2714
MQALHIPQT

SEQ ID NO: 5428 - protein, 16 aa, Homo sapiens
  heavy chain complementarity determining region 3 for antibody 2714
ALKWEVLLTVPCAFDI

SEQ ID NO: 5429 - protein, 9 aa, Homo sapiens
  light chain complementarity determining region 3 for antibody 2715
MPGTHWPHT

SEQ ID NO: 5430 - protein, 11 aa, Homo sapiens
  heavy chain complementarity determining region 3 for antibody 2715
ATFGQQWRLAH

SEQ ID NO: 5431 - protein, 9 aa, Homo sapiens
  light chain complementarity determining region 3 for antibody 2716
LQYDSYPWT

SEQ ID NO: 5432 - protein, 12 aa, Homo sapiens
  heavy chain complementarity determining region 3 for antibody 2716
ARLDWNYRAFDI

SEQ ID NO: 5433 - protein, 9 aa, Homo sapiens
  light chain complementarity determining region 3 for antibody 2717
LQYAHWPPT

SEQ ID NO: 5434 - protein, 9 aa, Homo sapiens
  heavy chain complementarity determining region 3 for antibody 2717
AGWGGTSNY

SEQ ID NO: 5435 - protein, 9 aa, Homo sapiens
  light chain complementarity determining region 3 for antibody 2718
LQYAHWPHT

SEQ ID NO: 5436 - protein, 15 aa, Homo sapiens
  heavy chain complementarity determining region 3 for antibody 2718
ARVGRPYRNAWYFDN

SEQ ID NO: 5437 - protein, 9 aa, Homo sapiens
  light chain complementarity determining region 3 for antibody 2719
LQYAHWPHT

SEQ ID NO: 5438 - protein, 15 aa, Homo sapiens
  heavy chain complementarity determining region 3 for antibody 2719
ARVGRPYHNARYFDN

SEQ ID NO: 5439 - protein, 9 aa, Homo sapiens
  light chain complementarity determining region 3 for antibody 2720
LQPNSYPLT

SEQ ID NO: 5440 - protein, 11 aa, Homo sapiens
  heavy chain complementarity determining region 3 for antibody 2720
VRVSTGWNFDY

SEQ ID NO: 5441 - protein, 9 aa, Homo sapiens
  light chain complementarity determining region 3 for antibody 2721
LQHNSYPLT

SEQ ID NO: 5442 - protein, 11 aa, Homo sapiens
  heavy chain complementarity determining region 3 for antibody 2721
VRVSTGWNFDS

SEQ ID NO: 5443 - protein, 9 aa, Homo sapiens
  light chain complementarity determining region 3 for antibody 2722
LQHNSYPLT

SEQ ID NO: 5444 - protein, 11 aa, Homo sapiens
  heavy chain complementarity determining region 3 for antibody 2722
ARVSTGWNFDY

SEQ ID NO: 5445 - protein, 11 aa, Homo sapiens
  light chain complementarity determining region 3 for antibody 2723
LQHDHFPLGLT

SEQ ID NO: 5446 - protein, 19 aa, Homo sapiens
  heavy chain complementarity determining region 3 for antibody 2723
AKDPGALYYGSGTYYGMDV

SEQ ID NO: 5447 - protein, 9 aa, Homo sapiens
  light chain complementarity determining region 3 for antibody 2724
LQHAHWPHT

SEQ ID NO: 5448 - protein, 15 aa, Homo sapiens
  heavy chain complementarity determining region 3 for antibody 2724
ARVGRPYHNAWYFDN

SEQ ID NO: 5449 - protein, 9 aa, Homo sapiens
  light chain complementarity determining region 3 for antibody 2725
LQGTYWPKT

SEQ ID NO: 5450 - protein, 13 aa, Homo sapiens
  heavy chain complementarity determining region 3 for antibody 2725
AKEGPYPGLDLDN

SEQ ID NO: 5451 - protein, 9 aa, Homo sapiens
  light chain complementarity determining region 3 for antibody 2726
LQGLQGPFT

SEQ ID NO: 5452 - protein, 11 aa, Homo sapiens
  heavy chain complementarity determining region 3 for antibody 2726
GRDVDYSTPGF

SEQ ID NO: 5453 - protein, 9 aa, Homo sapiens
  light chain complementarity determining region 3 for antibody 2727
LQDYSYPLS

SEQ ID NO: 5454 - protein, 16 aa, Homo sapiens
  heavy chain complementarity determining region 3 for antibody 2727
AADVGDHRDRYVTLDH

SEQ ID NO: 5455 - protein, 9 aa, Homo sapiens
  light chain complementarity determining region 3 for antibody 2728
LQDYNYPYT

SEQ ID NO: 5456 - protein, 15 aa, Homo sapiens
  heavy chain complementarity determining region 3 for antibody 2728
TTPSYSDTYFNAYDI

SEQ ID NO: 5457 - protein, 9 aa, Homo sapiens
  light chain complementarity determining region 3 for antibody 2729
LQDYNYPLT

SEQ ID NO: 5458 - protein, 10 aa, Homo sapiens
  heavy chain complementarity determining region 3 for antibody 2729
TRGFGWLPDN

SEQ ID NO: 5459 - protein, 9 aa, Homo sapiens
  light chain complementarity determining region 3 for antibody 2730
LQDNSYPFT

SEQ ID NO: 5460 - protein, 15 aa, Homo sapiens
  heavy chain complementarity determining region 3 for antibody 2730
TRDEYPGSPIEAFDI

SEQ ID NO: 5461 - protein, 9 aa, Homo sapiens
  light chain complementarity determining region 3 for antibody 2731
LQDHTYPFT

SEQ ID NO: 5462 - protein, 16 aa, Homo sapiens
  heavy chain complementarity determining region 3 for antibody 2731
ATDLGDHSDAYATLDY

SEQ ID NO: 5463 - protein, 9 aa, Homo sapiens
  light chain complementarity determining region 3 for antibody 2732
LQDHTYPFS

SEQ ID NO: 5464 - protein, 16 aa, Homo sapiens
  heavy chain complementarity determining region 3 for antibody 2732
AADLGDHSDTYAPLDY

SEQ ID NO: 5465 - protein, 10 aa, Homo sapiens
  light chain complementarity determining region 3 for antibody 2733
HQYNSWPPYT

SEQ ID NO: 5466 - protein, 20 aa, Homo sapiens
  heavy chain complementarity determining region 3 for antibody 2733
GTRSPNDGSDYDVFSAAIEI

SEQ ID NO: 5467 - protein, 9 aa, Homo sapiens
  light chain complementarity determining region 3 for antibody 2734
HQTYRTPYT

SEQ ID NO: 5468 - protein, 14 aa, Homo sapiens
  heavy chain complementarity determining region 3 for antibody 2734
ARLHGSGVGRWLDA

SEQ ID NO: 5469 - protein, 9 aa, Homo sapiens
  light chain complementarity determining region 3 for antibody 2735
HQSSSFPQT

SEQ ID NO: 5470 - protein, 23 aa, Homo sapiens
  heavy chain complementarity determining region 3 for antibody 2735
ARDAFIVVVPDAIVGDDLMPFDI

SEQ ID NO: 5471 - protein, 9 aa, Homo sapiens
  light chain complementarity determining region 3 for antibody 2736
HQSAHSPRT

SEQ ID NO: 5472 - protein, 13 aa, Homo sapiens
  heavy chain complementarity determining region 3 for antibody 2736
ARGTTATPWNIDY

SEQ ID NO: 5473 - protein, 9 aa, Homo sapiens
  light chain complementarity determining region 3 for antibody 2737
AQGSYWPAS

SEQ ID NO: 5474 - protein, 10 aa, Homo sapiens
  heavy chain complementarity determining region 3 for antibody 2737
CRDREWFGDV

SEQ ID NO: 5475 - protein, 9 aa, Homo sapiens
  light chain complementarity determining region 3 for antibody 2738
AQGSYWPAS

SEQ ID NO: 5476 - protein, 10 aa, Homo sapiens
  heavy chain complementarity determining region 3 for antibody 2738
CGDREGFGDV

SEQ ID NO: 5477 - protein, 9 aa, Homo sapiens
  light chain complementarity determining region 3 for antibody 2739
AQGSYWPAS

SEQ ID NO: 5478 - protein, 14 aa, Homo sapiens
  heavy chain complementarity determining region 3 for antibody 2739
ARGHFDSTGFRLDY

SEQ ID NO: 5479 - protein, 9 aa, Homo sapiens
  light chain complementarity determining region 3 for antibody 2740
AQGSHWPAS

SEQ ID NO: 5480 - protein, 10 aa, Homo sapiens
  heavy chain complementarity determining region 3 for antibody 2740
CRDREGFGDV

SEQ ID NO: 5481 - protein, 9 aa, Homo sapiens
  light chain complementarity determining region 3 for antibody 2741
VQPLQTSWT

SEQ ID NO: 5482 - protein, 10 aa, Homo sapiens
  heavy chain complementarity determining region 3 for antibody 2741
VGYNWNGPAY

SEQ ID NO: 5483 - protein, 9 aa, Homo sapiens
  light chain complementarity determining region 3 for antibody 2742
QVYGTSRGT

SEQ ID NO: 5484 - protein, 15 aa, Homo sapiens
  heavy chain complementarity determining region 3 for antibody 2742
AKPRSNMCAHDAFDI

SEQ ID NO: 5485 - protein, 9 aa, Homo sapiens
  light chain complementarity determining region 3 for antibody 2743
QRYNSVPWT

SEQ ID NO: 5486 - protein, 20 aa, Homo sapiens
  heavy chain complementarity determining region 3 for antibody 2743
ARDQRSINLWSLAEGGGMDV

SEQ ID NO: 5487 - protein, 10 aa, Homo sapiens
  light chain complementarity determining region 3 for antibody 2744
QRYDISPPWT

SEQ ID NO: 5488 - protein, 16 aa, Homo sapiens
  heavy chain complementarity determining region 3 for antibody 2744
ASPNTLGRLVGVAFDY

SEQ ID NO: 5489 - protein, 9 aa, Homo sapiens
  light chain complementarity determining region 3 for antibody 2745
QRTYSSPWT

SEQ ID NO: 5490 - protein, 15 aa, Homo sapiens
  heavy chain complementarity determining region 3 for antibody 2745
ARIWTSSTNCRYMDV

SEQ ID NO: 5491 - protein, 9 aa, Homo sapiens
  light chain complementarity determining region 3 for antibody 2746
QQYYTPPYT

SEQ ID NO: 5492 - protein, 10 aa, Homo sapiens
  heavy chain complementarity determining region 3 for antibody 2746
TRSMYAYNDI

SEQ ID NO: 5493 - protein, 9 aa, Homo sapiens
  light chain complementarity determining region 3 for antibody 2747
QQYYTAPIT

SEQ ID NO: 5494 - protein, 15 aa, Homo sapiens
  heavy chain complementarity determining region 3 for antibody 2747
VKAVLPTEMSYAIGY

SEQ ID NO: 5495 - protein, 10 aa, Homo sapiens
  light chain complementarity determining region 3 for antibody 2748
QQYYSSPPWG

SEQ ID NO: 5496 - protein, 16 aa, Homo sapiens
  heavy chain complementarity determining region 3 for antibody 2748
ASLNRGDKEFGVPPAL

SEQ ID NO: 5497 - protein, 9 aa, Homo sapiens
  light chain complementarity determining region 3 for antibody 2749
QQYYNIPWT

SEQ ID NO: 5498 - protein, 9 aa, Homo sapiens
  heavy chain complementarity determining region 3 for antibody 2749
TRATWLLDY

SEQ ID NO: 5499 - protein, 9 aa, Homo sapiens
  light chain complementarity determining region 3 for antibody 2750
QQYYGSPLT

SEQ ID NO: 5500 - protein, 15 aa, Homo sapiens
  heavy chain complementarity determining region 3 for antibody 2750
STSIKYGGNSFLCDS

SEQ ID NO: 5501 - protein, 9 aa, Homo sapiens
  light chain complementarity determining region 3 for antibody 2751
QQYYGSPIT

SEQ ID NO: 5502 - protein, 16 aa, Homo sapiens
  heavy chain complementarity determining region 3 for antibody 2751
ARARYCSGGYCFIIEK

SEQ ID NO: 5503 - protein, 9 aa, Homo sapiens
  light chain complementarity determining region 3 for antibody 2752
QQYYDPPLT

SEQ ID NO: 5504 - protein, 21 aa, Homo sapiens
  heavy chain complementarity determining region 3 for antibody 2752
ARGSRTDCRSGDTGCRPMFDS

SEQ ID NO: 5505 - protein, 7 aa, Homo sapiens
  light chain complementarity determining region 3 for antibody 2753
QQYTTWT

SEQ ID NO: 5506 - protein, 12 aa, Homo sapiens
  heavy chain complementarity determining region 3 for antibody 2753
ARDKGGRNGMDV

SEQ ID NO: 5507 - protein, 9 aa, Homo sapiens
  light chain complementarity determining region 3 for antibody 2754
QQYTGYPLT

SEQ ID NO: 5508 - protein, 16 aa, Homo sapiens
  heavy chain complementarity determining region 3 for antibody 2754
ARDLWVAAWYPGALDV

SEQ ID NO: 5509 - protein, 7 aa, Homo sapiens
  light chain complementarity determining region 3 for antibody 2755
QQYNTWT

SEQ ID NO: 5510 - protein, 15 aa, Homo sapiens
  heavy chain complementarity determining region 3 for antibody 2755
ARIWTSSTNCRYMDV

SEQ ID NO: 5511 - protein, 7 aa, Homo sapiens
  light chain complementarity determining region 3 for antibody 2756
QQYNTWT

SEQ ID NO: 5512 - protein, 12 aa, Homo sapiens
  heavy chain complementarity determining region 3 for antibody 2756
ARDKGGRNGMDA

SEQ ID NO: 5513 - protein, 7 aa, Homo sapiens
  light chain complementarity determining region 3 for antibody 2757
QQYNTWT

SEQ ID NO: 5514 - protein, 12 aa, Homo sapiens
  heavy chain complementarity determining region 3 for antibody 2757
ARDKGGRNGLDV

SEQ ID NO: 5515 - protein, 7 aa, Homo sapiens
  light chain complementarity determining region 3 for antibody 2758
QQYNTWT

SEQ ID NO: 5516 - protein, 12 aa, Homo sapiens
  heavy chain complementarity determining region 3 for antibody 2758
ARDKGGLNGMDV

SEQ ID NO: 5517 - protein, 7 aa, Homo sapiens
  light chain complementarity determining region 3 for antibody 2759
QQYNTWT

SEQ ID NO: 5518 - protein, 12 aa, Homo sapiens
  heavy chain complementarity determining region 3 for antibody 2759
AMDKGGRNGMDV

SEQ ID NO: 5519 - protein, 7 aa, Homo sapiens
  light chain complementarity determining region 3 for antibody 2760
QQYNTWS

SEQ ID NO: 5520 - protein, 12 aa, Homo sapiens
  heavy chain complementarity determining region 3 for antibody 2760
ARDKGGRNGMDV

SEQ ID NO: 5521 - protein, 7 aa, Homo sapiens
  light chain complementarity determining region 3 for antibody 2761
QQYNTCT

SEQ ID NO: 5522 - protein, 12 aa, Homo sapiens
  heavy chain complementarity determining region 3 for antibody 2761
ARDKGGRNGMDV

SEQ ID NO: 5523 - protein, 9 aa, Homo sapiens
  light chain complementarity determining region 3 for antibody 2762
QQYNSYSRT

SEQ ID NO: 5524 - protein, 14 aa, Homo sapiens
  heavy chain complementarity determining region 3 for antibody 2762
ATAPGFWSTAPFDY

SEQ ID NO: 5525 - protein, 9 aa, Homo sapiens
  light chain complementarity determining region 3 for antibody 2763
QQYNSYPWT

SEQ ID NO: 5526 - protein, 15 aa, Homo sapiens
  heavy chain complementarity determining region 3 for antibody 2763
GKEGTGSSGWLTGHY

SEQ ID NO: 5527 - protein, 9 aa, Homo sapiens
  light chain complementarity determining region 3 for antibody 2764
QQYNSYPWT

SEQ ID NO: 5528 - protein, 15 aa, Homo sapiens
  heavy chain complementarity determining region 3 for antibody 2764
GKEGPGSSGWLTVHY

SEQ ID NO: 5529 - protein, 9 aa, Homo sapiens
  light chain complementarity determining region 3 for antibody 2765
QQYNSYPWT

SEQ ID NO: 5530 - protein, 15 aa, Homo sapiens
  heavy chain complementarity determining region 3 for antibody 2765
GKEGPGSRGWLTGHY

SEQ ID NO: 5531 - protein, 9 aa, Homo sapiens
  light chain complementarity determining region 3 for antibody 2766
QQYNSYPWT

SEQ ID NO: 5532 - protein, 12 aa, Homo sapiens
  heavy chain complementarity determining region 3 for antibody 2766
ARDKGGRNGMDV

SEQ ID NO: 5533 - protein, 9 aa, Homo sapiens
  light chain complementarity determining region 3 for antibody 2767
QQYNSYLYT

SEQ ID NO: 5534 - protein, 15 aa, Homo sapiens
  heavy chain complementarity determining region 3 for antibody 2767
ATVTCTNGWYNAFDI

SEQ ID NO: 5535 - protein, 9 aa, Homo sapiens
  light chain complementarity determining region 3 for antibody 2768
QQYNNWPRT

SEQ ID NO: 5536 - protein, 11 aa, Homo sapiens
  heavy chain complementarity determining region 3 for antibody 2768
VSAFITTFGVV

SEQ ID NO: 5537 - protein, 9 aa, Homo sapiens
  light chain complementarity determining region 3 for antibody 2769
QQYNNWPRT

SEQ ID NO: 5538 - protein, 11 aa, Homo sapiens
  heavy chain complementarity determining region 3 for antibody 2769
ARVGAVGAFDI

SEQ ID NO: 5539 - protein, 9 aa, Homo sapiens
  light chain complementarity determining region 3 for antibody 2770
QQYNNWPRT

SEQ ID NO: 5540 - protein, 19 aa, Homo sapiens
  heavy chain complementarity determining region 3 for antibody 2770
ARSTYYYNSSGYYYSAFDI

SEQ ID NO: 5541 - protein, 11 aa, Homo sapiens
  light chain complementarity determining region 3 for antibody 2771
QQYNNWPPSST

SEQ ID NO: 5542 - protein, 11 aa, Homo sapiens
  heavy chain complementarity determining region 3 for antibody 2771
ARDFDGAGYDY

SEQ ID NO: 5543 - protein, 10 aa, Homo sapiens
  light chain complementarity determining region 3 for antibody 2772
QQYNFYSPLT

SEQ ID NO: 5544 - protein, 16 aa, Homo sapiens
  heavy chain complementarity determining region 3 for antibody 2772
GRQVVSGSRWPNRLDY

SEQ ID NO: 5545 - protein, 9 aa, Homo sapiens
  light chain complementarity determining region 3 for antibody 2773
QQYKTVPWT

SEQ ID NO: 5546 - protein, 20 aa, Homo sapiens
  heavy chain complementarity determining region 3 for antibody 2773
VKDGRGTADYHSAGGGGMDV

SEQ ID NO: 5547 - protein, 9 aa, Homo sapiens
  light chain complementarity determining region 3 for antibody 2774
QQYKTVPWT

SEQ ID NO: 5548 - protein, 20 aa, Homo sapiens
  heavy chain complementarity determining region 3 for antibody 2774
AKDGRGTEHYHSSGGGGLDV

SEQ ID NO: 5549 - protein, 9 aa, Homo sapiens
  light chain complementarity determining region 3 for antibody 2775
QQYKTVPWT

SEQ ID NO: 5550 - protein, 20 aa, Homo sapiens
  heavy chain complementarity determining region 3 for antibody 2775
AKDGRGTAYYHSAVGGGLDV

SEQ ID NO: 5551 - protein, 9 aa, Homo sapiens
  light chain complementarity determining region 3 for antibody 2776
QQYHSYPLT

SEQ ID NO: 5552 - protein, 16 aa, Homo sapiens
  heavy chain complementarity determining region 3 for antibody 2776
ARTYCSSTSCSKRIDY

SEQ ID NO: 5553 - protein, 9 aa, Homo sapiens
  light chain complementarity determining region 3 for antibody 2777
QQYHSTPWT

SEQ ID NO: 5554 - protein, 11 aa, Homo sapiens
  heavy chain complementarity determining region 3 for antibody 2777
ATGEDNAKTGY

SEQ ID NO: 5555 - protein, 9 aa, Homo sapiens
  light chain complementarity determining region 3 for antibody 2778
QQYHNWPGT

SEQ ID NO: 5556 - protein, 11 aa, Homo sapiens
  heavy chain complementarity determining region 3 for antibody 2778
AKGGCYFLTGD

SEQ ID NO: 5557 - protein, 8 aa, Homo sapiens
  light chain complementarity determining region 3 for antibody 2779
QQYHIYSD

SEQ ID NO: 5558 - protein, 15 aa, Homo sapiens
  heavy chain complementarity determining region 3 for antibody 2779
ARHDGAGAGAGVFDT

SEQ ID NO: 5559 - protein, 9 aa, Homo sapiens
  light chain complementarity determining region 3 for antibody 2780
QQYHGYPWT

SEQ ID NO: 5560 - protein, 15 aa, Homo sapiens
  heavy chain complementarity determining region 3 for antibody 2780
GKEGPGSSGWLTGHY

SEQ ID NO: 5561 - protein, 9 aa, Homo sapiens
  light chain complementarity determining region 3 for antibody 2781
QQYGSSTWT

SEQ ID NO: 5562 - protein, 17 aa, Homo sapiens
  heavy chain complementarity determining region 3 for antibody 2781
AKGRGSVAMALIYYLDV

SEQ ID NO: 5563 - protein, 9 aa, Homo sapiens
  light chain complementarity determining region 3 for antibody 2782
QQYGSSTGT

SEQ ID NO: 5564 - protein, 17 aa, Homo sapiens
  heavy chain complementarity determining region 3 for antibody 2782
AKGRGSVAMALIYYLDL

SEQ ID NO: 5565 - protein, 9 aa, Homo sapiens
  light chain complementarity determining region 3 for antibody 2783
QQYGSSPWT

SEQ ID NO: 5566 - protein, 10 aa, Homo sapiens
  heavy chain complementarity determining region 3 for antibody 2783
AHRINRAFDI

SEQ ID NO: 5567 - protein, 10 aa, Homo sapiens
  light chain complementarity determining region 3 for antibody 2784
QQYGSSPLYT

SEQ ID NO: 5568 - protein, 23 aa, Homo sapiens
  heavy chain complementarity determining region 3 for antibody 2784
ARHFPMGGSTVTGTQSLLYYMDV

SEQ ID NO: 5569 - protein, 9 aa, Homo sapiens
  light chain complementarity determining region 3 for antibody 2785
QQYGSSPLT

SEQ ID NO: 5570 - protein, 13 aa, Homo sapiens
  heavy chain complementarity determining region 3 for antibody 2785
AKDHSSGWYAWGY

SEQ ID NO: 5571 - protein, 9 aa, Homo sapiens
  light chain complementarity determining region 3 for antibody 2786
QQYGSSPIT

SEQ ID NO: 5572 - protein, 14 aa, Homo sapiens
  heavy chain complementarity determining region 3 for antibody 2786
CRGWLDPATPHYDF

SEQ ID NO: 5573 - protein, 9 aa, Homo sapiens
  light chain complementarity determining region 3 for antibody 2787
QQYGSSPIT

SEQ ID NO: 5574 - protein, 11 aa, Homo sapiens
  heavy chain complementarity determining region 3 for antibody 2787
AREGALYAFDF

SEQ ID NO: 5575 - protein, 9 aa, Homo sapiens
  light chain complementarity determining region 3 for antibody 2788
QQYGSSPGT

SEQ ID NO: 5576 - protein, 10 aa, Homo sapiens
  heavy chain complementarity determining region 3 for antibody 2788
ARERSGSYDI

SEQ ID NO: 5577 - protein, 11 aa, Homo sapiens
  light chain complementarity determining region 3 for antibody 2789
QQYGSSPGGYT

SEQ ID NO: 5578 - protein, 10 aa, Homo sapiens
  heavy chain complementarity determining region 3 for antibody 2789
AHRINRAFDI

SEQ ID NO: 5579 - protein, 9 aa, Homo sapiens
  light chain complementarity determining region 3 for antibody 2790
QQYGSSLWT

SEQ ID NO: 5580 - protein, 16 aa, Homo sapiens
  heavy chain complementarity determining region 3 for antibody 2790
ARHDAGQPRSQNWFDP

SEQ ID NO: 5581 - protein, 8 aa, Homo sapiens
  light chain complementarity determining region 3 for antibody 2791
QQYGSSLP

SEQ ID NO: 5582 - protein, 19 aa, Homo sapiens
  heavy chain complementarity determining region 3 for antibody 2791
ARWNGIRSQNNFWTGPFDH

SEQ ID NO: 5583 - protein, 8 aa, Homo sapiens
  light chain complementarity determining region 3 for antibody 2792
QQYGSSHT

SEQ ID NO: 5584 - protein, 15 aa, Homo sapiens
  heavy chain complementarity determining region 3 for antibody 2792
ARGLLATGGWYYFDY

SEQ ID NO: 5585 - protein, 9 aa, Homo sapiens
  light chain complementarity determining region 3 for antibody 2793
QQYGNSRGT

SEQ ID NO: 5586 - protein, 10 aa, Homo sapiens
  heavy chain complementarity determining region 3 for antibody 2793
TTEDWGSGRS

SEQ ID NO: 5587 - protein, 9 aa, Homo sapiens
  light chain complementarity determining region 3 for antibody 2794
QQYGNSPVP

SEQ ID NO: 5588 - protein, 18 aa, Homo sapiens
  heavy chain complementarity determining region 3 for antibody 2794
ARGDCPEARTGYFLDFDY

SEQ ID NO: 5589 - protein, 9 aa, Homo sapiens
  light chain complementarity determining region 3 for antibody 2795
QQYGNSPKT

SEQ ID NO: 5590 - protein, 9 aa, Homo sapiens
  heavy chain complementarity determining region 3 for antibody 2795
TREVNSFDG

SEQ ID NO: 5591 - protein, 9 aa, Homo sapiens
  light chain complementarity determining region 3 for antibody 2796
QQYDSLPLT

SEQ ID NO: 5592 - protein, 18 aa, Homo sapiens
  heavy chain complementarity determining region 3 for antibody 2796
ARAPGDYDMLRRGYYFDH

SEQ ID NO: 5593 - protein, 9 aa, Homo sapiens
  light chain complementarity determining region 3 for antibody 2797
QQYDNWPWT

SEQ ID NO: 5594 - protein, 17 aa, Homo sapiens
  heavy chain complementarity determining region 3 for antibody 2797
VTHYYHDSGIYHDFFSY

SEQ ID NO: 5595 - protein, 10 aa, Homo sapiens
  light chain complementarity determining region 3 for antibody 2798
QQYDNLTSLT

SEQ ID NO: 5596 - protein, 13 aa, Homo sapiens
  heavy chain complementarity determining region 3 for antibody 2798
AKEGSSPGPDFEY

SEQ ID NO: 5597 - protein, 9 aa, Homo sapiens
  light chain complementarity determining region 3 for antibody 2799
QQYDNLPPA

SEQ ID NO: 5598 - protein, 13 aa, Homo sapiens
  heavy chain complementarity determining region 3 for antibody 2799
TKEGSSAGPDFDY

SEQ ID NO: 5599 - protein, 10 aa, Homo sapiens
  light chain complementarity determining region 3 for antibody 2800
QQYDNLASLT

SEQ ID NO: 5600 - protein, 9 aa, Homo sapiens
  heavy chain complementarity determining region 3 for antibody 2800
ARSEYQPTY

SEQ ID NO: 5601 - protein, 9 aa, Homo sapiens
  light chain complementarity determining region 3 for antibody 2801
QQYASSSGT

SEQ ID NO: 5602 - protein, 18 aa, Homo sapiens
  heavy chain complementarity determining region 3 for antibody 2801
AKDRVWGSYRYRYDAFHI

SEQ ID NO: 5603 - protein, 9 aa, Homo sapiens
  light chain complementarity determining region 3 for antibody 2802
QQTYSSPWT

SEQ ID NO: 5604 - protein, 15 aa, Homo sapiens
  heavy chain complementarity determining region 3 for antibody 2802
ARVWTSSTNCRYMDV

SEQ ID NO: 5605 - protein, 9 aa, Homo sapiens
  light chain complementarity determining region 3 for antibody 2803
QQTYSSPWT

SEQ ID NO: 5606 - protein, 15 aa, Homo sapiens
  heavy chain complementarity determining region 3 for antibody 2803
ARIWTSITNCRYMDV

SEQ ID NO: 5607 - protein, 9 aa, Homo sapiens
  light chain complementarity determining region 3 for antibody 2804
QQTYSSPWT

SEQ ID NO: 5608 - protein, 15 aa, Homo sapiens
  heavy chain complementarity determining region 3 for antibody 2804
ARIWPSSPNCRYMDV

SEQ ID NO: 5609 - protein, 9 aa, Homo sapiens
  light chain complementarity determining region 3 for antibody 2805
QQTYRTPYT

SEQ ID NO: 5610 - protein, 14 aa, Homo sapiens
  heavy chain complementarity determining region 3 for antibody 2805
ARLHGSGLGRWLDH

SEQ ID NO: 5611 - protein, 9 aa, Homo sapiens
  light chain complementarity determining region 3 for antibody 2806
QQTYRTPYT

SEQ ID NO: 5612 - protein, 14 aa, Homo sapiens
  heavy chain complementarity determining region 3 for antibody 2806
ARLHGSGLGGWLDP

SEQ ID NO: 5613 - protein, 9 aa, Homo sapiens
  light chain complementarity determining region 3 for antibody 2807
QQTYLVPPT

SEQ ID NO: 5614 - protein, 11 aa, Homo sapiens
  heavy chain complementarity determining region 3 for antibody 2807
TRHQFGVGSEY

SEQ ID NO: 5615 - protein, 10 aa, Homo sapiens
  light chain complementarity determining region 3 for antibody 2808
QQTYKTPPFT

SEQ ID NO: 5616 - protein, 18 aa, Homo sapiens
  heavy chain complementarity determining region 3 for antibody 2808
ARRSFGSGEYWGYTWFDP

SEQ ID NO: 5617 - protein, 9 aa, Homo sapiens
  light chain complementarity determining region 3 for antibody 2809
QQTYISPWT

SEQ ID NO: 5618 - protein, 15 aa, Homo sapiens
  heavy chain complementarity determining region 3 for antibody 2809
ARIWTSSTNCRYMDV

SEQ ID NO: 5619 - protein, 9 aa, Homo sapiens
  light chain complementarity determining region 3 for antibody 2810
QQTHSSPWT

SEQ ID NO: 5620 - protein, 15 aa, Homo sapiens
  heavy chain complementarity determining region 3 for antibody 2810
ARIWTSSTNCRYMDV

SEQ ID NO: 5621 - protein, 8 aa, Homo sapiens
  light chain complementarity determining region 3 for antibody 2811
QQSYTTPT

SEQ ID NO: 5622 - protein, 26 aa, Homo sapiens
  heavy chain complementarity determining region 3 for antibody 2811
ARDFPKGGSYSSDWYGSVGGNYYMDV

SEQ ID NO: 5623 - protein, 9 aa, Homo sapiens
  light chain complementarity determining region 3 for antibody 2812
QQSYTMPRT

SEQ ID NO: 5624 - protein, 18 aa, Homo sapiens
  heavy chain complementarity determining region 3 for antibody 2812
TTVLSQLLAGDWHRYFQH

SEQ ID NO: 5625 - protein, 10 aa, Homo sapiens
  light chain complementarity determining region 3 for antibody 2813
QQSYTHPRWT

SEQ ID NO: 5626 - protein, 11 aa, Homo sapiens
  heavy chain complementarity determining region 3 for antibody 2813
VRVHRVHVSGL

SEQ ID NO: 5627 - protein, 9 aa, Homo sapiens
  light chain complementarity determining region 3 for antibody 2814
QQSYSTPRT

SEQ ID NO: 5628 - protein, 20 aa, Homo sapiens
  heavy chain complementarity determining region 3 for antibody 2814
ARERSLAVAGNGYYYYGMDV

SEQ ID NO: 5629 - protein, 9 aa, Homo sapiens
  light chain complementarity determining region 3 for antibody 2815
QQSYSTPQT

SEQ ID NO: 5630 - protein, 16 aa, Homo sapiens
  heavy chain complementarity determining region 3 for antibody 2815
AKERGYSSGWYGELDY

SEQ ID NO: 5631 - protein, 9 aa, Homo sapiens
  light chain complementarity determining region 3 for antibody 2816
QQSYSTPPT

SEQ ID NO: 5632 - protein, 9 aa, Homo sapiens
  heavy chain complementarity determining region 3 for antibody 2816
ARSEYQPTY

SEQ ID NO: 5633 - protein, 10 aa, Homo sapiens
  light chain complementarity determining region 3 for antibody 2817
QQSYSTPLLT

SEQ ID NO: 5634 - protein, 23 aa, Homo sapiens
  heavy chain complementarity determining region 3 for antibody 2817
ARHFPMGGSTVTGTQSLLYYMDV

SEQ ID NO: 5635 - protein, 10 aa, Homo sapiens
  light chain complementarity determining region 3 for antibody 2818
QQSYSTPLFT

SEQ ID NO: 5636 - protein, 15 aa, Homo sapiens
  heavy chain complementarity determining region 3 for antibody 2818
ARVGRPYRNAWYFDN

SEQ ID NO: 5637 - protein, 10 aa, Homo sapiens
  light chain complementarity determining region 3 for antibody 2819
QQSYSTPLFT

SEQ ID NO: 5638 - protein, 15 aa, Homo sapiens
  heavy chain complementarity determining region 3 for antibody 2819
ARVGRPYHNAWYLDN

SEQ ID NO: 5639 - protein, 10 aa, Homo sapiens
  light chain complementarity determining region 3 for antibody 2820
QQSYSTPLFT

SEQ ID NO: 5640 - protein, 15 aa, Homo sapiens
  heavy chain complementarity determining region 3 for antibody 2820
ARVGRPYHNARYFDN

SEQ ID NO: 5641 - protein, 10 aa, Homo sapiens
  light chain complementarity determining region 3 for antibody 2821
QQSYSTPLFT

SEQ ID NO: 5642 - protein, 22 aa, Homo sapiens
  heavy chain complementarity determining region 3 for antibody 2821
ARIGATTVTTGPYYSYYYNMDV

SEQ ID NO: 5643 - protein, 10 aa, Homo sapiens
  light chain complementarity determining region 3 for antibody 2822
QQSYSTPLFT

SEQ ID NO: 5644 - protein, 23 aa, Homo sapiens
  heavy chain complementarity determining region 3 for antibody 2822
ARHFPMGGSTVTGAQSLLYYMDV

SEQ ID NO: 5645 - protein, 9 aa, Homo sapiens
  light chain complementarity determining region 3 for antibody 2823
QQSYSTPIT

SEQ ID NO: 5646 - protein, 17 aa, Homo sapiens
  heavy chain complementarity determining region 3 for antibody 2823
ARNTMVGAWQRQGNLDH

SEQ ID NO: 5647 - protein, 10 aa, Homo sapiens
  light chain complementarity determining region 3 for antibody 2824
QQSYSTPFFT

SEQ ID NO: 5648 - protein, 23 aa, Homo sapiens
  heavy chain complementarity determining region 3 for antibody 2824
ARHFPMGGSTVTGTQSLLYYMDV

SEQ ID NO: 5649 - protein, 9 aa, Homo sapiens
  light chain complementarity determining region 3 for antibody 2825
QQSYRAPLT

SEQ ID NO: 5650 - protein, 18 aa, Homo sapiens
  heavy chain complementarity determining region 3 for antibody 2825
AKVHLRAPLPTPNYFFDY

SEQ ID NO: 5651 - protein, 9 aa, Homo sapiens
  light chain complementarity determining region 3 for antibody 2826
QQSSTTPLT

SEQ ID NO: 5652 - protein, 16 aa, Homo sapiens
  heavy chain complementarity determining region 3 for antibody 2826
VRDLAGFTRGGSTFDY

SEQ ID NO: 5653 - protein, 9 aa, Homo sapiens
  light chain complementarity determining region 3 for antibody 2827
QQRYSTPST

SEQ ID NO: 5654 - protein, 16 aa, Homo sapiens
  heavy chain complementarity determining region 3 for antibody 2827
ARWFSRSSTGVSYMDV

SEQ ID NO: 5655 - protein, 10 aa, Homo sapiens
  light chain complementarity determining region 3 for antibody 2828
QQRSNWPPYT

SEQ ID NO: 5656 - protein, 12 aa, Homo sapiens
  heavy chain complementarity determining region 3 for antibody 2828
ARRDYGSARSDY

SEQ ID NO: 5657 - protein, 10 aa, Homo sapiens
  light chain complementarity determining region 3 for antibody 2829
QQRSNWPPWT

SEQ ID NO: 5658 - protein, 10 aa, Homo sapiens
  heavy chain complementarity determining region 3 for antibody 2829
ARETSGSYDV

SEQ ID NO: 5659 - protein, 10 aa, Homo sapiens
  light chain complementarity determining region 3 for antibody 2830
QQRSNWPPLT

SEQ ID NO: 5660 - protein, 16 aa, Homo sapiens
  heavy chain complementarity determining region 3 for antibody 2830
TSCYRRILSAYSCHVY

SEQ ID NO: 5661 - protein, 9 aa, Homo sapiens
  light chain complementarity determining region 3 for antibody 2831
QQMYRTPYT

SEQ ID NO: 5662 - protein, 14 aa, Homo sapiens
  heavy chain complementarity determining region 3 for antibody 2831
ARLHGSGLGRWLDP

SEQ ID NO: 5663 - protein, 9 aa, Homo sapiens
  light chain complementarity determining region 3 for antibody 2832
QQLYRYPIT

SEQ ID NO: 5664 - protein, 14 aa, Homo sapiens
  heavy chain complementarity determining region 3 for antibody 2832
GRDTTHDWSDGGSY

SEQ ID NO: 5665 - protein, 9 aa, Homo sapiens
  light chain complementarity determining region 3 for antibody 2833
QQLSNAPLT

SEQ ID NO: 5666 - protein, 17 aa, Homo sapiens
  heavy chain complementarity determining region 3 for antibody 2833
AKRVPDLLGGGHHYIDV

SEQ ID NO: 5667 - protein, 9 aa, Homo sapiens
  light chain complementarity determining region 3 for antibody 2834
QQLSNAPLT

SEQ ID NO: 5668 - protein, 17 aa, Homo sapiens
  heavy chain complementarity determining region 3 for antibody 2834
AKRLPDRLGGGHHYIDV

SEQ ID NO: 5669 - protein, 9 aa, Homo sapiens
  light chain complementarity determining region 3 for antibody 2835
QQLSNAPFT

SEQ ID NO: 5670 - protein, 17 aa, Homo sapiens
  heavy chain complementarity determining region 3 for antibody 2835
AKRLPDLLGGGHHYIDV

SEQ ID NO: 5671 - protein, 9 aa, Homo sapiens
  light chain complementarity determining region 3 for antibody 2836
QQLNTYPLT

SEQ ID NO: 5672 - protein, 13 aa, Homo sapiens
  heavy chain complementarity determining region 3 for antibody 2836
TREGDSSGPDLHL

SEQ ID NO: 5673 - protein, 9 aa, Homo sapiens
  light chain complementarity determining region 3 for antibody 2837
QQLNSYPYT

SEQ ID NO: 5674 - protein, 14 aa, Homo sapiens
  heavy chain complementarity determining region 3 for antibody 2837
ARGHFDSTGLRLDY

SEQ ID NO: 5675 - protein, 9 aa, Homo sapiens
  light chain complementarity determining region 3 for antibody 2838
QQLNSYPLT

SEQ ID NO: 5676 - protein, 19 aa, Homo sapiens
  heavy chain complementarity determining region 3 for antibody 2838
AKGLYYYDSSGWLCEYFQH

SEQ ID NO: 5677 - protein, 9 aa, Homo sapiens
  light chain complementarity determining region 3 for antibody 2839
QQLNSSPYT

SEQ ID NO: 5678 - protein, 14 aa, Homo sapiens
  heavy chain complementarity determining region 3 for antibody 2839
ARGHFDSTGLRLDY

SEQ ID NO: 5679 - protein, 9 aa, Homo sapiens
  light chain complementarity determining region 3 for antibody 2840
QQLMVYPYT

SEQ ID NO: 5680 - protein, 14 aa, Homo sapiens
  heavy chain complementarity determining region 3 for antibody 2840
TRGRFDSTGFRLDY

SEQ ID NO: 5681 - protein, 9 aa, Homo sapiens
  light chain complementarity determining region 3 for antibody 2841
QQLKTYPIT

SEQ ID NO: 5682 - protein, 16 aa, Homo sapiens
  heavy chain complementarity determining region 3 for antibody 2841
AKGHYGSGNPQDAFDI

SEQ ID NO: 5683 - protein, 9 aa, Homo sapiens
  light chain complementarity determining region 3 for antibody 2842
QQLKSYPLT

SEQ ID NO: 5684 - protein, 19 aa, Homo sapiens
  heavy chain complementarity determining region 3 for antibody 2842
AKGLYYYDNSVYNCEYFQH

SEQ ID NO: 5685 - protein, 10 aa, Homo sapiens
  light chain complementarity determining region 3 for antibody 2843
QQHYSSPPWA

SEQ ID NO: 5686 - protein, 16 aa, Homo sapiens
  heavy chain complementarity determining region 3 for antibody 2843
ASLNRGDKEFGVPPAL

SEQ ID NO: 5687 - protein, 9 aa, Homo sapiens
  light chain complementarity determining region 3 for antibody 2844
QQHNSYPWT

SEQ ID NO: 5688 - protein, 15 aa, Homo sapiens
  heavy chain complementarity determining region 3 for antibody 2844
GKEGPGSSGWLTGHY

SEQ ID NO: 5689 - protein, 8 aa, Homo sapiens
  light chain complementarity determining region 3 for antibody 2845
QQHKSYWT

SEQ ID NO: 5690 - protein, 10 aa, Homo sapiens
  heavy chain complementarity determining region 3 for antibody 2845
ARERSGSYDI

SEQ ID NO: 5691 - protein, 9 aa, Homo sapiens
  light chain complementarity determining region 3 for antibody 2846
QQHGESLWT

SEQ ID NO: 5692 - protein, 9 aa, Homo sapiens
  heavy chain complementarity determining region 3 for antibody 2846
ARWNEGMDV

SEQ ID NO: 5693 - protein, 10 aa, Homo sapiens
  light chain complementarity determining region 3 for antibody 2847
QQHDNLASLT

SEQ ID NO: 5694 - protein, 13 aa, Homo sapiens
  heavy chain complementarity determining region 3 for antibody 2847
AKEGSSPGPDFEY

SEQ ID NO: 5695 - protein, 9 aa, Homo sapiens
  light chain complementarity determining region 3 for antibody 2848
QQFYEIPPT

SEQ ID NO: 5696 - protein, 16 aa, Homo sapiens
  heavy chain complementarity determining region 3 for antibody 2848
ARDGRGASSQFNLFDP

SEQ ID NO: 5697 - protein, 9 aa, Homo sapiens
  light chain complementarity determining region 3 for antibody 2849
QQFSNLPRT

SEQ ID NO: 5698 - protein, 16 aa, Homo sapiens
  heavy chain complementarity determining region 3 for antibody 2849
VRDLAGFTRGGSTFDY

SEQ ID NO: 5699 - protein, 9 aa, Homo sapiens
  light chain complementarity determining region 3 for antibody 2850
QQFSNLPRT

SEQ ID NO: 5700 - protein, 13 aa, Homo sapiens
  heavy chain complementarity determining region 3 for antibody 2850
AKEGSSPGPDFDP

SEQ ID NO: 5701 - protein, 9 aa, Homo sapiens
  light chain complementarity determining region 3 for antibody 2851
QQFSNLPRP

SEQ ID NO: 5702 - protein, 13 aa, Homo sapiens
  heavy chain complementarity determining region 3 for antibody 2851
AKEGSSPGPDFDS

SEQ ID NO: 5703 - protein, 9 aa, Homo sapiens
  light chain complementarity determining region 3 for antibody 2852
QQANSLPPT

SEQ ID NO: 5704 - protein, 17 aa, Homo sapiens
  heavy chain complementarity determining region 3 for antibody 2852
ARGTGIGSGSYYADFDY

SEQ ID NO: 5705 - protein, 9 aa, Homo sapiens
  light chain complementarity determining region 3 for antibody 2853
QQANSFPLT

SEQ ID NO: 5706 - protein, 16 aa, Homo sapiens
  heavy chain complementarity determining region 3 for antibody 2853
ARDPDGNGNGWYYFDS

SEQ ID NO: 5707 - protein, 9 aa, Homo sapiens
  light chain complementarity determining region 3 for antibody 2854
QLSGSSPLT

SEQ ID NO: 5708 - protein, 12 aa, Homo sapiens
  heavy chain complementarity determining region 3 for antibody 2854
ALDEWHPSWYKY

SEQ ID NO: 5709 - protein, 9 aa, Homo sapiens
  light chain complementarity determining region 3 for antibody 2855
QLSGSSLLT

SEQ ID NO: 5710 - protein, 12 aa, Homo sapiens
  heavy chain complementarity determining region 3 for antibody 2855
ALGEWHPSWYKY

SEQ ID NO: 5711 - protein, 9 aa, Homo sapiens
  light chain complementarity determining region 3 for antibody 2856
QLSGSSLLT

SEQ ID NO: 5712 - protein, 12 aa, Homo sapiens
  heavy chain complementarity determining region 3 for antibody 2856
ALDEWHSSWYKY

SEQ ID NO: 5713 - protein, 9 aa, Homo sapiens
  light chain complementarity determining region 3 for antibody 2857
QLSGSSLLT

SEQ ID NO: 5714 - protein, 12 aa, Homo sapiens
  heavy chain complementarity determining region 3 for antibody 2857
ALDEWHPSWYEY

SEQ ID NO: 5715 - protein, 9 aa, Homo sapiens
  light chain complementarity determining region 3 for antibody 2858
QLSGSSLLT

SEQ ID NO: 5716 - protein, 12 aa, Homo sapiens
  heavy chain complementarity determining region 3 for antibody 2858
ALDEWHPSWSKY

SEQ ID NO: 5717 - protein, 9 aa, Homo sapiens
  light chain complementarity determining region 3 for antibody 2859
QLSGSSLLT

SEQ ID NO: 5718 - protein, 12 aa, Homo sapiens
  heavy chain complementarity determining region 3 for antibody 2859
ALDEWHPSCYKY

SEQ ID NO: 5719 - protein, 9 aa, Homo sapiens
  light chain complementarity determining region 3 for antibody 2860
QLPGSSLLT

SEQ ID NO: 5720 - protein, 12 aa, Homo sapiens
  heavy chain complementarity determining region 3 for antibody 2860
ALDEWHPSWYKY

SEQ ID NO: 5721 - protein, 9 aa, Homo sapiens
  light chain complementarity determining region 3 for antibody 2861
QKYNSAPFT

SEQ ID NO: 5722 - protein, 13 aa, Homo sapiens
  heavy chain complementarity determining region 3 for antibody 2861
AKEGSSPGPDFEY

SEQ ID NO: 5723 - protein, 9 aa, Homo sapiens
  light chain complementarity determining region 3 for antibody 2862
QKYGSSPVP

SEQ ID NO: 5724 - protein, 18 aa, Homo sapiens
  heavy chain complementarity determining region 3 for antibody 2862
ARGDYPEARTGYFLDLDY

SEQ ID NO: 5725 - protein, 9 aa, Homo sapiens
  light chain complementarity determining region 3 for antibody 2863
QKNGSSPVP

SEQ ID NO: 5726 - protein, 18 aa, Homo sapiens
  heavy chain complementarity determining region 3 for antibody 2863
ARGDYPEARTGYFLDFDY

SEQ ID NO: 5727 - protein, 10 aa, Homo sapiens
  light chain complementarity determining region 3 for antibody 2864
QHYYGGPPYT

SEQ ID NO: 5728 - protein, 14 aa, Homo sapiens
  heavy chain complementarity determining region 3 for antibody 2864
TRGFGRTWFRAFEI

SEQ ID NO: 5729 - protein, 10 aa, Homo sapiens
  light chain complementarity determining region 3 for antibody 2865
QHYGSSPPIT

SEQ ID NO: 5730 - protein, 15 aa, Homo sapiens
  heavy chain complementarity determining region 3 for antibody 2865
VRDSGVRGISGDLDY

SEQ ID NO: 5731 - protein, 11 aa, Homo sapiens
  light chain complementarity determining region 3 for antibody 2866
QHSALSQWLWT

SEQ ID NO: 5732 - protein, 13 aa, Homo sapiens
  heavy chain complementarity determining region 3 for antibody 2866
ARVNRGIFDAFDN

SEQ ID NO: 5733 - protein, 9 aa, Homo sapiens
  light chain complementarity determining region 3 for antibody 2867
QERSTWPGS

SEQ ID NO: 5734 - protein, 13 aa, Homo sapiens
  heavy chain complementarity determining region 3 for antibody 2867
AAGAWGSSWWGDY

SEQ ID NO: 5735 - protein, 9 aa, Homo sapiens
  light chain complementarity determining region 3 for antibody 2868
MQVTHWPRT

SEQ ID NO: 5736 - protein, 13 aa, Homo sapiens
  heavy chain complementarity determining region 3 for antibody 2868
TKEGSSAGPDFVY

SEQ ID NO: 5737 - protein, 9 aa, Homo sapiens
  light chain complementarity determining region 3 for antibody 2869
MQTPQTPWT

SEQ ID NO: 5738 - protein, 12 aa, Homo sapiens
  heavy chain complementarity determining region 3 for antibody 2869
ARLDWNYRAFDI

SEQ ID NO: 5739 - protein, 9 aa, Homo sapiens
  light chain complementarity determining region 3 for antibody 2870
MQTLQTPWT

SEQ ID NO: 5740 - protein, 17 aa, Homo sapiens
  heavy chain complementarity determining region 3 for antibody 2870
SRDGRIEWPGSQGSLDS

SEQ ID NO: 5741 - protein, 9 aa, Homo sapiens
  light chain complementarity determining region 3 for antibody 2871
MQTLQTPWT

SEQ ID NO: 5742 - protein, 12 aa, Homo sapiens
  heavy chain complementarity determining region 3 for antibody 2871
ARLDWNYRTFDI

SEQ ID NO: 5743 - protein, 9 aa, Homo sapiens
  light chain complementarity determining region 3 for antibody 2872
MQTLQTPWT

SEQ ID NO: 5744 - protein, 12 aa, Homo sapiens
  heavy chain complementarity determining region 3 for antibody 2872
ARLDWNYRSFDI

SEQ ID NO: 5745 - protein, 9 aa, Homo sapiens
  light chain complementarity determining region 3 for antibody 2873
MQTLQTPWT

SEQ ID NO: 5746 - protein, 12 aa, Homo sapiens
  heavy chain complementarity determining region 3 for antibody 2873
ARLDGNYRAFDI

SEQ ID NO: 5747 - protein, 9 aa, Homo sapiens
  light chain complementarity determining region 3 for antibody 2874
MQTLQTPWT

SEQ ID NO: 5748 - protein, 12 aa, Homo sapiens
  heavy chain complementarity determining region 3 for antibody 2874
ARLDCNYRAFDI

SEQ ID NO: 5749 - protein, 9 aa, Homo sapiens
  light chain complementarity determining region 3 for antibody 2875
MQTGQTPWT

SEQ ID NO: 5750 - protein, 12 aa, Homo sapiens
  heavy chain complementarity determining region 3 for antibody 2875
ARLDWNYRAFDI

SEQ ID NO: 5751 - protein, 10 aa, Homo sapiens
  light chain complementarity determining region 3 for antibody 2876
MQGTYWPPIT

SEQ ID NO: 5752 - protein, 11 aa, Homo sapiens
  heavy chain complementarity determining region 3 for antibody 2876
TGGEAGNKVNF

SEQ ID NO: 5753 - protein, 9 aa, Homo sapiens
  light chain complementarity determining region 3 for antibody 2877
MQGTHWRHT

SEQ ID NO: 5754 - protein, 11 aa, Homo sapiens
  heavy chain complementarity determining region 3 for antibody 2877
ATFGQQWRLAH

SEQ ID NO: 5755 - protein, 9 aa, Homo sapiens
  light chain complementarity determining region 3 for antibody 2878
MQGTHWPWT

SEQ ID NO: 5756 - protein, 12 aa, Homo sapiens
  heavy chain complementarity determining region 3 for antibody 2878
ASVVPGRWDLDD

SEQ ID NO: 5757 - protein, 9 aa, Homo sapiens
  light chain complementarity determining region 3 for antibody 2879
MQGTHWPIN

SEQ ID NO: 5758 - protein, 12 aa, Homo sapiens
  heavy chain complementarity determining region 3 for antibody 2879
TRDPEGDEDFDY

SEQ ID NO: 5759 - protein, 9 aa, Homo sapiens
  light chain complementarity determining region 3 for antibody 2880
MQGTHWPIN

SEQ ID NO: 5760 - protein, 13 aa, Homo sapiens
  heavy chain complementarity determining region 3 for antibody 2880
AKEGSAAGPDFDY

SEQ ID NO: 5761 - protein, 9 aa, Homo sapiens
  light chain complementarity determining region 3 for antibody 2881
MQGTHWPHT

SEQ ID NO: 5762 - protein, 11 aa, Homo sapiens
  heavy chain complementarity determining region 3 for antibody 2881
ATFGQQWSLAH

SEQ ID NO: 5763 - protein, 9 aa, Homo sapiens
  light chain complementarity determining region 3 for antibody 2882
MQGTHWPHT

SEQ ID NO: 5764 - protein, 11 aa, Homo sapiens
  heavy chain complementarity determining region 3 for antibody 2882
ATFGQQWRLAR

SEQ ID NO: 5765 - protein, 9 aa, Homo sapiens
  light chain complementarity determining region 3 for antibody 2883
MQGTHWPHT

SEQ ID NO: 5766 - protein, 11 aa, Homo sapiens
  heavy chain complementarity determining region 3 for antibody 2883
ATFGQQWRLAL

SEQ ID NO: 5767 - protein, 9 aa, Homo sapiens
  light chain complementarity determining region 3 for antibody 2884
MQGTHWPHT

SEQ ID NO: 5768 - protein, 14 aa, Homo sapiens
  heavy chain complementarity determining region 3 for antibody 2884
ARDTTYNWNDGGIS

SEQ ID NO: 5769 - protein, 8 aa, Homo sapiens
  light chain complementarity determining region 3 for antibody 2885
MQGTHWPA

SEQ ID NO: 5770 - protein, 12 aa, Homo sapiens
  heavy chain complementarity determining region 3 for antibody 2885
AIVVPGRWDFDD

SEQ ID NO: 5771 - protein, 9 aa, Homo sapiens
  light chain complementarity determining region 3 for antibody 2886
MQFLRTPLT

SEQ ID NO: 5772 - protein, 10 aa, Homo sapiens
  heavy chain complementarity determining region 3 for antibody 2886
ARERSGSYDI

SEQ ID NO: 5773 - protein, 9 aa, Homo sapiens
  light chain complementarity determining region 3 for antibody 2887
MQFLQTPLT

SEQ ID NO: 5774 - protein, 10 aa, Homo sapiens
  heavy chain complementarity determining region 3 for antibody 2887
ASERSGSYDI

SEQ ID NO: 5775 - protein, 9 aa, Homo sapiens
  light chain complementarity determining region 3 for antibody 2888
MQFLQTPLT

SEQ ID NO: 5776 - protein, 10 aa, Homo sapiens
  heavy chain complementarity determining region 3 for antibody 2888
ARGRSGSYDI

SEQ ID NO: 5777 - protein, 9 aa, Homo sapiens
  light chain complementarity determining region 3 for antibody 2889
MQFLQTPLT

SEQ ID NO: 5778 - protein, 10 aa, Homo sapiens
  heavy chain complementarity determining region 3 for antibody 2889
ARERSGSDDI

SEQ ID NO: 5779 - protein, 9 aa, Homo sapiens
  light chain complementarity determining region 3 for antibody 2890
MQFLQTPLT

SEQ ID NO: 5780 - protein, 10 aa, Homo sapiens
  heavy chain complementarity determining region 3 for antibody 2890
AREGSGSYDI

SEQ ID NO: 5781 - protein, 9 aa, Homo sapiens
  light chain complementarity determining region 3 for antibody 2891
MQFLQTPLT

SEQ ID NO: 5782 - protein, 13 aa, Homo sapiens
  heavy chain complementarity determining region 3 for antibody 2891
AKEGSSPGPDFEY

SEQ ID NO: 5783 - protein, 9 aa, Homo sapiens
  light chain complementarity determining region 3 for antibody 2892
MQFLQTHLT

SEQ ID NO: 5784 - protein, 10 aa, Homo sapiens
  heavy chain complementarity determining region 3 for antibody 2892
ARERSGSYDI

SEQ ID NO: 5785 - protein, 9 aa, Homo sapiens
  light chain complementarity determining region 3 for antibody 2893
MQFIQTPLT

SEQ ID NO: 5786 - protein, 10 aa, Homo sapiens
  heavy chain complementarity determining region 3 for antibody 2893
ARERSGSYDI

SEQ ID NO: 5787 - protein, 9 aa, Homo sapiens
  light chain complementarity determining region 3 for antibody 2894
MQDTHWPGA

SEQ ID NO: 5788 - protein, 8 aa, Homo sapiens
  heavy chain complementarity determining region 3 for antibody 2894
VRGPSAQY

SEQ ID NO: 5789 - protein, 9 aa, Homo sapiens
  light chain complementarity determining region 3 for antibody 2895
MQATHWPRT

SEQ ID NO: 5790 - protein, 12 aa, Homo sapiens
  heavy chain complementarity determining region 3 for antibody 2895
STDVETTFPAVS

SEQ ID NO: 5791 - protein, 9 aa, Homo sapiens
  light chain complementarity determining region 3 for antibody 2896
MQATHWPRT

SEQ ID NO: 5792 - protein, 12 aa, Homo sapiens
  heavy chain complementarity determining region 3 for antibody 2896
STDVETSFPSVS

SEQ ID NO: 5793 - protein, 9 aa, Homo sapiens
  light chain complementarity determining region 3 for antibody 2897
MQATHWPRP

SEQ ID NO: 5794 - protein, 12 aa, Homo sapiens
  heavy chain complementarity determining region 3 for antibody 2897
STDVETTFPSVS

SEQ ID NO: 5795 - protein, 9 aa, Homo sapiens
  light chain complementarity determining region 3 for antibody 2898
MQASYWPNT

SEQ ID NO: 5796 - protein, 11 aa, Homo sapiens
  heavy chain complementarity determining region 3 for antibody 2898
TRDLYNSGGTD

SEQ ID NO: 5797 - protein, 9 aa, Homo sapiens
  light chain complementarity determining region 3 for antibody 2899
MQASYWPNT

SEQ ID NO: 5798 - protein, 11 aa, Homo sapiens
  heavy chain complementarity determining region 3 for antibody 2899
ARGDGWIGLEY

SEQ ID NO: 5799 - protein, 9 aa, Homo sapiens
  light chain complementarity determining region 3 for antibody 2900
MQALQTPYP

SEQ ID NO: 5800 - protein, 10 aa, Homo sapiens
  heavy chain complementarity determining region 3 for antibody 2900
AKDLSGGGGY

SEQ ID NO: 5801 - protein, 9 aa, Homo sapiens
  light chain complementarity determining region 3 for antibody 2901
MQALQTPWT

SEQ ID NO: 5802 - protein, 20 aa, Homo sapiens
  heavy chain complementarity determining region 3 for antibody 2901
AKAGGQYYYSSGSHSGGMDV

SEQ ID NO: 5803 - protein, 9 aa, Homo sapiens
  light chain complementarity determining region 3 for antibody 2902
MPTLQTPGT

SEQ ID NO: 5804 - protein, 12 aa, Homo sapiens
  heavy chain complementarity determining region 3 for antibody 2902
ARLDWNYRAFDI

SEQ ID NO: 5805 - protein, 9 aa, Homo sapiens
  light chain complementarity determining region 3 for antibody 2903
MHATQWPPT

SEQ ID NO: 5806 - protein, 10 aa, Homo sapiens
  heavy chain complementarity determining region 3 for antibody 2903
VKDFWSNVHY

SEQ ID NO: 5807 - protein, 9 aa, Homo sapiens
  light chain complementarity determining region 3 for antibody 2904
LQYDSYPWT

SEQ ID NO: 5808 - protein, 9 aa, Homo sapiens
  heavy chain complementarity determining region 3 for antibody 2904
ARGHYGLDY

SEQ ID NO: 5809 - protein, 9 aa, Homo sapiens
  light chain complementarity determining region 3 for antibody 2905
LQYANWPHT

SEQ ID NO: 5810 - protein, 15 aa, Homo sapiens
  heavy chain complementarity determining region 3 for antibody 2905
ARVGRPYHNAWYFDN

SEQ ID NO: 5811 - protein, 9 aa, Homo sapiens
  light chain complementarity determining region 3 for antibody 2906
LQRNSYPLT

SEQ ID NO: 5812 - protein, 11 aa, Homo sapiens
  heavy chain complementarity determining region 3 for antibody 2906
VRVSTGWNFDY

SEQ ID NO: 5813 - protein, 9 aa, Homo sapiens
  light chain complementarity determining region 3 for antibody 2907
LQHYTYPLT

SEQ ID NO: 5814 - protein, 9 aa, Homo sapiens
  heavy chain complementarity determining region 3 for antibody 2907
ASTFYYEGY

SEQ ID NO: 5815 - protein, 9 aa, Homo sapiens
  light chain complementarity determining region 3 for antibody 2908
LQHNSYPRT

SEQ ID NO: 5816 - protein, 11 aa, Homo sapiens
  heavy chain complementarity determining region 3 for antibody 2908
VRVSTGWNFDY

SEQ ID NO: 5817 - protein, 9 aa, Homo sapiens
  light chain complementarity determining region 3 for antibody 2909
LQHNSYPLT

SEQ ID NO: 5818 - protein, 11 aa, Homo sapiens
  heavy chain complementarity determining region 3 for antibody 2909
VRVSTGWNSDY

SEQ ID NO: 5819 - protein, 9 aa, Homo sapiens
  light chain complementarity determining region 3 for antibody 2910
LQHNSYPLT

SEQ ID NO: 5820 - protein, 11 aa, Homo sapiens
  heavy chain complementarity determining region 3 for antibody 2910
VRVSTGWHFDY

SEQ ID NO: 5821 - protein, 9 aa, Homo sapiens
  light chain complementarity determining region 3 for antibody 2911
LQHNSYPLT

SEQ ID NO: 5822 - protein, 17 aa, Homo sapiens
  heavy chain complementarity determining region 3 for antibody 2911
ARNTMVGTWQRQGNLDH

SEQ ID NO: 5823 - protein, 9 aa, Homo sapiens
  light chain complementarity determining region 3 for antibody 2912
LQHNSYPLT

SEQ ID NO: 5824 - protein, 14 aa, Homo sapiens
  heavy chain complementarity determining region 3 for antibody 2912
ARGHFDSTGFRLDY

SEQ ID NO: 5825 - protein, 8 aa, Homo sapiens
  light chain complementarity determining region 3 for antibody 2913
LQHNRYLF

SEQ ID NO: 5826 - protein, 10 aa, Homo sapiens
  heavy chain complementarity determining region 3 for antibody 2913
ARQNWADGDY

SEQ ID NO: 5827 - protein, 9 aa, Homo sapiens
  light chain complementarity determining region 3 for antibody 2914
LQHNNYPLS

SEQ ID NO: 5828 - protein, 11 aa, Homo sapiens
  heavy chain complementarity determining region 3 for antibody 2914
VRVSAGWYFDY

SEQ ID NO: 5829 - protein, 9 aa, Homo sapiens
  light chain complementarity determining region 3 for antibody 2915
LQHHSSPHT

SEQ ID NO: 5830 - protein, 7 aa, Homo sapiens
  heavy chain complementarity determining region 3 for antibody 2915
SCRSIDY

SEQ ID NO: 5831 - protein, 9 aa, Homo sapiens
  light chain complementarity determining region 3 for antibody 2916
LQDYNHSAA

SEQ ID NO: 5832 - protein, 12 aa, Homo sapiens
  heavy chain complementarity determining region 3 for antibody 2916
ARGHITGYKGDY

SEQ ID NO: 5833 - protein, 9 aa, Homo sapiens
  light chain complementarity determining region 3 for antibody 2917
LQDYNHFGT

SEQ ID NO: 5834 - protein, 9 aa, Homo sapiens
  heavy chain complementarity determining region 3 for antibody 2917
GSRRPYFDY

SEQ ID NO: 5835 - protein, 9 aa, Homo sapiens
  light chain complementarity determining region 3 for antibody 2918
LQDYKYPFS

SEQ ID NO: 5836 - protein, 16 aa, Homo sapiens
  heavy chain complementarity determining region 3 for antibody 2918
AADLGDHADAYAALDS

SEQ ID NO: 5837 - protein, 9 aa, Homo sapiens
  light chain complementarity determining region 3 for antibody 2919
LQDYGFPRT

SEQ ID NO: 5838 - protein, 19 aa, Homo sapiens
  heavy chain complementarity determining region 3 for antibody 2919
ARELVVPTTDNGNKDAFDI

SEQ ID NO: 5839 - protein, 9 aa, Homo sapiens
  light chain complementarity determining region 3 for antibody 2920
LQDHNYPFS

SEQ ID NO: 5840 - protein, 16 aa, Homo sapiens
  heavy chain complementarity determining region 3 for antibody 2920
AADLDDHTDAYAPLDS

SEQ ID NO: 5841 - protein, 9 aa, Homo sapiens
  light chain complementarity determining region 3 for antibody 2921
LQDHKYPFS

SEQ ID NO: 5842 - protein, 16 aa, Homo sapiens
  heavy chain complementarity determining region 3 for antibody 2921
AADLGDHTDPYATLDS

SEQ ID NO: 5843 - protein, 9 aa, Homo sapiens
  light chain complementarity determining region 3 for antibody 2922
LQDFSYPFS

SEQ ID NO: 5844 - protein, 16 aa, Homo sapiens
  heavy chain complementarity determining region 3 for antibody 2922
VTDVGDHRDSYTTLDY

SEQ ID NO: 5845 - protein, 9 aa, Homo sapiens
  light chain complementarity determining region 3 for antibody 2923
LQDDSYPFT

SEQ ID NO: 5846 - protein, 15 aa, Homo sapiens
  heavy chain complementarity determining region 3 for antibody 2923
TKDEYPGSQIEAFDI

SEQ ID NO: 5847 - protein, 9 aa, Homo sapiens
  light chain complementarity determining region 3 for antibody 2924
IQGTRWPYT

SEQ ID NO: 5848 - protein, 19 aa, Homo sapiens
  heavy chain complementarity determining region 3 for antibody 2924
ARDPYVAHNRTAFYAAFDL

SEQ ID NO: 5849 - protein, 7 aa, Homo sapiens
  light chain complementarity determining region 3 for antibody 2925
HQYNTWT

SEQ ID NO: 5850 - protein, 12 aa, Homo sapiens
  heavy chain complementarity determining region 3 for antibody 2925
ARDKGGRNGMDV

SEQ ID NO: 5851 - protein, 9 aa, Homo sapiens
  light chain complementarity determining region 3 for antibody 2926
HQYGSSPYT

SEQ ID NO: 5852 - protein, 11 aa, Homo sapiens
  heavy chain complementarity determining region 3 for antibody 2926
TRGGYSVGYDY

SEQ ID NO: 5853 - protein, 9 aa, Homo sapiens
  light chain complementarity determining region 3 for antibody 2927
HQYASSPLT

SEQ ID NO: 5854 - protein, 17 aa, Homo sapiens
  heavy chain complementarity determining region 3 for antibody 2927
ARNTMVHGWQRQGSVDH

SEQ ID NO: 5855 - protein, 9 aa, Homo sapiens
  light chain complementarity determining region 3 for antibody 2928
HHFGSPTGT

SEQ ID NO: 5856 - protein, 13 aa, Homo sapiens
  heavy chain complementarity determining region 3 for antibody 2928
AKEGSSPGPDFEY

SEQ ID NO: 5857 - protein, 9 aa, Homo sapiens
  light chain complementarity determining region 3 for antibody 2929
HHFGSATGT

SEQ ID NO: 5858 - protein, 13 aa, Homo sapiens
  heavy chain complementarity determining region 3 for antibody 2929
AKEGASPGPDFEY

SEQ ID NO: 5859 - protein, 11 aa, Homo sapiens
  light chain complementarity determining region 3 for antibody 2930
AQYGSSSGSGT

SEQ ID NO: 5860 - protein, 10 aa, Homo sapiens
  heavy chain complementarity determining region 3 for antibody 2930
ARATYWAHDS

SEQ ID NO: 5861 - protein, 9 aa, Homo sapiens
  light chain complementarity determining region 3 for antibody 2931
AQGSYWPGS

SEQ ID NO: 5862 - protein, 10 aa, Homo sapiens
  heavy chain complementarity determining region 3 for antibody 2931
CRDREGFGDV

SEQ ID NO: 5863 - protein, 9 aa, Homo sapiens
  light chain complementarity determining region 3 for antibody 2932
AQGSYWPAS

SEQ ID NO: 5864 - protein, 10 aa, Homo sapiens
  heavy chain complementarity determining region 3 for antibody 2932
CRDREGLGDV

SEQ ID NO: 5865 - protein, 9 aa, Homo sapiens
  light chain complementarity determining region 3 for antibody 2933
AQGSYWPAS

SEQ ID NO: 5866 - protein, 12 aa, Homo sapiens
  heavy chain complementarity determining region 3 for antibody 2933
ARDKGGRNGMDV

SEQ ID NO: 5867 - protein, 9 aa, Homo sapiens
  light chain complementarity determining region 3 for antibody 2934
AQGSCWPAS

SEQ ID NO: 5868 - protein, 10 aa, Homo sapiens
  heavy chain complementarity determining region 3 for antibody 2934
CRDREGFGDV

SEQ ID NO: 5869 - protein, 9 aa, Homo sapiens
  light chain complementarity determining region 3 for antibody 2935
TQTTHWPGT

SEQ ID NO: 5870 - protein, 11 aa, Homo sapiens
  heavy chain complementarity determining region 3 for antibody 2935
TRDLRGSAAAY

SEQ ID NO: 5871 - protein, 9 aa, Homo sapiens
  light chain complementarity determining region 3 for antibody 2936
TQTLQTPWT

SEQ ID NO: 5872 - protein, 12 aa, Homo sapiens
  heavy chain complementarity determining region 3 for antibody 2936
ARLDWNYRAFDI

SEQ ID NO: 5873 - protein, 9 aa, Homo sapiens
  light chain complementarity determining region 3 for antibody 2937
TQGTHWPHT

SEQ ID NO: 5874 - protein, 11 aa, Homo sapiens
  heavy chain complementarity determining region 3 for antibody 2937
ATFGQQWRLAH

SEQ ID NO: 5875 - protein, 9 aa, Homo sapiens
  light chain complementarity determining region 3 for antibody 2938
RLSGSSLLT

SEQ ID NO: 5876 - protein, 12 aa, Homo sapiens
  heavy chain complementarity determining region 3 for antibody 2938
ALDEWHPSWYKY

SEQ ID NO: 5877 - protein, 9 aa, Homo sapiens
  light chain complementarity determining region 3 for antibody 2939
QTYNSPPFT

SEQ ID NO: 5878 - protein, 15 aa, Homo sapiens
  heavy chain complementarity determining region 3 for antibody 2939
TTATYTNAWYNSFGI

SEQ ID NO: 5879 - protein, 9 aa, Homo sapiens
  light chain complementarity determining region 3 for antibody 2940
QQYYTTPYT

SEQ ID NO: 5880 - protein, 13 aa, Homo sapiens
  heavy chain complementarity determining region 3 for antibody 2940
ARRLTGSYGQFDY

SEQ ID NO: 5881 - protein, 9 aa, Homo sapiens
  light chain complementarity determining region 3 for antibody 2941
QQYYTPPST

SEQ ID NO: 5882 - protein, 10 aa, Homo sapiens
  heavy chain complementarity determining region 3 for antibody 2941
TRSTDAYNDI

SEQ ID NO: 5883 - protein, 9 aa, Homo sapiens
  light chain complementarity determining region 3 for antibody 2942
QQYYSVPYT

SEQ ID NO: 5884 - protein, 10 aa, Homo sapiens
  heavy chain complementarity determining region 3 for antibody 2942
CRDREGFGDV

SEQ ID NO: 5885 - protein, 10 aa, Homo sapiens
  light chain complementarity determining region 3 for antibody 2943
QQYYSSPPWT

SEQ ID NO: 5886 - protein, 14 aa, Homo sapiens
  heavy chain complementarity determining region 3 for antibody 2943
AGTNRGTGVAGTAF

SEQ ID NO: 5887 - protein, 10 aa, Homo sapiens
  light chain complementarity determining region 3 for antibody 2944
QQYYSSPPRA

SEQ ID NO: 5888 - protein, 16 aa, Homo sapiens
  heavy chain complementarity determining region 3 for antibody 2944
ASLNRGDKEFGVPPAL

SEQ ID NO: 5889 - protein, 9 aa, Homo sapiens
  light chain complementarity determining region 3 for antibody 2945
QQYYSSPLT

SEQ ID NO: 5890 - protein, 11 aa, Homo sapiens
  heavy chain complementarity determining region 3 for antibody 2945
VRVSTGWNFDY

SEQ ID NO: 5891 - protein, 10 aa, Homo sapiens
  light chain complementarity determining region 3 for antibody 2946
QQYYSRPPWA

SEQ ID NO: 5892 - protein, 16 aa, Homo sapiens
  heavy chain complementarity determining region 3 for antibody 2946
ASLNRGDKEFGVPPAL

SEQ ID NO: 5893 - protein, 9 aa, Homo sapiens
  light chain complementarity determining region 3 for antibody 2947
QQYYSIPYT

SEQ ID NO: 5894 - protein, 17 aa, Homo sapiens
  heavy chain complementarity determining region 3 for antibody 2947
ARDLPPGVSKRRDAFDI

SEQ ID NO: 5895 - protein, 9 aa, Homo sapiens
  light chain complementarity determining region 3 for antibody 2948
QQYYNAPLT

SEQ ID NO: 5896 - protein, 14 aa, Homo sapiens
  heavy chain complementarity determining region 3 for antibody 2948
ARPTYGSGSFLIEY

SEQ ID NO: 5897 - protein, 9 aa, Homo sapiens
  light chain complementarity determining region 3 for antibody 2949
QQYYGTPIT

SEQ ID NO: 5898 - protein, 10 aa, Homo sapiens
  heavy chain complementarity determining region 3 for antibody 2949
ARDSFSKGDY

SEQ ID NO: 5899 - protein, 9 aa, Homo sapiens
  light chain complementarity determining region 3 for antibody 2950
QQYYGSPLT

SEQ ID NO: 5900 - protein, 14 aa, Homo sapiens
  heavy chain complementarity determining region 3 for antibody 2950
AKPTRGPGSFLIDF

SEQ ID NO: 5901 - protein, 10 aa, Homo sapiens
  light chain complementarity determining region 3 for antibody 2951
QQYVISPPWT

SEQ ID NO: 5902 - protein, 16 aa, Homo sapiens
  heavy chain complementarity determining region 3 for antibody 2951
ASPNTWRDLVGVAFDY

SEQ ID NO: 5903 - protein, 9 aa, Homo sapiens
  light chain complementarity determining region 3 for antibody 2952
QQYNYYPLT

SEQ ID NO: 5904 - protein, 15 aa, Homo sapiens
  heavy chain complementarity determining region 3 for antibody 2952
VRGDYGDYKGVPFDK

SEQ ID NO: 5905 - protein, 7 aa, Homo sapiens
  light chain complementarity determining region 3 for antibody 2953
QQYNTWT

SEQ ID NO: 5906 - protein, 12 aa, Homo sapiens
  heavy chain complementarity determining region 3 for antibody 2953
SRDKNGRNGMDV

SEQ ID NO: 5907 - protein, 7 aa, Homo sapiens
  light chain complementarity determining region 3 for antibody 2954
QQYNTWT

SEQ ID NO: 5908 - protein, 12 aa, Homo sapiens
  heavy chain complementarity determining region 3 for antibody 2954
ARDRGGRNGMDV

SEQ ID NO: 5909 - protein, 7 aa, Homo sapiens
  light chain complementarity determining region 3 for antibody 2955
QQYNTWT

SEQ ID NO: 5910 - protein, 12 aa, Homo sapiens
  heavy chain complementarity determining region 3 for antibody 2955
ARDKGGRNGVDV

SEQ ID NO: 5911 - protein, 7 aa, Homo sapiens
  light chain complementarity determining region 3 for antibody 2956
QQYNTWT

SEQ ID NO: 5912 - protein, 12 aa, Homo sapiens
  heavy chain complementarity determining region 3 for antibody 2956
ARDKGGRKGMDV

SEQ ID NO: 5913 - protein, 7 aa, Homo sapiens
  light chain complementarity determining region 3 for antibody 2957
QQYNTWT

SEQ ID NO: 5914 - protein, 12 aa, Homo sapiens
  heavy chain complementarity determining region 3 for antibody 2957
ARDKGGRDGMDV

SEQ ID NO: 5915 - protein, 7 aa, Homo sapiens
  light chain complementarity determining region 3 for antibody 2958
QQYNTWT

SEQ ID NO: 5916 - protein, 12 aa, Homo sapiens
  heavy chain complementarity determining region 3 for antibody 2958
ARAKGGRNGMDV

SEQ ID NO: 5917 - protein, 7 aa, Homo sapiens
  light chain complementarity determining region 3 for antibody 2959
QQYNTWT

SEQ ID NO: 5918 - protein, 12 aa, Homo sapiens
  heavy chain complementarity determining region 3 for antibody 2959
AKDKGGRNGMDV

SEQ ID NO: 5919 - protein, 9 aa, Homo sapiens
  light chain complementarity determining region 3 for antibody 2960
QQYNTAPWT

SEQ ID NO: 5920 - protein, 20 aa, Homo sapiens
  heavy chain complementarity determining region 3 for antibody 2960
TRDGRGSSYYAYGGGGGLDV

SEQ ID NO: 5921 - protein, 8 aa, Homo sapiens
  light chain complementarity determining region 3 for antibody 2961
QQYNSYYT

SEQ ID NO: 5922 - protein, 13 aa, Homo sapiens
  heavy chain complementarity determining region 3 for antibody 2961
TREGDSSGPDFHL

SEQ ID NO: 5923 - protein, 9 aa, Homo sapiens
  light chain complementarity determining region 3 for antibody 2962
QQYNSYSRT

SEQ ID NO: 5924 - protein, 12 aa, Homo sapiens
  heavy chain complementarity determining region 3 for antibody 2962
ARDFTANYCPDY

SEQ ID NO: 5925 - protein, 9 aa, Homo sapiens
  light chain complementarity determining region 3 for antibody 2963
QQYNSYSLT

SEQ ID NO: 5926 - protein, 12 aa, Homo sapiens
  heavy chain complementarity determining region 3 for antibody 2963
ARDKGGRNGMDV

SEQ ID NO: 5927 - protein, 9 aa, Homo sapiens
  light chain complementarity determining region 3 for antibody 2964
QQYNSYPWT

SEQ ID NO: 5928 - protein, 14 aa, Homo sapiens
  heavy chain complementarity determining region 3 for antibody 2964
VREEGSGYYRTVDY

SEQ ID NO: 5929 - protein, 9 aa, Homo sapiens
  light chain complementarity determining region 3 for antibody 2965
QQYNSYPWT

SEQ ID NO: 5930 - protein, 12 aa, Homo sapiens
  heavy chain complementarity determining region 3 for antibody 2965
VRDISAWGRFDY

SEQ ID NO: 5931 - protein, 9 aa, Homo sapiens
  light chain complementarity determining region 3 for antibody 2966
QQYNSYPWT

SEQ ID NO: 5932 - protein, 15 aa, Homo sapiens
  heavy chain complementarity determining region 3 for antibody 2966
GKEGPGSSGWWTGHY

SEQ ID NO: 5933 - protein, 9 aa, Homo sapiens
  light chain complementarity determining region 3 for antibody 2967
QQYNSYPWT

SEQ ID NO: 5934 - protein, 15 aa, Homo sapiens
  heavy chain complementarity determining region 3 for antibody 2967
GKEGPGSSGWLTGHC

SEQ ID NO: 5935 - protein, 9 aa, Homo sapiens
  light chain complementarity determining region 3 for antibody 2968
QQYNSYPWT

SEQ ID NO: 5936 - protein, 15 aa, Homo sapiens
  heavy chain complementarity determining region 3 for antibody 2968
GEEGPGSSGWLTGHY

SEQ ID NO: 5937 - protein, 9 aa, Homo sapiens
  light chain complementarity determining region 3 for antibody 2969
QQYNSYPPT

SEQ ID NO: 5938 - protein, 13 aa, Homo sapiens
  heavy chain complementarity determining region 3 for antibody 2969
AKEGSAPGPDFEY

SEQ ID NO: 5939 - protein, 9 aa, Homo sapiens
  light chain complementarity determining region 3 for antibody 2970
QQYNSYPLT

SEQ ID NO: 5940 - protein, 16 aa, Homo sapiens
  heavy chain complementarity determining region 3 for antibody 2970
ARPPDGIHYDSDGRDY

SEQ ID NO: 5941 - protein, 9 aa, Homo sapiens
  light chain complementarity determining region 3 for antibody 2971
QQYNSYPCT

SEQ ID NO: 5942 - protein, 15 aa, Homo sapiens
  heavy chain complementarity determining region 3 for antibody 2971
GKEGPGSSGWLTGHY

SEQ ID NO: 5943 - protein, 7 aa, Homo sapiens
  light chain complementarity determining region 3 for antibody 2972
QQYNSWP

SEQ ID NO: 5944 - protein, 12 aa, Homo sapiens
  heavy chain complementarity determining region 3 for antibody 2972
AKDKGGRSGMDV

SEQ ID NO: 5945 - protein, 9 aa, Homo sapiens
  light chain complementarity determining region 3 for antibody 2973
QQYLYPPLT

SEQ ID NO: 5946 - protein, 21 aa, Homo sapiens
  heavy chain complementarity determining region 3 for antibody 2973
ARGSRTDCRRDDTGCRPMFDF

SEQ ID NO: 5947 - protein, 9 aa, Homo sapiens
  light chain complementarity determining region 3 for antibody 2974
QQYLYPPLT

SEQ ID NO: 5948 - protein, 21 aa, Homo sapiens
  heavy chain complementarity determining region 3 for antibody 2974
ARGSRTDCRDGDIGCRPMFDY

SEQ ID NO: 5949 - protein, 8 aa, Homo sapiens
  light chain complementarity determining region 3 for antibody 2975
QQYKSYWT

SEQ ID NO: 5950 - protein, 10 aa, Homo sapiens
  heavy chain complementarity determining region 3 for antibody 2975
ARERSGAYDI

SEQ ID NO: 5951 - protein, 8 aa, Homo sapiens
  light chain complementarity determining region 3 for antibody 2976
QQYKGYWT

SEQ ID NO: 5952 - protein, 10 aa, Homo sapiens
  heavy chain complementarity determining region 3 for antibody 2976
ARERSGSYDI

SEQ ID NO: 5953 - protein, 8 aa, Homo sapiens
  light chain complementarity determining region 3 for antibody 2977
QQYKAWRT

SEQ ID NO: 5954 - protein, 11 aa, Homo sapiens
  heavy chain complementarity determining region 3 for antibody 2977
ARDLYGGAHHT

SEQ ID NO: 5955 - protein, 9 aa, Homo sapiens
  light chain complementarity determining region 3 for antibody 2978
QQYHSSPIT

SEQ ID NO: 5956 - protein, 13 aa, Homo sapiens
  heavy chain complementarity determining region 3 for antibody 2978
ARDSFSLPLETDN

SEQ ID NO: 5957 - protein, 9 aa, Homo sapiens
  light chain complementarity determining region 3 for antibody 2979
QQYHGYPWT

SEQ ID NO: 5958 - protein, 17 aa, Homo sapiens
  heavy chain complementarity determining region 3 for antibody 2979
ARNTMVDGWQRQGSVDH

SEQ ID NO: 5959 - protein, 8 aa, Homo sapiens
  light chain complementarity determining region 3 for antibody 2980
QQYGYSPT

SEQ ID NO: 5960 - protein, 15 aa, Homo sapiens
  heavy chain complementarity determining region 3 for antibody 2980
ARGLLATGGWYYFDY

SEQ ID NO: 5961 - protein, 9 aa, Homo sapiens
  light chain complementarity determining region 3 for antibody 2981
QQYGTIPLT

SEQ ID NO: 5962 - protein, 20 aa, Homo sapiens
  heavy chain complementarity determining region 3 for antibody 2981
ASRFMRSGVVTLNMDDGFDT

SEQ ID NO: 5963 - protein, 7 aa, Homo sapiens
  light chain complementarity determining region 3 for antibody 2982
QQYGSYP

SEQ ID NO: 5964 - protein, 10 aa, Homo sapiens
  heavy chain complementarity determining region 3 for antibody 2982
ARRWERYFDY

SEQ ID NO: 5965 - protein, 9 aa, Homo sapiens
  light chain complementarity determining region 3 for antibody 2983
QQYGSTAWT

SEQ ID NO: 5966 - protein, 17 aa, Homo sapiens
  heavy chain complementarity determining region 3 for antibody 2983
ARNTMVHGWQRQGSVDH

SEQ ID NO: 5967 - protein, 9 aa, Homo sapiens
  light chain complementarity determining region 3 for antibody 2984
QQYGSSTWT

SEQ ID NO: 5968 - protein, 17 aa, Homo sapiens
  heavy chain complementarity determining region 3 for antibody 2984
AKGRGSVAMALIYSLDL

SEQ ID NO: 5969 - protein, 9 aa, Homo sapiens
  light chain complementarity determining region 3 for antibody 2985
QQYGSSPKT

SEQ ID NO: 5970 - protein, 13 aa, Homo sapiens
  heavy chain complementarity determining region 3 for antibody 2985
ASLRRDNSGHFNY

SEQ ID NO: 5971 - protein, 10 aa, Homo sapiens
  light chain complementarity determining region 3 for antibody 2986
QQYGSSPGFA

SEQ ID NO: 5972 - protein, 19 aa, Homo sapiens
  heavy chain complementarity determining region 3 for antibody 2986
VRVPNLRFLEGYYYYGMDV

SEQ ID NO: 5973 - protein, 9 aa, Homo sapiens
  light chain complementarity determining region 3 for antibody 2987
QQYGRSPLT

SEQ ID NO: 5974 - protein, 23 aa, Homo sapiens
  heavy chain complementarity determining region 3 for antibody 2987
ARVGRKARTLRPIQNYYWYYMDV

SEQ ID NO: 5975 - protein, 9 aa, Homo sapiens
  light chain complementarity determining region 3 for antibody 2988
QQYGNSPVP

SEQ ID NO: 5976 - protein, 18 aa, Homo sapiens
  heavy chain complementarity determining region 3 for antibody 2988
ARGDYPEARTGYFLDLDY

SEQ ID NO: 5977 - protein, 9 aa, Homo sapiens
  light chain complementarity determining region 3 for antibody 2989
QQYGNSPRT

SEQ ID NO: 5978 - protein, 15 aa, Homo sapiens
  heavy chain complementarity determining region 3 for antibody 2989
ARDIYTGNYWGYFDS

SEQ ID NO: 5979 - protein, 10 aa, Homo sapiens
  light chain complementarity determining region 3 for antibody 2990
QQYGNSPMWT

SEQ ID NO: 5980 - protein, 14 aa, Homo sapiens
  heavy chain complementarity determining region 3 for antibody 2990
AKLSRIAVAGTWDY

SEQ ID NO: 5981 - protein, 9 aa, Homo sapiens
  light chain complementarity determining region 3 for antibody 2991
QQYGNPVHT

SEQ ID NO: 5982 - protein, 11 aa, Homo sapiens
  heavy chain complementarity determining region 3 for antibody 2991
AAVDSWGTLVY

SEQ ID NO: 5983 - protein, 10 aa, Homo sapiens
  light chain complementarity determining region 3 for antibody 2992
QQYGGSPPFT

SEQ ID NO: 5984 - protein, 14 aa, Homo sapiens
  heavy chain complementarity determining region 3 for antibody 2992
AKTPLITTAWGMDV

SEQ ID NO: 5985 - protein, 11 aa, Homo sapiens
  light chain complementarity determining region 3 for antibody 2993
QQYGGSPPAGT

SEQ ID NO: 5986 - protein, 18 aa, Homo sapiens
  heavy chain complementarity determining region 3 for antibody 2993
AKDNRWYCSTTNCYLFDS

SEQ ID NO: 5987 - protein, 9 aa, Homo sapiens
  light chain complementarity determining region 3 for antibody 2994
QQYGDSPRT

SEQ ID NO: 5988 - protein, 31 aa, Homo sapiens
  heavy chain complementarity determining region 3 for antibody 2994
ARGPDIVATIAFPAYCGGDCYPYYYYYYMDV

SEQ ID NO: 5989 - protein, 10 aa, Homo sapiens
  light chain complementarity determining region 3 for antibody 2995
QQYFSSPPWA

SEQ ID NO: 5990 - protein, 16 aa, Homo sapiens
  heavy chain complementarity determining region 3 for antibody 2995
ASLNRGDKEFGVPPAL

SEQ ID NO: 5991 - protein, 9 aa, Homo sapiens
  light chain complementarity determining region 3 for antibody 2996
QQYDSYPIT

SEQ ID NO: 5992 - protein, 16 aa, Homo sapiens
  heavy chain complementarity determining region 3 for antibody 2996
ASLNRGDKEFGVPPAL

SEQ ID NO: 5993 - protein, 9 aa, Homo sapiens
  light chain complementarity determining region 3 for antibody 2997
QQYDNLQLT

SEQ ID NO: 5994 - protein, 12 aa, Homo sapiens
  heavy chain complementarity determining region 3 for antibody 2997
AIVVPGRWDLDD

SEQ ID NO: 5995 - protein, 9 aa, Homo sapiens
  light chain complementarity determining region 3 for antibody 2998
QQYDNLPYT

SEQ ID NO: 5996 - protein, 13 aa, Homo sapiens
  heavy chain complementarity determining region 3 for antibody 2998
TNEELGGFGAFDI

SEQ ID NO: 5997 - protein, 9 aa, Homo sapiens
  light chain complementarity determining region 3 for antibody 2999
QQYDNLPWT

SEQ ID NO: 5998 - protein, 17 aa, Homo sapiens
  heavy chain complementarity determining region 3 for antibody 2999
ARNTMVGTWQRQGNLDH

SEQ ID NO: 5999 - protein, 10 aa, Homo sapiens
  light chain complementarity determining region 3 for antibody 3000
QQYDNLPPYT

SEQ ID NO: 6000 - protein, 11 aa, Homo sapiens
  heavy chain complementarity determining region 3 for antibody 3000
AGGGAGTKVDS

SEQ ID NO: 6001 - protein, 9 aa, Homo sapiens
  light chain complementarity determining region 3 for antibody 3001
QQYDNLPLT

SEQ ID NO: 6002 - protein, 18 aa, Homo sapiens
  heavy chain complementarity determining region 3 for antibody 3001
ARERQNSGGWYGESFFDY

SEQ ID NO: 6003 - protein, 9 aa, Homo sapiens
  light chain complementarity determining region 3 for antibody 3002
QQYDNLLFT

SEQ ID NO: 6004 - protein, 12 aa, Homo sapiens
  heavy chain complementarity determining region 3 for antibody 3002
ARLDWNYRAFDI

SEQ ID NO: 6005 - protein, 10 aa, Homo sapiens
  light chain complementarity determining region 3 for antibody 3003
QQYDNLDSLT

SEQ ID NO: 6006 - protein, 13 aa, Homo sapiens
  heavy chain complementarity determining region 3 for antibody 3003
AKEGSSPGPDFEY

SEQ ID NO: 6007 - protein, 10 aa, Homo sapiens
  light chain complementarity determining region 3 for antibody 3004
QQYDNLASLT

SEQ ID NO: 6008 - protein, 13 aa, Homo sapiens
  heavy chain complementarity determining region 3 for antibody 3004
AKEGSSPGPDCEY

SEQ ID NO: 6009 - protein, 10 aa, Homo sapiens
  light chain complementarity determining region 3 for antibody 3005
QQYDNLASLT

SEQ ID NO: 6010 - protein, 13 aa, Homo sapiens
  heavy chain complementarity determining region 3 for antibody 3005
AKEGPSPGPDFEY

SEQ ID NO: 6011 - protein, 10 aa, Homo sapiens
  light chain complementarity determining region 3 for antibody 3006
QQYDISPPWT

SEQ ID NO: 6012 - protein, 16 aa, Homo sapiens
  heavy chain complementarity determining region 3 for antibody 3006
ASPNTLGRLVGGAFDY

SEQ ID NO: 6013 - protein, 9 aa, Homo sapiens
  light chain complementarity determining region 3 for antibody 3007
QQYAASPLT

SEQ ID NO: 6014 - protein, 9 aa, Homo sapiens
  heavy chain complementarity determining region 3 for antibody 3007
VRATWLLDY

SEQ ID NO: 6015 - protein, 9 aa, Homo sapiens
  light chain complementarity determining region 3 for antibody 3008
QQTYSSPWT

SEQ ID NO: 6016 - protein, 15 aa, Homo sapiens
  heavy chain complementarity determining region 3 for antibody 3008
ARIWTSSTNCRYMDI

SEQ ID NO: 6017 - protein, 9 aa, Homo sapiens
  light chain complementarity determining region 3 for antibody 3009
QQTYSSPWT

SEQ ID NO: 6018 - protein, 15 aa, Homo sapiens
  heavy chain complementarity determining region 3 for antibody 3009
ARIWISSTNCRYMDV

SEQ ID NO: 6019 - protein, 9 aa, Homo sapiens
  light chain complementarity determining region 3 for antibody 3010
QQTYSSPWA

SEQ ID NO: 6020 - protein, 15 aa, Homo sapiens
  heavy chain complementarity determining region 3 for antibody 3010
ARIWTSSTNCRYMDV

SEQ ID NO: 6021 - protein, 9 aa, Homo sapiens
  light chain complementarity determining region 3 for antibody 3011
QQTYSSPCT

SEQ ID NO: 6022 - protein, 15 aa, Homo sapiens
  heavy chain complementarity determining region 3 for antibody 3011
ARIWTSSTNCRYMDV

SEQ ID NO: 6023 - protein, 9 aa, Homo sapiens
  light chain complementarity determining region 3 for antibody 3012
QQTYSFPRS

SEQ ID NO: 6024 - protein, 15 aa, Homo sapiens
  heavy chain complementarity determining region 3 for antibody 3012
AREKGKQHLSWYFDL

SEQ ID NO: 6025 - protein, 9 aa, Homo sapiens
  light chain complementarity determining region 3 for antibody 3013
QQTYGSPWT

SEQ ID NO: 6026 - protein, 15 aa, Homo sapiens
  heavy chain complementarity determining region 3 for antibody 3013
ARIWTSSTNCRYMDV

SEQ ID NO: 6027 - protein, 10 aa, Homo sapiens
  light chain complementarity determining region 3 for antibody 3014
QQTYATARPT

SEQ ID NO: 6028 - protein, 17 aa, Homo sapiens
  heavy chain complementarity determining region 3 for antibody 3014
ARNTMVGTWQRQGNLDH

SEQ ID NO: 6029 - protein, 9 aa, Homo sapiens
  light chain complementarity determining region 3 for antibody 3015
QQSYYTPRT

SEQ ID NO: 6030 - protein, 8 aa, Homo sapiens
  heavy chain complementarity determining region 3 for antibody 3015
ARDLIISS

SEQ ID NO: 6031 - protein, 9 aa, Homo sapiens
  light chain complementarity determining region 3 for antibody 3016
QQSYTMPRT

SEQ ID NO: 6032 - protein, 18 aa, Homo sapiens
  heavy chain complementarity determining region 3 for antibody 3016
TTVLSQLLAGDWHLYVQH

SEQ ID NO: 6033 - protein, 9 aa, Homo sapiens
  light chain complementarity determining region 3 for antibody 3017
QQSYTIPRT

SEQ ID NO: 6034 - protein, 18 aa, Homo sapiens
  heavy chain complementarity determining region 3 for antibody 3017
TTVLSHLLAGDWHLYFQH

SEQ ID NO: 6035 - protein, 10 aa, Homo sapiens
  light chain complementarity determining region 3 for antibody 3018
QQSYSTPLFT

SEQ ID NO: 6036 - protein, 23 aa, Homo sapiens
  heavy chain complementarity determining region 3 for antibody 3018
ARHLPMGGSTVTGTQSLLYYMDV

SEQ ID NO: 6037 - protein, 10 aa, Homo sapiens
  light chain complementarity determining region 3 for antibody 3019
QQSYSTPLFT

SEQ ID NO: 6038 - protein, 23 aa, Homo sapiens
  heavy chain complementarity determining region 3 for antibody 3019
ARHFPMGGATVTGTQSLLYYMDV

SEQ ID NO: 6039 - protein, 10 aa, Homo sapiens
  light chain complementarity determining region 3 for antibody 3020
QQSYSTLPLT

SEQ ID NO: 6040 - protein, 12 aa, Homo sapiens
  heavy chain complementarity determining region 3 for antibody 3020
AIVVPGRWDLDD

SEQ ID NO: 6041 - protein, 9 aa, Homo sapiens
  light chain complementarity determining region 3 for antibody 3021
QQSYSTLCT

SEQ ID NO: 6042 - protein, 18 aa, Homo sapiens
  heavy chain complementarity determining region 3 for antibody 3021
ARGDYPEARTGYFLDFDY

SEQ ID NO: 6043 - protein, 10 aa, Homo sapiens
  light chain complementarity determining region 3 for antibody 3022
QQSYSSPPWA

SEQ ID NO: 6044 - protein, 16 aa, Homo sapiens
  heavy chain complementarity determining region 3 for antibody 3022
ASLNRGDKEFGVPPAL

SEQ ID NO: 6045 - protein, 10 aa, Homo sapiens
  light chain complementarity determining region 3 for antibody 3023
QQSYRTPLFT

SEQ ID NO: 6046 - protein, 23 aa, Homo sapiens
  heavy chain complementarity determining region 3 for antibody 3023
ARHFPMGGSTVTGTQSLLYYMDV

SEQ ID NO: 6047 - protein, 9 aa, Homo sapiens
  light chain complementarity determining region 3 for antibody 3024
QQSHNFPLT

SEQ ID NO: 6048 - protein, 15 aa, Homo sapiens
  heavy chain complementarity determining region 3 for antibody 3024
STQEAPGHDSIVFDY

SEQ ID NO: 6049 - protein, 9 aa, Homo sapiens
  light chain complementarity determining region 3 for antibody 3025
QQRYSTPRT

SEQ ID NO: 6050 - protein, 11 aa, Homo sapiens
  heavy chain complementarity determining region 3 for antibody 3025
AREQHGQAPDY

SEQ ID NO: 6051 - protein, 11 aa, Homo sapiens
  light chain complementarity determining region 3 for antibody 3026
QQRSNWPREVT

SEQ ID NO: 6052 - protein, 20 aa, Homo sapiens
  heavy chain complementarity determining region 3 for antibody 3026
VRDKGYSYGKVPYSYYGMDV

SEQ ID NO: 6053 - protein, 10 aa, Homo sapiens
  light chain complementarity determining region 3 for antibody 3027
QQRSNWPPRT

SEQ ID NO: 6054 - protein, 13 aa, Homo sapiens
  heavy chain complementarity determining region 3 for antibody 3027
AKEGSSPGPDFDY

SEQ ID NO: 6055 - protein, 9 aa, Homo sapiens
  light chain complementarity determining region 3 for antibody 3028
QQRSNWPLT

SEQ ID NO: 6056 - protein, 10 aa, Homo sapiens
  heavy chain complementarity determining region 3 for antibody 3028
AHRINRAFDI

SEQ ID NO: 6057 - protein, 9 aa, Homo sapiens
  light chain complementarity determining region 3 for antibody 3029
QQRGYWPPT

SEQ ID NO: 6058 - protein, 13 aa, Homo sapiens
  heavy chain complementarity determining region 3 for antibody 3029
AKEGSAPGPDFEY

SEQ ID NO: 6059 - protein, 9 aa, Homo sapiens
  light chain complementarity determining region 3 for antibody 3030
QQLYSYPIT

SEQ ID NO: 6060 - protein, 14 aa, Homo sapiens
  heavy chain complementarity determining region 3 for antibody 3030
GRDTTHDWSDGGIY

SEQ ID NO: 6061 - protein, 9 aa, Homo sapiens
  light chain complementarity determining region 3 for antibody 3031
QQLYRYPIT

SEQ ID NO: 6062 - protein, 14 aa, Homo sapiens
  heavy chain complementarity determining region 3 for antibody 3031
GIDTTHDWSDGGIY

SEQ ID NO: 6063 - protein, 9 aa, Homo sapiens
  light chain complementarity determining region 3 for antibody 3032
QQLYNYPIT

SEQ ID NO: 6064 - protein, 14 aa, Homo sapiens
  heavy chain complementarity determining region 3 for antibody 3032
ARDTAYNWNDGGIS

SEQ ID NO: 6065 - protein, 9 aa, Homo sapiens
  light chain complementarity determining region 3 for antibody 3033
QQLSNAPLT

SEQ ID NO: 6066 - protein, 14 aa, Homo sapiens
  heavy chain complementarity determining region 3 for antibody 3033
ARGHFDSTGFRLDY

SEQ ID NO: 6067 - protein, 9 aa, Homo sapiens
  light chain complementarity determining region 3 for antibody 3034
QQLNSYPYT

SEQ ID NO: 6068 - protein, 10 aa, Homo sapiens
  heavy chain complementarity determining region 3 for antibody 3034
CRDREGFGDV

SEQ ID NO: 6069 - protein, 9 aa, Homo sapiens
  light chain complementarity determining region 3 for antibody 3035
QQLNSYPYT

SEQ ID NO: 6070 - protein, 10 aa, Homo sapiens
  heavy chain complementarity determining region 3 for antibody 3035
ARGTSGAYDI

SEQ ID NO: 6071 - protein, 9 aa, Homo sapiens
  light chain complementarity determining region 3 for antibody 3036
QQLNSYPYT

SEQ ID NO: 6072 - protein, 14 aa, Homo sapiens
  heavy chain complementarity determining region 3 for antibody 3036
ARGHFDSTGFRLDS

SEQ ID NO: 6073 - protein, 9 aa, Homo sapiens
  light chain complementarity determining region 3 for antibody 3037
QQLNSYPYT

SEQ ID NO: 6074 - protein, 14 aa, Homo sapiens
  heavy chain complementarity determining region 3 for antibody 3037
ARGHFDSTCFRLDY

SEQ ID NO: 6075 - protein, 10 aa, Homo sapiens
  light chain complementarity determining region 3 for antibody 3038
QQLNNWPPLP

SEQ ID NO: 6076 - protein, 15 aa, Homo sapiens
  heavy chain complementarity determining region 3 for antibody 3038
ACPNGRYNHPHYFDY

SEQ ID NO: 6077 - protein, 9 aa, Homo sapiens
  light chain complementarity determining region 3 for antibody 3039
QQIHTFPLA

SEQ ID NO: 6078 - protein, 11 aa, Homo sapiens
  heavy chain complementarity determining region 3 for antibody 3039
ARHPPYSPFDH

SEQ ID NO: 6079 - protein, 9 aa, Homo sapiens
  light chain complementarity determining region 3 for antibody 3040
QQHYSIPFT

SEQ ID NO: 6080 - protein, 10 aa, Homo sapiens
  heavy chain complementarity determining region 3 for antibody 3040
CRDREGFGDV

SEQ ID NO: 6081 - protein, 9 aa, Homo sapiens
  light chain complementarity determining region 3 for antibody 3041
QQHNSYSRT

SEQ ID NO: 6082 - protein, 16 aa, Homo sapiens
  heavy chain complementarity determining region 3 for antibody 3041
VGPHLTYNSGWRYFDY

SEQ ID NO: 6083 - protein, 9 aa, Homo sapiens
  light chain complementarity determining region 3 for antibody 3042
QQFSSFPRP

SEQ ID NO: 6084 - protein, 9 aa, Homo sapiens
  heavy chain complementarity determining region 3 for antibody 3042
ARGRNNFRY

SEQ ID NO: 6085 - protein, 9 aa, Homo sapiens
  light chain complementarity determining region 3 for antibody 3043
QQFSNLSRT

SEQ ID NO: 6086 - protein, 13 aa, Homo sapiens
  heavy chain complementarity determining region 3 for antibody 3043
AKEGSSPGPDFDS

SEQ ID NO: 6087 - protein, 9 aa, Homo sapiens
  light chain complementarity determining region 3 for antibody 3044
QQFSNLPRT

SEQ ID NO: 6088 - protein, 13 aa, Homo sapiens
  heavy chain complementarity determining region 3 for antibody 3044
AKEVSSPGPDFDS

SEQ ID NO: 6089 - protein, 9 aa, Homo sapiens
  light chain complementarity determining region 3 for antibody 3045
QQFSNLPRT

SEQ ID NO: 6090 - protein, 13 aa, Homo sapiens
  heavy chain complementarity determining region 3 for antibody 3045
AKEGSSPGPDFGS

SEQ ID NO: 6091 - protein, 9 aa, Homo sapiens
  light chain complementarity determining region 3 for antibody 3046
QQFSNLPRT

SEQ ID NO: 6092 - protein, 13 aa, Homo sapiens
  heavy chain complementarity determining region 3 for antibody 3046
AKEGSSPGHDFDS

SEQ ID NO: 6093 - protein, 9 aa, Homo sapiens
  light chain complementarity determining region 3 for antibody 3047
QQFSNHPRT

SEQ ID NO: 6094 - protein, 13 aa, Homo sapiens
  heavy chain complementarity determining region 3 for antibody 3047
AKEGSSPGPDFDS

SEQ ID NO: 6095 - protein, 9 aa, Homo sapiens
  light chain complementarity determining region 3 for antibody 3048
QQFSNFPRT

SEQ ID NO: 6096 - protein, 9 aa, Homo sapiens
  heavy chain complementarity determining region 3 for antibody 3048
ARGRNNFRY

SEQ ID NO: 6097 - protein, 9 aa, Homo sapiens
  light chain complementarity determining region 3 for antibody 3049
QQFSDFPRP

SEQ ID NO: 6098 - protein, 9 aa, Homo sapiens
  heavy chain complementarity determining region 3 for antibody 3049
VRGRNNFRY

SEQ ID NO: 6099 - protein, 9 aa, Homo sapiens
  light chain complementarity determining region 3 for antibody 3050
QQFHNLPRT

SEQ ID NO: 6100 - protein, 9 aa, Homo sapiens
  heavy chain complementarity determining region 3 for antibody 3050
ARGRNNYRY

SEQ ID NO: 6101 - protein, 9 aa, Homo sapiens
  light chain complementarity determining region 3 for antibody 3051
QQDYYTPRT

SEQ ID NO: 6102 - protein, 11 aa, Homo sapiens
  heavy chain complementarity determining region 3 for antibody 3051
ARRSRGGAFDY

SEQ ID NO: 6103 - protein, 9 aa, Homo sapiens
  light chain complementarity determining region 3 for antibody 3052
QQDYSTPRT

SEQ ID NO: 6104 - protein, 11 aa, Homo sapiens
  heavy chain complementarity determining region 3 for antibody 3052
ARRAVGGAFDY

SEQ ID NO: 6105 - protein, 9 aa, Homo sapiens
  light chain complementarity determining region 3 for antibody 3053
QQDSYTPRT

SEQ ID NO: 6106 - protein, 11 aa, Homo sapiens
  heavy chain complementarity determining region 3 for antibody 3053
ARRSLGGAFDY

SEQ ID NO: 6107 - protein, 9 aa, Homo sapiens
  light chain complementarity determining region 3 for antibody 3054
QQCYNLPYT

SEQ ID NO: 6108 - protein, 21 aa, Homo sapiens
  heavy chain complementarity determining region 3 for antibody 3054
ARHPRHFSRYQTRASYNWFDP

SEQ ID NO: 6109 - protein, 7 aa, Homo sapiens
  light chain complementarity determining region 3 for antibody 3055
QQCNTWT

SEQ ID NO: 6110 - protein, 12 aa, Homo sapiens
  heavy chain complementarity determining region 3 for antibody 3055
ARDKGGRNGMDV

SEQ ID NO: 6111 - protein, 9 aa, Homo sapiens
  light chain complementarity determining region 3 for antibody 3056
QQCARSPLT

SEQ ID NO: 6112 - protein, 10 aa, Homo sapiens
  heavy chain complementarity determining region 3 for antibody 3056
AGGIGWTEQY

SEQ ID NO: 6113 - protein, 9 aa, Homo sapiens
  light chain complementarity determining region 3 for antibody 3057
QQANSFPYT

SEQ ID NO: 6114 - protein, 15 aa, Homo sapiens
  heavy chain complementarity determining region 3 for antibody 3057
ARGGGSATGWPGIDY

SEQ ID NO: 6115 - protein, 10 aa, Homo sapiens
  light chain complementarity determining region 3 for antibody 3058
QQANSFPALT

SEQ ID NO: 6116 - protein, 12 aa, Homo sapiens
  heavy chain complementarity determining region 3 for antibody 3058
ARYSGRYLSIDY

SEQ ID NO: 6117 - protein, 9 aa, Homo sapiens
  light chain complementarity determining region 3 for antibody 3059
QQANRMPRT

SEQ ID NO: 6118 - protein, 12 aa, Homo sapiens
  heavy chain complementarity determining region 3 for antibody 3059
ASSRSGGGSVDY

SEQ ID NO: 6119 - protein, 9 aa, Homo sapiens
  light chain complementarity determining region 3 for antibody 3060
QKYNTAPWT

SEQ ID NO: 6120 - protein, 17 aa, Homo sapiens
  heavy chain complementarity determining region 3 for antibody 3060
TRDRPDSTWTSANRRDF

SEQ ID NO: 6121 - protein, 9 aa, Homo sapiens
  light chain complementarity determining region 3 for antibody 3061
QKYGSSPVP

SEQ ID NO: 6122 - protein, 18 aa, Homo sapiens
  heavy chain complementarity determining region 3 for antibody 3061
ARGDYPEARTGYFLDFDD

SEQ ID NO: 6123 - protein, 9 aa, Homo sapiens
  light chain complementarity determining region 3 for antibody 3062
QKYGSSPVP

SEQ ID NO: 6124 - protein, 18 aa, Homo sapiens
  heavy chain complementarity determining region 3 for antibody 3062
ARGDSPEARTGYFLDFDY

SEQ ID NO: 6125 - protein, 9 aa, Homo sapiens
  light chain complementarity determining region 3 for antibody 3063
QKDGSAPVP

SEQ ID NO: 6126 - protein, 18 aa, Homo sapiens
  heavy chain complementarity determining region 3 for antibody 3063
ARGDYPEARTGYFLDFDY

SEQ ID NO: 6127 - protein, 9 aa, Homo sapiens
  light chain complementarity determining region 3 for antibody 3064
QHYYSSPFT

SEQ ID NO: 6128 - protein, 14 aa, Homo sapiens
  heavy chain complementarity determining region 3 for antibody 3064
AASYSSGWLEYFQY

SEQ ID NO: 6129 - protein, 9 aa, Homo sapiens
  light chain complementarity determining region 3 for antibody 3065
QHYGSFPLT

SEQ ID NO: 6130 - protein, 7 aa, Homo sapiens
  heavy chain complementarity determining region 3 for antibody 3065
TTGDLKN

SEQ ID NO: 6131 - protein, 11 aa, Homo sapiens
  light chain complementarity determining region 3 for antibody 3066
QHFALSQWLGT

SEQ ID NO: 6132 - protein, 13 aa, Homo sapiens
  heavy chain complementarity determining region 3 for antibody 3066
ARVNRGIFDAFDN

SEQ ID NO: 6133 - protein, 9 aa, Homo sapiens
  light chain complementarity determining region 3 for antibody 3067
QEYKTVPWT

SEQ ID NO: 6134 - protein, 20 aa, Homo sapiens
  heavy chain complementarity determining region 3 for antibody 3067
AKDGRGTAFYHGSGGGGLDV

SEQ ID NO: 6135 - protein, 9 aa, Homo sapiens
  light chain complementarity determining region 3 for antibody 3068
QEYKTVPWA

SEQ ID NO: 6136 - protein, 20 aa, Homo sapiens
  heavy chain complementarity determining region 3 for antibody 3068
AKDGRGTAFYHGAGGGGLDV

SEQ ID NO: 6137 - protein, 9 aa, Homo sapiens
  light chain complementarity determining region 3 for antibody 3069
QERSTWPGP

SEQ ID NO: 6138 - protein, 13 aa, Homo sapiens
  heavy chain complementarity determining region 3 for antibody 3069
ATGAWGSSWWGDY

SEQ ID NO: 6139 - protein, 9 aa, Homo sapiens
  light chain complementarity determining region 3 for antibody 3070
PQHNSYPLT

SEQ ID NO: 6140 - protein, 10 aa, Homo sapiens
  heavy chain complementarity determining region 3 for antibody 3070
CRDRWGFGDV

SEQ ID NO: 6141 - protein, 9 aa, Homo sapiens
  light chain complementarity determining region 3 for antibody 3071
PQDYYTPRT

SEQ ID NO: 6142 - protein, 11 aa, Homo sapiens
  heavy chain complementarity determining region 3 for antibody 3071
ARRSLGGAFDY

SEQ ID NO: 6143 - protein, 9 aa, Homo sapiens
  light chain complementarity determining region 3 for antibody 3072
MRTLQTPWT

SEQ ID NO: 6144 - protein, 12 aa, Homo sapiens
  heavy chain complementarity determining region 3 for antibody 3072
ARLDWNYRAFDI

SEQ ID NO: 6145 - protein, 9 aa, Homo sapiens
  light chain complementarity determining region 3 for antibody 3073
MQYTHRPHT

SEQ ID NO: 6146 - protein, 8 aa, Homo sapiens
  heavy chain complementarity determining region 3 for antibody 3073
AGWGYASY

SEQ ID NO: 6147 - protein, 9 aa, Homo sapiens
  light chain complementarity determining region 3 for antibody 3074
MQYAHGPHT

SEQ ID NO: 6148 - protein, 8 aa, Homo sapiens
  heavy chain complementarity determining region 3 for antibody 3074
AGWGYGSY

SEQ ID NO: 6149 - protein, 9 aa, Homo sapiens
  light chain complementarity determining region 3 for antibody 3075
MQVTHWPHT

SEQ ID NO: 6150 - protein, 11 aa, Homo sapiens
  heavy chain complementarity determining region 3 for antibody 3075
ATFGQQWRLAH

SEQ ID NO: 6151 - protein, 9 aa, Homo sapiens
  light chain complementarity determining region 3 for antibody 3076
MQTLQTPWT

SEQ ID NO: 6152 - protein, 12 aa, Homo sapiens
  heavy chain complementarity determining region 3 for antibody 3076
ARLDWNYRDFDI

SEQ ID NO: 6153 - protein, 9 aa, Homo sapiens
  light chain complementarity determining region 3 for antibody 3077
MQTLQTPWT

SEQ ID NO: 6154 - protein, 12 aa, Homo sapiens
  heavy chain complementarity determining region 3 for antibody 3077
ARLDWNYRACDI

SEQ ID NO: 6155 - protein, 9 aa, Homo sapiens
  light chain complementarity determining region 3 for antibody 3078
MQTLQTPWM

SEQ ID NO: 6156 - protein, 12 aa, Homo sapiens
  heavy chain complementarity determining region 3 for antibody 3078
ARLDWNYRAFDI

SEQ ID NO: 6157 - protein, 9 aa, Homo sapiens
  light chain complementarity determining region 3 for antibody 3079
MQSLLTPPT

SEQ ID NO: 6158 - protein, 13 aa, Homo sapiens
  heavy chain complementarity determining region 3 for antibody 3079
GRDQTRGYPTNEY

SEQ ID NO: 6159 - protein, 9 aa, Homo sapiens
  light chain complementarity determining region 3 for antibody 3080
MQPLQTPYT

SEQ ID NO: 6160 - protein, 17 aa, Homo sapiens
  heavy chain complementarity determining region 3 for antibody 3080
ARVDHLEPRDYYYGMDV

SEQ ID NO: 6161 - protein, 9 aa, Homo sapiens
  light chain complementarity determining region 3 for antibody 3081
MQGTYCPYT

SEQ ID NO: 6162 - protein, 11 aa, Homo sapiens
  heavy chain complementarity determining region 3 for antibody 3081
AREGWGSLLDY

SEQ ID NO: 6163 - protein, 9 aa, Homo sapiens
  light chain complementarity determining region 3 for antibody 3082
MQGTHWQHT

SEQ ID NO: 6164 - protein, 11 aa, Homo sapiens
  heavy chain complementarity determining region 3 for antibody 3082
ATFGQQWRLAH

SEQ ID NO: 6165 - protein, 9 aa, Homo sapiens
  light chain complementarity determining region 3 for antibody 3083
MQGTHWPYT

SEQ ID NO: 6166 - protein, 13 aa, Homo sapiens
  heavy chain complementarity determining region 3 for antibody 3083
VRDNRWFGELCDH

SEQ ID NO: 6167 - protein, 9 aa, Homo sapiens
  light chain complementarity determining region 3 for antibody 3084
MQGTHWPWT

SEQ ID NO: 6168 - protein, 12 aa, Homo sapiens
  heavy chain complementarity determining region 3 for antibody 3084
ARLDWNYRAFDI

SEQ ID NO: 6169 - protein, 9 aa, Homo sapiens
  light chain complementarity determining region 3 for antibody 3085
MQGTHWPWT

SEQ ID NO: 6170 - protein, 12 aa, Homo sapiens
  heavy chain complementarity determining region 3 for antibody 3085
AIVVPGRWDFDD

SEQ ID NO: 6171 - protein, 9 aa, Homo sapiens
  light chain complementarity determining region 3 for antibody 3086
MQGTHWPWP

SEQ ID NO: 6172 - protein, 16 aa, Homo sapiens
  heavy chain complementarity determining region 3 for antibody 3086
ARGHTNPGERRGGSDF

SEQ ID NO: 6173 - protein, 9 aa, Homo sapiens
  light chain complementarity determining region 3 for antibody 3087
MQGTHWPQP

SEQ ID NO: 6174 - protein, 11 aa, Homo sapiens
  heavy chain complementarity determining region 3 for antibody 3087
ATFGQQWRLAH

SEQ ID NO: 6175 - protein, 9 aa, Homo sapiens
  light chain complementarity determining region 3 for antibody 3088
MQGTHWPKT

SEQ ID NO: 6176 - protein, 11 aa, Homo sapiens
  heavy chain complementarity determining region 3 for antibody 3088
ARGDGWYGLDY

SEQ ID NO: 6177 - protein, 9 aa, Homo sapiens
  light chain complementarity determining region 3 for antibody 3089
MQGTHWPIN

SEQ ID NO: 6178 - protein, 13 aa, Homo sapiens
  heavy chain complementarity determining region 3 for antibody 3089
AKEGASAGPDFDY

SEQ ID NO: 6179 - protein, 9 aa, Homo sapiens
  light chain complementarity determining region 3 for antibody 3090
MQGTHWPHT

SEQ ID NO: 6180 - protein, 10 aa, Homo sapiens
  heavy chain complementarity determining region 3 for antibody 3090
CRDREGFGDV

SEQ ID NO: 6181 - protein, 9 aa, Homo sapiens
  light chain complementarity determining region 3 for antibody 3091
MQGTHWPHT

SEQ ID NO: 6182 - protein, 11 aa, Homo sapiens
  heavy chain complementarity determining region 3 for antibody 3091
ATFGQQWGLAH

SEQ ID NO: 6183 - protein, 9 aa, Homo sapiens
  light chain complementarity determining region 3 for antibody 3092
MQGTHWPHT

SEQ ID NO: 6184 - protein, 11 aa, Homo sapiens
  heavy chain complementarity determining region 3 for antibody 3092
ASFGQQWRLAH

SEQ ID NO: 6185 - protein, 10 aa, Homo sapiens
  light chain complementarity determining region 3 for antibody 3093
MQGTHWPAWT

SEQ ID NO: 6186 - protein, 12 aa, Homo sapiens
  heavy chain complementarity determining region 3 for antibody 3093
TAWIKTSVWLDY

SEQ ID NO: 6187 - protein, 10 aa, Homo sapiens
  light chain complementarity determining region 3 for antibody 3094
MQGTHWPAWT

SEQ ID NO: 6188 - protein, 13 aa, Homo sapiens
  heavy chain complementarity determining region 3 for antibody 3094
CTWVESNSGWLDY

SEQ ID NO: 6189 - protein, 10 aa, Homo sapiens
  light chain complementarity determining region 3 for antibody 3095
MQGTHWPART

SEQ ID NO: 6190 - protein, 12 aa, Homo sapiens
  heavy chain complementarity determining region 3 for antibody 3095
TTWIKTSVWLDY

SEQ ID NO: 6191 - protein, 6 aa, Homo sapiens
  light chain complementarity determining region 3 for antibody 3096
MQGTHT

SEQ ID NO: 6192 - protein, 11 aa, Homo sapiens
  heavy chain complementarity determining region 3 for antibody 3096
ATFGQQWRLAH

SEQ ID NO: 6193 - protein, 9 aa, Homo sapiens
  light chain complementarity determining region 3 for antibody 3097
MQGTHRPHT

SEQ ID NO: 6194 - protein, 11 aa, Homo sapiens
  heavy chain complementarity determining region 3 for antibody 3097
ATFGQQWRLAH

SEQ ID NO: 6195 - protein, 9 aa, Homo sapiens
  light chain complementarity determining region 3 for antibody 3098
MQGTHLPHT

SEQ ID NO: 6196 - protein, 11 aa, Homo sapiens
  heavy chain complementarity determining region 3 for antibody 3098
ATFGQQWRLAH

SEQ ID NO: 6197 - protein, 9 aa, Homo sapiens
  light chain complementarity determining region 3 for antibody 3099
MQGLQTPST

SEQ ID NO: 6198 - protein, 19 aa, Homo sapiens
  heavy chain complementarity determining region 3 for antibody 3099
ARDRKVVAASISYYFGLDV

SEQ ID NO: 6199 - protein, 9 aa, Homo sapiens
  light chain complementarity determining region 3 for antibody 3100
MQGIHWPGT

SEQ ID NO: 6200 - protein, 13 aa, Homo sapiens
  heavy chain complementarity determining region 3 for antibody 3100
TKEGSSAGPDFVY

SEQ ID NO: 6201 - protein, 9 aa, Homo sapiens
  light chain complementarity determining region 3 for antibody 3101
MQFLQTPLT

SEQ ID NO: 6202 - protein, 10 aa, Homo sapiens
  heavy chain complementarity determining region 3 for antibody 3101
ARESSGSYDI

SEQ ID NO: 6203 - protein, 9 aa, Homo sapiens
  light chain complementarity determining region 3 for antibody 3102
MQFLQTPLT

SEQ ID NO: 6204 - protein, 10 aa, Homo sapiens
  heavy chain complementarity determining region 3 for antibody 3102
ARERSGSFDI

SEQ ID NO: 6205 - protein, 9 aa, Homo sapiens
  light chain complementarity determining region 3 for antibody 3103
MQFLQTPLT

SEQ ID NO: 6206 - protein, 10 aa, Homo sapiens
  heavy chain complementarity determining region 3 for antibody 3103
ARERSGSCDI

SEQ ID NO: 6207 - protein, 9 aa, Homo sapiens
  light chain complementarity determining region 3 for antibody 3104
MQFLQTPLT

SEQ ID NO: 6208 - protein, 10 aa, Homo sapiens
  heavy chain complementarity determining region 3 for antibody 3104
ARERPGSYDI

SEQ ID NO: 6209 - protein, 9 aa, Homo sapiens
  light chain complementarity determining region 3 for antibody 3105
MQFLQTPLT

SEQ ID NO: 6210 - protein, 10 aa, Homo sapiens
  heavy chain complementarity determining region 3 for antibody 3105
ARDRSGSYDI

SEQ ID NO: 6211 - protein, 9 aa, Homo sapiens
  light chain complementarity determining region 3 for antibody 3106
MQFLQTPLT

SEQ ID NO: 6212 - protein, 10 aa, Homo sapiens
  heavy chain complementarity determining region 3 for antibody 3106
AGERSGSYDI

SEQ ID NO: 6213 - protein, 9 aa, Homo sapiens
  light chain complementarity determining region 3 for antibody 3107
MQFLQAPLT

SEQ ID NO: 6214 - protein, 10 aa, Homo sapiens
  heavy chain complementarity determining region 3 for antibody 3107
ARERSGSYDI

SEQ ID NO: 6215 - protein, 9 aa, Homo sapiens
  light chain complementarity determining region 3 for antibody 3108
MQDTHWPHT

SEQ ID NO: 6216 - protein, 17 aa, Homo sapiens
  heavy chain complementarity determining region 3 for antibody 3108
ARYGRWVGKLWNDAFDV

SEQ ID NO: 6217 - protein, 9 aa, Homo sapiens
  light chain complementarity determining region 3 for antibody 3109
MQATHWPRT

SEQ ID NO: 6218 - protein, 12 aa, Homo sapiens
  heavy chain complementarity determining region 3 for antibody 3109
STDVETTFPSVA

SEQ ID NO: 6219 - protein, 9 aa, Homo sapiens
  light chain complementarity determining region 3 for antibody 3110
MQATHWPRT

SEQ ID NO: 6220 - protein, 12 aa, Homo sapiens
  heavy chain complementarity determining region 3 for antibody 3110
STDVETTCPSVS

SEQ ID NO: 6221 - protein, 9 aa, Homo sapiens
  light chain complementarity determining region 3 for antibody 3111
MQATHWPGT

SEQ ID NO: 6222 - protein, 12 aa, Homo sapiens
  heavy chain complementarity determining region 3 for antibody 3111
ARGPLRMAAGTS

SEQ ID NO: 6223 - protein, 9 aa, Homo sapiens
  light chain complementarity determining region 3 for antibody 3112
MQALRLPLT

SEQ ID NO: 6224 - protein, 15 aa, Homo sapiens
  heavy chain complementarity determining region 3 for antibody 3112
VRDPGGLAYFYNMEV

SEQ ID NO: 6225 - protein, 9 aa, Homo sapiens
  light chain complementarity determining region 3 for antibody 3113
MQALQTVWT

SEQ ID NO: 6226 - protein, 10 aa, Homo sapiens
  heavy chain complementarity determining region 3 for antibody 3113
VGYNWNDAVY

SEQ ID NO: 6227 - protein, 9 aa, Homo sapiens
  light chain complementarity determining region 3 for antibody 3114
MQALQTSIT

SEQ ID NO: 6228 - protein, 15 aa, Homo sapiens
  heavy chain complementarity determining region 3 for antibody 3114
ARDWRYTYGQEGMNV

SEQ ID NO: 6229 - protein, 9 aa, Homo sapiens
  light chain complementarity determining region 3 for antibody 3115
MQALQTPYT

SEQ ID NO: 6230 - protein, 10 aa, Homo sapiens
  heavy chain complementarity determining region 3 for antibody 3115
AKGLSGGGGY

SEQ ID NO: 6231 - protein, 9 aa, Homo sapiens
  light chain complementarity determining region 3 for antibody 3116
MQALQTPWT

SEQ ID NO: 6232 - protein, 20 aa, Homo sapiens
  heavy chain complementarity determining region 3 for antibody 3116
AKAGGQYYDSSGSHSGGMDV

SEQ ID NO: 6233 - protein, 9 aa, Homo sapiens
  light chain complementarity determining region 3 for antibody 3117
MQALQTPRT

SEQ ID NO: 6234 - protein, 19 aa, Homo sapiens
  heavy chain complementarity determining region 3 for antibody 3117
VRDCYDYGNYVFPCEAFDI

SEQ ID NO: 6235 - protein, 9 aa, Homo sapiens
  light chain complementarity determining region 3 for antibody 3118
MQALQTPIT

SEQ ID NO: 6236 - protein, 19 aa, Homo sapiens
  heavy chain complementarity determining region 3 for antibody 3118
ARQNTGYNWNDGREIHMDV

SEQ ID NO: 6237 - protein, 9 aa, Homo sapiens
  light chain complementarity determining region 3 for antibody 3119
MQALQAPPT

SEQ ID NO: 6238 - protein, 14 aa, Homo sapiens
  heavy chain complementarity determining region 3 for antibody 3119
ARNAFTGSVYANTY

SEQ ID NO: 6239 - protein, 9 aa, Homo sapiens
  light chain complementarity determining region 3 for antibody 3120
MHYAHGPHT

SEQ ID NO: 6240 - protein, 8 aa, Homo sapiens
  heavy chain complementarity determining region 3 for antibody 3120
AGWGYGNY

SEQ ID NO: 6241 - protein, 9 aa, Homo sapiens
  light chain complementarity determining region 3 for antibody 3121
MHFLQTPLT

SEQ ID NO: 6242 - protein, 10 aa, Homo sapiens
  heavy chain complementarity determining region 3 for antibody 3121
ARERSGSYDI

SEQ ID NO: 6243 - protein, 9 aa, Homo sapiens
  light chain complementarity determining region 3 for antibody 3122
LRHNSYPLT

SEQ ID NO: 6244 - protein, 11 aa, Homo sapiens
  heavy chain complementarity determining region 3 for antibody 3122
VRVSTGWNFDY

SEQ ID NO: 6245 - protein, 9 aa, Homo sapiens
  light chain complementarity determining region 3 for antibody 3123
LQYVHWPHT

SEQ ID NO: 6246 - protein, 15 aa, Homo sapiens
  heavy chain complementarity determining region 3 for antibody 3123
ARVGRPYHNAWYFDN

SEQ ID NO: 6247 - protein, 9 aa, Homo sapiens
  light chain complementarity determining region 3 for antibody 3124
LQYAPWPHT

SEQ ID NO: 6248 - protein, 15 aa, Homo sapiens
  heavy chain complementarity determining region 3 for antibody 3124
ARVGRPYHNAWYFDN

SEQ ID NO: 6249 - protein, 9 aa, Homo sapiens
  light chain complementarity determining region 3 for antibody 3125
LQYAHWPQT

SEQ ID NO: 6250 - protein, 15 aa, Homo sapiens
  heavy chain complementarity determining region 3 for antibody 3125
ARVGRPYHNAWYFDN

SEQ ID NO: 6251 - protein, 9 aa, Homo sapiens
  light chain complementarity determining region 3 for antibody 3126
LQYAHWPHT

SEQ ID NO: 6252 - protein, 15 aa, Homo sapiens
  heavy chain complementarity determining region 3 for antibody 3126
ARVGRPYHNAWCFDN

SEQ ID NO: 6253 - protein, 9 aa, Homo sapiens
  light chain complementarity determining region 3 for antibody 3127
LQYAHWPHT

SEQ ID NO: 6254 - protein, 15 aa, Homo sapiens
  heavy chain complementarity determining region 3 for antibody 3127
ARVGRAYHNAWYFDN

SEQ ID NO: 6255 - protein, 9 aa, Homo sapiens
  light chain complementarity determining region 3 for antibody 3128
LQTIHWPWT

SEQ ID NO: 6256 - protein, 14 aa, Homo sapiens
  heavy chain complementarity determining region 3 for antibody 3128
ANYRASIGANCFDP

SEQ ID NO: 6257 - protein, 9 aa, Homo sapiens
  light chain complementarity determining region 3 for antibody 3129
LQHNYYPLT

SEQ ID NO: 6258 - protein, 11 aa, Homo sapiens
  heavy chain complementarity determining region 3 for antibody 3129
VRVSTGWNFDY

SEQ ID NO: 6259 - protein, 9 aa, Homo sapiens
  light chain complementarity determining region 3 for antibody 3130
LQHNTYPWT

SEQ ID NO: 6260 - protein, 15 aa, Homo sapiens
  heavy chain complementarity determining region 3 for antibody 3130
VRDPGGLAYFYNMEV

SEQ ID NO: 6261 - protein, 9 aa, Homo sapiens
  light chain complementarity determining region 3 for antibody 3131
LQHNSYPWT

SEQ ID NO: 6262 - protein, 15 aa, Homo sapiens
  heavy chain complementarity determining region 3 for antibody 3131
ATPLGSITWYNAFDV

SEQ ID NO: 6263 - protein, 9 aa, Homo sapiens
  light chain complementarity determining region 3 for antibody 3132
LQHNSYPLT

SEQ ID NO: 6264 - protein, 11 aa, Homo sapiens
  heavy chain complementarity determining region 3 for antibody 3132
VSVSTGWNFDY

SEQ ID NO: 6265 - protein, 9 aa, Homo sapiens
  light chain complementarity determining region 3 for antibody 3133
LQHNSYPLT

SEQ ID NO: 6266 - protein, 11 aa, Homo sapiens
  heavy chain complementarity determining region 3 for antibody 3133
VRVSTGWNFDH

SEQ ID NO: 6267 - protein, 9 aa, Homo sapiens
  light chain complementarity determining region 3 for antibody 3134
LQHNSYPLT

SEQ ID NO: 6268 - protein, 11 aa, Homo sapiens
  heavy chain complementarity determining region 3 for antibody 3134
VRVSTGLNFDY

SEQ ID NO: 6269 - protein, 9 aa, Homo sapiens
  light chain complementarity determining region 3 for antibody 3135
LQHNSYPLT

SEQ ID NO: 6270 - protein, 10 aa, Homo sapiens
  heavy chain complementarity determining region 3 for antibody 3135
CRDRWGFVDV

SEQ ID NO: 6271 - protein, 9 aa, Homo sapiens
  light chain complementarity determining region 3 for antibody 3136
LQHDSSPYT

SEQ ID NO: 6272 - protein, 16 aa, Homo sapiens
  heavy chain complementarity determining region 3 for antibody 3136
ASDFRYGSSIWYWGAV

SEQ ID NO: 6273 - protein, 9 aa, Homo sapiens
  light chain complementarity determining region 3 for antibody 3137
LQFAHWPNT

SEQ ID NO: 6274 - protein, 9 aa, Homo sapiens
  heavy chain complementarity determining region 3 for antibody 3137
AGWGGLSNY

SEQ ID NO: 6275 - protein, 9 aa, Homo sapiens
  light chain complementarity determining region 3 for antibody 3138
LQFAHWPHT

SEQ ID NO: 6276 - protein, 9 aa, Homo sapiens
  heavy chain complementarity determining region 3 for antibody 3138
AGWGGLSSY

SEQ ID NO: 6277 - protein, 9 aa, Homo sapiens
  light chain complementarity determining region 3 for antibody 3139
LQDYTYPFS

SEQ ID NO: 6278 - protein, 16 aa, Homo sapiens
  heavy chain complementarity determining region 3 for antibody 3139
ATDVGDHSDRFTALDY

SEQ ID NO: 6279 - protein, 9 aa, Homo sapiens
  light chain complementarity determining region 3 for antibody 3140
LQDYSYPLS

SEQ ID NO: 6280 - protein, 16 aa, Homo sapiens
  heavy chain complementarity determining region 3 for antibody 3140
TAGVGDHRDRYVTLDH

SEQ ID NO: 6281 - protein, 9 aa, Homo sapiens
  light chain complementarity determining region 3 for antibody 3141
LQDYSYPLS

SEQ ID NO: 6282 - protein, 16 aa, Homo sapiens
  heavy chain complementarity determining region 3 for antibody 3141
TADGGDHRDRYVTLDH

SEQ ID NO: 6283 - protein, 9 aa, Homo sapiens
  light chain complementarity determining region 3 for antibody 3142
LQDYNYPFT

SEQ ID NO: 6284 - protein, 16 aa, Homo sapiens
  heavy chain complementarity determining region 3 for antibody 3142
SADLGDHVDYYAPLDY

SEQ ID NO: 6285 - protein, 9 aa, Homo sapiens
  light chain complementarity determining region 3 for antibody 3143
LQDYNNSAV

SEQ ID NO: 6286 - protein, 12 aa, Homo sapiens
  heavy chain complementarity determining region 3 for antibody 3143
ARGHITGYKGDY

SEQ ID NO: 6287 - protein, 9 aa, Homo sapiens
  light chain complementarity determining region 3 for antibody 3144
LQDYNHSAG

SEQ ID NO: 6288 - protein, 12 aa, Homo sapiens
  heavy chain complementarity determining region 3 for antibody 3144
ARGHITGYKGDY

SEQ ID NO: 6289 - protein, 9 aa, Homo sapiens
  light chain complementarity determining region 3 for antibody 3145
LQDYKYPFS

SEQ ID NO: 6290 - protein, 16 aa, Homo sapiens
  heavy chain complementarity determining region 3 for antibody 3145
AADWGDHADAYATLDS

SEQ ID NO: 6291 - protein, 9 aa, Homo sapiens
  light chain complementarity determining region 3 for antibody 3146
LQDYIYPFS

SEQ ID NO: 6292 - protein, 16 aa, Homo sapiens
  heavy chain complementarity determining region 3 for antibody 3146
SSYVGDHRDSYTTLDF

SEQ ID NO: 6293 - protein, 9 aa, Homo sapiens
  light chain complementarity determining region 3 for antibody 3147
LQDHKYPFT

SEQ ID NO: 6294 - protein, 16 aa, Homo sapiens
  heavy chain complementarity determining region 3 for antibody 3147
AADLGDHSDVYAPLDS

SEQ ID NO: 6295 - protein, 9 aa, Homo sapiens
  light chain complementarity determining region 3 for antibody 3148
IQATHWPPT

SEQ ID NO: 6296 - protein, 10 aa, Homo sapiens
  heavy chain complementarity determining region 3 for antibody 3148
VYDFWSPRHY

SEQ ID NO: 6297 - protein, 9 aa, Homo sapiens
  light chain complementarity determining region 3 for antibody 3149
HQYNNWPYT

SEQ ID NO: 6298 - protein, 11 aa, Homo sapiens
  heavy chain complementarity determining region 3 for antibody 3149
ASIGWTQLRDY

SEQ ID NO: 6299 - protein, 9 aa, Homo sapiens
  light chain complementarity determining region 3 for antibody 3150
HQYGSLPLP

SEQ ID NO: 6300 - protein, 13 aa, Homo sapiens
  heavy chain complementarity determining region 3 for antibody 3150
AKDRSSGWYAWGY

SEQ ID NO: 6301 - protein, 9 aa, Homo sapiens
  light chain complementarity determining region 3 for antibody 3151
HQYAGTPWT

SEQ ID NO: 6302 - protein, 11 aa, Homo sapiens
  heavy chain complementarity determining region 3 for antibody 3151
ARGRDQSKLGY

SEQ ID NO: 6303 - protein, 9 aa, Homo sapiens
  light chain complementarity determining region 3 for antibody 3152
HQSSTFPHT

SEQ ID NO: 6304 - protein, 10 aa, Homo sapiens
  heavy chain complementarity determining region 3 for antibody 3152
ARETSGAYDI

SEQ ID NO: 6305 - protein, 9 aa, Homo sapiens
  light chain complementarity determining region 3 for antibody 3153
HQSSSLRGT

SEQ ID NO: 6306 - protein, 12 aa, Homo sapiens
  heavy chain complementarity determining region 3 for antibody 3153
ARTQERGYPFDY

SEQ ID NO: 6307 - protein, 9 aa, Homo sapiens
  light chain complementarity determining region 3 for antibody 3154
HQHGTTPGT

SEQ ID NO: 6308 - protein, 18 aa, Homo sapiens
  heavy chain complementarity determining region 3 for antibody 3154
ASWAGYCGGDCSAVSLDY

SEQ ID NO: 6309 - protein, 9 aa, Homo sapiens
  light chain complementarity determining region 3 for antibody 3155
HQCATSLYT

SEQ ID NO: 6310 - protein, 9 aa, Homo sapiens
  heavy chain complementarity determining region 3 for antibody 3155
AIYASGIPY

SEQ ID NO: 6311 - protein, 9 aa, Homo sapiens
  light chain complementarity determining region 3 for antibody 3156
ARGSYWPAS

SEQ ID NO: 6312 - protein, 10 aa, Homo sapiens
  heavy chain complementarity determining region 3 for antibody 3156
CRDREGFGDV

SEQ ID NO: 6313 - protein, 9 aa, Homo sapiens
  light chain complementarity determining region 3 for antibody 3157
AQGSYWPPS

SEQ ID NO: 6314 - protein, 10 aa, Homo sapiens
  heavy chain complementarity determining region 3 for antibody 3157
CRDREGFGDV

SEQ ID NO: 6315 - protein, 9 aa, Homo sapiens
  light chain complementarity determining region 3 for antibody 3158
AQGSYWPAS

SEQ ID NO: 6316 - protein, 10 aa, Homo sapiens
  heavy chain complementarity determining region 3 for antibody 3158
CRDREGFGGV

SEQ ID NO: 6317 - protein, 9 aa, Homo sapiens
  light chain complementarity determining region 3 for antibody 3159
AQGSYWPAS

SEQ ID NO: 6318 - protein, 13 aa, Homo sapiens
  heavy chain complementarity determining region 3 for antibody 3159
AKEGSSPGPDFEY

SEQ ID NO: 6319 - protein, 9 aa, Homo sapiens
  light chain complementarity determining region 3 for antibody 3160
AQGSYWPAP

SEQ ID NO: 6320 - protein, 10 aa, Homo sapiens
  heavy chain complementarity determining region 3 for antibody 3160
CRDREGFGDV

SEQ ID NO: 6321 - protein, 9 aa, Homo sapiens
  light chain complementarity determining region 3 for antibody 3161
AQGSYWPAA

SEQ ID NO: 6322 - protein, 10 aa, Homo sapiens
  heavy chain complementarity determining region 3 for antibody 3161
CRDREGFGDV

SEQ ID NO: 6323 - protein, 9 aa, Homo sapiens
  light chain complementarity determining region 3 for antibody 3162
AQGSYGPAS

SEQ ID NO: 6324 - protein, 10 aa, Homo sapiens
  heavy chain complementarity determining region 3 for antibody 3162
CRDRWGFGDV

SEQ ID NO: 6325 - protein, 9 aa, Homo sapiens
  light chain complementarity determining region 3 for antibody 3163
AQGSFWPAS

SEQ ID NO: 6326 - protein, 10 aa, Homo sapiens
  heavy chain complementarity determining region 3 for antibody 3163
CREREGFGDV

SEQ ID NO: 6327 - protein, 9 aa, Homo sapiens
  light chain complementarity determining region 3 for antibody 3164
AQGPYWPAS

SEQ ID NO: 6328 - protein, 10 aa, Homo sapiens
  heavy chain complementarity determining region 3 for antibody 3164
CRDREGFGDV

SEQ ID NO: 6329 - protein, 9 aa, Homo sapiens
  light chain complementarity determining region 3 for antibody 3165
APGSYWPAS

SEQ ID NO: 6330 - protein, 10 aa, Homo sapiens
  heavy chain complementarity determining region 3 for antibody 3165
CRDRWGFGDV

SEQ ID NO: 6331 - protein, 9 aa, Homo sapiens
  light chain complementarity determining region 3 for antibody 3166
APGSFWPAS

SEQ ID NO: 6332 - protein, 10 aa, Homo sapiens
  heavy chain complementarity determining region 3 for antibody 3166
CRDREGFGDV

SEQ ID NO: 6333 - protein, 11 aa, Homo sapiens
  light chain complementarity determining region 3 for antibody 3167
AHYGSSSGSGT

SEQ ID NO: 6334 - protein, 10 aa, Homo sapiens
  heavy chain complementarity determining region 3 for antibody 3167
ARATYWAYDS

SEQ ID NO: 6335 - protein, 9 aa, Homo sapiens
  light chain complementarity determining region 3 for antibody 3168
VQFLQTPLT

SEQ ID NO: 6336 - protein, 10 aa, Homo sapiens
  heavy chain complementarity determining region 3 for antibody 3168
ARERSGSYDI

SEQ ID NO: 6337 - protein, 9 aa, Homo sapiens
  light chain complementarity determining region 3 for antibody 3169
TQFLQTPLT

SEQ ID NO: 6338 - protein, 10 aa, Homo sapiens
  heavy chain complementarity determining region 3 for antibody 3169
ARERSGSYDI

SEQ ID NO: 6339 - protein, 9 aa, Homo sapiens
  light chain complementarity determining region 3 for antibody 3170
TQATHWPRT

SEQ ID NO: 6340 - protein, 12 aa, Homo sapiens
  heavy chain complementarity determining region 3 for antibody 3170
STDVETTFPSVS

SEQ ID NO: 6341 - protein, 9 aa, Homo sapiens
  light chain complementarity determining region 3 for antibody 3171
RQYDNLPLT

SEQ ID NO: 6342 - protein, 10 aa, Homo sapiens
  heavy chain complementarity determining region 3 for antibody 3171
ARETSGSYDI

SEQ ID NO: 6343 - protein, 10 aa, Homo sapiens
  light chain complementarity determining region 3 for antibody 3172
RQYDGSPPWT

SEQ ID NO: 6344 - protein, 14 aa, Homo sapiens
  heavy chain complementarity determining region 3 for antibody 3172
SHPTRGARLPIFDY

SEQ ID NO: 6345 - protein, 9 aa, Homo sapiens
  light chain complementarity determining region 3 for antibody 3173
RQTYSSPWT

SEQ ID NO: 6346 - protein, 15 aa, Homo sapiens
  heavy chain complementarity determining region 3 for antibody 3173
ARIWTSSTNCRYMDV

SEQ ID NO: 6347 - protein, 9 aa, Homo sapiens
  light chain complementarity determining region 3 for antibody 3174
RQFLQTPLT

SEQ ID NO: 6348 - protein, 10 aa, Homo sapiens
  heavy chain complementarity determining region 3 for antibody 3174
ARERSGSYDI

SEQ ID NO: 6349 - protein, 9 aa, Homo sapiens
  light chain complementarity determining region 3 for antibody 3175
QVYKSAPHP

SEQ ID NO: 6350 - protein, 14 aa, Homo sapiens
  heavy chain complementarity determining region 3 for antibody 3175
CRGWLDPATPHYDF

SEQ ID NO: 6351 - protein, 10 aa, Homo sapiens
  light chain complementarity determining region 3 for antibody 3176
QRYDNLASLT

SEQ ID NO: 6352 - protein, 13 aa, Homo sapiens
  heavy chain complementarity determining region 3 for antibody 3176
AKEGSSPGPDFEY

SEQ ID NO: 6353 - protein, 8 aa, Homo sapiens
  light chain complementarity determining region 3 for antibody 3177
QRYDLSLT

SEQ ID NO: 6354 - protein, 14 aa, Homo sapiens
  heavy chain complementarity determining region 3 for antibody 3177
ARGTIGDYTDYFPY

SEQ ID NO: 6355 - protein, 9 aa, Homo sapiens
  light chain complementarity determining region 3 for antibody 3178
QQYYTPPHT

SEQ ID NO: 6356 - protein, 17 aa, Homo sapiens
  heavy chain complementarity determining region 3 for antibody 3178
ARNTMVGTWQRQGNLDH

SEQ ID NO: 6357 - protein, 9 aa, Homo sapiens
  light chain complementarity determining region 3 for antibody 3179
QQYYSTPPT

SEQ ID NO: 6358 - protein, 10 aa, Homo sapiens
  heavy chain complementarity determining region 3 for antibody 3179
TREVSWVFDH

SEQ ID NO: 6359 - protein, 9 aa, Homo sapiens
  light chain complementarity determining region 3 for antibody 3180
QQYYSTPKT

SEQ ID NO: 6360 - protein, 9 aa, Homo sapiens
  heavy chain complementarity determining region 3 for antibody 3180
ARESYPYDY

SEQ ID NO: 6361 - protein, 9 aa, Homo sapiens
  light chain complementarity determining region 3 for antibody 3181
QQYYSSPLT

SEQ ID NO: 6362 - protein, 17 aa, Homo sapiens
  heavy chain complementarity determining region 3 for antibody 3181
ARNTMVGAWQRQGNLDH

SEQ ID NO: 6363 - protein, 9 aa, Homo sapiens
  light chain complementarity determining region 3 for antibody 3182
QQYYSSPFT

SEQ ID NO: 6364 - protein, 14 aa, Homo sapiens
  heavy chain complementarity determining region 3 for antibody 3182
AAAYSSGWLEYFQY

SEQ ID NO: 6365 - protein, 9 aa, Homo sapiens
  light chain complementarity determining region 3 for antibody 3183
QQYYSSPFP

SEQ ID NO: 6366 - protein, 14 aa, Homo sapiens
  heavy chain complementarity determining region 3 for antibody 3183
AASYSSGWLEYFQY

SEQ ID NO: 6367 - protein, 9 aa, Homo sapiens
  light chain complementarity determining region 3 for antibody 3184
QQYYSLPWT

SEQ ID NO: 6368 - protein, 17 aa, Homo sapiens
  heavy chain complementarity determining region 3 for antibody 3184
ARQGYCSSTTCNANFDY

SEQ ID NO: 6369 - protein, 9 aa, Homo sapiens
  light chain complementarity determining region 3 for antibody 3185
QQYYSAPTT

SEQ ID NO: 6370 - protein, 15 aa, Homo sapiens
  heavy chain complementarity determining region 3 for antibody 3185
VRALSPTEMSYAIAY

SEQ ID NO: 6371 - protein, 9 aa, Homo sapiens
  light chain complementarity determining region 3 for antibody 3186
QQYYSAPLT

SEQ ID NO: 6372 - protein, 11 aa, Homo sapiens
  heavy chain complementarity determining region 3 for antibody 3186
ARDRANSYSDY

SEQ ID NO: 6373 - protein, 10 aa, Homo sapiens
  light chain complementarity determining region 3 for antibody 3187
QQYYRSPPWA

SEQ ID NO: 6374 - protein, 16 aa, Homo sapiens
  heavy chain complementarity determining region 3 for antibody 3187
ASLNRGDKEFGVPPAL

SEQ ID NO: 6375 - protein, 9 aa, Homo sapiens
  light chain complementarity determining region 3 for antibody 3188
QQYYNSPLT

SEQ ID NO: 6376 - protein, 13 aa, Homo sapiens
  heavy chain complementarity determining region 3 for antibody 3188
ARGHGPGSFLIDY

SEQ ID NO: 6377 - protein, 9 aa, Homo sapiens
  light chain complementarity determining region 3 for antibody 3189
QQYYHTPLT

SEQ ID NO: 6378 - protein, 16 aa, Homo sapiens
  heavy chain complementarity determining region 3 for antibody 3189
ATLRITGNQGRGYLNL

SEQ ID NO: 6379 - protein, 9 aa, Homo sapiens
  light chain complementarity determining region 3 for antibody 3190
QQYYGSPLT

SEQ ID NO: 6380 - protein, 14 aa, Homo sapiens
  heavy chain complementarity determining region 3 for antibody 3190
TKPTRGPGSFLIDY

SEQ ID NO: 6381 - protein, 8 aa, Homo sapiens
  light chain complementarity determining region 3 for antibody 3191
QQYSSSYT

SEQ ID NO: 6382 - protein, 9 aa, Homo sapiens
  heavy chain complementarity determining region 3 for antibody 3191
ARGLHFPYD

SEQ ID NO: 6383 - protein, 9 aa, Homo sapiens
  light chain complementarity determining region 3 for antibody 3192
QQYSNWPLT

SEQ ID NO: 6384 - protein, 13 aa, Homo sapiens
  heavy chain complementarity determining region 3 for antibody 3192
AKRYSTNWGHFDY

SEQ ID NO: 6385 - protein, 10 aa, Homo sapiens
  light chain complementarity determining region 3 for antibody 3193
QQYSHWPPAT

SEQ ID NO: 6386 - protein, 11 aa, Homo sapiens
  heavy chain complementarity determining region 3 for antibody 3193
IASSGWYYFDH

SEQ ID NO: 6387 - protein, 9 aa, Homo sapiens
  light chain complementarity determining region 3 for antibody 3194
QQYSEWPLT

SEQ ID NO: 6388 - protein, 13 aa, Homo sapiens
  heavy chain complementarity determining region 3 for antibody 3194
AKRYSTNWGHFDY

SEQ ID NO: 6389 - protein, 9 aa, Homo sapiens
  light chain complementarity determining region 3 for antibody 3195
QQYNVYQGT

SEQ ID NO: 6390 - protein, 19 aa, Homo sapiens
  heavy chain complementarity determining region 3 for antibody 3195
ARQVQSGYELDEQPNRFDR

SEQ ID NO: 6391 - protein, 9 aa, Homo sapiens
  light chain complementarity determining region 3 for antibody 3196
QQYNTYPLT

SEQ ID NO: 6392 - protein, 16 aa, Homo sapiens
  heavy chain complementarity determining region 3 for antibody 3196
VRDLAGFTRGGSTFDY

SEQ ID NO: 6393 - protein, 7 aa, Homo sapiens
  light chain complementarity determining region 3 for antibody 3197
QQYNTWT

SEQ ID NO: 6394 - protein, 11 aa, Homo sapiens
  heavy chain complementarity determining region 3 for antibody 3197
ATFGQQWRLAH

SEQ ID NO: 6395 - protein, 7 aa, Homo sapiens
  light chain complementarity determining region 3 for antibody 3198
QQYNTWT

SEQ ID NO: 6396 - protein, 12 aa, Homo sapiens
  heavy chain complementarity determining region 3 for antibody 3198
ARNKGGRNGMDV

SEQ ID NO: 6397 - protein, 7 aa, Homo sapiens
  light chain complementarity determining region 3 for antibody 3199
QQYNTWT

SEQ ID NO: 6398 - protein, 10 aa, Homo sapiens
  heavy chain complementarity determining region 3 for antibody 3199
ARETSGSYDI

SEQ ID NO: 6399 - protein, 7 aa, Homo sapiens
  light chain complementarity determining region 3 for antibody 3200
QQYNTWT

SEQ ID NO: 6400 - protein, 12 aa, Homo sapiens
  heavy chain complementarity determining region 3 for antibody 3200
ARDKGGWNGMDV

SEQ ID NO: 6401 - protein, 7 aa, Homo sapiens
  light chain complementarity determining region 3 for antibody 3201
QQYNTWT

SEQ ID NO: 6402 - protein, 12 aa, Homo sapiens
  heavy chain complementarity determining region 3 for antibody 3201
ARDKGGRNRMDV

SEQ ID NO: 6403 - protein, 7 aa, Homo sapiens
  light chain complementarity determining region 3 for antibody 3202
QQYNTWT

SEQ ID NO: 6404 - protein, 12 aa, Homo sapiens
  heavy chain complementarity determining region 3 for antibody 3202
ARDKGGRNGMAV

SEQ ID NO: 6405 - protein, 7 aa, Homo sapiens
  light chain complementarity determining region 3 for antibody 3203
QQYNTWT

SEQ ID NO: 6406 - protein, 12 aa, Homo sapiens
  heavy chain complementarity determining region 3 for antibody 3203
ARDKGGRNDMDV

SEQ ID NO: 6407 - protein, 7 aa, Homo sapiens
  light chain complementarity determining region 3 for antibody 3204
QQYNTWP

SEQ ID NO: 6408 - protein, 12 aa, Homo sapiens
  heavy chain complementarity determining region 3 for antibody 3204
SRDKGGRNGMDV

SEQ ID NO: 6409 - protein, 9 aa, Homo sapiens
  light chain complementarity determining region 3 for antibody 3205
QQYNSYSRT

SEQ ID NO: 6410 - protein, 16 aa, Homo sapiens
  heavy chain complementarity determining region 3 for antibody 3205
VGPQLTYNSGWRYFDY

SEQ ID NO: 6411 - protein, 9 aa, Homo sapiens
  light chain complementarity determining region 3 for antibody 3206
QQYNSYSRT

SEQ ID NO: 6412 - protein, 16 aa, Homo sapiens
  heavy chain complementarity determining region 3 for antibody 3206
VGPHVTYNSGWRYFDY

SEQ ID NO: 6413 - protein, 10 aa, Homo sapiens
  light chain complementarity determining region 3 for antibody 3207
QQYNSYSPSP

SEQ ID NO: 6414 - protein, 15 aa, Homo sapiens
  heavy chain complementarity determining region 3 for antibody 3207
ARVGRPYHNAWYFDN

SEQ ID NO: 6415 - protein, 9 aa, Homo sapiens
  light chain complementarity determining region 3 for antibody 3208
QQYNSYSHT

SEQ ID NO: 6416 - protein, 16 aa, Homo sapiens
  heavy chain complementarity determining region 3 for antibody 3208
VGPHLTYNSGWRYFDY

SEQ ID NO: 6417 - protein, 9 aa, Homo sapiens
  light chain complementarity determining region 3 for antibody 3209
QQYNSYSHT

SEQ ID NO: 6418 - protein, 14 aa, Homo sapiens
  heavy chain complementarity determining region 3 for antibody 3209
ARGVHTTGWTLGGY

SEQ ID NO: 6419 - protein, 9 aa, Homo sapiens
  light chain complementarity determining region 3 for antibody 3210
QQYNSYSHT

SEQ ID NO: 6420 - protein, 14 aa, Homo sapiens
  heavy chain complementarity determining region 3 for antibody 3210
ARDVHTTGWTLVGY

SEQ ID NO: 6421 - protein, 9 aa, Homo sapiens
  light chain complementarity determining region 3 for antibody 3211
QQYNSYSHT

SEQ ID NO: 6422 - protein, 12 aa, Homo sapiens
  heavy chain complementarity determining region 3 for antibody 3211
ARDKGGRNGMDV

SEQ ID NO: 6423 - protein, 9 aa, Homo sapiens
  light chain complementarity determining region 3 for antibody 3212
QQYNSYSGT

SEQ ID NO: 6424 - protein, 17 aa, Homo sapiens
  heavy chain complementarity determining region 3 for antibody 3212
AKGTGYFDDTGDDAFDS

SEQ ID NO: 6425 - protein, 9 aa, Homo sapiens
  light chain complementarity determining region 3 for antibody 3213
QQYNSYPWT

SEQ ID NO: 6426 - protein, 15 aa, Homo sapiens
  heavy chain complementarity determining region 3 for antibody 3213
GKEGPGSSGWLTRHY

SEQ ID NO: 6427 - protein, 9 aa, Homo sapiens
  light chain complementarity determining region 3 for antibody 3214
QQYNSYPWT

SEQ ID NO: 6428 - protein, 15 aa, Homo sapiens
  heavy chain complementarity determining region 3 for antibody 3214
GKEGPGSSGWLSGHY

SEQ ID NO: 6429 - protein, 9 aa, Homo sapiens
  light chain complementarity determining region 3 for antibody 3215
QQYNSYPWT

SEQ ID NO: 6430 - protein, 15 aa, Homo sapiens
  heavy chain complementarity determining region 3 for antibody 3215
GKEGLGSSGWLTGHY

SEQ ID NO: 6431 - protein, 9 aa, Homo sapiens
  light chain complementarity determining region 3 for antibody 3216
QQYNSYPWT

SEQ ID NO: 6432 - protein, 10 aa, Homo sapiens
  heavy chain complementarity determining region 3 for antibody 3216
CRDREGFGDV

SEQ ID NO: 6433 - protein, 9 aa, Homo sapiens
  light chain complementarity determining region 3 for antibody 3217
QQYNSYPWT

SEQ ID NO: 6434 - protein, 15 aa, Homo sapiens
  heavy chain complementarity determining region 3 for antibody 3217
ARSMVSGTTDDAFDI

SEQ ID NO: 6435 - protein, 9 aa, Homo sapiens
  light chain complementarity determining region 3 for antibody 3218
QQYNSYPWT

SEQ ID NO: 6436 - protein, 9 aa, Homo sapiens
  heavy chain complementarity determining region 3 for antibody 3218
ARSEYQPTY

SEQ ID NO: 6437 - protein, 9 aa, Homo sapiens
  light chain complementarity determining region 3 for antibody 3219
QQYNSYPWT

SEQ ID NO: 6438 - protein, 14 aa, Homo sapiens
  heavy chain complementarity determining region 3 for antibody 3219
ARGHFDSTGFRLDY

SEQ ID NO: 6439 - protein, 9 aa, Homo sapiens
  light chain complementarity determining region 3 for antibody 3220
QQYNSYPWT

SEQ ID NO: 6440 - protein, 13 aa, Homo sapiens
  heavy chain complementarity determining region 3 for antibody 3220
AKEGSSPGPDFEY

SEQ ID NO: 6441 - protein, 9 aa, Homo sapiens
  light chain complementarity determining region 3 for antibody 3221
QQYNSYPWT

SEQ ID NO: 6442 - protein, 11 aa, Homo sapiens
  heavy chain complementarity determining region 3 for antibody 3221
AGIVARKPDDY

SEQ ID NO: 6443 - protein, 9 aa, Homo sapiens
  light chain complementarity determining region 3 for antibody 3222
QQYNSYPWP

SEQ ID NO: 6444 - protein, 15 aa, Homo sapiens
  heavy chain complementarity determining region 3 for antibody 3222
GKEGPGSSGWLTGHY

SEQ ID NO: 6445 - protein, 9 aa, Homo sapiens
  light chain complementarity determining region 3 for antibody 3223
QQYNSYPWM

SEQ ID NO: 6446 - protein, 15 aa, Homo sapiens
  heavy chain complementarity determining region 3 for antibody 3223
GKEGPGSSGWLTGHY

SEQ ID NO: 6447 - protein, 9 aa, Homo sapiens
  light chain complementarity determining region 3 for antibody 3224
QQYNSYPPT

SEQ ID NO: 6448 - protein, 13 aa, Homo sapiens
  heavy chain complementarity determining region 3 for antibody 3224
AKEGSSPGPDLEY

SEQ ID NO: 6449 - protein, 9 aa, Homo sapiens
  light chain complementarity determining region 3 for antibody 3225
QQYNSYPLS

SEQ ID NO: 6450 - protein, 12 aa, Homo sapiens
  heavy chain complementarity determining region 3 for antibody 3225
AIVVPGRWDLDD

SEQ ID NO: 6451 - protein, 7 aa, Homo sapiens
  light chain complementarity determining region 3 for antibody 3226
QQYNSWT

SEQ ID NO: 6452 - protein, 12 aa, Homo sapiens
  heavy chain complementarity determining region 3 for antibody 3226
ARDKGGRNGMDV

SEQ ID NO: 6453 - protein, 7 aa, Homo sapiens
  light chain complementarity determining region 3 for antibody 3227
QQYNSWT

SEQ ID NO: 6454 - protein, 12 aa, Homo sapiens
  heavy chain complementarity determining region 3 for antibody 3227
AKDKGVRSGMDV

SEQ ID NO: 6455 - protein, 9 aa, Homo sapiens
  light chain complementarity determining region 3 for antibody 3228
QQYNNYPWT

SEQ ID NO: 6456 - protein, 14 aa, Homo sapiens
  heavy chain complementarity determining region 3 for antibody 3228
VREEGSGWYRTADY

SEQ ID NO: 6457 - protein, 10 aa, Homo sapiens
  light chain complementarity determining region 3 for antibody 3229
QQYNNWPPYT

SEQ ID NO: 6458 - protein, 14 aa, Homo sapiens
  heavy chain complementarity determining region 3 for antibody 3229
ARENCYGTGSCFDI

SEQ ID NO: 6459 - protein, 10 aa, Homo sapiens
  light chain complementarity determining region 3 for antibody 3230
QQYNNWPPIT

SEQ ID NO: 6460 - protein, 13 aa, Homo sapiens
  heavy chain complementarity determining region 3 for antibody 3230
AKEGVGGGLDLDY

SEQ ID NO: 6461 - protein, 9 aa, Homo sapiens
  light chain complementarity determining region 3 for antibody 3231
QQYNNWPFP

SEQ ID NO: 6462 - protein, 10 aa, Homo sapiens
  heavy chain complementarity determining region 3 for antibody 3231
VRSDSPGDDS

SEQ ID NO: 6463 - protein, 9 aa, Homo sapiens
  light chain complementarity determining region 3 for antibody 3232
QQYNDWPQS

SEQ ID NO: 6464 - protein, 15 aa, Homo sapiens
  heavy chain complementarity determining region 3 for antibody 3232
ARSYEDRGYTAWLDT

SEQ ID NO: 6465 - protein, 9 aa, Homo sapiens
  light chain complementarity determining region 3 for antibody 3233
QQYNDAPWT

SEQ ID NO: 6466 - protein, 20 aa, Homo sapiens
  heavy chain complementarity determining region 3 for antibody 3233
TRDARGSSSYAYGGGGGLDV

SEQ ID NO: 6467 - protein, 9 aa, Homo sapiens
  light chain complementarity determining region 3 for antibody 3234
QQYLDWPWT

SEQ ID NO: 6468 - protein, 11 aa, Homo sapiens
  heavy chain complementarity determining region 3 for antibody 3234
VRVGSSGSARY

SEQ ID NO: 6469 - protein, 9 aa, Homo sapiens
  light chain complementarity determining region 3 for antibody 3235
QQYKTYPPT

SEQ ID NO: 6470 - protein, 13 aa, Homo sapiens
  heavy chain complementarity determining region 3 for antibody 3235
AKDRYSSGNNFDY

SEQ ID NO: 6471 - protein, 8 aa, Homo sapiens
  light chain complementarity determining region 3 for antibody 3236
QQYKSYWA

SEQ ID NO: 6472 - protein, 10 aa, Homo sapiens
  heavy chain complementarity determining region 3 for antibody 3236
ARERSGSYDI

SEQ ID NO: 6473 - protein, 8 aa, Homo sapiens
  light chain complementarity determining region 3 for antibody 3237
QQYKSYAA

SEQ ID NO: 6474 - protein, 21 aa, Homo sapiens
  heavy chain complementarity determining region 3 for antibody 3237
TAVRGVFHDVLTGNWEGPFDY

SEQ ID NO: 6475 - protein, 8 aa, Homo sapiens
  light chain complementarity determining region 3 for antibody 3238
QQYKSCWT

SEQ ID NO: 6476 - protein, 10 aa, Homo sapiens
  heavy chain complementarity determining region 3 for antibody 3238
ARERSGSYDI

SEQ ID NO: 6477 - protein, 9 aa, Homo sapiens
  light chain complementarity determining region 3 for antibody 3239
QQYHNWPGT

SEQ ID NO: 6478 - protein, 11 aa, Homo sapiens
  heavy chain complementarity determining region 3 for antibody 3239
AKGGFYFLAGD

SEQ ID NO: 6479 - protein, 8 aa, Homo sapiens
  light chain complementarity determining region 3 for antibody 3240
QQYHIYSD

SEQ ID NO: 6480 - protein, 12 aa, Homo sapiens
  heavy chain complementarity determining region 3 for antibody 3240
IHCRWTVCYYTS

SEQ ID NO: 6481 - protein, 9 aa, Homo sapiens
  light chain complementarity determining region 3 for antibody 3241
QQYHGYPWT

SEQ ID NO: 6482 - protein, 11 aa, Homo sapiens
  heavy chain complementarity determining region 3 for antibody 3241
ARIVARKPVDY

SEQ ID NO: 6483 - protein, 9 aa, Homo sapiens
  light chain complementarity determining region 3 for antibody 3242
QQYHGYPGT

SEQ ID NO: 6484 - protein, 9 aa, Homo sapiens
  heavy chain complementarity determining region 3 for antibody 3242
AGWGGLSNY

SEQ ID NO: 6485 - protein, 9 aa, Homo sapiens
  light chain complementarity determining region 3 for antibody 3243
QQYGYSPLP

SEQ ID NO: 6486 - protein, 18 aa, Homo sapiens
  heavy chain complementarity determining region 3 for antibody 3243
ARGDYPEARSDYYLDFDY

SEQ ID NO: 6487 - protein, 9 aa, Homo sapiens
  light chain complementarity determining region 3 for antibody 3244
QQYGTTPLP

SEQ ID NO: 6488 - protein, 6 aa, Homo sapiens
  heavy chain complementarity determining region 3 for antibody 3244
TTGYHA

SEQ ID NO: 6489 - protein, 9 aa, Homo sapiens
  light chain complementarity determining region 3 for antibody 3245
QQYGTSPVT

SEQ ID NO: 6490 - protein, 13 aa, Homo sapiens
  heavy chain complementarity determining region 3 for antibody 3245
AKDRGSGWFALGY

SEQ ID NO: 6491 - protein, 9 aa, Homo sapiens
  light chain complementarity determining region 3 for antibody 3246
QQYGTSPVT

SEQ ID NO: 6492 - protein, 13 aa, Homo sapiens
  heavy chain complementarity determining region 3 for antibody 3246
AKDRGRGWFAWGY

SEQ ID NO: 6493 - protein, 8 aa, Homo sapiens
  light chain complementarity determining region 3 for antibody 3247
QQYGTSFP

SEQ ID NO: 6494 - protein, 16 aa, Homo sapiens
  heavy chain complementarity determining region 3 for antibody 3247
SRWAGVASGWSGPFDN

SEQ ID NO: 6495 - protein, 9 aa, Homo sapiens
  light chain complementarity determining region 3 for antibody 3248
QQYGSSTWT

SEQ ID NO: 6496 - protein, 17 aa, Homo sapiens
  heavy chain complementarity determining region 3 for antibody 3248
AKGRGSVAMALIYYLDF

SEQ ID NO: 6497 - protein, 7 aa, Homo sapiens
  light chain complementarity determining region 3 for antibody 3249
QQYGSST

SEQ ID NO: 6498 - protein, 10 aa, Homo sapiens
  heavy chain complementarity determining region 3 for antibody 3249
ARRWERYFDY

SEQ ID NO: 6499 - protein, 9 aa, Homo sapiens
  light chain complementarity determining region 3 for antibody 3250
QQYGSSPST

SEQ ID NO: 6500 - protein, 19 aa, Homo sapiens
  heavy chain complementarity determining region 3 for antibody 3250
ARDGFIWFGELTNPYYFDY

SEQ ID NO: 6501 - protein, 9 aa, Homo sapiens
  light chain complementarity determining region 3 for antibody 3251
QQYGSSPRT

SEQ ID NO: 6502 - protein, 14 aa, Homo sapiens
  heavy chain complementarity determining region 3 for antibody 3251
TRGHFDSTGFRLDY

SEQ ID NO: 6503 - protein, 9 aa, Homo sapiens
  light chain complementarity determining region 3 for antibody 3252
QQYGSSPRT

SEQ ID NO: 6504 - protein, 19 aa, Homo sapiens
  heavy chain complementarity determining region 3 for antibody 3252
ARERVRCRSGICYDATFDI

SEQ ID NO: 6505 - protein, 10 aa, Homo sapiens
  light chain complementarity determining region 3 for antibody 3253
QQYGSSPPYT

SEQ ID NO: 6506 - protein, 13 aa, Homo sapiens
  heavy chain complementarity determining region 3 for antibody 3253
AKEGSAPGPDFEY

SEQ ID NO: 6507 - protein, 9 aa, Homo sapiens
  light chain complementarity determining region 3 for antibody 3254
QQYGSSPPT

SEQ ID NO: 6508 - protein, 10 aa, Homo sapiens
  heavy chain complementarity determining region 3 for antibody 3254
AKYLRRAFDV

SEQ ID NO: 6509 - protein, 10 aa, Homo sapiens
  light chain complementarity determining region 3 for antibody 3255
QQYGSSPLYT

SEQ ID NO: 6510 - protein, 13 aa, Homo sapiens
  heavy chain complementarity determining region 3 for antibody 3255
VSWSISDSDGLAY

SEQ ID NO: 6511 - protein, 8 aa, Homo sapiens
  light chain complementarity determining region 3 for antibody 3256
QQYGSSGR

SEQ ID NO: 6512 - protein, 18 aa, Homo sapiens
  heavy chain complementarity determining region 3 for antibody 3256
TRSYYDDNSASFLYGMDV

SEQ ID NO: 6513 - protein, 6 aa, Homo sapiens
  light chain complementarity determining region 3 for antibody 3257
QQYGRT

SEQ ID NO: 6514 - protein, 18 aa, Homo sapiens
  heavy chain complementarity determining region 3 for antibody 3257
TTGGQAGPTPWLRSWVDY

SEQ ID NO: 6515 - protein, 9 aa, Homo sapiens
  light chain complementarity determining region 3 for antibody 3258
QQYGNSRWT

SEQ ID NO: 6516 - protein, 10 aa, Homo sapiens
  heavy chain complementarity determining region 3 for antibody 3258
TTEDWGSGSS

SEQ ID NO: 6517 - protein, 9 aa, Homo sapiens
  light chain complementarity determining region 3 for antibody 3259
QQYGNSPVP

SEQ ID NO: 6518 - protein, 18 aa, Homo sapiens
  heavy chain complementarity determining region 3 for antibody 3259
ARGDYPEARTGYFRDFDY

SEQ ID NO: 6519 - protein, 9 aa, Homo sapiens
  light chain complementarity determining region 3 for antibody 3260
QQYGNPPFT

SEQ ID NO: 6520 - protein, 12 aa, Homo sapiens
  heavy chain complementarity determining region 3 for antibody 3260
NADHGYVDGFDI

SEQ ID NO: 6521 - protein, 9 aa, Homo sapiens
  light chain complementarity determining region 3 for antibody 3261
QQYGNLPPT

SEQ ID NO: 6522 - protein, 9 aa, Homo sapiens
  heavy chain complementarity determining region 3 for antibody 3261
ARENGFNMF

SEQ ID NO: 6523 - protein, 11 aa, Homo sapiens
  light chain complementarity determining region 3 for antibody 3262
QQYGGSPPEGP

SEQ ID NO: 6524 - protein, 18 aa, Homo sapiens
  heavy chain complementarity determining region 3 for antibody 3262
AKDNRWYCSTTNCYLFDS

SEQ ID NO: 6525 - protein, 12 aa, Homo sapiens
  light chain complementarity determining region 3 for antibody 3263
QQYGEGGSPPIT

SEQ ID NO: 6526 - protein, 17 aa, Homo sapiens
  heavy chain complementarity determining region 3 for antibody 3263
ARNTMVGTWQRQGNLDH

SEQ ID NO: 6527 - protein, 9 aa, Homo sapiens
  light chain complementarity determining region 3 for antibody 3264
QQYESLPHT

SEQ ID NO: 6528 - protein, 13 aa, Homo sapiens
  heavy chain complementarity determining region 3 for antibody 3264
AKGGGRLTLFRGI

SEQ ID NO: 6529 - protein, 10 aa, Homo sapiens
  light chain complementarity determining region 3 for antibody 3265
QQYDYSPPWT

SEQ ID NO: 6530 - protein, 14 aa, Homo sapiens
  heavy chain complementarity determining region 3 for antibody 3265
AHPTKAARLPIFDY

SEQ ID NO: 6531 - protein, 10 aa, Homo sapiens
  light chain complementarity determining region 3 for antibody 3266
QQYDYSPPGT

SEQ ID NO: 6532 - protein, 14 aa, Homo sapiens
  heavy chain complementarity determining region 3 for antibody 3266
SHPTRAARLPIFDY

SEQ ID NO: 6533 - protein, 7 aa, Homo sapiens
  light chain complementarity determining region 3 for antibody 3267
QQYDTWT

SEQ ID NO: 6534 - protein, 12 aa, Homo sapiens
  heavy chain complementarity determining region 3 for antibody 3267
ARDKGGRNGMDV

SEQ ID NO: 6535 - protein, 9 aa, Homo sapiens
  light chain complementarity determining region 3 for antibody 3268
QQYDTWPWT

SEQ ID NO: 6536 - protein, 17 aa, Homo sapiens
  heavy chain complementarity determining region 3 for antibody 3268
VTHYYHDSGIYHDFFNY

SEQ ID NO: 6537 - protein, 9 aa, Homo sapiens
  light chain complementarity determining region 3 for antibody 3269
QQYDSYPLT

SEQ ID NO: 6538 - protein, 14 aa, Homo sapiens
  heavy chain complementarity determining region 3 for antibody 3269
ARGESSSCDYIFDF

SEQ ID NO: 6539 - protein, 8 aa, Homo sapiens
  light chain complementarity determining region 3 for antibody 3270
QQYDSYGT

SEQ ID NO: 6540 - protein, 20 aa, Homo sapiens
  heavy chain complementarity determining region 3 for antibody 3270
ATRFMITGVVTLNMDDAFNI

SEQ ID NO: 6541 - protein, 9 aa, Homo sapiens
  light chain complementarity determining region 3 for antibody 3271
QQYDSIPLT

SEQ ID NO: 6542 - protein, 23 aa, Homo sapiens
  heavy chain complementarity determining region 3 for antibody 3271
ARHFPMGGSTVTGTQSLLYYMDV

SEQ ID NO: 6543 - protein, 9 aa, Homo sapiens
  light chain complementarity determining region 3 for antibody 3272
QQYDNWPWA

SEQ ID NO: 6544 - protein, 17 aa, Homo sapiens
  heavy chain complementarity determining region 3 for antibody 3272
VTHYYHDSGIYHDFFNY

SEQ ID NO: 6545 - protein, 9 aa, Homo sapiens
  light chain complementarity determining region 3 for antibody 3273
QQYDNWPLT

SEQ ID NO: 6546 - protein, 18 aa, Homo sapiens
  heavy chain complementarity determining region 3 for antibody 3273
AGLLVVPAVVHHFYGMDV

SEQ ID NO: 6547 - protein, 9 aa, Homo sapiens
  light chain complementarity determining region 3 for antibody 3274
QQYDNLPWT

SEQ ID NO: 6548 - protein, 13 aa, Homo sapiens
  heavy chain complementarity determining region 3 for antibody 3274
AKEGSAPGPDFEY

SEQ ID NO: 6549 - protein, 9 aa, Homo sapiens
  light chain complementarity determining region 3 for antibody 3275
QQYDNLPPA

SEQ ID NO: 6550 - protein, 13 aa, Homo sapiens
  heavy chain complementarity determining region 3 for antibody 3275
TKEGSSAGPDLVY

SEQ ID NO: 6551 - protein, 9 aa, Homo sapiens
  light chain complementarity determining region 3 for antibody 3276
QQYDNLPPA

SEQ ID NO: 6552 - protein, 13 aa, Homo sapiens
  heavy chain complementarity determining region 3 for antibody 3276
TKEGSSAGPDFVS

SEQ ID NO: 6553 - protein, 9 aa, Homo sapiens
  light chain complementarity determining region 3 for antibody 3277
QQYDNLPLT

SEQ ID NO: 6554 - protein, 12 aa, Homo sapiens
  heavy chain complementarity determining region 3 for antibody 3277
ASVVPGRWDLDD

SEQ ID NO: 6555 - protein, 9 aa, Homo sapiens
  light chain complementarity determining region 3 for antibody 3278
QQYDNLPLT

SEQ ID NO: 6556 - protein, 14 aa, Homo sapiens
  heavy chain complementarity determining region 3 for antibody 3278
ARLKDTTMVGGMDV

SEQ ID NO: 6557 - protein, 10 aa, Homo sapiens
  light chain complementarity determining region 3 for antibody 3279
QQYDNLASLT

SEQ ID NO: 6558 - protein, 10 aa, Homo sapiens
  heavy chain complementarity determining region 3 for antibody 3279
CRDRWGFGDV

SEQ ID NO: 6559 - protein, 10 aa, Homo sapiens
  light chain complementarity determining region 3 for antibody 3280
QQYDNLASLT

SEQ ID NO: 6560 - protein, 13 aa, Homo sapiens
  heavy chain complementarity determining region 3 for antibody 3280
AKEGSSPGPAFEY

SEQ ID NO: 6561 - protein, 10 aa, Homo sapiens
  light chain complementarity determining region 3 for antibody 3281
QQYDNLASLT

SEQ ID NO: 6562 - protein, 13 aa, Homo sapiens
  heavy chain complementarity determining region 3 for antibody 3281
AKEGSSPGADFEY

SEQ ID NO: 6563 - protein, 10 aa, Homo sapiens
  light chain complementarity determining region 3 for antibody 3282
QQYDNLASLN

SEQ ID NO: 6564 - protein, 13 aa, Homo sapiens
  heavy chain complementarity determining region 3 for antibody 3282
AKEGSSPGPDFEY

SEQ ID NO: 6565 - protein, 8 aa, Homo sapiens
  light chain complementarity determining region 3 for antibody 3283
QQYDNART

SEQ ID NO: 6566 - protein, 9 aa, Homo sapiens
  heavy chain complementarity determining region 3 for antibody 3283
ARSEYHPTY

SEQ ID NO: 6567 - protein, 10 aa, Homo sapiens
  light chain complementarity determining region 3 for antibody 3284
QQYDISPPRT

SEQ ID NO: 6568 - protein, 16 aa, Homo sapiens
  heavy chain complementarity determining region 3 for antibody 3284
ASPNTLGRLVGVAFDY

SEQ ID NO: 6569 - protein, 9 aa, Homo sapiens
  light chain complementarity determining region 3 for antibody 3285
QQYDHYAHT

SEQ ID NO: 6570 - protein, 14 aa, Homo sapiens
  heavy chain complementarity determining region 3 for antibody 3285
ARDVHTPGWTLGGY

SEQ ID NO: 6571 - protein, 9 aa, Homo sapiens
  light chain complementarity determining region 3 for antibody 3286
QQYCGSLLT

SEQ ID NO: 6572 - protein, 10 aa, Homo sapiens
  heavy chain complementarity determining region 3 for antibody 3286
CRDRWGFGDV

SEQ ID NO: 6573 - protein, 9 aa, Homo sapiens
  light chain complementarity determining region 3 for antibody 3287
QQYANWPWT

SEQ ID NO: 6574 - protein, 17 aa, Homo sapiens
  heavy chain complementarity determining region 3 for antibody 3287
VTHYYHDSGIYHDFFNY

SEQ ID NO: 6575 - protein, 9 aa, Homo sapiens
  light chain complementarity determining region 3 for antibody 3288
QQYAKSLIT

SEQ ID NO: 6576 - protein, 14 aa, Homo sapiens
  heavy chain complementarity determining region 3 for antibody 3288
ARASRGEIDFLIDS

SEQ ID NO: 6577 - protein, 9 aa, Homo sapiens
  light chain complementarity determining region 3 for antibody 3289
QQTYSSPWK

SEQ ID NO: 6578 - protein, 15 aa, Homo sapiens
  heavy chain complementarity determining region 3 for antibody 3289
ARIWTSSTNCRYMDV

SEQ ID NO: 6579 - protein, 9 aa, Homo sapiens
  light chain complementarity determining region 3 for antibody 3290
QQTYSSPRT

SEQ ID NO: 6580 - protein, 11 aa, Homo sapiens
  heavy chain complementarity determining region 3 for antibody 3290
TRGGYSVGYDY

SEQ ID NO: 6581 - protein, 9 aa, Homo sapiens
  light chain complementarity determining region 3 for antibody 3291
QQTYSSPGT

SEQ ID NO: 6582 - protein, 11 aa, Homo sapiens
  heavy chain complementarity determining region 3 for antibody 3291
TRGGYSVGYDY

SEQ ID NO: 6583 - protein, 9 aa, Homo sapiens
  light chain complementarity determining region 3 for antibody 3292
QQTYSRPWT

SEQ ID NO: 6584 - protein, 15 aa, Homo sapiens
  heavy chain complementarity determining region 3 for antibody 3292
ARIWTSSTNCRYMDV

SEQ ID NO: 6585 - protein, 9 aa, Homo sapiens
  light chain complementarity determining region 3 for antibody 3293
QQTYSIPWT

SEQ ID NO: 6586 - protein, 15 aa, Homo sapiens
  heavy chain complementarity determining region 3 for antibody 3293
ARIWTSSTNCRYMDV

SEQ ID NO: 6587 - protein, 9 aa, Homo sapiens
  light chain complementarity determining region 3 for antibody 3294
QQTYRTPYT

SEQ ID NO: 6588 - protein, 14 aa, Homo sapiens
  heavy chain complementarity determining region 3 for antibody 3294
ARLHGSCLGRWLDP

SEQ ID NO: 6589 - protein, 9 aa, Homo sapiens
  light chain complementarity determining region 3 for antibody 3295
QQTYRTPYT

SEQ ID NO: 6590 - protein, 14 aa, Homo sapiens
  heavy chain complementarity determining region 3 for antibody 3295
ARGHFDSTGFRLDY

SEQ ID NO: 6591 - protein, 9 aa, Homo sapiens
  light chain complementarity determining region 3 for antibody 3296
QQTYRTPYT

SEQ ID NO: 6592 - protein, 17 aa, Homo sapiens
  heavy chain complementarity determining region 3 for antibody 3296
AKRLPDLLGGGHHYIDV

SEQ ID NO: 6593 - protein, 9 aa, Homo sapiens
  light chain complementarity determining region 3 for antibody 3297
QQTYRTPYT

SEQ ID NO: 6594 - protein, 10 aa, Homo sapiens
  heavy chain complementarity determining region 3 for antibody 3297
AHRINRAFDV

SEQ ID NO: 6595 - protein, 9 aa, Homo sapiens
  light chain complementarity determining region 3 for antibody 3298
QQTYRTPYA

SEQ ID NO: 6596 - protein, 14 aa, Homo sapiens
  heavy chain complementarity determining region 3 for antibody 3298
ARLHGSGLGRWLDP

SEQ ID NO: 6597 - protein, 9 aa, Homo sapiens
  light chain complementarity determining region 3 for antibody 3299
QQTYRAPDT

SEQ ID NO: 6598 - protein, 14 aa, Homo sapiens
  heavy chain complementarity determining region 3 for antibody 3299
SREPPRGLAGPGDY

SEQ ID NO: 6599 - protein, 9 aa, Homo sapiens
  light chain complementarity determining region 3 for antibody 3300
QQSYTTPYT

SEQ ID NO: 6600 - protein, 13 aa, Homo sapiens
  heavy chain complementarity determining region 3 for antibody 3300
AREGSAPGPDFEY

SEQ ID NO: 6601 - protein, 9 aa, Homo sapiens
  light chain complementarity determining region 3 for antibody 3301
QQSYTTPYT

SEQ ID NO: 6602 - protein, 14 aa, Homo sapiens
  heavy chain complementarity determining region 3 for antibody 3301
ANYRASIGANCFDP

SEQ ID NO: 6603 - protein, 8 aa, Homo sapiens
  light chain complementarity determining region 3 for antibody 3302
QQSYTTPT

SEQ ID NO: 6604 - protein, 26 aa, Homo sapiens
  heavy chain complementarity determining region 3 for antibody 3302
ARDVPKGGSYSSGWYGSVGGNYYMDV

SEQ ID NO: 6605 - protein, 8 aa, Homo sapiens
  light chain complementarity determining region 3 for antibody 3303
QQSYTTPT

SEQ ID NO: 6606 - protein, 26 aa, Homo sapiens
  heavy chain complementarity determining region 3 for antibody 3303
ARDVPKGGSYSSGWYGSVGGKYYMDV

SEQ ID NO: 6607 - protein, 9 aa, Homo sapiens
  light chain complementarity determining region 3 for antibody 3304
QQSYTTPRP

SEQ ID NO: 6608 - protein, 16 aa, Homo sapiens
  heavy chain complementarity determining region 3 for antibody 3304
AREFPYSSTSVWYFDV

SEQ ID NO: 6609 - protein, 8 aa, Homo sapiens
  light chain complementarity determining region 3 for antibody 3305
QQSYTNAT

SEQ ID NO: 6610 - protein, 12 aa, Homo sapiens
  heavy chain complementarity determining region 3 for antibody 3305
AIVVPGRWDLDD

SEQ ID NO: 6611 - protein, 9 aa, Homo sapiens
  light chain complementarity determining region 3 for antibody 3306
QQSYTMPRT

SEQ ID NO: 6612 - protein, 18 aa, Homo sapiens
  heavy chain complementarity determining region 3 for antibody 3306
TTVLSQLLAGNWHLYFQH

SEQ ID NO: 6613 - protein, 9 aa, Homo sapiens
  light chain complementarity determining region 3 for antibody 3307
QQSYTMPRT

SEQ ID NO: 6614 - protein, 18 aa, Homo sapiens
  heavy chain complementarity determining region 3 for antibody 3307
TTVLSQLLAGDWHLYLQH

SEQ ID NO: 6615 - protein, 9 aa, Homo sapiens
  light chain complementarity determining region 3 for antibody 3308
QQSYSTPST

SEQ ID NO: 6616 - protein, 16 aa, Homo sapiens
  heavy chain complementarity determining region 3 for antibody 3308
ARWVSRSSTGVSYMDV

SEQ ID NO: 6617 - protein, 9 aa, Homo sapiens
  light chain complementarity determining region 3 for antibody 3309
QQSYSTPST

SEQ ID NO: 6618 - protein, 16 aa, Homo sapiens
  heavy chain complementarity determining region 3 for antibody 3309
ARWFSRSSTGVSYVDV

SEQ ID NO: 6619 - protein, 9 aa, Homo sapiens
  light chain complementarity determining region 3 for antibody 3310
QQSYSTPST

SEQ ID NO: 6620 - protein, 16 aa, Homo sapiens
  heavy chain complementarity determining region 3 for antibody 3310
ARRFSRSSTGVSYMDV

SEQ ID NO: 6621 - protein, 9 aa, Homo sapiens
  light chain complementarity determining region 3 for antibody 3311
QQSYSTPST

SEQ ID NO: 6622 - protein, 16 aa, Homo sapiens
  heavy chain complementarity determining region 3 for antibody 3311
ARGFSRSSTGVSYMDV

SEQ ID NO: 6623 - protein, 9 aa, Homo sapiens
  light chain complementarity determining region 3 for antibody 3312
QQSYSTPRT

SEQ ID NO: 6624 - protein, 16 aa, Homo sapiens
  heavy chain complementarity determining region 3 for antibody 3312
VRDLAGFTRGGSPFDY

SEQ ID NO: 6625 - protein, 9 aa, Homo sapiens
  light chain complementarity determining region 3 for antibody 3313
QQSYSTPRT

SEQ ID NO: 6626 - protein, 13 aa, Homo sapiens
  heavy chain complementarity determining region 3 for antibody 3313
AKEGSAPGPDFEY

SEQ ID NO: 6627 - protein, 10 aa, Homo sapiens
  light chain complementarity determining region 3 for antibody 3314
QQSYSTPPYT

SEQ ID NO: 6628 - protein, 17 aa, Homo sapiens
  heavy chain complementarity determining region 3 for antibody 3314
VSERYGSGLYHCCAFEI

SEQ ID NO: 6629 - protein, 11 aa, Homo sapiens
  light chain complementarity determining region 3 for antibody 3315
QQSYSTPPRLT

SEQ ID NO: 6630 - protein, 13 aa, Homo sapiens
  heavy chain complementarity determining region 3 for antibody 3315
TKEGSAAGPDFVY

SEQ ID NO: 6631 - protein, 9 aa, Homo sapiens
  light chain complementarity determining region 3 for antibody 3316
QQSYSTPLT

SEQ ID NO: 6632 - protein, 13 aa, Homo sapiens
  heavy chain complementarity determining region 3 for antibody 3316
AKEGSSPGPDFEY

SEQ ID NO: 6633 - protein, 9 aa, Homo sapiens
  light chain complementarity determining region 3 for antibody 3317
QQSYSTPLT

SEQ ID NO: 6634 - protein, 13 aa, Homo sapiens
  heavy chain complementarity determining region 3 for antibody 3317
AKEGSAAGPDFDY

SEQ ID NO: 6635 - protein, 10 aa, Homo sapiens
  light chain complementarity determining region 3 for antibody 3318
QQSYSTPLFT

SEQ ID NO: 6636 - protein, 15 aa, Homo sapiens
  heavy chain complementarity determining region 3 for antibody 3318
ARVGRPYHNAWSFDN

SEQ ID NO: 6637 - protein, 10 aa, Homo sapiens
  light chain complementarity determining region 3 for antibody 3319
QQSYSTPLFT

SEQ ID NO: 6638 - protein, 15 aa, Homo sapiens
  heavy chain complementarity determining region 3 for antibody 3319
ARVGRPYHNAGYFDN

SEQ ID NO: 6639 - protein, 10 aa, Homo sapiens
  light chain complementarity determining region 3 for antibody 3320
QQSYSTPLFT

SEQ ID NO: 6640 - protein, 15 aa, Homo sapiens
  heavy chain complementarity determining region 3 for antibody 3320
ARVGRAYHNAWYFDN

SEQ ID NO: 6641 - protein, 10 aa, Homo sapiens
  light chain complementarity determining region 3 for antibody 3321
QQSYSTPLFT

SEQ ID NO: 6642 - protein, 10 aa, Homo sapiens
  heavy chain complementarity determining region 3 for antibody 3321
ARERSGSYDI

SEQ ID NO: 6643 - protein, 9 aa, Homo sapiens
  light chain complementarity determining region 3 for antibody 3322
QQSYSTPFT

SEQ ID NO: 6644 - protein, 14 aa, Homo sapiens
  heavy chain complementarity determining region 3 for antibody 3322
ARGHFDTTGFRLDY

SEQ ID NO: 6645 - protein, 8 aa, Homo sapiens
  light chain complementarity determining region 3 for antibody 3323
QQSYSSPT

SEQ ID NO: 6646 - protein, 17 aa, Homo sapiens
  heavy chain complementarity determining region 3 for antibody 3323
AKGRGSVAMALRYYLDL

SEQ ID NO: 6647 - protein, 8 aa, Homo sapiens
  light chain complementarity determining region 3 for antibody 3324
QQSYSSPT

SEQ ID NO: 6648 - protein, 17 aa, Homo sapiens
  heavy chain complementarity determining region 3 for antibody 3324
AKGRGSVAMALIYYLDV

SEQ ID NO: 6649 - protein, 8 aa, Homo sapiens
  light chain complementarity determining region 3 for antibody 3325
QQSYSSPT

SEQ ID NO: 6650 - protein, 17 aa, Homo sapiens
  heavy chain complementarity determining region 3 for antibody 3325
AKGRGSVAMALIYYLDF

SEQ ID NO: 6651 - protein, 9 aa, Homo sapiens
  light chain complementarity determining region 3 for antibody 3326
QQSYSSPRT

SEQ ID NO: 6652 - protein, 12 aa, Homo sapiens
  heavy chain complementarity determining region 3 for antibody 3326
TSSSSGGGSVDF

SEQ ID NO: 6653 - protein, 9 aa, Homo sapiens
  light chain complementarity determining region 3 for antibody 3327
QQSYSNPRT

SEQ ID NO: 6654 - protein, 16 aa, Homo sapiens
  heavy chain complementarity determining region 3 for antibody 3327
ARDFSFSSTSVWYFDL

SEQ ID NO: 6655 - protein, 10 aa, Homo sapiens
  light chain complementarity determining region 3 for antibody 3328
QQSYSAPALT

SEQ ID NO: 6656 - protein, 15 aa, Homo sapiens
  heavy chain complementarity determining region 3 for antibody 3328
TTDYFFEGYSYGYSY

SEQ ID NO: 6657 - protein, 9 aa, Homo sapiens
  light chain complementarity determining region 3 for antibody 3329
QQSYPMPRT

SEQ ID NO: 6658 - protein, 18 aa, Homo sapiens
  heavy chain complementarity determining region 3 for antibody 3329
TTVLSQLLAGDWHLYFQH

SEQ ID NO: 6659 - protein, 9 aa, Homo sapiens
  light chain complementarity determining region 3 for antibody 3330
QQSSNTPLT

SEQ ID NO: 6660 - protein, 14 aa, Homo sapiens
  heavy chain complementarity determining region 3 for antibody 3330
ARGHFDSTGFRLDY

SEQ ID NO: 6661 - protein, 9 aa, Homo sapiens
  light chain complementarity determining region 3 for antibody 3331
QQRSYWPLT

SEQ ID NO: 6662 - protein, 9 aa, Homo sapiens
  heavy chain complementarity determining region 3 for antibody 3331
AGWGGTSNY

SEQ ID NO: 6663 - protein, 9 aa, Homo sapiens
  light chain complementarity determining region 3 for antibody 3332
QQRSNWPPT

SEQ ID NO: 6664 - protein, 10 aa, Homo sapiens
  heavy chain complementarity determining region 3 for antibody 3332
AHRINRAFDI

SEQ ID NO: 6665 - protein, 10 aa, Homo sapiens
  light chain complementarity determining region 3 for antibody 3333
QQRSNWPPST

SEQ ID NO: 6666 - protein, 12 aa, Homo sapiens
  heavy chain complementarity determining region 3 for antibody 3333
TREYSSGWYPGY

SEQ ID NO: 6667 - protein, 9 aa, Homo sapiens
  light chain complementarity determining region 3 for antibody 3334
QQRSNWPLT

SEQ ID NO: 6668 - protein, 11 aa, Homo sapiens
  heavy chain complementarity determining region 3 for antibody 3334
VRVSTGWNFDY

SEQ ID NO: 6669 - protein, 9 aa, Homo sapiens
  light chain complementarity determining region 3 for antibody 3335
QQRSNWPLT

SEQ ID NO: 6670 - protein, 12 aa, Homo sapiens
  heavy chain complementarity determining region 3 for antibody 3335
NADHGYVDGFDI

SEQ ID NO: 6671 - protein, 10 aa, Homo sapiens
  light chain complementarity determining region 3 for antibody 3336
QQRSDWPRLT

SEQ ID NO: 6672 - protein, 21 aa, Homo sapiens
  heavy chain complementarity determining region 3 for antibody 3336
ARWGAGFYDSRGNYYGRGIDC

SEQ ID NO: 6673 - protein, 10 aa, Homo sapiens
  light chain complementarity determining region 3 for antibody 3337
QQRKNWPPLT

SEQ ID NO: 6674 - protein, 15 aa, Homo sapiens
  heavy chain complementarity determining region 3 for antibody 3337
AKAFFERGFGETLEF

SEQ ID NO: 6675 - protein, 9 aa, Homo sapiens
  light chain complementarity determining region 3 for antibody 3338
QQRGSWPPP

SEQ ID NO: 6676 - protein, 14 aa, Homo sapiens
  heavy chain complementarity determining region 3 for antibody 3338
AKGMTTWYLMVVDY

SEQ ID NO: 6677 - protein, 9 aa, Homo sapiens
  light chain complementarity determining region 3 for antibody 3339
QQNNSYPWT

SEQ ID NO: 6678 - protein, 15 aa, Homo sapiens
  heavy chain complementarity determining region 3 for antibody 3339
GKEGPGSSGWLTGHY

SEQ ID NO: 6679 - protein, 9 aa, Homo sapiens
  light chain complementarity determining region 3 for antibody 3340
QQLYRYPLT

SEQ ID NO: 6680 - protein, 14 aa, Homo sapiens
  heavy chain complementarity determining region 3 for antibody 3340
GRDTTHDWSDGGIY

SEQ ID NO: 6681 - protein, 9 aa, Homo sapiens
  light chain complementarity determining region 3 for antibody 3341
QQLTSYPYT

SEQ ID NO: 6682 - protein, 14 aa, Homo sapiens
  heavy chain complementarity determining region 3 for antibody 3341
ARGHFDSTGFRLDY

SEQ ID NO: 6683 - protein, 9 aa, Homo sapiens
  light chain complementarity determining region 3 for antibody 3342
QQLSNLPRT

SEQ ID NO: 6684 - protein, 13 aa, Homo sapiens
  heavy chain complementarity determining region 3 for antibody 3342
AKEGSSPGPDFDS

SEQ ID NO: 6685 - protein, 9 aa, Homo sapiens
  light chain complementarity determining region 3 for antibody 3343
QQLSNAPLT

SEQ ID NO: 6686 - protein, 12 aa, Homo sapiens
  heavy chain complementarity determining region 3 for antibody 3343
ARDKGGRNGMDV

SEQ ID NO: 6687 - protein, 9 aa, Homo sapiens
  light chain complementarity determining region 3 for antibody 3344
QQLSNAPLT

SEQ ID NO: 6688 - protein, 17 aa, Homo sapiens
  heavy chain complementarity determining region 3 for antibody 3344
AKRLPDPLGGGHHYIDV

SEQ ID NO: 6689 - protein, 9 aa, Homo sapiens
  light chain complementarity determining region 3 for antibody 3345
QQLSNAPLT

SEQ ID NO: 6690 - protein, 17 aa, Homo sapiens
  heavy chain complementarity determining region 3 for antibody 3345
AKRLPDLLGGGHHYIGV

SEQ ID NO: 6691 - protein, 9 aa, Homo sapiens
  light chain complementarity determining region 3 for antibody 3346
QQLSNAPLT

SEQ ID NO: 6692 - protein, 17 aa, Homo sapiens
  heavy chain complementarity determining region 3 for antibody 3346
AKRLPDLLEGGHHYIDV

SEQ ID NO: 6693 - protein, 9 aa, Homo sapiens
  light chain complementarity determining region 3 for antibody 3347
QQLRNAPLT

SEQ ID NO: 6694 - protein, 17 aa, Homo sapiens
  heavy chain complementarity determining region 3 for antibody 3347
AKRLPDLLGGGHHYIDV

SEQ ID NO: 6695 - protein, 9 aa, Homo sapiens
  light chain complementarity determining region 3 for antibody 3348
QQLNTYPLT

SEQ ID NO: 6696 - protein, 13 aa, Homo sapiens
  heavy chain complementarity determining region 3 for antibody 3348
PREGDSSGPDFHL

SEQ ID NO: 6697 - protein, 9 aa, Homo sapiens
  light chain complementarity determining region 3 for antibody 3349
QQLNSYPYT

SEQ ID NO: 6698 - protein, 9 aa, Homo sapiens
  heavy chain complementarity determining region 3 for antibody 3349
ARSEYQPTY

SEQ ID NO: 6699 - protein, 9 aa, Homo sapiens
  light chain complementarity determining region 3 for antibody 3350
QQLNSYPYT

SEQ ID NO: 6700 - protein, 14 aa, Homo sapiens
  heavy chain complementarity determining region 3 for antibody 3350
ARGHFDSTGVRLDY

SEQ ID NO: 6701 - protein, 9 aa, Homo sapiens
  light chain complementarity determining region 3 for antibody 3351
QQLNSYPYT

SEQ ID NO: 6702 - protein, 14 aa, Homo sapiens
  heavy chain complementarity determining region 3 for antibody 3351
ARGHFDSAGFRLDY

SEQ ID NO: 6703 - protein, 9 aa, Homo sapiens
  light chain complementarity determining region 3 for antibody 3352
QQLNSYPYT

SEQ ID NO: 6704 - protein, 10 aa, Homo sapiens
  heavy chain complementarity determining region 3 for antibody 3352
ARETAGAYDI

SEQ ID NO: 6705 - protein, 9 aa, Homo sapiens
  light chain complementarity determining region 3 for antibody 3353
QQLNSYPYP

SEQ ID NO: 6706 - protein, 14 aa, Homo sapiens
  heavy chain complementarity determining region 3 for antibody 3353
ARGHFDSTGFRLDY

SEQ ID NO: 6707 - protein, 9 aa, Homo sapiens
  light chain complementarity determining region 3 for antibody 3354
QQLNSSPYT

SEQ ID NO: 6708 - protein, 14 aa, Homo sapiens
  heavy chain complementarity determining region 3 for antibody 3354
ARGRFDSTGFRLDY

SEQ ID NO: 6709 - protein, 9 aa, Homo sapiens
  light chain complementarity determining region 3 for antibody 3355
QQLNSSPYT

SEQ ID NO: 6710 - protein, 14 aa, Homo sapiens
  heavy chain complementarity determining region 3 for antibody 3355
ARGHFDSTGVRLDY

SEQ ID NO: 6711 - protein, 9 aa, Homo sapiens
  light chain complementarity determining region 3 for antibody 3356
QQLNSSPYT

SEQ ID NO: 6712 - protein, 14 aa, Homo sapiens
  heavy chain complementarity determining region 3 for antibody 3356
ARGHFDSTGCRLDY

SEQ ID NO: 6713 - protein, 9 aa, Homo sapiens
  light chain complementarity determining region 3 for antibody 3357
QQLMVYPYP

SEQ ID NO: 6714 - protein, 14 aa, Homo sapiens
  heavy chain complementarity determining region 3 for antibody 3357
TRGHFDSTGFRLDY

SEQ ID NO: 6715 - protein, 9 aa, Homo sapiens
  light chain complementarity determining region 3 for antibody 3358
QQLMVYPST

SEQ ID NO: 6716 - protein, 14 aa, Homo sapiens
  heavy chain complementarity determining region 3 for antibody 3358
TRGHFDSTGFRLDY

SEQ ID NO: 6717 - protein, 9 aa, Homo sapiens
  light chain complementarity determining region 3 for antibody 3359
QQLMASPYT

SEQ ID NO: 6718 - protein, 14 aa, Homo sapiens
  heavy chain complementarity determining region 3 for antibody 3359
TRGHFDSTGFRLDY

SEQ ID NO: 6719 - protein, 9 aa, Homo sapiens
  light chain complementarity determining region 3 for antibody 3360
QQLHSYPYT

SEQ ID NO: 6720 - protein, 14 aa, Homo sapiens
  heavy chain complementarity determining region 3 for antibody 3360
ARGHFDSTGLRLDY

SEQ ID NO: 6721 - protein, 9 aa, Homo sapiens
  light chain complementarity determining region 3 for antibody 3361
QQLHSYPYP

SEQ ID NO: 6722 - protein, 14 aa, Homo sapiens
  heavy chain complementarity determining region 3 for antibody 3361
ARGHFDSTGFRLDY

SEQ ID NO: 6723 - protein, 9 aa, Homo sapiens
  light chain complementarity determining region 3 for antibody 3362
QQLHRSPYT

SEQ ID NO: 6724 - protein, 14 aa, Homo sapiens
  heavy chain complementarity determining region 3 for antibody 3362
ARGDFDSTGFRLDY

SEQ ID NO: 6725 - protein, 9 aa, Homo sapiens
  light chain complementarity determining region 3 for antibody 3363
QQINSYPYT

SEQ ID NO: 6726 - protein, 14 aa, Homo sapiens
  heavy chain complementarity determining region 3 for antibody 3363
ARGHFDSTGFRLDY

SEQ ID NO: 6727 - protein, 9 aa, Homo sapiens
  light chain complementarity determining region 3 for antibody 3364
QQHYETPYT

SEQ ID NO: 6728 - protein, 18 aa, Homo sapiens
  heavy chain complementarity determining region 3 for antibody 3364
ARAADCIGDKCYQSHFDF

SEQ ID NO: 6729 - protein, 9 aa, Homo sapiens
  light chain complementarity determining region 3 for antibody 3365
QQFSSFPRT

SEQ ID NO: 6730 - protein, 9 aa, Homo sapiens
  heavy chain complementarity determining region 3 for antibody 3365
ARGRDNFRY

SEQ ID NO: 6731 - protein, 9 aa, Homo sapiens
  light chain complementarity determining region 3 for antibody 3366
QQFSNLPRT

SEQ ID NO: 6732 - protein, 13 aa, Homo sapiens
  heavy chain complementarity determining region 3 for antibody 3366
VKEGSSPGPDFDS

SEQ ID NO: 6733 - protein, 9 aa, Homo sapiens
  light chain complementarity determining region 3 for antibody 3367
QQFSNLPRT

SEQ ID NO: 6734 - protein, 10 aa, Homo sapiens
  heavy chain complementarity determining region 3 for antibody 3367
CRDREGFGDV

SEQ ID NO: 6735 - protein, 9 aa, Homo sapiens
  light chain complementarity determining region 3 for antibody 3368
QQFSNLPRT

SEQ ID NO: 6736 - protein, 13 aa, Homo sapiens
  heavy chain complementarity determining region 3 for antibody 3368
AKGGSSPGPDFDS

SEQ ID NO: 6737 - protein, 9 aa, Homo sapiens
  light chain complementarity determining region 3 for antibody 3369
QQFSNLPRT

SEQ ID NO: 6738 - protein, 13 aa, Homo sapiens
  heavy chain complementarity determining region 3 for antibody 3369
AKEGSSPGADFDS

SEQ ID NO: 6739 - protein, 9 aa, Homo sapiens
  light chain complementarity determining region 3 for antibody 3370
QQFSNLPRT

SEQ ID NO: 6740 - protein, 13 aa, Homo sapiens
  heavy chain complementarity determining region 3 for antibody 3370
AKEGSPPGPDFDS

SEQ ID NO: 6741 - protein, 9 aa, Homo sapiens
  light chain complementarity determining region 3 for antibody 3371
QQFSNLPRT

SEQ ID NO: 6742 - protein, 13 aa, Homo sapiens
  heavy chain complementarity determining region 3 for antibody 3371
AEEGSSPGPDFDS

SEQ ID NO: 6743 - protein, 9 aa, Homo sapiens
  light chain complementarity determining region 3 for antibody 3372
QQFRDLPRT

SEQ ID NO: 6744 - protein, 9 aa, Homo sapiens
  heavy chain complementarity determining region 3 for antibody 3372
ARGRSNFSH

SEQ ID NO: 6745 - protein, 9 aa, Homo sapiens
  light chain complementarity determining region 3 for antibody 3373
QQFNSYPYT

SEQ ID NO: 6746 - protein, 15 aa, Homo sapiens
  heavy chain complementarity determining region 3 for antibody 3373
ARIWTSSTNCRYMDV

SEQ ID NO: 6747 - protein, 9 aa, Homo sapiens
  light chain complementarity determining region 3 for antibody 3374
QQFNSYPLT

SEQ ID NO: 6748 - protein, 16 aa, Homo sapiens
  heavy chain complementarity determining region 3 for antibody 3374
ARGGLLWSGELTWFDP

SEQ ID NO: 6749 - protein, 9 aa, Homo sapiens
  light chain complementarity determining region 3 for antibody 3375
QQDYYTPRT

SEQ ID NO: 6750 - protein, 11 aa, Homo sapiens
  heavy chain complementarity determining region 3 for antibody 3375
ARRALGGAFDY

SEQ ID NO: 6751 - protein, 9 aa, Homo sapiens
  light chain complementarity determining region 3 for antibody 3376
QQDYNIPFT

SEQ ID NO: 6752 - protein, 14 aa, Homo sapiens
  heavy chain complementarity determining region 3 for antibody 3376
AKGRIASCYDASDI

SEQ ID NO: 6753 - protein, 9 aa, Homo sapiens
  light chain complementarity determining region 3 for antibody 3377
QQCGSSPLT

SEQ ID NO: 6754 - protein, 19 aa, Homo sapiens
  heavy chain complementarity determining region 3 for antibody 3377
ASWAGYCPSTNCHTTTFDY

SEQ ID NO: 6755 - protein, 10 aa, Homo sapiens
  light chain complementarity determining region 3 for antibody 3378
QQCGNWPQCP

SEQ ID NO: 6756 - protein, 12 aa, Homo sapiens
  heavy chain complementarity determining region 3 for antibody 3378
AKPAYGSGSPDY

SEQ ID NO: 6757 - protein, 9 aa, Homo sapiens
  light chain complementarity determining region 3 for antibody 3379
QQAYSSPWT

SEQ ID NO: 6758 - protein, 15 aa, Homo sapiens
  heavy chain complementarity determining region 3 for antibody 3379
ARIWTSSTNCRYMDV

SEQ ID NO: 6759 - protein, 9 aa, Homo sapiens
  light chain complementarity determining region 3 for antibody 3380
QQANSLPLT

SEQ ID NO: 6760 - protein, 17 aa, Homo sapiens
  heavy chain complementarity determining region 3 for antibody 3380
ARGIGIGSGSYYADFDY

SEQ ID NO: 6761 - protein, 9 aa, Homo sapiens
  light chain complementarity determining region 3 for antibody 3381
QQANSFPYT

SEQ ID NO: 6762 - protein, 10 aa, Homo sapiens
  heavy chain complementarity determining region 3 for antibody 3381
ATHNDYNMAY

SEQ ID NO: 6763 - protein, 9 aa, Homo sapiens
  light chain complementarity determining region 3 for antibody 3382
QQADSFPYT

SEQ ID NO: 6764 - protein, 16 aa, Homo sapiens
  heavy chain complementarity determining region 3 for antibody 3382
ARDQGLGYGVPDGCDI

SEQ ID NO: 6765 - protein, 7 aa, Homo sapiens
  light chain complementarity determining region 3 for antibody 3383
QPYNTWT

SEQ ID NO: 6766 - protein, 12 aa, Homo sapiens
  heavy chain complementarity determining region 3 for antibody 3383
ARDKGGRNGMDV

SEQ ID NO: 6767 - protein, 9 aa, Homo sapiens
  light chain complementarity determining region 3 for antibody 3384
QPYNSYPWT

SEQ ID NO: 6768 - protein, 15 aa, Homo sapiens
  heavy chain complementarity determining region 3 for antibody 3384
GKEGPGSSGWLTGHY

SEQ ID NO: 6769 - protein, 9 aa, Homo sapiens
  light chain complementarity determining region 3 for antibody 3385
QNYNTAPWT

SEQ ID NO: 6770 - protein, 16 aa, Homo sapiens
  heavy chain complementarity determining region 3 for antibody 3385
TRDIGWGDSGPRGMDV

SEQ ID NO: 6771 - protein, 9 aa, Homo sapiens
  light chain complementarity determining region 3 for antibody 3386
QLSYSTPST

SEQ ID NO: 6772 - protein, 16 aa, Homo sapiens
  heavy chain complementarity determining region 3 for antibody 3386
ARWFSRSSTGVSYMDV

SEQ ID NO: 6773 - protein, 9 aa, Homo sapiens
  light chain complementarity determining region 3 for antibody 3387
QLSGSSLLT

SEQ ID NO: 6774 - protein, 12 aa, Homo sapiens
  heavy chain complementarity determining region 3 for antibody 3387
ARLDWNYRAFDI

SEQ ID NO: 6775 - protein, 9 aa, Homo sapiens
  light chain complementarity determining region 3 for antibody 3388
QLSGSSLLT

SEQ ID NO: 6776 - protein, 12 aa, Homo sapiens
  heavy chain complementarity determining region 3 for antibody 3388
ALDEWHPSWCKY

SEQ ID NO: 6777 - protein, 9 aa, Homo sapiens
  light chain complementarity determining region 3 for antibody 3389
QLFGSSLLT

SEQ ID NO: 6778 - protein, 12 aa, Homo sapiens
  heavy chain complementarity determining region 3 for antibody 3389
ALDEWHPSWYKY

SEQ ID NO: 6779 - protein, 9 aa, Homo sapiens
  light chain complementarity determining region 3 for antibody 3390
QKYNSAPWT

SEQ ID NO: 6780 - protein, 15 aa, Homo sapiens
  heavy chain complementarity determining region 3 for antibody 3390
ARQVTGATKVRHFDY

SEQ ID NO: 6781 - protein, 9 aa, Homo sapiens
  light chain complementarity determining region 3 for antibody 3391
QKYKTVPWT

SEQ ID NO: 6782 - protein, 20 aa, Homo sapiens
  heavy chain complementarity determining region 3 for antibody 3391
AKDGRGTAFYHGAGGGGLDV

SEQ ID NO: 6783 - protein, 9 aa, Homo sapiens
  light chain complementarity determining region 3 for antibody 3392
QKYGSSPVP

SEQ ID NO: 6784 - protein, 18 aa, Homo sapiens
  heavy chain complementarity determining region 3 for antibody 3392
ARGDYPEARTGYLLDFDY

SEQ ID NO: 6785 - protein, 9 aa, Homo sapiens
  light chain complementarity determining region 3 for antibody 3393
QKYGSSPVP

SEQ ID NO: 6786 - protein, 18 aa, Homo sapiens
  heavy chain complementarity determining region 3 for antibody 3393
ARGDYPEARIGYFLDFDY

SEQ ID NO: 6787 - protein, 9 aa, Homo sapiens
  light chain complementarity determining region 3 for antibody 3394
QKYGSSPVP

SEQ ID NO: 6788 - protein, 18 aa, Homo sapiens
  heavy chain complementarity determining region 3 for antibody 3394
ARGDDPEARTGYFLDFDY

SEQ ID NO: 6789 - protein, 9 aa, Homo sapiens
  light chain complementarity determining region 3 for antibody 3395
QKYGDSPGP

SEQ ID NO: 6790 - protein, 18 aa, Homo sapiens
  heavy chain complementarity determining region 3 for antibody 3395
ARGDYPEGRTGYFLDFDY

SEQ ID NO: 6791 - protein, 9 aa, Homo sapiens
  light chain complementarity determining region 3 for antibody 3396
QKLSNAPLT

SEQ ID NO: 6792 - protein, 17 aa, Homo sapiens
  heavy chain complementarity determining region 3 for antibody 3396
AKRLPDLLGGGHHYIDV

SEQ ID NO: 6793 - protein, 9 aa, Homo sapiens
  light chain complementarity determining region 3 for antibody 3397
QHYNGYPIT

SEQ ID NO: 6794 - protein, 16 aa, Homo sapiens
  heavy chain complementarity determining region 3 for antibody 3397
TRGGTATSRYFDPMDV

SEQ ID NO: 6795 - protein, 10 aa, Homo sapiens
  light chain complementarity determining region 3 for antibody 3398
QHYGSSQGIT

SEQ ID NO: 6796 - protein, 17 aa, Homo sapiens
  heavy chain complementarity determining region 3 for antibody 3398
ARGTGIGAGSYYADFDY

SEQ ID NO: 6797 - protein, 10 aa, Homo sapiens
  light chain complementarity determining region 3 for antibody 3399
QHYGSSQGIP

SEQ ID NO: 6798 - protein, 17 aa, Homo sapiens
  heavy chain complementarity determining region 3 for antibody 3399
ARGTGIGSGSYYADFDY

SEQ ID NO: 6799 - protein, 10 aa, Homo sapiens
  light chain complementarity determining region 3 for antibody 3400
QHYGSSPGIT

SEQ ID NO: 6800 - protein, 17 aa, Homo sapiens
  heavy chain complementarity determining region 3 for antibody 3400
ARGTGIGSGSYYADFDY

SEQ ID NO: 6801 - protein, 9 aa, Homo sapiens
  light chain complementarity determining region 3 for antibody 3401
QHYGSSPDT

SEQ ID NO: 6802 - protein, 17 aa, Homo sapiens
  heavy chain complementarity determining region 3 for antibody 3401
ARNTMVGTWQRQGNLDH

SEQ ID NO: 6803 - protein, 8 aa, Homo sapiens
  light chain complementarity determining region 3 for antibody 3402
QHYGNSFP

SEQ ID NO: 6804 - protein, 16 aa, Homo sapiens
  heavy chain complementarity determining region 3 for antibody 3402
AIWAGLSSGWSGPFDF

SEQ ID NO: 6805 - protein, 9 aa, Homo sapiens
  light chain complementarity determining region 3 for antibody 3403
QHSYNTPRT

SEQ ID NO: 6806 - protein, 20 aa, Homo sapiens
  heavy chain complementarity determining region 3 for antibody 3403
TREGNLGSAGGGYSYFGLDV

SEQ ID NO: 6807 - protein, 9 aa, Homo sapiens
  light chain complementarity determining region 3 for antibody 3404
QHSYNTPRT

SEQ ID NO: 6808 - protein, 11 aa, Homo sapiens
  heavy chain complementarity determining region 3 for antibody 3404
AREQHGQAPDY

SEQ ID NO: 6809 - protein, 10 aa, Homo sapiens
  light chain complementarity determining region 3 for antibody 3405
QHSFSTPPWT

SEQ ID NO: 6810 - protein, 13 aa, Homo sapiens
  heavy chain complementarity determining region 3 for antibody 3405
ASLRRDNSGHFNY

SEQ ID NO: 6811 - protein, 9 aa, Homo sapiens
  light chain complementarity determining region 3 for antibody 3406
QEYSTYSRP

SEQ ID NO: 6812 - protein, 15 aa, Homo sapiens
  heavy chain complementarity determining region 3 for antibody 3406
ARDCISTNCYLIFDN

SEQ ID NO: 6813 - protein, 9 aa, Homo sapiens
  light chain complementarity determining region 3 for antibody 3407
QEYRTYSRT

SEQ ID NO: 6814 - protein, 15 aa, Homo sapiens
  heavy chain complementarity determining region 3 for antibody 3407
ARDCISTNCYLIFDN

SEQ ID NO: 6815 - protein, 9 aa, Homo sapiens
  light chain complementarity determining region 3 for antibody 3408
QERSTWPGS

SEQ ID NO: 6816 - protein, 12 aa, Homo sapiens
  heavy chain complementarity determining region 3 for antibody 3408
ARDKGGRNGMDV

SEQ ID NO: 6817 - protein, 9 aa, Homo sapiens
  light chain complementarity determining region 3 for antibody 3409
QERRTWPGS

SEQ ID NO: 6818 - protein, 13 aa, Homo sapiens
  heavy chain complementarity determining region 3 for antibody 3409
ATGAWGSSWWGDY

SEQ ID NO: 6819 - protein, 9 aa, Homo sapiens
  light chain complementarity determining region 3 for antibody 3410
PQHNSYPLT

SEQ ID NO: 6820 - protein, 11 aa, Homo sapiens
  heavy chain complementarity determining region 3 for antibody 3410
VRVSTGWNFDY

SEQ ID NO: 6821 - protein, 9 aa, Homo sapiens
  light chain complementarity determining region 3 for antibody 3411
PEYKTVPWT

SEQ ID NO: 6822 - protein, 20 aa, Homo sapiens
  heavy chain complementarity determining region 3 for antibody 3411
AKDGRGTAFYHGAGGGGLDV

SEQ ID NO: 6823 - protein, 9 aa, Homo sapiens
  light chain complementarity determining region 3 for antibody 3412
MQYEHGPHT

SEQ ID NO: 6824 - protein, 8 aa, Homo sapiens
  heavy chain complementarity determining region 3 for antibody 3412
AGWGYGNY

SEQ ID NO: 6825 - protein, 9 aa, Homo sapiens
  light chain complementarity determining region 3 for antibody 3413
MQTVQTPWT

SEQ ID NO: 6826 - protein, 12 aa, Homo sapiens
  heavy chain complementarity determining region 3 for antibody 3413
ARLDWSYRAFDI

SEQ ID NO: 6827 - protein, 9 aa, Homo sapiens
  light chain complementarity determining region 3 for antibody 3414
MQTLQTPWT

SEQ ID NO: 6828 - protein, 12 aa, Homo sapiens
  heavy chain complementarity determining region 3 for antibody 3414
ARLDWNYWAFDI

SEQ ID NO: 6829 - protein, 9 aa, Homo sapiens
  light chain complementarity determining region 3 for antibody 3415
MQTLQTPWT

SEQ ID NO: 6830 - protein, 12 aa, Homo sapiens
  heavy chain complementarity determining region 3 for antibody 3415
ARLDWNYGAFDI

SEQ ID NO: 6831 - protein, 9 aa, Homo sapiens
  light chain complementarity determining region 3 for antibody 3416
MQTLQTPWT

SEQ ID NO: 6832 - protein, 12 aa, Homo sapiens
  heavy chain complementarity determining region 3 for antibody 3416
ARLDWNHRAFDI

SEQ ID NO: 6833 - protein, 9 aa, Homo sapiens
  light chain complementarity determining region 3 for antibody 3417
MQTLQTPWT

SEQ ID NO: 6834 - protein, 13 aa, Homo sapiens
  heavy chain complementarity determining region 3 for antibody 3417
AKEGSSPGPDFDS

SEQ ID NO: 6835 - protein, 9 aa, Homo sapiens
  light chain complementarity determining region 3 for antibody 3418
MQTLQTPWT

SEQ ID NO: 6836 - protein, 12 aa, Homo sapiens
  heavy chain complementarity determining region 3 for antibody 3418
AIVVPGRWDLDD

SEQ ID NO: 6837 - protein, 9 aa, Homo sapiens
  light chain complementarity determining region 3 for antibody 3419
MQTLQTPVT

SEQ ID NO: 6838 - protein, 17 aa, Homo sapiens
  heavy chain complementarity determining region 3 for antibody 3419
ARNTMVGAWQRQGNLDH

SEQ ID NO: 6839 - protein, 9 aa, Homo sapiens
  light chain complementarity determining region 3 for antibody 3420
MQTLQTPGR

SEQ ID NO: 6840 - protein, 12 aa, Homo sapiens
  heavy chain complementarity determining region 3 for antibody 3420
ARLDWNYRAFDI

SEQ ID NO: 6841 - protein, 6 aa, Homo sapiens
  light chain complementarity determining region 3 for antibody 3421
MQSTNG

SEQ ID NO: 6842 - protein, 19 aa, Homo sapiens
  heavy chain complementarity determining region 3 for antibody 3421
ARERVRCRSGICYDATFDI

SEQ ID NO: 6843 - protein, 9 aa, Homo sapiens
  light chain complementarity determining region 3 for antibody 3422
MQSLQTPWT

SEQ ID NO: 6844 - protein, 12 aa, Homo sapiens
  heavy chain complementarity determining region 3 for antibody 3422
ARLDWNYRAFDI

SEQ ID NO: 6845 - protein, 9 aa, Homo sapiens
  light chain complementarity determining region 3 for antibody 3423
MQNTNWPPT

SEQ ID NO: 6846 - protein, 19 aa, Homo sapiens
  heavy chain complementarity determining region 3 for antibody 3423
ARERVRCRTGICYDATFDI

SEQ ID NO: 6847 - protein, 9 aa, Homo sapiens
  light chain complementarity determining region 3 for antibody 3424
MQGTYWPYT

SEQ ID NO: 6848 - protein, 11 aa, Homo sapiens
  heavy chain complementarity determining region 3 for antibody 3424
ARDTWGSLLDY

SEQ ID NO: 6849 - protein, 9 aa, Homo sapiens
  light chain complementarity determining region 3 for antibody 3425
MQGTQWPHT

SEQ ID NO: 6850 - protein, 11 aa, Homo sapiens
  heavy chain complementarity determining region 3 for antibody 3425
ATFGQQWRLAH

SEQ ID NO: 6851 - protein, 9 aa, Homo sapiens
  light chain complementarity determining region 3 for antibody 3426
MQGTHWPWT

SEQ ID NO: 6852 - protein, 12 aa, Homo sapiens
  heavy chain complementarity determining region 3 for antibody 3426
AIVVPGRWVLDD

SEQ ID NO: 6853 - protein, 9 aa, Homo sapiens
  light chain complementarity determining region 3 for antibody 3427
MQGTHWPWT

SEQ ID NO: 6854 - protein, 12 aa, Homo sapiens
  heavy chain complementarity determining region 3 for antibody 3427
AIVVPGRRDLDD

SEQ ID NO: 6855 - protein, 9 aa, Homo sapiens
  light chain complementarity determining region 3 for antibody 3428
MQGTHWPPS

SEQ ID NO: 6856 - protein, 16 aa, Homo sapiens
  heavy chain complementarity determining region 3 for antibody 3428
AADLGDHADAYATLDS

SEQ ID NO: 6857 - protein, 9 aa, Homo sapiens
  light chain complementarity determining region 3 for antibody 3429
MQGTHWPIN

SEQ ID NO: 6858 - protein, 13 aa, Homo sapiens
  heavy chain complementarity determining region 3 for antibody 3429
AKEGSSAGPDLDY

SEQ ID NO: 6859 - protein, 9 aa, Homo sapiens
  light chain complementarity determining region 3 for antibody 3430
MQGTHWPHT

SEQ ID NO: 6860 - protein, 11 aa, Homo sapiens
  heavy chain complementarity determining region 3 for antibody 3430
ATFRQQWRLAH

SEQ ID NO: 6861 - protein, 9 aa, Homo sapiens
  light chain complementarity determining region 3 for antibody 3431
MQGTHWPHT

SEQ ID NO: 6862 - protein, 11 aa, Homo sapiens
  heavy chain complementarity determining region 3 for antibody 3431
ATFGQQWRRAH

SEQ ID NO: 6863 - protein, 9 aa, Homo sapiens
  light chain complementarity determining region 3 for antibody 3432
MQGTHWPHT

SEQ ID NO: 6864 - protein, 11 aa, Homo sapiens
  heavy chain complementarity determining region 3 for antibody 3432
ATFGQQWRPAH

SEQ ID NO: 6865 - protein, 9 aa, Homo sapiens
  light chain complementarity determining region 3 for antibody 3433
MQGTHWPHT

SEQ ID NO: 6866 - protein, 14 aa, Homo sapiens
  heavy chain complementarity determining region 3 for antibody 3433
ARGHFDSTGFRLDY

SEQ ID NO: 6867 - protein, 9 aa, Homo sapiens
  light chain complementarity determining region 3 for antibody 3434
MQGTHWPHN

SEQ ID NO: 6868 - protein, 11 aa, Homo sapiens
  heavy chain complementarity determining region 3 for antibody 3434
ATFGQQWRLAH

SEQ ID NO: 6869 - protein, 9 aa, Homo sapiens
  light chain complementarity determining region 3 for antibody 3435
MQGTHGPPS

SEQ ID NO: 6870 - protein, 13 aa, Homo sapiens
  heavy chain complementarity determining region 3 for antibody 3435
ARDTVTNKMGSDY

SEQ ID NO: 6871 - protein, 9 aa, Homo sapiens
  light chain complementarity determining region 3 for antibody 3436
MQGSYWPFT

SEQ ID NO: 6872 - protein, 11 aa, Homo sapiens
  heavy chain complementarity determining region 3 for antibody 3436
ASYNWGSAIDT

SEQ ID NO: 6873 - protein, 9 aa, Homo sapiens
  light chain complementarity determining region 3 for antibody 3437
MQGIHWPHT

SEQ ID NO: 6874 - protein, 11 aa, Homo sapiens
  heavy chain complementarity determining region 3 for antibody 3437
ATFGQQWRLAH

SEQ ID NO: 6875 - protein, 9 aa, Homo sapiens
  light chain complementarity determining region 3 for antibody 3438
MQGAHWPHT

SEQ ID NO: 6876 - protein, 11 aa, Homo sapiens
  heavy chain complementarity determining region 3 for antibody 3438
ATFGQQWRLAH

SEQ ID NO: 6877 - protein, 9 aa, Homo sapiens
  light chain complementarity determining region 3 for antibody 3439
MQFLQTPLT

SEQ ID NO: 6878 - protein, 10 aa, Homo sapiens
  heavy chain complementarity determining region 3 for antibody 3439
TRERSGSYDI

SEQ ID NO: 6879 - protein, 9 aa, Homo sapiens
  light chain complementarity determining region 3 for antibody 3440
MQFLQTPLT

SEQ ID NO: 6880 - protein, 15 aa, Homo sapiens
  heavy chain complementarity determining region 3 for antibody 3440
ARVGRPYHNAWYFDN

SEQ ID NO: 6881 - protein, 9 aa, Homo sapiens
  light chain complementarity determining region 3 for antibody 3441
MQFLQTPLT

SEQ ID NO: 6882 - protein, 10 aa, Homo sapiens
  heavy chain complementarity determining region 3 for antibody 3441
ARETSGSYDI

SEQ ID NO: 6883 - protein, 9 aa, Homo sapiens
  light chain complementarity determining region 3 for antibody 3442
MQFLQTPLT

SEQ ID NO: 6884 - protein, 10 aa, Homo sapiens
  heavy chain complementarity determining region 3 for antibody 3442
AREISGSYDI

SEQ ID NO: 6885 - protein, 9 aa, Homo sapiens
  light chain complementarity determining region 3 for antibody 3443
MQFLQTPFT

SEQ ID NO: 6886 - protein, 10 aa, Homo sapiens
  heavy chain complementarity determining region 3 for antibody 3443
ARERSGSYDI

SEQ ID NO: 6887 - protein, 9 aa, Homo sapiens
  light chain complementarity determining region 3 for antibody 3444
MQFLQNPLT

SEQ ID NO: 6888 - protein, 10 aa, Homo sapiens
  heavy chain complementarity determining region 3 for antibody 3444
ARERSGSYDI

SEQ ID NO: 6889 - protein, 9 aa, Homo sapiens
  light chain complementarity determining region 3 for antibody 3445
MQATHWPRT

SEQ ID NO: 6890 - protein, 12 aa, Homo sapiens
  heavy chain complementarity determining region 3 for antibody 3445
STDVETTLPSVS

SEQ ID NO: 6891 - protein, 9 aa, Homo sapiens
  light chain complementarity determining region 3 for antibody 3446
MQATHWPRT

SEQ ID NO: 6892 - protein, 12 aa, Homo sapiens
  heavy chain complementarity determining region 3 for antibody 3446
STDVETPFPSVS

SEQ ID NO: 6893 - protein, 8 aa, Homo sapiens
  light chain complementarity determining region 3 for antibody 3447
MQALQTWT

SEQ ID NO: 6894 - protein, 6 aa, Homo sapiens
  heavy chain complementarity determining region 3 for antibody 3447
ARGIGV

SEQ ID NO: 6895 - protein, 9 aa, Homo sapiens
  light chain complementarity determining region 3 for antibody 3448
MQALQTPYT

SEQ ID NO: 6896 - protein, 10 aa, Homo sapiens
  heavy chain complementarity determining region 3 for antibody 3448
CRDREGFGDV

SEQ ID NO: 6897 - protein, 9 aa, Homo sapiens
  light chain complementarity determining region 3 for antibody 3449
MQALQTPYT

SEQ ID NO: 6898 - protein, 15 aa, Homo sapiens
  heavy chain complementarity determining region 3 for antibody 3449
ARGPDYGDRTDYFDY

SEQ ID NO: 6899 - protein, 9 aa, Homo sapiens
  light chain complementarity determining region 3 for antibody 3450
MQALQTPYT

SEQ ID NO: 6900 - protein, 10 aa, Homo sapiens
  heavy chain complementarity determining region 3 for antibody 3450
AKALSGGGGY

SEQ ID NO: 6901 - protein, 9 aa, Homo sapiens
  light chain complementarity determining region 3 for antibody 3451
MQALQTPYI

SEQ ID NO: 6902 - protein, 13 aa, Homo sapiens
  heavy chain complementarity determining region 3 for antibody 3451
AKDGLYGSGRTLD

SEQ ID NO: 6903 - protein, 9 aa, Homo sapiens
  light chain complementarity determining region 3 for antibody 3452
MQALQTPLT

SEQ ID NO: 6904 - protein, 15 aa, Homo sapiens
  heavy chain complementarity determining region 3 for antibody 3452
TTPSYNSAWYNAFDM

SEQ ID NO: 6905 - protein, 9 aa, Homo sapiens
  light chain complementarity determining region 3 for antibody 3453
MQALQTPLT

SEQ ID NO: 6906 - protein, 16 aa, Homo sapiens
  heavy chain complementarity determining region 3 for antibody 3453
AKEWGYSSGWYGELDY

SEQ ID NO: 6907 - protein, 9 aa, Homo sapiens
  light chain complementarity determining region 3 for antibody 3454
MQALQTLLT

SEQ ID NO: 6908 - protein, 12 aa, Homo sapiens
  heavy chain complementarity determining region 3 for antibody 3454
ARDFSHRTPGGY

SEQ ID NO: 6909 - protein, 9 aa, Homo sapiens
  light chain complementarity determining region 3 for antibody 3455
MPYAHGPHT

SEQ ID NO: 6910 - protein, 8 aa, Homo sapiens
  heavy chain complementarity determining region 3 for antibody 3455
AGWGYGNY

SEQ ID NO: 6911 - protein, 9 aa, Homo sapiens
  light chain complementarity determining region 3 for antibody 3456
LQYAHWPHT

SEQ ID NO: 6912 - protein, 15 aa, Homo sapiens
  heavy chain complementarity determining region 3 for antibody 3456
ARVGRPYHNAWYLDN

SEQ ID NO: 6913 - protein, 9 aa, Homo sapiens
  light chain complementarity determining region 3 for antibody 3457
LQYAHWPHT

SEQ ID NO: 6914 - protein, 15 aa, Homo sapiens
  heavy chain complementarity determining region 3 for antibody 3457
ARVGRPYHNAWYCDN

SEQ ID NO: 6915 - protein, 9 aa, Homo sapiens
  light chain complementarity determining region 3 for antibody 3458
LQYAHGPHT

SEQ ID NO: 6916 - protein, 15 aa, Homo sapiens
  heavy chain complementarity determining region 3 for antibody 3458
ARVGRPYHNAWYFDN

SEQ ID NO: 6917 - protein, 9 aa, Homo sapiens
  light chain complementarity determining region 3 for antibody 3459
LQYAHCPHT

SEQ ID NO: 6918 - protein, 15 aa, Homo sapiens
  heavy chain complementarity determining region 3 for antibody 3459
ARVGRPYHNAWYFDN

SEQ ID NO: 6919 - protein, 9 aa, Homo sapiens
  light chain complementarity determining region 3 for antibody 3460
LQVAHWPHT

SEQ ID NO: 6920 - protein, 9 aa, Homo sapiens
  heavy chain complementarity determining region 3 for antibody 3460
AGWGGLSNY

SEQ ID NO: 6921 - protein, 9 aa, Homo sapiens
  light chain complementarity determining region 3 for antibody 3461
LQLAHWPHT

SEQ ID NO: 6922 - protein, 9 aa, Homo sapiens
  heavy chain complementarity determining region 3 for antibody 3461
AGWGGLSNY

SEQ ID NO: 6923 - protein, 9 aa, Homo sapiens
  light chain complementarity determining region 3 for antibody 3462
LQHNTYPWT

SEQ ID NO: 6924 - protein, 11 aa, Homo sapiens
  heavy chain complementarity determining region 3 for antibody 3462
AREGWGSLLDY

SEQ ID NO: 6925 - protein, 9 aa, Homo sapiens
  light chain complementarity determining region 3 for antibody 3463
LQHNSYPYT

SEQ ID NO: 6926 - protein, 12 aa, Homo sapiens
  heavy chain complementarity determining region 3 for antibody 3463
ARERSADYWFGP

SEQ ID NO: 6927 - protein, 9 aa, Homo sapiens
  light chain complementarity determining region 3 for antibody 3464
LQHNSYPWT

SEQ ID NO: 6928 - protein, 14 aa, Homo sapiens
  heavy chain complementarity determining region 3 for antibody 3464
CRGWLDPATPHYDF

SEQ ID NO: 6929 - protein, 9 aa, Homo sapiens
  light chain complementarity determining region 3 for antibody 3465
LQHNSYPLT

SEQ ID NO: 6930 - protein, 11 aa, Homo sapiens
  heavy chain complementarity determining region 3 for antibody 3465
VRVSTGWNFDD

SEQ ID NO: 6931 - protein, 9 aa, Homo sapiens
  light chain complementarity determining region 3 for antibody 3466
LQHNSYPLT

SEQ ID NO: 6932 - protein, 11 aa, Homo sapiens
  heavy chain complementarity determining region 3 for antibody 3466
VRVSTGWIFDY

SEQ ID NO: 6933 - protein, 9 aa, Homo sapiens
  light chain complementarity determining region 3 for antibody 3467
LQHNSYPLT

SEQ ID NO: 6934 - protein, 11 aa, Homo sapiens
  heavy chain complementarity determining region 3 for antibody 3467
VRVSTCWNFDY

SEQ ID NO: 6935 - protein, 9 aa, Homo sapiens
  light chain complementarity determining region 3 for antibody 3468
LQHNSYPLT

SEQ ID NO: 6936 - protein, 11 aa, Homo sapiens
  heavy chain complementarity determining region 3 for antibody 3468
VRVSNGWNFDY

SEQ ID NO: 6937 - protein, 9 aa, Homo sapiens
  light chain complementarity determining region 3 for antibody 3469
LQHNSYPLT

SEQ ID NO: 6938 - protein, 11 aa, Homo sapiens
  heavy chain complementarity determining region 3 for antibody 3469
VRVRTGWNFDY

SEQ ID NO: 6939 - protein, 9 aa, Homo sapiens
  light chain complementarity determining region 3 for antibody 3470
LQHNSYPLT

SEQ ID NO: 6940 - protein, 11 aa, Homo sapiens
  heavy chain complementarity determining region 3 for antibody 3470
VRVNTGWNFDY

SEQ ID NO: 6941 - protein, 9 aa, Homo sapiens
  light chain complementarity determining region 3 for antibody 3471
LQHNSYPLT

SEQ ID NO: 6942 - protein, 11 aa, Homo sapiens
  heavy chain complementarity determining region 3 for antibody 3471
VRVITGWNFDY

SEQ ID NO: 6943 - protein, 9 aa, Homo sapiens
  light chain complementarity determining region 3 for antibody 3472
LQHNSYPLT

SEQ ID NO: 6944 - protein, 11 aa, Homo sapiens
  heavy chain complementarity determining region 3 for antibody 3472
VRISTGWNFDY

SEQ ID NO: 6945 - protein, 9 aa, Homo sapiens
  light chain complementarity determining region 3 for antibody 3473
LQHNSYPLT

SEQ ID NO: 6946 - protein, 10 aa, Homo sapiens
  heavy chain complementarity determining region 3 for antibody 3473
CRDRWGCGDV

SEQ ID NO: 6947 - protein, 9 aa, Homo sapiens
  light chain complementarity determining region 3 for antibody 3474
LQHNSYPLT

SEQ ID NO: 6948 - protein, 11 aa, Homo sapiens
  heavy chain complementarity determining region 3 for antibody 3474
AREQHGQAPDY

SEQ ID NO: 6949 - protein, 9 aa, Homo sapiens
  light chain complementarity determining region 3 for antibody 3475
LQHNSYPLN

SEQ ID NO: 6950 - protein, 11 aa, Homo sapiens
  heavy chain complementarity determining region 3 for antibody 3475
VRVSTGWNFDY

SEQ ID NO: 6951 - protein, 9 aa, Homo sapiens
  light chain complementarity determining region 3 for antibody 3476
LQHNSYPFT

SEQ ID NO: 6952 - protein, 11 aa, Homo sapiens
  heavy chain complementarity determining region 3 for antibody 3476
VRVSTGWNFDF

SEQ ID NO: 6953 - protein, 9 aa, Homo sapiens
  light chain complementarity determining region 3 for antibody 3477
LQHNSYLLT

SEQ ID NO: 6954 - protein, 11 aa, Homo sapiens
  heavy chain complementarity determining region 3 for antibody 3477
VRVSTGWNFDY

SEQ ID NO: 6955 - protein, 9 aa, Homo sapiens
  light chain complementarity determining region 3 for antibody 3478
LQHDSSPYP

SEQ ID NO: 6956 - protein, 16 aa, Homo sapiens
  heavy chain complementarity determining region 3 for antibody 3478
TSDFRYGSSIWYWGAV

SEQ ID NO: 6957 - protein, 9 aa, Homo sapiens
  light chain complementarity determining region 3 for antibody 3479
LQHDSSPCT

SEQ ID NO: 6958 - protein, 16 aa, Homo sapiens
  heavy chain complementarity determining region 3 for antibody 3479
TSDFRYGSSIWYWGAV

SEQ ID NO: 6959 - protein, 11 aa, Homo sapiens
  light chain complementarity determining region 3 for antibody 3480
LQFATSPSIYT

SEQ ID NO: 6960 - protein, 12 aa, Homo sapiens
  heavy chain complementarity determining region 3 for antibody 3480
VRQYTPKSVPDS

SEQ ID NO: 6961 - protein, 9 aa, Homo sapiens
  light chain complementarity determining region 3 for antibody 3481
LQDYTYPFS

SEQ ID NO: 6962 - protein, 16 aa, Homo sapiens
  heavy chain complementarity determining region 3 for antibody 3481
ATDVGDHSDRFTPLDY

SEQ ID NO: 6963 - protein, 9 aa, Homo sapiens
  light chain complementarity determining region 3 for antibody 3482
LQDYSYPLS

SEQ ID NO: 6964 - protein, 16 aa, Homo sapiens
  heavy chain complementarity determining region 3 for antibody 3482
TAYVGDHRDRYVTLDH

SEQ ID NO: 6965 - protein, 9 aa, Homo sapiens
  light chain complementarity determining region 3 for antibody 3483
LQDYNYPWT

SEQ ID NO: 6966 - protein, 11 aa, Homo sapiens
  heavy chain complementarity determining region 3 for antibody 3483
ARDGGRFSDDY

SEQ ID NO: 6967 - protein, 9 aa, Homo sapiens
  light chain complementarity determining region 3 for antibody 3484
LQDYNHVGT

SEQ ID NO: 6968 - protein, 9 aa, Homo sapiens
  heavy chain complementarity determining region 3 for antibody 3484
GSRRPYFDA

SEQ ID NO: 6969 - protein, 9 aa, Homo sapiens
  light chain complementarity determining region 3 for antibody 3485
LQDYNHVGT

SEQ ID NO: 6970 - protein, 9 aa, Homo sapiens
  heavy chain complementarity determining region 3 for antibody 3485
GGRRPYFDS

SEQ ID NO: 6971 - protein, 9 aa, Homo sapiens
  light chain complementarity determining region 3 for antibody 3486
LQDYNHVGT

SEQ ID NO: 6972 - protein, 12 aa, Homo sapiens
  heavy chain complementarity determining region 3 for antibody 3486
ARLDWNYRAFDI

SEQ ID NO: 6973 - protein, 9 aa, Homo sapiens
  light chain complementarity determining region 3 for antibody 3487
LQDYNHAGT

SEQ ID NO: 6974 - protein, 9 aa, Homo sapiens
  heavy chain complementarity determining region 3 for antibody 3487
GSRRPYFDY

SEQ ID NO: 6975 - protein, 9 aa, Homo sapiens
  light chain complementarity determining region 3 for antibody 3488
LQDYIYPFS

SEQ ID NO: 6976 - protein, 16 aa, Homo sapiens
  heavy chain complementarity determining region 3 for antibody 3488
TSYVGDHRDSYTTLDF

SEQ ID NO: 6977 - protein, 9 aa, Homo sapiens
  light chain complementarity determining region 3 for antibody 3489
LPHNSYPLT

SEQ ID NO: 6978 - protein, 11 aa, Homo sapiens
  heavy chain complementarity determining region 3 for antibody 3489
VRVSTGWNFDY

SEQ ID NO: 6979 - protein, 11 aa, Homo sapiens
  light chain complementarity determining region 3 for antibody 3490
LKNDNFPFMWH

SEQ ID NO: 6980 - protein, 15 aa, Homo sapiens
  heavy chain complementarity determining region 3 for antibody 3490
ARVRTNNYDSSGYDV

SEQ ID NO: 6981 - protein, 9 aa, Homo sapiens
  light chain complementarity determining region 3 for antibody 3491
HQYYGVPYT

SEQ ID NO: 6982 - protein, 15 aa, Homo sapiens
  heavy chain complementarity determining region 3 for antibody 3491
ARQVTGATKVRHFDS

SEQ ID NO: 6983 - protein, 9 aa, Homo sapiens
  light chain complementarity determining region 3 for antibody 3492
HQYSSWEFT

SEQ ID NO: 6984 - protein, 16 aa, Homo sapiens
  heavy chain complementarity determining region 3 for antibody 3492
ARERGGYTGLGQPFDR

SEQ ID NO: 6985 - protein, 9 aa, Homo sapiens
  light chain complementarity determining region 3 for antibody 3493
HQYHDWPWT

SEQ ID NO: 6986 - protein, 14 aa, Homo sapiens
  heavy chain complementarity determining region 3 for antibody 3493
ASLSGWSLLDRFDP

SEQ ID NO: 6987 - protein, 9 aa, Homo sapiens
  light chain complementarity determining region 3 for antibody 3494
HQYGSSALT

SEQ ID NO: 6988 - protein, 13 aa, Homo sapiens
  heavy chain complementarity determining region 3 for antibody 3494
AKDRGSGWYAWGY

SEQ ID NO: 6989 - protein, 9 aa, Homo sapiens
  light chain complementarity determining region 3 for antibody 3495
HQYGGLPLT

SEQ ID NO: 6990 - protein, 13 aa, Homo sapiens
  heavy chain complementarity determining region 3 for antibody 3495
ARDRGSGWYAWGY

SEQ ID NO: 6991 - protein, 9 aa, Homo sapiens
  light chain complementarity determining region 3 for antibody 3496
HQSAKSPRT

SEQ ID NO: 6992 - protein, 13 aa, Homo sapiens
  heavy chain complementarity determining region 3 for antibody 3496
ARGAAATSWNIDY

SEQ ID NO: 6993 - protein, 9 aa, Homo sapiens
  light chain complementarity determining region 3 for antibody 3497
HQCGSSPKT

SEQ ID NO: 6994 - protein, 13 aa, Homo sapiens
  heavy chain complementarity determining region 3 for antibody 3497
ARDGSSDWYELAY

SEQ ID NO: 6995 - protein, 9 aa, Homo sapiens
  light chain complementarity determining region 3 for antibody 3498
HHFGSATGT

SEQ ID NO: 6996 - protein, 13 aa, Homo sapiens
  heavy chain complementarity determining region 3 for antibody 3498
AKEGSSPGPDFEH

SEQ ID NO: 6997 - protein, 9 aa, Homo sapiens
  light chain complementarity determining region 3 for antibody 3499
HHFGSATGT

SEQ ID NO: 6998 - protein, 13 aa, Homo sapiens
  heavy chain complementarity determining region 3 for antibody 3499
AKEGSSPGPDFDY

SEQ ID NO: 6999 - protein, 9 aa, Homo sapiens
  light chain complementarity determining region 3 for antibody 3500
AQGSYWPAS

SEQ ID NO: 7000 - protein, 10 aa, Homo sapiens
  heavy chain complementarity determining region 3 for antibody 3500
WRDREGFGDV

SEQ ID NO: 7001 - protein, 9 aa, Homo sapiens
  light chain complementarity determining region 3 for antibody 3501
AQGSYWPAS

SEQ ID NO: 7002 - protein, 13 aa, Homo sapiens
  heavy chain complementarity determining region 3 for antibody 3501
TKEGSSAGPDFVY

SEQ ID NO: 7003 - protein, 9 aa, Homo sapiens
  light chain complementarity determining region 3 for antibody 3502
AQGSYWPAS

SEQ ID NO: 7004 - protein, 10 aa, Homo sapiens
  heavy chain complementarity determining region 3 for antibody 3502
CRDREGFGDF

SEQ ID NO: 7005 - protein, 9 aa, Homo sapiens
  light chain complementarity determining region 3 for antibody 3503
AQGSFWPAS

SEQ ID NO: 7006 - protein, 10 aa, Homo sapiens
  heavy chain complementarity determining region 3 for antibody 3503
CRDREGLGDV

SEQ ID NO: 7007 - protein, 9 aa, Homo sapiens
  light chain complementarity determining region 3 for antibody 3504
VQGSYWPAS

SEQ ID NO: 7008 - protein, 10 aa, Homo sapiens
  heavy chain complementarity determining region 3 for antibody 3504
CRDREGFGDV

SEQ ID NO: 7009 - protein, 9 aa, Homo sapiens
  light chain complementarity determining region 3 for antibody 3505
TQYAHGPHT

SEQ ID NO: 7010 - protein, 8 aa, Homo sapiens
  heavy chain complementarity determining region 3 for antibody 3505
AGWGYGNY

SEQ ID NO: 7011 - protein, 9 aa, Homo sapiens
  light chain complementarity determining region 3 for antibody 3506
TQTTHWPWT

SEQ ID NO: 7012 - protein, 11 aa, Homo sapiens
  heavy chain complementarity determining region 3 for antibody 3506
TRGLRGSAAAY

SEQ ID NO: 7013 - protein, 10 aa, Homo sapiens
  light chain complementarity determining region 3 for antibody 3507
QYHGYSPLYT

SEQ ID NO: 7014 - protein, 12 aa, Homo sapiens
  heavy chain complementarity determining region 3 for antibody 3507
AKGILGRGGMDV

SEQ ID NO: 7015 - protein, 9 aa, Homo sapiens
  light chain complementarity determining region 3 for antibody 3508
QTYKSAPFT

SEQ ID NO: 7016 - protein, 13 aa, Homo sapiens
  heavy chain complementarity determining region 3 for antibody 3508
AKEGSSPGPDFEY

SEQ ID NO: 7017 - protein, 9 aa, Homo sapiens
  light chain complementarity determining region 3 for antibody 3509
QTYGSSPVP

SEQ ID NO: 7018 - protein, 18 aa, Homo sapiens
  heavy chain complementarity determining region 3 for antibody 3509
ARGDYPEARTGYFLDFDY

SEQ ID NO: 7019 - protein, 7 aa, Homo sapiens
  light chain complementarity determining region 3 for antibody 3510
QRYNTWT

SEQ ID NO: 7020 - protein, 12 aa, Homo sapiens
  heavy chain complementarity determining region 3 for antibody 3510
ARDKGGRNGMDV

SEQ ID NO: 7021 - protein, 9 aa, Homo sapiens
  light chain complementarity determining region 3 for antibody 3511
QRYNSYSYT

SEQ ID NO: 7022 - protein, 10 aa, Homo sapiens
  heavy chain complementarity determining region 3 for antibody 3511
ARARGFLFDY

SEQ ID NO: 7023 - protein, 8 aa, Homo sapiens
  light chain complementarity determining region 3 for antibody 3512
QRSYTTPT

SEQ ID NO: 7024 - protein, 12 aa, Homo sapiens
  heavy chain complementarity determining region 3 for antibody 3512
ARLDWNYRAFDI

SEQ ID NO: 7025 - protein, 7 aa, Homo sapiens
  light chain complementarity determining region 3 for antibody 3513
QRNRNWA

SEQ ID NO: 7026 - protein, 20 aa, Homo sapiens
  heavy chain complementarity determining region 3 for antibody 3513
STYLPGDCTCTACFYWYSDF

SEQ ID NO: 7027 - protein, 9 aa, Homo sapiens
  light chain complementarity determining region 3 for antibody 3514
QRDNSYSYT

SEQ ID NO: 7028 - protein, 10 aa, Homo sapiens
  heavy chain complementarity determining region 3 for antibody 3514
ARTRGFLFDY

SEQ ID NO: 7029 - protein, 9 aa, Homo sapiens
  light chain complementarity determining region 3 for antibody 3515
QQYYTPPYT

SEQ ID NO: 7030 - protein, 18 aa, Homo sapiens
  heavy chain complementarity determining region 3 for antibody 3515
AKECCYFDSTSHPNWFDP

SEQ ID NO: 7031 - protein, 9 aa, Homo sapiens
  light chain complementarity determining region 3 for antibody 3516
QQYYTPPYP

SEQ ID NO: 7032 - protein, 10 aa, Homo sapiens
  heavy chain complementarity determining region 3 for antibody 3516
TRSTDAYNDI

SEQ ID NO: 7033 - protein, 9 aa, Homo sapiens
  light chain complementarity determining region 3 for antibody 3517
QQYYTPPST

SEQ ID NO: 7034 - protein, 10 aa, Homo sapiens
  heavy chain complementarity determining region 3 for antibody 3517
TRSTYAYNDI

SEQ ID NO: 7035 - protein, 9 aa, Homo sapiens
  light chain complementarity determining region 3 for antibody 3518
QQYYSTPYT

SEQ ID NO: 7036 - protein, 18 aa, Homo sapiens
  heavy chain complementarity determining region 3 for antibody 3518
ARAAGCINGNCYQSYFDL

SEQ ID NO: 7037 - protein, 10 aa, Homo sapiens
  light chain complementarity determining region 3 for antibody 3519
QQYYSSPTWA

SEQ ID NO: 7038 - protein, 16 aa, Homo sapiens
  heavy chain complementarity determining region 3 for antibody 3519
ASLNRGDKEFGVPPAL

SEQ ID NO: 7039 - protein, 9 aa, Homo sapiens
  light chain complementarity determining region 3 for antibody 3520
QQYYSSPIT

SEQ ID NO: 7040 - protein, 14 aa, Homo sapiens
  heavy chain complementarity determining region 3 for antibody 3520
ARGESTSCDFIFDF

SEQ ID NO: 7041 - protein, 10 aa, Homo sapiens
  light chain complementarity determining region 3 for antibody 3521
QQYYSNPPWA

SEQ ID NO: 7042 - protein, 16 aa, Homo sapiens
  heavy chain complementarity determining region 3 for antibody 3521
ASLNRGDKEFGVPPAL

SEQ ID NO: 7043 - protein, 9 aa, Homo sapiens
  light chain complementarity determining region 3 for antibody 3522
QQYYSAPLT

SEQ ID NO: 7044 - protein, 13 aa, Homo sapiens
  heavy chain complementarity determining region 3 for antibody 3522
ARGHAPGSFLIDS

SEQ ID NO: 7045 - protein, 9 aa, Homo sapiens
  light chain complementarity determining region 3 for antibody 3523
QQYYRSPFT

SEQ ID NO: 7046 - protein, 14 aa, Homo sapiens
  heavy chain complementarity determining region 3 for antibody 3523
AASYSSGWLEYFQY

SEQ ID NO: 7047 - protein, 9 aa, Homo sapiens
  light chain complementarity determining region 3 for antibody 3524
QQYYNIPRT

SEQ ID NO: 7048 - protein, 9 aa, Homo sapiens
  heavy chain complementarity determining region 3 for antibody 3524
ARSVGPLDS

SEQ ID NO: 7049 - protein, 9 aa, Homo sapiens
  light chain complementarity determining region 3 for antibody 3525
QQYYGSPLT

SEQ ID NO: 7050 - protein, 15 aa, Homo sapiens
  heavy chain complementarity determining region 3 for antibody 3525
ATSMIYGGNSFICDS

SEQ ID NO: 7051 - protein, 9 aa, Homo sapiens
  light chain complementarity determining region 3 for antibody 3526
QQYYGAPIT

SEQ ID NO: 7052 - protein, 14 aa, Homo sapiens
  heavy chain complementarity determining region 3 for antibody 3526
AKGQWTSCDYIIDY

SEQ ID NO: 7053 - protein, 9 aa, Homo sapiens
  light chain complementarity determining region 3 for antibody 3527
QQYYDPPLT

SEQ ID NO: 7054 - protein, 21 aa, Homo sapiens
  heavy chain complementarity determining region 3 for antibody 3527
ARGSRTDCRSDDTGCRPMFDS

SEQ ID NO: 7055 - protein, 9 aa, Homo sapiens
  light chain complementarity determining region 3 for antibody 3528
QQYVTSPYT

SEQ ID NO: 7056 - protein, 17 aa, Homo sapiens
  heavy chain complementarity determining region 3 for antibody 3528
ARVSSDGPLDDSSWFDL

SEQ ID NO: 7057 - protein, 9 aa, Homo sapiens
  light chain complementarity determining region 3 for antibody 3529
QQYSSYPWT

SEQ ID NO: 7058 - protein, 11 aa, Homo sapiens
  heavy chain complementarity determining region 3 for antibody 3529
ARIVARKPDDY

SEQ ID NO: 7059 - protein, 7 aa, Homo sapiens
  light chain complementarity determining region 3 for antibody 3530
QQYSSWT

SEQ ID NO: 7060 - protein, 12 aa, Homo sapiens
  heavy chain complementarity determining region 3 for antibody 3530
ASVVPGRWDLDD

SEQ ID NO: 7061 - protein, 7 aa, Homo sapiens
  light chain complementarity determining region 3 for antibody 3531
QQYSSWT

SEQ ID NO: 7062 - protein, 12 aa, Homo sapiens
  heavy chain complementarity determining region 3 for antibody 3531
AIVVPGRWDLDE

SEQ ID NO: 7063 - protein, 7 aa, Homo sapiens
  light chain complementarity determining region 3 for antibody 3532
QQYSSWP

SEQ ID NO: 7064 - protein, 12 aa, Homo sapiens
  heavy chain complementarity determining region 3 for antibody 3532
AIVVPGRWDLDD

SEQ ID NO: 7065 - protein, 10 aa, Homo sapiens
  light chain complementarity determining region 3 for antibody 3533
QQYSSSPPWA

SEQ ID NO: 7066 - protein, 16 aa, Homo sapiens
  heavy chain complementarity determining region 3 for antibody 3533
ASLNRGDKEFGVPPAL

SEQ ID NO: 7067 - protein, 9 aa, Homo sapiens
  light chain complementarity determining region 3 for antibody 3534
QQYSSPPPT

SEQ ID NO: 7068 - protein, 10 aa, Homo sapiens
  heavy chain complementarity determining region 3 for antibody 3534
ARDLSFRYFE

SEQ ID NO: 7069 - protein, 7 aa, Homo sapiens
  light chain complementarity determining region 3 for antibody 3535
QQYNTWT

SEQ ID NO: 7070 - protein, 11 aa, Homo sapiens
  heavy chain complementarity determining region 3 for antibody 3535
VRVSTGWNFDY

SEQ ID NO: 7071 - protein, 7 aa, Homo sapiens
  light chain complementarity determining region 3 for antibody 3536
QQYNTWT

SEQ ID NO: 7072 - protein, 13 aa, Homo sapiens
  heavy chain complementarity determining region 3 for antibody 3536
TKEGSSAGPDFVY

SEQ ID NO: 7073 - protein, 7 aa, Homo sapiens
  light chain complementarity determining region 3 for antibody 3537
QQYNTWT

SEQ ID NO: 7074 - protein, 9 aa, Homo sapiens
  heavy chain complementarity determining region 3 for antibody 3537
GSRRPYFDS

SEQ ID NO: 7075 - protein, 7 aa, Homo sapiens
  light chain complementarity determining region 3 for antibody 3538
QQYNTWT

SEQ ID NO: 7076 - protein, 16 aa, Homo sapiens
  heavy chain complementarity determining region 3 for antibody 3538
ARWFSRSSTGVSYMDV

SEQ ID NO: 7077 - protein, 7 aa, Homo sapiens
  light chain complementarity determining region 3 for antibody 3539
QQYNTWT

SEQ ID NO: 7078 - protein, 12 aa, Homo sapiens
  heavy chain complementarity determining region 3 for antibody 3539
ARDKGWRNGMDV

SEQ ID NO: 7079 - protein, 7 aa, Homo sapiens
  light chain complementarity determining region 3 for antibody 3540
QQYNTWT

SEQ ID NO: 7080 - protein, 12 aa, Homo sapiens
  heavy chain complementarity determining region 3 for antibody 3540
ARDKGGGNGMDV

SEQ ID NO: 7081 - protein, 7 aa, Homo sapiens
  light chain complementarity determining region 3 for antibody 3541
QQYNTWT

SEQ ID NO: 7082 - protein, 12 aa, Homo sapiens
  heavy chain complementarity determining region 3 for antibody 3541
ARDKCGRNGMDV

SEQ ID NO: 7083 - protein, 7 aa, Homo sapiens
  light chain complementarity determining region 3 for antibody 3542
QQYNTWT

SEQ ID NO: 7084 - protein, 13 aa, Homo sapiens
  heavy chain complementarity determining region 3 for antibody 3542
AKEGSSPGPDFDY

SEQ ID NO: 7085 - protein, 7 aa, Homo sapiens
  light chain complementarity determining region 3 for antibody 3543
QQYNTWT

SEQ ID NO: 7086 - protein, 9 aa, Homo sapiens
  heavy chain complementarity determining region 3 for antibody 3543
AGWGGLSNY

SEQ ID NO: 7087 - protein, 9 aa, Homo sapiens
  light chain complementarity determining region 3 for antibody 3544
QQYNSYYRT

SEQ ID NO: 7088 - protein, 16 aa, Homo sapiens
  heavy chain complementarity determining region 3 for antibody 3544
VGPHLTYNSGWRYFDY

SEQ ID NO: 7089 - protein, 9 aa, Homo sapiens
  light chain complementarity determining region 3 for antibody 3545
QQYNSYSRT

SEQ ID NO: 7090 - protein, 16 aa, Homo sapiens
  heavy chain complementarity determining region 3 for antibody 3545
VGPNLTYNSGWRYFDY

SEQ ID NO: 7091 - protein, 9 aa, Homo sapiens
  light chain complementarity determining region 3 for antibody 3546
QQYNSYSRT

SEQ ID NO: 7092 - protein, 16 aa, Homo sapiens
  heavy chain complementarity determining region 3 for antibody 3546
VGPHLTYNSGWRYFNY

SEQ ID NO: 7093 - protein, 9 aa, Homo sapiens
  light chain complementarity determining region 3 for antibody 3547
QQYNSYSRT

SEQ ID NO: 7094 - protein, 13 aa, Homo sapiens
  heavy chain complementarity determining region 3 for antibody 3547
AKEGSAPGPDFEY

SEQ ID NO: 7095 - protein, 9 aa, Homo sapiens
  light chain complementarity determining region 3 for antibody 3548
QQYNSYSLT

SEQ ID NO: 7096 - protein, 16 aa, Homo sapiens
  heavy chain complementarity determining region 3 for antibody 3548
VRDLAGFTRGGSTFDY

SEQ ID NO: 7097 - protein, 9 aa, Homo sapiens
  light chain complementarity determining region 3 for antibody 3549
QQYNSYSHT

SEQ ID NO: 7098 - protein, 14 aa, Homo sapiens
  heavy chain complementarity determining region 3 for antibody 3549
ARDVHTTGWTLGDY

SEQ ID NO: 7099 - protein, 9 aa, Homo sapiens
  light chain complementarity determining region 3 for antibody 3550
QQYNSYSHT

SEQ ID NO: 7100 - protein, 14 aa, Homo sapiens
  heavy chain complementarity determining region 3 for antibody 3550
ARDVHTAGWTLGGY

SEQ ID NO: 7101 - protein, 9 aa, Homo sapiens
  light chain complementarity determining region 3 for antibody 3551
QQYNSYSCT

SEQ ID NO: 7102 - protein, 16 aa, Homo sapiens
  heavy chain complementarity determining region 3 for antibody 3551
VGPHLTYNSGWRYFDY

SEQ ID NO: 7103 - protein, 9 aa, Homo sapiens
  light chain complementarity determining region 3 for antibody 3552
QQYNSYPYT

SEQ ID NO: 7104 - protein, 14 aa, Homo sapiens
  heavy chain complementarity determining region 3 for antibody 3552
CRGWLDPATPHYDF

SEQ ID NO: 7105 - protein, 9 aa, Homo sapiens
  light chain complementarity determining region 3 for antibody 3553
QQYNSYPWT

SEQ ID NO: 7106 - protein, 14 aa, Homo sapiens
  heavy chain complementarity determining region 3 for antibody 3553
VREEGSGYYRPADY

SEQ ID NO: 7107 - protein, 9 aa, Homo sapiens
  light chain complementarity determining region 3 for antibody 3554
QQYNSYPWT

SEQ ID NO: 7108 - protein, 16 aa, Homo sapiens
  heavy chain complementarity determining region 3 for antibody 3554
VGPHLTYNSGWRYFDY

SEQ ID NO: 7109 - protein, 9 aa, Homo sapiens
  light chain complementarity determining region 3 for antibody 3555
QQYNSYPWT

SEQ ID NO: 7110 - protein, 12 aa, Homo sapiens
  heavy chain complementarity determining region 3 for antibody 3555
NADHGYVDGFDI

SEQ ID NO: 7111 - protein, 9 aa, Homo sapiens
  light chain complementarity determining region 3 for antibody 3556
QQYNSYPWT

SEQ ID NO: 7112 - protein, 15 aa, Homo sapiens
  heavy chain complementarity determining region 3 for antibody 3556
GKEGPGSSGWLTGHD

SEQ ID NO: 7113 - protein, 9 aa, Homo sapiens
  light chain complementarity determining region 3 for antibody 3557
QQYNSYPWT

SEQ ID NO: 7114 - protein, 15 aa, Homo sapiens
  heavy chain complementarity determining region 3 for antibody 3557
GKEGAGSSGWLTGHY

SEQ ID NO: 7115 - protein, 9 aa, Homo sapiens
  light chain complementarity determining region 3 for antibody 3558
QQYNSYPWT

SEQ ID NO: 7116 - protein, 11 aa, Homo sapiens
  heavy chain complementarity determining region 3 for antibody 3558
ARIVARRPDDY

SEQ ID NO: 7117 - protein, 9 aa, Homo sapiens
  light chain complementarity determining region 3 for antibody 3559
QQYNSYPWT

SEQ ID NO: 7118 - protein, 11 aa, Homo sapiens
  heavy chain complementarity determining region 3 for antibody 3559
ARIVARKPGDY

SEQ ID NO: 7119 - protein, 9 aa, Homo sapiens
  light chain complementarity determining region 3 for antibody 3560
QQYNSYPWT

SEQ ID NO: 7120 - protein, 11 aa, Homo sapiens
  heavy chain complementarity determining region 3 for antibody 3560
ARIVAREPDDY

SEQ ID NO: 7121 - protein, 9 aa, Homo sapiens
  light chain complementarity determining region 3 for antibody 3561
QQYNSYPWT

SEQ ID NO: 7122 - protein, 10 aa, Homo sapiens
  heavy chain complementarity determining region 3 for antibody 3561
ARERSGSYDI

SEQ ID NO: 7123 - protein, 9 aa, Homo sapiens
  light chain complementarity determining region 3 for antibody 3562
QQYNSYPWT

SEQ ID NO: 7124 - protein, 17 aa, Homo sapiens
  heavy chain complementarity determining region 3 for antibody 3562
AKRLPDLLGGGHHYIDV

SEQ ID NO: 7125 - protein, 9 aa, Homo sapiens
  light chain complementarity determining region 3 for antibody 3563
QQYNSYPWT

SEQ ID NO: 7126 - protein, 12 aa, Homo sapiens
  heavy chain complementarity determining region 3 for antibody 3563
AKPAYGSGSPDY

SEQ ID NO: 7127 - protein, 9 aa, Homo sapiens
  light chain complementarity determining region 3 for antibody 3564
QQYNSYPWT

SEQ ID NO: 7128 - protein, 13 aa, Homo sapiens
  heavy chain complementarity determining region 3 for antibody 3564
AKEGSSPGPDFDY

SEQ ID NO: 7129 - protein, 9 aa, Homo sapiens
  light chain complementarity determining region 3 for antibody 3565
QQYNSYPPT

SEQ ID NO: 7130 - protein, 13 aa, Homo sapiens
  heavy chain complementarity determining region 3 for antibody 3565
AKEGASPGPDFEY

SEQ ID NO: 7131 - protein, 9 aa, Homo sapiens
  light chain complementarity determining region 3 for antibody 3566
QQYNSYPPT

SEQ ID NO: 7132 - protein, 12 aa, Homo sapiens
  heavy chain complementarity determining region 3 for antibody 3566
AIVVPGRWDLDD

SEQ ID NO: 7133 - protein, 7 aa, Homo sapiens
  light chain complementarity determining region 3 for antibody 3567
QQYNSWT

SEQ ID NO: 7134 - protein, 12 aa, Homo sapiens
  heavy chain complementarity determining region 3 for antibody 3567
ARDKGGRSGMDV

SEQ ID NO: 7135 - protein, 9 aa, Homo sapiens
  light chain complementarity determining region 3 for antibody 3568
QQYNSWPLT

SEQ ID NO: 7136 - protein, 16 aa, Homo sapiens
  heavy chain complementarity determining region 3 for antibody 3568
AKEWGYSSGWYGEFDY

SEQ ID NO: 7137 - protein, 8 aa, Homo sapiens
  light chain complementarity determining region 3 for antibody 3569
QQYNSGGT

SEQ ID NO: 7138 - protein, 20 aa, Homo sapiens
  heavy chain complementarity determining region 3 for antibody 3569
ARTSNRDVDTAMVIGYYFDY

SEQ ID NO: 7139 - protein, 9 aa, Homo sapiens
  light chain complementarity determining region 3 for antibody 3570
QQYNNYSHT

SEQ ID NO: 7140 - protein, 14 aa, Homo sapiens
  heavy chain complementarity determining region 3 for antibody 3570
ARDVHTTGWTLGGY

SEQ ID NO: 7141 - protein, 9 aa, Homo sapiens
  light chain complementarity determining region 3 for antibody 3571
QQYNNWPYT

SEQ ID NO: 7142 - protein, 10 aa, Homo sapiens
  heavy chain complementarity determining region 3 for antibody 3571
ASEISGAYGV

SEQ ID NO: 7143 - protein, 9 aa, Homo sapiens
  light chain complementarity determining region 3 for antibody 3572
QQYNNWPWT

SEQ ID NO: 7144 - protein, 13 aa, Homo sapiens
  heavy chain complementarity determining region 3 for antibody 3572
AKEGSSPGPDFEY

SEQ ID NO: 7145 - protein, 9 aa, Homo sapiens
  light chain complementarity determining region 3 for antibody 3573
QQYNNWPWT

SEQ ID NO: 7146 - protein, 18 aa, Homo sapiens
  heavy chain complementarity determining region 3 for antibody 3573
AKECCYFDSTSHPNWFDP

SEQ ID NO: 7147 - protein, 10 aa, Homo sapiens [sequence omitted]

SEQ ID NO: 7148 - protein, 11 aa, Homo sapiens
  heavy chain complementarity determining region 3 for antibody 3574
ARDFDGAGYDY

SEQ ID NO: 7149 - protein, 9 aa, Homo sapiens
  light chain complementarity determining region 3 for antibody 3575
QQYNKWPKT

SEQ ID NO: 7150 - protein, 16 aa, Homo sapiens
  heavy chain complementarity determining region 3 for antibody 3575
AADVGDHIDVYATLDY

SEQ ID NO: 7151 - protein, 9 aa, Homo sapiens
  light chain complementarity determining region 3 for antibody 3576
QQYKTAPWT

SEQ ID NO: 7152 - protein, 20 aa, Homo sapiens
  heavy chain complementarity determining region 3 for antibody 3576
TRDARGSMSYAYGGGGGLDV

SEQ ID NO: 7153 - protein, 8 aa, Homo sapiens
  light chain complementarity determining region 3 for antibody 3577
QQYKSYWT

SEQ ID NO: 7154 - protein, 10 aa, Homo sapiens
  heavy chain complementarity determining region 3 for antibody 3577
ARERYGSYDI

SEQ ID NO: 7155 - protein, 8 aa, Homo sapiens
  light chain complementarity determining region 3 for antibody 3578
QQYKSYWT

SEQ ID NO: 7156 - protein, 10 aa, Homo sapiens
  heavy chain complementarity determining region 3 for antibody 3578
ARERSCSYDI

SEQ ID NO: 7157 - protein, 10 aa, Homo sapiens
  light chain complementarity determining region 3 for antibody 3579
QQYKNWPPST

SEQ ID NO: 7158 - protein, 14 aa, Homo sapiens
  heavy chain complementarity determining region 3 for antibody 3579
ARENCYGTGSCFDI

SEQ ID NO: 7159 - protein, 9 aa, Homo sapiens
  light chain complementarity determining region 3 for antibody 3580
QQYHRYSHT

SEQ ID NO: 7160 - protein, 14 aa, Homo sapiens
  heavy chain complementarity determining region 3 for antibody 3580
GRDVHTTGWPLGGY

SEQ ID NO: 7161 - protein, 8 aa, Homo sapiens
  light chain complementarity determining region 3 for antibody 3581
QQYGYSPT

SEQ ID NO: 7162 - protein, 15 aa, Homo sapiens
  heavy chain complementarity determining region 3 for antibody 3581
ARGLLAAGGWYYFDY

SEQ ID NO: 7163 - protein, 9 aa, Homo sapiens
  light chain complementarity determining region 3 for antibody 3582
QQYGYSPLT

SEQ ID NO: 7164 - protein, 18 aa, Homo sapiens
  heavy chain complementarity determining region 3 for antibody 3582
ARGDYPEARSDYSLDFDY

SEQ ID NO: 7165 - protein, 9 aa, Homo sapiens
  light chain complementarity determining region 3 for antibody 3583
QQYGTSPVT

SEQ ID NO: 7166 - protein, 13 aa, Homo sapiens
  heavy chain complementarity determining region 3 for antibody 3583
AKEGSSPGPDFEY

SEQ ID NO: 7167 - protein, 9 aa, Homo sapiens
  light chain complementarity determining region 3 for antibody 3584
QQYGTSPVT

SEQ ID NO: 7168 - protein, 13 aa, Homo sapiens
  heavy chain complementarity determining region 3 for antibody 3584
AKDRGSGWFAWDY

SEQ ID NO: 7169 - protein, 9 aa, Homo sapiens
  light chain complementarity determining region 3 for antibody 3585
QQYGSSTWT

SEQ ID NO: 7170 - protein, 17 aa, Homo sapiens
  heavy chain complementarity determining region 3 for antibody 3585
AKGRGSVAMAPIYYLDL

SEQ ID NO: 7171 - protein, 9 aa, Homo sapiens
  light chain complementarity determining region 3 for antibody 3586
QQYGSSTWT

SEQ ID NO: 7172 - protein, 12 aa, Homo sapiens
  heavy chain complementarity determining region 3 for antibody 3586
AIVVPGRWDLDD

SEQ ID NO: 7173 - protein, 9 aa, Homo sapiens
  light chain complementarity determining region 3 for antibody 3587
QQYGSSTWP

SEQ ID NO: 7174 - protein, 17 aa, Homo sapiens
  heavy chain complementarity determining region 3 for antibody 3587
AKGRGSVAMALIYYLDL

SEQ ID NO: 7175 - protein, 9 aa, Homo sapiens
  light chain complementarity determining region 3 for antibody 3588
QQYGSSTWA

SEQ ID NO: 7176 - protein, 17 aa, Homo sapiens
  heavy chain complementarity determining region 3 for antibody 3588
AKGRGSVAMALIYYLDL

SEQ ID NO: 7177 - protein, 9 aa, Homo sapiens
  light chain complementarity determining region 3 for antibody 3589
QQYGSSRGT

SEQ ID NO: 7178 - protein, 17 aa, Homo sapiens
  heavy chain complementarity determining region 3 for antibody 3589
ARADYDILTGYQYYFDY

SEQ ID NO: 7179 - protein, 8 aa, Homo sapiens
  light chain complementarity determining region 3 for antibody 3590
QQYGSSPT

SEQ ID NO: 7180 - protein, 13 aa, Homo sapiens
  heavy chain complementarity determining region 3 for antibody 3590
ARRPGLDYVGFEY

SEQ ID NO: 7181 - protein, 9 aa, Homo sapiens
  light chain complementarity determining region 3 for antibody 3591
QQYGSSPRT

SEQ ID NO: 7182 - protein, 20 aa, Homo sapiens
  heavy chain complementarity determining region 3 for antibody 3591
ARQIGVRREGEDFWTGYLDF

SEQ ID NO: 7183 - protein, 9 aa, Homo sapiens
  light chain complementarity determining region 3 for antibody 3592
QQYGSSPRT

SEQ ID NO: 7184 - protein, 17 aa, Homo sapiens
  heavy chain complementarity determining region 3 for antibody 3592
ARNTMVGTWQRQGNLDH

SEQ ID NO: 7185 - protein, 10 aa, Homo sapiens
  light chain complementarity determining region 3 for antibody 3593
QQYGSSPPLT

SEQ ID NO: 7186 - protein, 20 aa, Homo sapiens
  heavy chain complementarity determining region 3 for antibody 3593
GRDSSRSCSNSWAHYYGTDV

SEQ ID NO: 7187 - protein, 9 aa, Homo sapiens
  light chain complementarity determining region 3 for antibody 3594
QQYGSSPGT

SEQ ID NO: 7188 - protein, 15 aa, Homo sapiens
  heavy chain complementarity determining region 3 for antibody 3594
ARGGIIGTTDDAFDF

SEQ ID NO: 7189 - protein, 9 aa, Homo sapiens
  light chain complementarity determining region 3 for antibody 3595
QQYGSSPFT

SEQ ID NO: 7190 - protein, 11 aa, Homo sapiens
  heavy chain complementarity determining region 3 for antibody 3595
ARRSLGGAFDY

SEQ ID NO: 7191 - protein, 9 aa, Homo sapiens
  light chain complementarity determining region 3 for antibody 3596
QQYGSSPDT

SEQ ID NO: 7192 - protein, 17 aa, Homo sapiens
  heavy chain complementarity determining region 3 for antibody 3596
ARNAMVGTWQRQGNLDH

SEQ ID NO: 7193 - protein, 8 aa, Homo sapiens
  light chain complementarity determining region 3 for antibody 3597
QQYGSLWT

SEQ ID NO: 7194 - protein, 17 aa, Homo sapiens
  heavy chain complementarity determining region 3 for antibody 3597
ARNTMVGTWQRQGNLDH

SEQ ID NO: 7195 - protein, 10 aa, Homo sapiens
  light chain complementarity determining region 3 for antibody 3598
QQYGRSPLYP

SEQ ID NO: 7196 - protein, 13 aa, Homo sapiens
  heavy chain complementarity determining region 3 for antibody 3598
TTYMAARPEYFRH

SEQ ID NO: 7197 - protein, 10 aa, Homo sapiens
  light chain complementarity determining region 3 for antibody 3599
QQYGISPPWT

SEQ ID NO: 7198 - protein, 16 aa, Homo sapiens
  heavy chain complementarity determining region 3 for antibody 3599
ASPNTLGRLVGVAFDY

SEQ ID NO: 7199 - protein, 11 aa, Homo sapiens
  light chain complementarity determining region 3 for antibody 3600
QQYGGSPPEGT

SEQ ID NO: 7200 - protein, 18 aa, Homo sapiens
  heavy chain complementarity determining region 3 for antibody 3600
AKDNRWYCSTTNCCLFDS

SEQ ID NO: 7201 - protein, 9 aa, Homo sapiens
  light chain complementarity determining region 3 for antibody 3601
QQYGASPFT

SEQ ID NO: 7202 - protein, 16 aa, Homo sapiens
  heavy chain complementarity determining region 3 for antibody 3601
ARGGRPAGAGGGDFGY

SEQ ID NO: 7203 - protein, 9 aa, Homo sapiens
  light chain complementarity determining region 3 for antibody 3602
QQYFSPPET

SEQ ID NO: 7204 - protein, 13 aa, Homo sapiens
  heavy chain complementarity determining region 3 for antibody 3602
ATVTNFWSGYPGF

SEQ ID NO: 7205 - protein, 9 aa, Homo sapiens
  light chain complementarity determining region 3 for antibody 3603
QQYFSAPPT

SEQ ID NO: 7206 - protein, 13 aa, Homo sapiens
  heavy chain complementarity determining region 3 for antibody 3603
TTGAPYSGSCFDH

SEQ ID NO: 7207 - protein, 10 aa, Homo sapiens
  light chain complementarity determining region 3 for antibody 3604
QQYDYSPPWT

SEQ ID NO: 7208 - protein, 14 aa, Homo sapiens
  heavy chain complementarity determining region 3 for antibody 3604
SHPTKAARLPSFDY

SEQ ID NO: 7209 - protein, 9 aa, Homo sapiens
  light chain complementarity determining region 3 for antibody 3605
QQYDSLPPT

SEQ ID NO: 7210 - protein, 12 aa, Homo sapiens
  heavy chain complementarity determining region 3 for antibody 3605
AKDCSGWGCFDS

SEQ ID NO: 7211 - protein, 9 aa, Homo sapiens
  light chain complementarity determining region 3 for antibody 3606
QQYDSDSYT

SEQ ID NO: 7212 - protein, 16 aa, Homo sapiens
  heavy chain complementarity determining region 3 for antibody 3606
ARDHCTTIKCPDAFDI

SEQ ID NO: 7213 - protein, 9 aa, Homo sapiens
  light chain complementarity determining region 3 for antibody 3607
QQYDRYPHT

SEQ ID NO: 7214 - protein, 14 aa, Homo sapiens
  heavy chain complementarity determining region 3 for antibody 3607
ARDVHTTGWTLGGY

SEQ ID NO: 7215 - protein, 9 aa, Homo sapiens
  light chain complementarity determining region 3 for antibody 3608
QQYDRYAHT

SEQ ID NO: 7216 - protein, 14 aa, Homo sapiens
  heavy chain complementarity determining region 3 for antibody 3608
ARDVHTPGWTLGGY

SEQ ID NO: 7217 - protein, 9 aa, Homo sapiens
  light chain complementarity determining region 3 for antibody 3609
QQYDNWPWP

SEQ ID NO: 7218 - protein, 17 aa, Homo sapiens
  heavy chain complementarity determining region 3 for antibody 3609
VTHYYHDSGIYYDFFNY

SEQ ID NO: 7219 - protein, 9 aa, Homo sapiens
  light chain complementarity determining region 3 for antibody 3610
QQYDNPPPA

SEQ ID NO: 7220 - protein, 13 aa, Homo sapiens
  heavy chain complementarity determining region 3 for antibody 3610
TKEGSSAGPDFVY

SEQ ID NO: 7221 - protein, 9 aa, Homo sapiens
  light chain complementarity determining region 3 for antibody 3611
QQYDNLPPT

SEQ ID NO: 7222 - protein, 12 aa, Homo sapiens
  heavy chain complementarity determining region 3 for antibody 3611
AIVVPGRWDLDD

SEQ ID NO: 7223 - protein, 9 aa, Homo sapiens
  light chain complementarity determining region 3 for antibody 3612
QQYDNLPPA

SEQ ID NO: 7224 - protein, 13 aa, Homo sapiens
  heavy chain complementarity determining region 3 for antibody 3612
TKEGSSAGPGFVY

SEQ ID NO: 7225 - protein, 9 aa, Homo sapiens
  light chain complementarity determining region 3 for antibody 3613
QQYDNLPPA

SEQ ID NO: 7226 - protein, 13 aa, Homo sapiens
  heavy chain complementarity determining region 3 for antibody 3613
TKEGSSAGADFVY

SEQ ID NO: 7227 - protein, 9 aa, Homo sapiens
  light chain complementarity determining region 3 for antibody 3614
QQYDNLPPA

SEQ ID NO: 7228 - protein, 13 aa, Homo sapiens
  heavy chain complementarity determining region 3 for antibody 3614
PKEGSSAGPDFVY

SEQ ID NO: 7229 - protein, 9 aa, Homo sapiens
  light chain complementarity determining region 3 for antibody 3615
QQYDNLPLT

SEQ ID NO: 7230 - protein, 13 aa, Homo sapiens
  heavy chain complementarity determining region 3 for antibody 3615
AKEGSSPGPDFEY

SEQ ID NO: 7231 - protein, 9 aa, Homo sapiens
  light chain complementarity determining region 3 for antibody 3616
QQYDNLPLT

SEQ ID NO: 7232 - protein, 12 aa, Homo sapiens
  heavy chain complementarity determining region 3 for antibody 3616
AIVVPGRWYLDD

SEQ ID NO: 7233 - protein, 9 aa, Homo sapiens
  light chain complementarity determining region 3 for antibody 3617
QQYDNLPLT

SEQ ID NO: 7234 - protein, 12 aa, Homo sapiens
  heavy chain complementarity determining region 3 for antibody 3617
AIVVPGRGDLDD

SEQ ID NO: 7235 - protein, 9 aa, Homo sapiens
  light chain complementarity determining region 3 for antibody 3618
QQYDNLPLT

SEQ ID NO: 7236 - protein, 12 aa, Homo sapiens
  heavy chain complementarity determining region 3 for antibody 3618
AIVVAGRWDLDD

SEQ ID NO: 7237 - protein, 10 aa, Homo sapiens
  light chain complementarity determining region 3 for antibody 3619
QQYDNLASLT

SEQ ID NO: 7238 - protein, 9 aa, Homo sapiens
  heavy chain complementarity determining region 3 for antibody 3619
ARGRNNFRY

SEQ ID NO: 7239 - protein, 10 aa, Homo sapiens
  light chain complementarity determining region 3 for antibody 3620
QQYDNLASLT

SEQ ID NO: 7240 - protein, 14 aa, Homo sapiens
  heavy chain complementarity determining region 3 for antibody 3620
ARGHFDSTGFRLDY

SEQ ID NO: 7241 - protein, 10 aa, Homo sapiens
  light chain complementarity determining region 3 for antibody 3621
QQYDNLASLT

SEQ ID NO: 7242 - protein, 13 aa, Homo sapiens
  heavy chain complementarity determining region 3 for antibody 3621
AKEGSSPGRDFEY

SEQ ID NO: 7243 - protein, 10 aa, Homo sapiens
  light chain complementarity determining region 3 for antibody 3622
QQYDNLASLT

SEQ ID NO: 7244 - protein, 13 aa, Homo sapiens
  heavy chain complementarity determining region 3 for antibody 3622
AKEGSSPGHDFEY

SEQ ID NO: 7245 - protein, 10 aa, Homo sapiens
  light chain complementarity determining region 3 for antibody 3623
QQYDNLASLT

SEQ ID NO: 7246 - protein, 13 aa, Homo sapiens
  heavy chain complementarity determining region 3 for antibody 3623
AKEGSSAGPDFDY

SEQ ID NO: 7247 - protein, 10 aa, Homo sapiens
  light chain complementarity determining region 3 for antibody 3624
QQYDNIASLT

SEQ ID NO: 7248 - protein, 13 aa, Homo sapiens
  heavy chain complementarity determining region 3 for antibody 3624
AKEGSSPGPDFEY

SEQ ID NO: 7249 - protein, 10 aa, Homo sapiens
  light chain complementarity determining region 3 for antibody 3625
QQYDNFASLT

SEQ ID NO: 7250 - protein, 13 aa, Homo sapiens
  heavy chain complementarity determining region 3 for antibody 3625
AKEGSSPGPDFEY

SEQ ID NO: 7251 - protein, 8 aa, Homo sapiens
  light chain complementarity determining region 3 for antibody 3626
QQYDLSLT

SEQ ID NO: 7252 - protein, 14 aa, Homo sapiens
  heavy chain complementarity determining region 3 for antibody 3626
ARGTSGDYTDYFPY

SEQ ID NO: 7253 - protein, 10 aa, Homo sapiens
  light chain complementarity determining region 3 for antibody 3627
QQYDIPPPWT

SEQ ID NO: 7254 - protein, 16 aa, Homo sapiens
  heavy chain complementarity determining region 3 for antibody 3627
ASPNTLGRLVGVAFDY

SEQ ID NO: 7255 - protein, 9 aa, Homo sapiens
  light chain complementarity determining region 3 for antibody 3628
QQYDHYAHT

SEQ ID NO: 7256 - protein, 14 aa, Homo sapiens
  heavy chain complementarity determining region 3 for antibody 3628
ARDVHTAGWTLGGY

SEQ ID NO: 7257 - protein, 9 aa, Homo sapiens
  light chain complementarity determining region 3 for antibody 3629
QQYCCSPLT

SEQ ID NO: 7258 - protein, 13 aa, Homo sapiens
  heavy chain complementarity determining region 3 for antibody 3629
AKDPVGHWGSWVD

SEQ ID NO: 7259 - protein, 9 aa, Homo sapiens
  light chain complementarity determining region 3 for antibody 3630
QQYATSPLT

SEQ ID NO: 7260 - protein, 17 aa, Homo sapiens
  heavy chain complementarity determining region 3 for antibody 3630
AKRLPDLLGGGHHYIDV

SEQ ID NO: 7261 - protein, 10 aa, Homo sapiens
  light chain complementarity determining region 3 for antibody 3631
QQYASSPDLT

SEQ ID NO: 7262 - protein, 20 aa, Homo sapiens
  heavy chain complementarity determining region 3 for antibody 3631
ARGRPYYSFWTGPRLNWFDP

SEQ ID NO: 7263 - protein, 9 aa, Homo sapiens
  light chain complementarity determining region 3 for antibody 3632
QQYASASYT

SEQ ID NO: 7264 - protein, 16 aa, Homo sapiens
  heavy chain complementarity determining region 3 for antibody 3632
ARDHCTTIKCPDAFDI

SEQ ID NO: 7265 - protein, 8 aa, Homo sapiens
  light chain complementarity determining region 3 for antibody 3633
QQYAGSPT

SEQ ID NO: 7266 - protein, 11 aa, Homo sapiens
  heavy chain complementarity determining region 3 for antibody 3633
AKQAWRRFADQ

SEQ ID NO: 7267 - protein, 9 aa, Homo sapiens
  light chain complementarity determining region 3 for antibody 3634
QQTYSTPYT

SEQ ID NO: 7268 - protein, 10 aa, Homo sapiens
  heavy chain complementarity determining region 3 for antibody 3634
AHRINRAFDI

SEQ ID NO: 7269 - protein, 9 aa, Homo sapiens
  light chain complementarity determining region 3 for antibody 3635
QQTYSSPWT

SEQ ID NO: 7270 - protein, 15 aa, Homo sapiens
  heavy chain complementarity determining region 3 for antibody 3635
ARIWTSSTNCRYTDV

SEQ ID NO: 7271 - protein, 9 aa, Homo sapiens
  light chain complementarity determining region 3 for antibody 3636
QQTYSSPWT

SEQ ID NO: 7272 - protein, 15 aa, Homo sapiens
  heavy chain complementarity determining region 3 for antibody 3636
ARIWTSSTNCRYMGV

SEQ ID NO: 7273 - protein, 9 aa, Homo sapiens
  light chain complementarity determining region 3 for antibody 3637
QQTYSSPWT

SEQ ID NO: 7274 - protein, 15 aa, Homo sapiens
  heavy chain complementarity determining region 3 for antibody 3637
ARIWTSSTNCRYIDV

SEQ ID NO: 7275 - protein, 9 aa, Homo sapiens
  light chain complementarity determining region 3 for antibody 3638
QQTYSSPWT

SEQ ID NO: 7276 - protein, 15 aa, Homo sapiens
  heavy chain complementarity determining region 3 for antibody 3638
ARIRTSSTNCRYMDV

SEQ ID NO: 7277 - protein, 9 aa, Homo sapiens
  light chain complementarity determining region 3 for antibody 3639
QQTYSSPWT

SEQ ID NO: 7278 - protein, 10 aa, Homo sapiens
  heavy chain complementarity determining region 3 for antibody 3639
ARERSGSYDI

SEQ ID NO: 7279 - protein, 9 aa, Homo sapiens
  light chain complementarity determining region 3 for antibody 3640
QQTYSSPWT

SEQ ID NO: 7280 - protein, 17 aa, Homo sapiens
  heavy chain complementarity determining region 3 for antibody 3640
AKGRGSVAMALIYYLDL

SEQ ID NO: 7281 - protein, 9 aa, Homo sapiens
  light chain complementarity determining region 3 for antibody 3641
QQTYSNPWT

SEQ ID NO: 7282 - protein, 15 aa, Homo sapiens
  heavy chain complementarity determining region 3 for antibody 3641
ARIWTSSTNCRYMDV

SEQ ID NO: 7283 - protein, 9 aa, Homo sapiens
  light chain complementarity determining region 3 for antibody 3642
QQTYSAPLT

SEQ ID NO: 7284 - protein, 14 aa, Homo sapiens
  heavy chain complementarity determining region 3 for antibody 3642
ARPRSAKSTYYFDY

SEQ ID NO: 7285 - protein, 9 aa, Homo sapiens
  light chain complementarity determining region 3 for antibody 3643
QQTYRTPYT

SEQ ID NO: 7286 - protein, 14 aa, Homo sapiens
  heavy chain complementarity determining region 3 for antibody 3643
SRLHGSGLGRWLDP

SEQ ID NO: 7287 - protein, 9 aa, Homo sapiens
  light chain complementarity determining region 3 for antibody 3644
QQTYRTPYT

SEQ ID NO: 7288 - protein, 14 aa, Homo sapiens
  heavy chain complementarity determining region 3 for antibody 3644
ARLHGSGLGRCLDP

SEQ ID NO: 7289 - protein, 9 aa, Homo sapiens
  light chain complementarity determining region 3 for antibody 3645
QQTYRTPYT

SEQ ID NO: 7290 - protein, 10 aa, Homo sapiens
  heavy chain complementarity determining region 3 for antibody 3645
AHRTNRAFDI

SEQ ID NO: 7291 - protein, 9 aa, Homo sapiens
  light chain complementarity determining region 3 for antibody 3646
QQTYRTPYT

SEQ ID NO: 7292 - protein, 14 aa, Homo sapiens
  heavy chain complementarity determining region 3 for antibody 3646
AGLHGSGLGRWLDP

SEQ ID NO: 7293 - protein, 9 aa, Homo sapiens
  light chain complementarity determining region 3 for antibody 3647
QQTYRTPHT

SEQ ID NO: 7294 - protein, 14 aa, Homo sapiens
  heavy chain complementarity determining region 3 for antibody 3647
ARLHGSGLGRWLDP

SEQ ID NO: 7295 - protein, 8 aa, Homo sapiens
  light chain complementarity determining region 3 for antibody 3648
QQTSTAIT

SEQ ID NO: 7296 - protein, 18 aa, Homo sapiens
  heavy chain complementarity determining region 3 for antibody 3648
ARGRGRHDYGGNLLGDDS

SEQ ID NO: 7297 - protein, 9 aa, Homo sapiens
  light chain complementarity determining region 3 for antibody 3649
QQTHRTPYT

SEQ ID NO: 7298 - protein, 14 aa, Homo sapiens
  heavy chain complementarity determining region 3 for antibody 3649
ARLHGSGLGRWLDP

SEQ ID NO: 7299 - protein, 9 aa, Homo sapiens
  light chain complementarity determining region 3 for antibody 3650
QQSYTTPYT

SEQ ID NO: 7300 - protein, 13 aa, Homo sapiens
  heavy chain complementarity determining region 3 for antibody 3650
AKEGSAPGTDFEY

SEQ ID NO: 7301 - protein, 9 aa, Homo sapiens
  light chain complementarity determining region 3 for antibody 3651
QQSYTTPYT

SEQ ID NO: 7302 - protein, 13 aa, Homo sapiens
  heavy chain complementarity determining region 3 for antibody 3651
AKEGAAPGPDFEY

SEQ ID NO: 7303 - protein, 9 aa, Homo sapiens
  light chain complementarity determining region 3 for antibody 3652
QQSYTMPRT

SEQ ID NO: 7304 - protein, 18 aa, Homo sapiens
  heavy chain complementarity determining region 3 for antibody 3652
TTVLSQLLAGGWHLYFQH

SEQ ID NO: 7305 - protein, 9 aa, Homo sapiens
  light chain complementarity determining region 3 for antibody 3653
QQSYTMPRT

SEQ ID NO: 7306 - protein, 18 aa, Homo sapiens
  heavy chain complementarity determining region 3 for antibody 3653
TTVLSQLLAGDWRLYFQH

SEQ ID NO: 7307 - protein, 9 aa, Homo sapiens
  light chain complementarity determining region 3 for antibody 3654
QQSYTMPRT

SEQ ID NO: 7308 - protein, 18 aa, Homo sapiens
  heavy chain complementarity determining region 3 for antibody 3654
TTVLSHLLAGDWHLYFHH

SEQ ID NO: 7309 - protein, 9 aa, Homo sapiens
  light chain complementarity determining region 3 for antibody 3655
QQSYTMPRP

SEQ ID NO: 7310 - protein, 18 aa, Homo sapiens
  heavy chain complementarity determining region 3 for antibody 3655
TTVLSQLLAGDWHLYFQH

SEQ ID NO: 7311 - protein, 9 aa, Homo sapiens
  light chain complementarity determining region 3 for antibody 3656
QQSYTMPRA

SEQ ID NO: 7312 - protein, 18 aa, Homo sapiens
  heavy chain complementarity determining region 3 for antibody 3656
TTVLSQLLAGDWHLYFQH

SEQ ID NO: 7313 - protein, 9 aa, Homo sapiens
  light chain complementarity determining region 3 for antibody 3657
QQSYTMHRT

SEQ ID NO: 7314 - protein, 18 aa, Homo sapiens
  heavy chain complementarity determining region 3 for antibody 3657
TTVLSQLLAGDWHLYFQH

SEQ ID NO: 7315 - protein, 9 aa, Homo sapiens
  light chain complementarity determining region 3 for antibody 3658
QQSYSTPST

SEQ ID NO: 7316 - protein, 10 aa, Homo sapiens
  heavy chain complementarity determining region 3 for antibody 3658
CRDREGFGDV

SEQ ID NO: 7317 - protein, 9 aa, Homo sapiens
  light chain complementarity determining region 3 for antibody 3659
QQSYSTPST

SEQ ID NO: 7318 - protein, 16 aa, Homo sapiens
  heavy chain complementarity determining region 3 for antibody 3659
ARWFSRSSTGVSYTDV

SEQ ID NO: 7319 - protein, 9 aa, Homo sapiens
  light chain complementarity determining region 3 for antibody 3660
QQSYSTPST

SEQ ID NO: 7320 - protein, 16 aa, Homo sapiens
  heavy chain complementarity determining region 3 for antibody 3660
ARWFSRSGTGVSYMDV

SEQ ID NO: 7321 - protein, 9 aa, Homo sapiens
  light chain complementarity determining region 3 for antibody 3661
QQSYSTPRT

SEQ ID NO: 7322 - protein, 11 aa, Homo sapiens
  heavy chain complementarity determining region 3 for antibody 3661
ARDQHGQAPDY

SEQ ID NO: 7323 - protein, 9 aa, Homo sapiens
  light chain complementarity determining region 3 for antibody 3662
QQSYSTPRP

SEQ ID NO: 7324 - protein, 11 aa, Homo sapiens
  heavy chain complementarity determining region 3 for antibody 3662
AREQHGQAPDY

SEQ ID NO: 7325 - protein, 9 aa, Homo sapiens
  light chain complementarity determining region 3 for antibody 3663
QQSYSTPPT

SEQ ID NO: 7326 - protein, 13 aa, Homo sapiens
  heavy chain complementarity determining region 3 for antibody 3663
AKEGSAPGPDFEY

SEQ ID NO: 7327 - protein, 11 aa, Homo sapiens
  light chain complementarity determining region 3 for antibody 3664
QQSYSTPPRLT

SEQ ID NO: 7328 - protein, 13 aa, Homo sapiens
  heavy chain complementarity determining region 3 for antibody 3664
AKEGSSAGPDFVY

SEQ ID NO: 7329 - protein, 10 aa, Homo sapiens
  light chain complementarity determining region 3 for antibody 3665
QQSYSTPLFT

SEQ ID NO: 7330 - protein, 15 aa, Homo sapiens
  heavy chain complementarity determining region 3 for antibody 3665
ARVGRRYHNAWYFDN

SEQ ID NO: 7331 - protein, 10 aa, Homo sapiens
  light chain complementarity determining region 3 for antibody 3666
QQSYSTPLFT

SEQ ID NO: 7332 - protein, 15 aa, Homo sapiens
  heavy chain complementarity determining region 3 for antibody 3666
ARVGRPYHNAWYFDT

SEQ ID NO: 7333 - protein, 10 aa, Homo sapiens
  light chain complementarity determining region 3 for antibody 3667
QQSYSTPLFT

SEQ ID NO: 7334 - protein, 15 aa, Homo sapiens
  heavy chain complementarity determining region 3 for antibody 3667
ARVGRPYHNAWCFDN

SEQ ID NO: 7335 - protein, 10 aa, Homo sapiens
  light chain complementarity determining region 3 for antibody 3668
QQSYSTPLFT

SEQ ID NO: 7336 - protein, 15 aa, Homo sapiens
  heavy chain complementarity determining region 3 for antibody 3668
ARVGRPYHNACYFDN

SEQ ID NO: 7337 - protein, 10 aa, Homo sapiens
  light chain complementarity determining region 3 for antibody 3669
QQSYSTPLFT

SEQ ID NO: 7338 - protein, 15 aa, Homo sapiens
  heavy chain complementarity determining region 3 for antibody 3669
ARVGRPDHNAWYFDN

SEQ ID NO: 7339 - protein, 10 aa, Homo sapiens
  light chain complementarity determining region 3 for antibody 3670
QQSYSTPLFT

SEQ ID NO: 7340 - protein, 23 aa, Homo sapiens
  heavy chain complementarity determining region 3 for antibody 3670
ARHFPMGGSTVTGTQSLLYYVDV

SEQ ID NO: 7341 - protein, 10 aa, Homo sapiens
  light chain complementarity determining region 3 for antibody 3671
QQSYSTPLFT

SEQ ID NO: 7342 - protein, 23 aa, Homo sapiens
  heavy chain complementarity determining region 3 for antibody 3671
ARHFPMGGSTVTGTQSLLYYIDV

SEQ ID NO: 7343 - protein, 10 aa, Homo sapiens
  light chain complementarity determining region 3 for antibody 3672
QQSYSTPLFT

SEQ ID NO: 7344 - protein, 23 aa, Homo sapiens
  heavy chain complementarity determining region 3 for antibody 3672
ARHFPMGGSAVTGTQSLLYYMDV

SEQ ID NO: 7345 - protein, 10 aa, Homo sapiens
  light chain complementarity determining region 3 for antibody 3673
QQSYSTPLFT

SEQ ID NO: 7346 - protein, 23 aa, Homo sapiens
  heavy chain complementarity determining region 3 for antibody 3673
ARHFPKGGSGVTGTQSLLCYMDV

SEQ ID NO: 7347 - protein, 9 aa, Homo sapiens
  light chain complementarity determining region 3 for antibody 3674
QQSYSTPIT

SEQ ID NO: 7348 - protein, 17 aa, Homo sapiens
  heavy chain complementarity determining region 3 for antibody 3674
ARNTMVGTWQRQGNPDH

SEQ ID NO: 7349 - protein, 9 aa, Homo sapiens
  light chain complementarity determining region 3 for antibody 3675
QQSYSTPIT

SEQ ID NO: 7350 - protein, 17 aa, Homo sapiens
  heavy chain complementarity determining region 3 for antibody 3675
ARNAMVGTWQRQGNLDH

SEQ ID NO: 7351 - protein, 9 aa, Homo sapiens
  light chain complementarity determining region 3 for antibody 3676
QQSYSTPGT

SEQ ID NO: 7352 - protein, 11 aa, Homo sapiens
  heavy chain complementarity determining region 3 for antibody 3676
ARRSLGGAFDY

SEQ ID NO: 7353 - protein, 10 aa, Homo sapiens
  light chain complementarity determining region 3 for antibody 3677
QQSYSTLPYT

SEQ ID NO: 7354 - protein, 22 aa, Homo sapiens
  heavy chain complementarity determining region 3 for antibody 3677
AKDKGTPYSCGPYYYYYYGMDV

SEQ ID NO: 7355 - protein, 10 aa, Homo sapiens
  light chain complementarity determining region 3 for antibody 3678
QQSYSTLPFT

SEQ ID NO: 7356 - protein, 12 aa, Homo sapiens
  heavy chain complementarity determining region 3 for antibody 3678
AIVVPGRWDLDD

SEQ ID NO: 7357 - protein, 9 aa, Homo sapiens
  light chain complementarity determining region 3 for antibody 3679
QQSYSSPWT

SEQ ID NO: 7358 - protein, 15 aa, Homo sapiens
  heavy chain complementarity determining region 3 for antibody 3679
ARIWTSSINCRYMDV

SEQ ID NO: 7359 - protein, 8 aa, Homo sapiens
  light chain complementarity determining region 3 for antibody 3680
QQSYSSPT

SEQ ID NO: 7360 - protein, 17 aa, Homo sapiens
  heavy chain complementarity determining region 3 for antibody 3680
AKGRGSVAMARIYYLDL

SEQ ID NO: 7361 - protein, 9 aa, Homo sapiens
  light chain complementarity determining region 3 for antibody 3681
QQSYRHPLS

SEQ ID NO: 7362 - protein, 9 aa, Homo sapiens
  heavy chain complementarity determining region 3 for antibody 3681
ARSEYQPTY

SEQ ID NO: 7363 - protein, 9 aa, Homo sapiens
  light chain complementarity determining region 3 for antibody 3682
QQSYNPPPT

SEQ ID NO: 7364 - protein, 11 aa, Homo sapiens
  heavy chain complementarity determining region 3 for antibody 3682
ARGGTLAWFDP

SEQ ID NO: 7365 - protein, 9 aa, Homo sapiens
  light chain complementarity determining region 3 for antibody 3683
QQSYNPPLT

SEQ ID NO: 7366 - protein, 11 aa, Homo sapiens
  heavy chain complementarity determining region 3 for antibody 3683
AKGGTLNWLDS

SEQ ID NO: 7367 - protein, 9 aa, Homo sapiens
  light chain complementarity determining region 3 for antibody 3684
QQSSNTPLT

SEQ ID NO: 7368 - protein, 16 aa, Homo sapiens
  heavy chain complementarity determining region 3 for antibody 3684
VRDLAGVTRGGSTFDY

SEQ ID NO: 7369 - protein, 9 aa, Homo sapiens
  light chain complementarity determining region 3 for antibody 3685
QQSSNTPLT

SEQ ID NO: 7370 - protein, 16 aa, Homo sapiens
  heavy chain complementarity determining region 3 for antibody 3685
VRDLAGFTRGGSTFGY

SEQ ID NO: 7371 - protein, 9 aa, Homo sapiens
  light chain complementarity determining region 3 for antibody 3686
QQSSNTPLT

SEQ ID NO: 7372 - protein, 16 aa, Homo sapiens
  heavy chain complementarity determining region 3 for antibody 3686
VRDLAGFARGGSTFDY

SEQ ID NO: 7373 - protein, 9 aa, Homo sapiens
  light chain complementarity determining region 3 for antibody 3687
QQSSNTPLT

SEQ ID NO: 7374 - protein, 12 aa, Homo sapiens
  heavy chain complementarity determining region 3 for antibody 3687
ARDKGGRNGMDV

SEQ ID NO: 7375 - protein, 10 aa, Homo sapiens
  light chain complementarity determining region 3 for antibody 3688
QQSHTTPALT

SEQ ID NO: 7376 - protein, 15 aa, Homo sapiens
  heavy chain complementarity determining region 3 for antibody 3688
ATPMYSTTWFNAFDI

SEQ ID NO: 7377 - protein, 11 aa, Homo sapiens
  light chain complementarity determining region 3 for antibody 3689
QQRSSSWPGLT

SEQ ID NO: 7378 - protein, 16 aa, Homo sapiens
  heavy chain complementarity determining region 3 for antibody 3689
AKSHGASHNSNYRFDY

SEQ ID NO: 7379 - protein, 8 aa, Homo sapiens
  light chain complementarity determining region 3 for antibody 3690
QQRSNWPT

SEQ ID NO: 7380 - protein, 9 aa, Homo sapiens
  heavy chain complementarity determining region 3 for antibody 3690
ARSEYQPTY

SEQ ID NO: 7381 - protein, 9 aa, Homo sapiens
  light chain complementarity determining region 3 for antibody 3691
QQRSNWPRP

SEQ ID NO: 7382 - protein, 12 aa, Homo sapiens
  heavy chain complementarity determining region 3 for antibody 3691
TRDTIQATILGC

SEQ ID NO: 7383 - protein, 9 aa, Homo sapiens
  light chain complementarity determining region 3 for antibody 3692
QQRSNWPPT

SEQ ID NO: 7384 - protein, 11 aa, Homo sapiens
  heavy chain complementarity determining region 3 for antibody 3692
AREQHGQAPDY

SEQ ID NO: 7385 - protein, 11 aa, Homo sapiens
  light chain complementarity determining region 3 for antibody 3693
QQRSNWPPALT

SEQ ID NO: 7386 - protein, 10 aa, Homo sapiens
  heavy chain complementarity determining region 3 for antibody 3693
CRDREGFGDV

SEQ ID NO: 7387 - protein, 9 aa, Homo sapiens
  light chain complementarity determining region 3 for antibody 3694
QQRSNWPIT

SEQ ID NO: 7388 - protein, 13 aa, Homo sapiens
  heavy chain complementarity determining region 3 for antibody 3694
ASLRRDNSGHFNY

SEQ ID NO: 7389 - protein, 9 aa, Homo sapiens
  light chain complementarity determining region 3 for antibody 3695
QQRSNTPLT

SEQ ID NO: 7390 - protein, 16 aa, Homo sapiens
  heavy chain complementarity determining region 3 for antibody 3695
VRDLAGFTRGGSTFDY

SEQ ID NO: 7391 - protein, 8 aa, Homo sapiens
  light chain complementarity determining region 3 for antibody 3696
QQRSNPAT

SEQ ID NO: 7392 - protein, 17 aa, Homo sapiens
  heavy chain complementarity determining region 3 for antibody 3696
ARGTGIGSGSYYADFDY

SEQ ID NO: 7393 - protein, 9 aa, Homo sapiens
  light chain complementarity determining region 3 for antibody 3697
QQPSNAPLT

SEQ ID NO: 7394 - protein, 17 aa, Homo sapiens
  heavy chain complementarity determining region 3 for antibody 3697
AKRLPDLLGGGHHYIDV

SEQ ID NO: 7395 - protein, 10 aa, Homo sapiens
  light chain complementarity determining region 3 for antibody 3698
QQNDNLASLT

SEQ ID NO: 7396 - protein, 13 aa, Homo sapiens
  heavy chain complementarity determining region 3 for antibody 3698
AKEGSSPGPDFEY

SEQ ID NO: 7397 - protein, 9 aa, Homo sapiens
  light chain complementarity determining region 3 for antibody 3699
QQLYSYPIT

SEQ ID NO: 7398 - protein, 14 aa, Homo sapiens
  heavy chain complementarity determining region 3 for antibody 3699
ARDTTYNWNDGGIS

SEQ ID NO: 7399 - protein, 9 aa, Homo sapiens
  light chain complementarity determining region 3 for antibody 3700
QQLYRYPIT

SEQ ID NO: 7400 - protein, 14 aa, Homo sapiens
  heavy chain complementarity determining region 3 for antibody 3700
GRDTTHDWSDGVIY

SEQ ID NO: 7401 - protein, 9 aa, Homo sapiens
  light chain complementarity determining region 3 for antibody 3701
QQLYRYPIT

SEQ ID NO: 7402 - protein, 14 aa, Homo sapiens
  heavy chain complementarity determining region 3 for antibody 3701
GRDTAHDWSDGGIY

SEQ ID NO: 7403 - protein, 9 aa, Homo sapiens
  light chain complementarity determining region 3 for antibody 3702
QQLYRYPIP

SEQ ID NO: 7404 - protein, 14 aa, Homo sapiens
  heavy chain complementarity determining region 3 for antibody 3702
GRDTTHDWSDGGIY

SEQ ID NO: 7405 - protein, 9 aa, Homo sapiens
  light chain complementarity determining region 3 for antibody 3703
QQLSTAPLT

SEQ ID NO: 7406 - protein, 17 aa, Homo sapiens
  heavy chain complementarity determining region 3 for antibody 3703
AKRLPDLLGGGHHYIDV

SEQ ID NO: 7407 - protein, 9 aa, Homo sapiens
  light chain complementarity determining region 3 for antibody 3704
QQLSNVPLT

SEQ ID NO: 7408 - protein, 17 aa, Homo sapiens
  heavy chain complementarity determining region 3 for antibody 3704
AKRLPDLLGGGHHYIDV

SEQ ID NO: 7409 - protein, 9 aa, Homo sapiens
  light chain complementarity determining region 3 for antibody 3705
QQLSNAPLT

SEQ ID NO: 7410 - protein, 16 aa, Homo sapiens
  heavy chain complementarity determining region 3 for antibody 3705
VRDLAGFTRGGSTFDY

SEQ ID NO: 7411 - protein, 9 aa, Homo sapiens
  light chain complementarity determining region 3 for antibody 3706
QQLSNAPLT

SEQ ID NO: 7412 - protein, 9 aa, Homo sapiens
  heavy chain complementarity determining region 3 for antibody 3706
GRAWTYARH

SEQ ID NO: 7413 - protein, 9 aa, Homo sapiens
  light chain complementarity determining region 3 for antibody 3707
QQLSNAPLT

SEQ ID NO: 7414 - protein, 17 aa, Homo sapiens
  heavy chain complementarity determining region 3 for antibody 3707
AKRLPDLLGGGHHYIDF

SEQ ID NO: 7415 - protein, 9 aa, Homo sapiens
  light chain complementarity determining region 3 for antibody 3708
QQLSNAPLT

SEQ ID NO: 7416 - protein, 17 aa, Homo sapiens
  heavy chain complementarity determining region 3 for antibody 3708
AKRLPDLLGCGHHYIDV

SEQ ID NO: 7417 - protein, 9 aa, Homo sapiens
  light chain complementarity determining region 3 for antibody 3709
QQLNSYPYT

SEQ ID NO: 7418 - protein, 17 aa, Homo sapiens
  heavy chain complementarity determining region 3 for antibody 3709
ARNTMVGTWQRQGNLDH

SEQ ID NO: 7419 - protein, 9 aa, Homo sapiens
  light chain complementarity determining region 3 for antibody 3710
QQLNSYPYT

SEQ ID NO: 7420 - protein, 14 aa, Homo sapiens
  heavy chain complementarity determining region 3 for antibody 3710
ARGHFDSTGFRLGY

SEQ ID NO: 7421 - protein, 9 aa, Homo sapiens
  light chain complementarity determining region 3 for antibody 3711
QQLNSYPYT

SEQ ID NO: 7422 - protein, 14 aa, Homo sapiens
  heavy chain complementarity determining region 3 for antibody 3711
ARGHFDRTGFRLDY

SEQ ID NO: 7423 - protein, 9 aa, Homo sapiens
  light chain complementarity determining region 3 for antibody 3712
QQLNSYPYA

SEQ ID NO: 7424 - protein, 14 aa, Homo sapiens
  heavy chain complementarity determining region 3 for antibody 3712
ARGHFDSTGFRLDY

SEQ ID NO: 7425 - protein, 9 aa, Homo sapiens
  light chain complementarity determining region 3 for antibody 3713
QQLNSYPRT

SEQ ID NO: 7426 - protein, 16 aa, Homo sapiens
  heavy chain complementarity determining region 3 for antibody 3713
ARGHTNPGERRGGSDF

SEQ ID NO: 7427 - protein, 9 aa, Homo sapiens
  light chain complementarity determining region 3 for antibody 3714
QQLNSYPLT

SEQ ID NO: 7428 - protein, 13 aa, Homo sapiens
  heavy chain complementarity determining region 3 for antibody 3714
ARDPTGKFSGFDL

SEQ ID NO: 7429 - protein, 9 aa, Homo sapiens
  light chain complementarity determining region 3 for antibody 3715
QQLNSYPLT

SEQ ID NO: 7430 - protein, 19 aa, Homo sapiens
  heavy chain complementarity determining region 3 for antibody 3715
AKGLYYYDNDVYNCEYFQH

SEQ ID NO: 7431 - protein, 9 aa, Homo sapiens
  light chain complementarity determining region 3 for antibody 3716
QQLNSFPYP

SEQ ID NO: 7432 - protein, 21 aa, Homo sapiens
  heavy chain complementarity determining region 3 for antibody 3716
ARGSRTDCRSDDTGCRPMFDS

SEQ ID NO: 7433 - protein, 9 aa, Homo sapiens
  light chain complementarity determining region 3 for antibody 3717
QQLMVYPYT

SEQ ID NO: 7434 - protein, 14 aa, Homo sapiens
  heavy chain complementarity determining region 3 for antibody 3717
TRGHLDSTGFRLDY

SEQ ID NO: 7435 - protein, 9 aa, Homo sapiens
  light chain complementarity determining region 3 for antibody 3718
QQLMVYPYT

SEQ ID NO: 7436 - protein, 14 aa, Homo sapiens
  heavy chain complementarity determining region 3 for antibody 3718
TRGHFDSTGVRLDY

SEQ ID NO: 7437 - protein, 9 aa, Homo sapiens
  light chain complementarity determining region 3 for antibody 3719
QQLMSYPYT

SEQ ID NO: 7438 - protein, 14 aa, Homo sapiens
  heavy chain complementarity determining region 3 for antibody 3719
ARGHVDSTGFRLDY

SEQ ID NO: 7439 - protein, 9 aa, Homo sapiens
  light chain complementarity determining region 3 for antibody 3720
QQLMSYPYT

SEQ ID NO: 7440 - protein, 14 aa, Homo sapiens
  heavy chain complementarity determining region 3 for antibody 3720
ARGHLDSTGFRLDY

SEQ ID NO: 7441 - protein, 9 aa, Homo sapiens
  light chain complementarity determining region 3 for antibody 3721
QQLMSYPYT

SEQ ID NO: 7442 - protein, 14 aa, Homo sapiens
  heavy chain complementarity determining region 3 for antibody 3721
ARGHFDSTGCRLDY

SEQ ID NO: 7443 - protein, 9 aa, Homo sapiens
  light chain complementarity determining region 3 for antibody 3722
QQLMSYPYT

SEQ ID NO: 7444 - protein, 14 aa, Homo sapiens
  heavy chain complementarity determining region 3 for antibody 3722
ARGHFDSAGFRLDY

SEQ ID NO: 7445 - protein, 9 aa, Homo sapiens
  light chain complementarity determining region 3 for antibody 3723
QQLMSYPYT

SEQ ID NO: 7446 - protein, 14 aa, Homo sapiens
  heavy chain complementarity determining region 3 for antibody 3723
ARGHCDSTGFRLDY

SEQ ID NO: 7447 - protein, 9 aa, Homo sapiens
  light chain complementarity determining region 3 for antibody 3724
QQLISYPYT

SEQ ID NO: 7448 - protein, 14 aa, Homo sapiens
  heavy chain complementarity determining region 3 for antibody 3724
ARGHFDSTGFRLDY

SEQ ID NO: 7449 - protein, 9 aa, Homo sapiens
  light chain complementarity determining region 3 for antibody 3725
QQLHSSPYT

SEQ ID NO: 7450 - protein, 14 aa, Homo sapiens
  heavy chain complementarity determining region 3 for antibody 3725
TRGHFDSTGFRLDY

SEQ ID NO: 7451 - protein, 9 aa, Homo sapiens
  light chain complementarity determining region 3 for antibody 3726
QQLHSSPYP

SEQ ID NO: 7452 - protein, 14 aa, Homo sapiens
  heavy chain complementarity determining region 3 for antibody 3726
ARGHFDSTGFRLDY

SEQ ID NO: 7453 - protein, 9 aa, Homo sapiens
  light chain complementarity determining region 3 for antibody 3727
QQLHSCPYT

SEQ ID NO: 7454 - protein, 14 aa, Homo sapiens
  heavy chain complementarity determining region 3 for antibody 3727
TRGHFDSTGFRLDY

SEQ ID NO: 7455 - protein, 9 aa, Homo sapiens
  light chain complementarity determining region 3 for antibody 3728
QQLDSYPLT

SEQ ID NO: 7456 - protein, 19 aa, Homo sapiens
  heavy chain complementarity determining region 3 for antibody 3728
AKGLYYYDSSGYKCEYLQH

SEQ ID NO: 7457 - protein, 9 aa, Homo sapiens
  light chain complementarity determining region 3 for antibody 3729
QQHYSIPFT

SEQ ID NO: 7458 - protein, 11 aa, Homo sapiens
  heavy chain complementarity determining region 3 for antibody 3729
VKEGDWFLGDP

SEQ ID NO: 7459 - protein, 9 aa, Homo sapiens
  light chain complementarity determining region 3 for antibody 3730
QQHYNTPYT

SEQ ID NO: 7460 - protein, 18 aa, Homo sapiens
  heavy chain complementarity determining region 3 for antibody 3730
AKTADCSGGNCYQSHFDF

SEQ ID NO: 7461 - protein, 9 aa, Homo sapiens
  light chain complementarity determining region 3 for antibody 3731
QQHYNIPFT

SEQ ID NO: 7462 - protein, 14 aa, Homo sapiens
  heavy chain complementarity determining region 3 for antibody 3731
AKGRIASCYDASDI

SEQ ID NO: 7463 - protein, 9 aa, Homo sapiens
  light chain complementarity determining region 3 for antibody 3732
QQHLYPPPT

SEQ ID NO: 7464 - protein, 21 aa, Homo sapiens
  heavy chain complementarity determining region 3 for antibody 3732
ARGRRTDCRNGDIGCRPMFDF

SEQ ID NO: 7465 - protein, 8 aa, Homo sapiens
  light chain complementarity determining region 3 for antibody 3733
QQHGTSFT

SEQ ID NO: 7466 - protein, 16 aa, Homo sapiens
  heavy chain complementarity determining region 3 for antibody 3733
SRWAGVASGWSGPFDN

SEQ ID NO: 7467 - protein, 9 aa, Homo sapiens
  light chain complementarity determining region 3 for antibody 3734
QQHDTSHSP

SEQ ID NO: 7468 - protein, 10 aa, Homo sapiens
  heavy chain complementarity determining region 3 for antibody 3734
ARDISARFDS

SEQ ID NO: 7469 - protein, 9 aa, Homo sapiens
  light chain complementarity determining region 3 for antibody 3735
QQFSSFPRT

SEQ ID NO: 7470 - protein, 13 aa, Homo sapiens
  heavy chain complementarity determining region 3 for antibody 3735
AKEGSSPGPDFEY

SEQ ID NO: 7471 - protein, 9 aa, Homo sapiens
  light chain complementarity determining region 3 for antibody 3736
QQFSNLPRT

SEQ ID NO: 7472 - protein, 14 aa, Homo sapiens
  heavy chain complementarity determining region 3 for antibody 3736
ARGHFDSTGFRLDY

SEQ ID NO: 7473 - protein, 9 aa, Homo sapiens
  light chain complementarity determining region 3 for antibody 3737
QQFSNLPRT

SEQ ID NO: 7474 - protein, 13 aa, Homo sapiens
  heavy chain complementarity determining region 3 for antibody 3737
AREGSSPGPDFDS

SEQ ID NO: 7475 - protein, 9 aa, Homo sapiens
  light chain complementarity determining region 3 for antibody 3738
QQFSNLPRT

SEQ ID NO: 7476 - protein, 13 aa, Homo sapiens
  heavy chain complementarity determining region 3 for antibody 3738
AKEGSSPGTDFDS

SEQ ID NO: 7477 - protein, 9 aa, Homo sapiens
  light chain complementarity determining region 3 for antibody 3739
QQFSNLPRT

SEQ ID NO: 7478 - protein, 13 aa, Homo sapiens
  heavy chain complementarity determining region 3 for antibody 3739
AKEGSSPGPDSDS

SEQ ID NO: 7479 - protein, 9 aa, Homo sapiens
  light chain complementarity determining region 3 for antibody 3740
QQFSNLPRT

SEQ ID NO: 7480 - protein, 13 aa, Homo sapiens
  heavy chain complementarity determining region 3 for antibody 3740
AKEGSAPGPDFEY

SEQ ID NO: 7481 - protein, 8 aa, Homo sapiens
  light chain complementarity determining region 3 for antibody 3741
QQFQVNPT

SEQ ID NO: 7482 - protein, 11 aa, Homo sapiens
  heavy chain complementarity determining region 3 for antibody 3741
TKWTVTTTFDY

SEQ ID NO: 7483 - protein, 9 aa, Homo sapiens
  light chain complementarity determining region 3 for antibody 3742
QQFNSYPYT

SEQ ID NO: 7484 - protein, 11 aa, Homo sapiens
  heavy chain complementarity determining region 3 for antibody 3742
AKEQHGQAPDY

SEQ ID NO: 7485 - protein, 9 aa, Homo sapiens
  light chain complementarity determining region 3 for antibody 3743
QQFNSYPRT

SEQ ID NO: 7486 - protein, 12 aa, Homo sapiens
  heavy chain complementarity determining region 3 for antibody 3743
ARDKGGRNGMDV

SEQ ID NO: 7487 - protein, 9 aa, Homo sapiens
  light chain complementarity determining region 3 for antibody 3744
QQFNSHPYT

SEQ ID NO: 7488 - protein, 9 aa, Homo sapiens
  heavy chain complementarity determining region 3 for antibody 3744
ARGRSNFRF

SEQ ID NO: 7489 - protein, 11 aa, Homo sapiens
  light chain complementarity determining region 3 for antibody 3745
QQFGGSPPTYT

SEQ ID NO: 7490 - protein, 12 aa, Homo sapiens
  heavy chain complementarity determining region 3 for antibody 3745
ARLDWNYRAFDI

SEQ ID NO: 7491 - protein, 10 aa, Homo sapiens
  light chain complementarity determining region 3 for antibody 3746
QQFGGSPMYP

SEQ ID NO: 7492 - protein, 13 aa, Homo sapiens
  heavy chain complementarity determining region 3 for antibody 3746
TADFYDYVWGPRY

SEQ ID NO: 7493 - protein, 9 aa, Homo sapiens
  light chain complementarity determining region 3 for antibody 3747
QQFDSFPRT

SEQ ID NO: 7494 - protein, 9 aa, Homo sapiens
  heavy chain complementarity determining region 3 for antibody 3747
VRGRNNFRY

SEQ ID NO: 7495 - protein, 9 aa, Homo sapiens
  light chain complementarity determining region 3 for antibody 3748
QQFANLPRT

SEQ ID NO: 7496 - protein, 9 aa, Homo sapiens
  heavy chain complementarity determining region 3 for antibody 3748
MRGRSNFRY

SEQ ID NO: 7497 - protein, 9 aa, Homo sapiens
  light chain complementarity determining region 3 for antibody 3749
QQDYYTPRT

SEQ ID NO: 7498 - protein, 11 aa, Homo sapiens
  heavy chain complementarity determining region 3 for antibody 3749
TRGGYSVGYDY

SEQ ID NO: 7499 - protein, 9 aa, Homo sapiens
  light chain complementarity determining region 3 for antibody 3750
QQDYYTPRT

SEQ ID NO: 7500 - protein, 10 aa, Homo sapiens
  heavy chain complementarity determining region 3 for antibody 3750
CRDREGFGDV

SEQ ID NO: 7501 - protein, 9 aa, Homo sapiens
  light chain complementarity determining region 3 for antibody 3751
QQDYYTPRT

SEQ ID NO: 7502 - protein, 11 aa, Homo sapiens
  heavy chain complementarity determining region 3 for antibody 3751
AGRSLGGAFDY

SEQ ID NO: 7503 - protein, 9 aa, Homo sapiens
  light chain complementarity determining region 3 for antibody 3752
QQDNSYPWT

SEQ ID NO: 7504 - protein, 15 aa, Homo sapiens
  heavy chain complementarity determining region 3 for antibody 3752
GKEGPGSSGWLTGHY

SEQ ID NO: 7505 - protein, 8 aa, Homo sapiens
  light chain complementarity determining region 3 for antibody 3753
QQDKSYWT

SEQ ID NO: 7506 - protein, 10 aa, Homo sapiens
  heavy chain complementarity determining region 3 for antibody 3753
ARERSGSYDI

SEQ ID NO: 7507 - protein, 9 aa, Homo sapiens
  light chain complementarity determining region 3 for antibody 3754
QQDGGSLIT

SEQ ID NO: 7508 - protein, 10 aa, Homo sapiens
  heavy chain complementarity determining region 3 for antibody 3754
CRDRWGFGDV

SEQ ID NO: 7509 - protein, 9 aa, Homo sapiens
  light chain complementarity determining region 3 for antibody 3755
QQDDNWPWT

SEQ ID NO: 7510 - protein, 17 aa, Homo sapiens
  heavy chain complementarity determining region 3 for antibody 3755
VTHYYHDSGIYHDFFNY

SEQ ID NO: 7511 - protein, 9 aa, Homo sapiens
  light chain complementarity determining region 3 for antibody 3756
QQDATSPLT

SEQ ID NO: 7512 - protein, 14 aa, Homo sapiens
  heavy chain complementarity determining region 3 for antibody 3756
ARASGGDTDFLIDF

SEQ ID NO: 7513 - protein, 10 aa, Homo sapiens
  light chain complementarity determining region 3 for antibody 3757
QQCSNWPALT

SEQ ID NO: 7514 - protein, 12 aa, Homo sapiens
  heavy chain complementarity determining region 3 for antibody 3757
AIVVPGRWDLDD

SEQ ID NO: 7515 - protein, 10 aa, Homo sapiens
  light chain complementarity determining region 3 for antibody 3758
QQANSFPPIT

SEQ ID NO: 7516 - protein, 9 aa, Homo sapiens
  heavy chain complementarity determining region 3 for antibody 3758
ALDHYGPRN

SEQ ID NO: 7517 - protein, 9 aa, Homo sapiens
  light chain complementarity determining region 3 for antibody 3759
QQAHTYPLT

SEQ ID NO: 7518 - protein, 14 aa, Homo sapiens
  heavy chain complementarity determining region 3 for antibody 3759
ARDPYGDPSSDFDY

SEQ ID NO: 7519 - protein, 9 aa, Homo sapiens
  light chain complementarity determining region 3 for antibody 3760
QPYYGVPIT

SEQ ID NO: 7520 - protein, 8 aa, Homo sapiens
  heavy chain complementarity determining region 3 for antibody 3760
ARDFSLTA

SEQ ID NO: 7521 - protein, 9 aa, Homo sapiens
  light chain complementarity determining region 3 for antibody 3761
QPYNSYSLT

SEQ ID NO: 7522 - protein, 15 aa, Homo sapiens
  heavy chain complementarity determining region 3 for antibody 3761
ARSMVSGTTDDAFDI

SEQ ID NO: 7523 - protein, 10 aa, Homo sapiens
  light chain complementarity determining region 3 for antibody 3762
QNYNYAPPIT

SEQ ID NO: 7524 - protein, 17 aa, Homo sapiens
  heavy chain complementarity determining region 3 for antibody 3762
ARGIQNSDRTSFFYFDF

SEQ ID NO: 7525 - protein, 9 aa, Homo sapiens
  light chain complementarity determining region 3 for antibody 3763
QLSGSSLLT

SEQ ID NO: 7526 - protein, 12 aa, Homo sapiens
  heavy chain complementarity determining region 3 for antibody 3763
ALDEWYPSWYKY

SEQ ID NO: 7527 - protein, 9 aa, Homo sapiens
  light chain complementarity determining region 3 for antibody 3764
QLSGSSLLT

SEQ ID NO: 7528 - protein, 12 aa, Homo sapiens
  heavy chain complementarity determining region 3 for antibody 3764
ALDEWPPSWYKY

SEQ ID NO: 7529 - protein, 9 aa, Homo sapiens
  light chain complementarity determining region 3 for antibody 3765
QLSGSSLLT

SEQ ID NO: 7530 - protein, 12 aa, Homo sapiens
  heavy chain complementarity determining region 3 for antibody 3765
ALDEWHPSWYNY

SEQ ID NO: 7531 - protein, 9 aa, Homo sapiens
  light chain complementarity determining region 3 for antibody 3766
QLSGRSLLT

SEQ ID NO: 7532 - protein, 12 aa, Homo sapiens
  heavy chain complementarity determining region 3 for antibody 3766
ALDEWHPSWYKY

SEQ ID NO: 7533 - protein, 10 aa, Homo sapiens
  light chain complementarity determining region 3 for antibody 3767
QKYYSSPPWA

SEQ ID NO: 7534 - protein, 16 aa, Homo sapiens
  heavy chain complementarity determining region 3 for antibody 3767
ASLNRGDKEFGVPPAL

SEQ ID NO: 7535 - protein, 7 aa, Homo sapiens
  light chain complementarity determining region 3 for antibody 3768
QKYNTWT

SEQ ID NO: 7536 - protein, 12 aa, Homo sapiens
  heavy chain complementarity determining region 3 for antibody 3768
ARDKGGRNGMDV

SEQ ID NO: 7537 - protein, 9 aa, Homo sapiens
  light chain complementarity determining region 3 for antibody 3769
QKYNSAPLT

SEQ ID NO: 7538 - protein, 16 aa, Homo sapiens
  heavy chain complementarity determining region 3 for antibody 3769
AKSLNIEVSHSGPFDF

SEQ ID NO: 7539 - protein, 9 aa, Homo sapiens
  light chain complementarity determining region 3 for antibody 3770
QKYNSAPHT

SEQ ID NO: 7540 - protein, 14 aa, Homo sapiens
  heavy chain complementarity determining region 3 for antibody 3770
TRGCVEASTPHFDY

SEQ ID NO: 7541 - protein, 9 aa, Homo sapiens
  light chain complementarity determining region 3 for antibody 3771
QKYNKVPWT

SEQ ID NO: 7542 - protein, 12 aa, Homo sapiens
  heavy chain complementarity determining region 3 for antibody 3771
AREIGSSYPFDY

SEQ ID NO: 7543 - protein, 9 aa, Homo sapiens
  light chain complementarity determining region 3 for antibody 3772
QKYKSAQFT

SEQ ID NO: 7544 - protein, 13 aa, Homo sapiens
  heavy chain complementarity determining region 3 for antibody 3772
AKEGSSPGPDFEY

SEQ ID NO: 7545 - protein, 9 aa, Homo sapiens
  light chain complementarity determining region 3 for antibody 3773
QKYKSAPLT

SEQ ID NO: 7546 - protein, 13 aa, Homo sapiens
  heavy chain complementarity determining region 3 for antibody 3773
AKEGSSPGPDFEY

SEQ ID NO: 7547 - protein, 9 aa, Homo sapiens
  light chain complementarity determining region 3 for antibody 3774
QKYKSAPFT

SEQ ID NO: 7548 - protein, 13 aa, Homo sapiens
  heavy chain complementarity determining region 3 for antibody 3774
AKEGSSPGTDFEY

SEQ ID NO: 7549 - protein, 9 aa, Homo sapiens
  light chain complementarity determining region 3 for antibody 3775
QKYKNVPWT

SEQ ID NO: 7550 - protein, 10 aa, Homo sapiens
  heavy chain complementarity determining region 3 for antibody 3775
ARERSGSYDI

SEQ ID NO: 7551 - protein, 9 aa, Homo sapiens
  light chain complementarity determining region 3 for antibody 3776
QKYGSSPVP

SEQ ID NO: 7552 - protein, 18 aa, Homo sapiens
  heavy chain complementarity determining region 3 for antibody 3776
ARGDYPEARTGYSLDFDY

SEQ ID NO: 7553 - protein, 9 aa, Homo sapiens
  light chain complementarity determining region 3 for antibody 3777
QKYGSSPVP

SEQ ID NO: 7554 - protein, 18 aa, Homo sapiens
  heavy chain complementarity determining region 3 for antibody 3777
ARGDYPEARTGYFPDFDY

SEQ ID NO: 7555 - protein, 9 aa, Homo sapiens
  light chain complementarity determining region 3 for antibody 3778
QKYGSSPVP

SEQ ID NO: 7556 - protein, 18 aa, Homo sapiens
  heavy chain complementarity determining region 3 for antibody 3778
ARGDYPEARTGYFLGFDY

SEQ ID NO: 7557 - protein, 9 aa, Homo sapiens
  light chain complementarity determining region 3 for antibody 3779
QKYGSSPVP

SEQ ID NO: 7558 - protein, 18 aa, Homo sapiens
  heavy chain complementarity determining region 3 for antibody 3779
ARGDYPEARTGYFLDVDY

SEQ ID NO: 7559 - protein, 9 aa, Homo sapiens
  light chain complementarity determining region 3 for antibody 3780
QKYGSSPVP

SEQ ID NO: 7560 - protein, 18 aa, Homo sapiens
  heavy chain complementarity determining region 3 for antibody 3780
ARGDYPEARTGYFLDFGY

SEQ ID NO: 7561 - protein, 9 aa, Homo sapiens
  light chain complementarity determining region 3 for antibody 3781
QKYGSSPVP

SEQ ID NO: 7562 - protein, 18 aa, Homo sapiens
  heavy chain complementarity determining region 3 for antibody 3781
ARGDYPDARTGYFLDFDY

SEQ ID NO: 7563 - protein, 9 aa, Homo sapiens
  light chain complementarity determining region 3 for antibody 3782
QKYGSSPAP

SEQ ID NO: 7564 - protein, 18 aa, Homo sapiens
  heavy chain complementarity determining region 3 for antibody 3782
ARGDYPEARTGYFLDFDY

SEQ ID NO: 7565 - protein, 9 aa, Homo sapiens
  light chain complementarity determining region 3 for antibody 3783
QKYGSAPGP

SEQ ID NO: 7566 - protein, 18 aa, Homo sapiens
  heavy chain complementarity determining region 3 for antibody 3783
ARGDYPEARTGYFLDFDY

SEQ ID NO: 7567 - protein, 9 aa, Homo sapiens
  light chain complementarity determining region 3 for antibody 3784
QKYGRSPVP

SEQ ID NO: 7568 - protein, 18 aa, Homo sapiens
  heavy chain complementarity determining region 3 for antibody 3784
ARGDYPEARTGYFLDFDY

SEQ ID NO: 7569 - protein, 10 aa, Homo sapiens
  light chain complementarity determining region 3 for antibody 3785
QKYDNLASLT

SEQ ID NO: 7570 - protein, 13 aa, Homo sapiens
  heavy chain complementarity determining region 3 for antibody 3785
AKEGSSPGPDFEY

SEQ ID NO: 7571 - protein, 9 aa, Homo sapiens
  light chain complementarity determining region 3 for antibody 3786
QKNYTVPLT

SEQ ID NO: 7572 - protein, 10 aa, Homo sapiens
  heavy chain complementarity determining region 3 for antibody 3786
VGGEGWLTDF

SEQ ID NO: 7573 - protein, 9 aa, Homo sapiens
  light chain complementarity determining region 3 for antibody 3787
QKNGDSPVP

SEQ ID NO: 7574 - protein, 18 aa, Homo sapiens
  heavy chain complementarity determining region 3 for antibody 3787
ARGDYPEGRTGYFLDFDY

SEQ ID NO: 7575 - protein, 9 aa, Homo sapiens
  light chain complementarity determining region 3 for antibody 3788
QKDKSAPFT

SEQ ID NO: 7576 - protein, 13 aa, Homo sapiens
  heavy chain complementarity determining region 3 for antibody 3788
AKEGSSPGPDFEY

SEQ ID NO: 7577 - protein, 8 aa, Homo sapiens
  light chain complementarity determining region 3 for antibody 3789
QHYSGFPA

SEQ ID NO: 7578 - protein, 15 aa, Homo sapiens
  heavy chain complementarity determining region 3 for antibody 3789
GRHVFAGSYPDYCDY

SEQ ID NO: 7579 - protein, 9 aa, Homo sapiens
  light chain complementarity determining region 3 for antibody 3790
QHYNNWPFS

SEQ ID NO: 7580 - protein, 13 aa, Homo sapiens
  heavy chain complementarity determining region 3 for antibody 3790
AKRSASGDYYFDS

SEQ ID NO: 7581 - protein, 9 aa, Homo sapiens
  light chain complementarity determining region 3 for antibody 3791
QHYNDWWWT

SEQ ID NO: 7582 - protein, 10 aa, Homo sapiens
  heavy chain complementarity determining region 3 for antibody 3791
AQSSSGRFYN

SEQ ID NO: 7583 - protein, 9 aa, Homo sapiens
  light chain complementarity determining region 3 for antibody 3792
QHYNAYPHT

SEQ ID NO: 7584 - protein, 11 aa, Homo sapiens
  heavy chain complementarity determining region 3 for antibody 3792
AREGALYAFDF

SEQ ID NO: 7585 - protein, 9 aa, Homo sapiens
  light chain complementarity determining region 3 for antibody 3793
QHYKGYPLT

SEQ ID NO: 7586 - protein, 8 aa, Homo sapiens
  heavy chain complementarity determining region 3 for antibody 3793
TGGRYWDV

SEQ ID NO: 7587 - protein, 9 aa, Homo sapiens
  light chain complementarity determining region 3 for antibody 3794
QHYHSYPLT

SEQ ID NO: 7588 - protein, 14 aa, Homo sapiens
  heavy chain complementarity determining region 3 for antibody 3794
ATLSGYLGNVWLGF

SEQ ID NO: 7589 - protein, 10 aa, Homo sapiens
  light chain complementarity determining region 3 for antibody 3795
QHYGSSQGFT

SEQ ID NO: 7590 - protein, 17 aa, Homo sapiens
  heavy chain complementarity determining region 3 for antibody 3795
ARGTGIGSGSYYADFDY

SEQ ID NO: 7591 - protein, 9 aa, Homo sapiens
  light chain complementarity determining region 3 for antibody 3796
QHYGNSPLA

SEQ ID NO: 7592 - protein, 18 aa, Homo sapiens
  heavy chain complementarity determining region 3 for antibody 3796
AGGDYPEARTGYYLDFDY

SEQ ID NO: 7593 - protein, 8 aa, Homo sapiens
  light chain complementarity determining region 3 for antibody 3797
QHYGGSPT

SEQ ID NO: 7594 - protein, 23 aa, Homo sapiens
  heavy chain complementarity determining region 3 for antibody 3797
ARHFPKGGSGVTGTQSPLYYMDV

SEQ ID NO: 7595 - protein, 8 aa, Homo sapiens
  light chain complementarity determining region 3 for antibody 3798
QHYGGPPT

SEQ ID NO: 7596 - protein, 23 aa, Homo sapiens
  heavy chain complementarity determining region 3 for antibody 3798
ARHFPKGGSGVTGTQSLLYYMDV

SEQ ID NO: 7597 - protein, 7 aa, Homo sapiens
  light chain complementarity determining region 3 for antibody 3799
QHRSNRS

SEQ ID NO: 7598 - protein, 11 aa, Homo sapiens
  heavy chain complementarity determining region 3 for antibody 3799
GRNDLGGGCVF

SEQ ID NO: 7599 - protein, 11 aa, Homo sapiens
  light chain complementarity determining region 3 for antibody 3800
QHFALSQWLCT

SEQ ID NO: 7600 - protein, 13 aa, Homo sapiens
  heavy chain complementarity determining region 3 for antibody 3800
ARVNRGIFDAFDN

SEQ ID NO: 7601 - protein, 8 aa, Homo sapiens
  light chain complementarity determining region 3 for antibody 3801
QGYGDSFP

SEQ ID NO: 7602 - protein, 16 aa, Homo sapiens
  heavy chain complementarity determining region 3 for antibody 3801
AIWAAVSSGWSGPFDF

SEQ ID NO: 7603 - protein, 9 aa, Homo sapiens
  light chain complementarity determining region 3 for antibody 3802
QEYYNAPLT

SEQ ID NO: 7604 - protein, 9 aa, Homo sapiens
  heavy chain complementarity determining region 3 for antibody 3802
ARELWPGDI

SEQ ID NO: 7605 - protein, 9 aa, Homo sapiens
  light chain complementarity determining region 3 for antibody 3803
QEYKSAPHT

SEQ ID NO: 7606 - protein, 14 aa, Homo sapiens
  heavy chain complementarity determining region 3 for antibody 3803
CRGWLDPATPHYDF

SEQ ID NO: 7607 - protein, 10 aa, Homo sapiens
  light chain complementarity determining region 3 for antibody 3804
QESYSTPLFT

SEQ ID NO: 7608 - protein, 14 aa, Homo sapiens
  heavy chain complementarity determining region 3 for antibody 3804
ANYRASIGAKCFDP

SEQ ID NO: 7609 - protein, 9 aa, Homo sapiens
  light chain complementarity determining region 3 for antibody 3805
QERSNWPGS

SEQ ID NO: 7610 - protein, 13 aa, Homo sapiens
  heavy chain complementarity determining region 3 for antibody 3805
ATGAWGSSWWGDY

SEQ ID NO: 7611 - protein, 10 aa, Homo sapiens
  light chain complementarity determining region 3 for antibody 3806
QEGYSTPLFT

SEQ ID NO: 7612 - protein, 23 aa, Homo sapiens
  heavy chain complementarity determining region 3 for antibody 3806
ARHFPKGGSGVTGTQSLHYYMDV

SEQ ID NO: 7613 - protein, 7 aa, Homo sapiens
  light chain complementarity determining region 3 for antibody 3807
QCKRNWA

SEQ ID NO: 7614 - protein, 20 aa, Homo sapiens
  heavy chain complementarity determining region 3 for antibody 3807
STYLPGDCSCTSCFYWYADL

SEQ ID NO: 7615 - protein, 9 aa, Homo sapiens
  light chain complementarity determining region 3 for antibody 3808
QAYSTYSRT

SEQ ID NO: 7616 - protein, 15 aa, Homo sapiens
  heavy chain complementarity determining region 3 for antibody 3808
ARDCISTNCYLIFDN

SEQ ID NO: 7617 - protein, 9 aa, Homo sapiens
  light chain complementarity determining region 3 for antibody 3809
QAYGTSRGT

SEQ ID NO: 7618 - protein, 15 aa, Homo sapiens
  heavy chain complementarity determining region 3 for antibody 3809
AKPRSNMFAHDAFDI

SEQ ID NO: 7619 - protein, 9 aa, Homo sapiens
  light chain complementarity determining region 3 for antibody 3810
PQYYGVPIT

SEQ ID NO: 7620 - protein, 8 aa, Homo sapiens
  heavy chain complementarity determining region 3 for antibody 3810
ARDFSLTA

SEQ ID NO: 7621 - protein, 9 aa, Homo sapiens
  light chain complementarity determining region 3 for antibody 3811
PQLMVYPYT

SEQ ID NO: 7622 - protein, 14 aa, Homo sapiens
  heavy chain complementarity determining region 3 for antibody 3811
TRGHFDSTGFRLDY

SEQ ID NO: 7623 - protein, 9 aa, Homo sapiens
  light chain complementarity determining region 3 for antibody 3812
PQDYTYPFS

SEQ ID NO: 7624 - protein, 16 aa, Homo sapiens
  heavy chain complementarity determining region 3 for antibody 3812
ATDVGDHSDRFTTLDY

SEQ ID NO: 7625 - protein, 9 aa, Homo sapiens
  light chain complementarity determining region 3 for antibody 3813
MQYTHRPHT

SEQ ID NO: 7626 - protein, 16 aa, Homo sapiens
  heavy chain complementarity determining region 3 for antibody 3813
VRDLAGFTRGGSTFDY

SEQ ID NO: 7627 - protein, 9 aa, Homo sapiens
  light chain complementarity determining region 3 for antibody 3814
MQYAHGPHP

SEQ ID NO: 7628 - protein, 8 aa, Homo sapiens
  heavy chain complementarity determining region 3 for antibody 3814
AGWGYGNY

SEQ ID NO: 7629 - protein, 9 aa, Homo sapiens
  light chain complementarity determining region 3 for antibody 3815
MQVTHWPRT

SEQ ID NO: 7630 - protein, 18 aa, Homo sapiens
  heavy chain complementarity determining region 3 for antibody 3815
TTVLSQLLAGDWHLYFQH

SEQ ID NO: 7631 - protein, 9 aa, Homo sapiens
  light chain complementarity determining region 3 for antibody 3816
MQVTHWPRT

SEQ ID NO: 7632 - protein, 15 aa, Homo sapiens
  heavy chain complementarity determining region 3 for antibody 3816
ARQVTGATKVRHFDS

SEQ ID NO: 7633 - protein, 9 aa, Homo sapiens
  light chain complementarity determining region 3 for antibody 3817
MQTVQTPWK

SEQ ID NO: 7634 - protein, 12 aa, Homo sapiens
  heavy chain complementarity determining region 3 for antibody 3817
ARLDWNYRAFDI

SEQ ID NO: 7635 - protein, 9 aa, Homo sapiens
  light chain complementarity determining region 3 for antibody 3818
MQTVQTPGP

SEQ ID NO: 7636 - protein, 12 aa, Homo sapiens
  heavy chain complementarity determining region 3 for antibody 3818
ARLDWNYRAFDI

SEQ ID NO: 7637 - protein, 9 aa, Homo sapiens
  light chain complementarity determining region 3 for antibody 3819
MQTLQTPWT

SEQ ID NO: 7638 - protein, 16 aa, Homo sapiens
  heavy chain complementarity determining region 3 for antibody 3819
VRDLAGFTRGGSTFDY

SEQ ID NO: 7639 - protein, 9 aa, Homo sapiens
  light chain complementarity determining region 3 for antibody 3820
MQTLQTPWT

SEQ ID NO: 7640 - protein, 11 aa, Homo sapiens
  heavy chain complementarity determining region 3 for antibody 3820
GRGGLRGGVDY

SEQ ID NO: 7641 - protein, 9 aa, Homo sapiens
  light chain complementarity determining region 3 for antibody 3821
MQTLQTPWT

SEQ ID NO: 7642 - protein, 12 aa, Homo sapiens
  heavy chain complementarity determining region 3 for antibody 3821
ERLDWNYRAFDI

SEQ ID NO: 7643 - protein, 9 aa, Homo sapiens
  light chain complementarity determining region 3 for antibody 3822
MQTLQTPWT

SEQ ID NO: 7644 - protein, 12 aa, Homo sapiens
  heavy chain complementarity determining region 3 for antibody 3822
ARLDWNYRVFDI

SEQ ID NO: 7645 - protein, 9 aa, Homo sapiens
  light chain complementarity determining region 3 for antibody 3823
MQTLQTPWT

SEQ ID NO: 7646 - protein, 12 aa, Homo sapiens
  heavy chain complementarity determining region 3 for antibody 3823
ARLDWNYMAFDI

SEQ ID NO: 7647 - protein, 9 aa, Homo sapiens
  light chain complementarity determining region 3 for antibody 3824
MQTLQTPWT

SEQ ID NO: 7648 - protein, 12 aa, Homo sapiens
  heavy chain complementarity determining region 3 for antibody 3824
ARLDWNFRAFDI

SEQ ID NO: 7649 - protein, 9 aa, Homo sapiens
  light chain complementarity determining region 3 for antibody 3825
MQTLQTPWT

SEQ ID NO: 7650 - protein, 12 aa, Homo sapiens
  heavy chain complementarity determining region 3 for antibody 3825
ARLDLNYRAFDI

SEQ ID NO: 7651 - protein, 9 aa, Homo sapiens
  light chain complementarity determining region 3 for antibody 3826
MQTLQTPWT

SEQ ID NO: 7652 - protein, 13 aa, Homo sapiens
  heavy chain complementarity determining region 3 for antibody 3826
AKEGSSPGPDFEY

SEQ ID NO: 7653 - protein, 9 aa, Homo sapiens
  light chain complementarity determining region 3 for antibody 3827
MQTLQTPWQ

SEQ ID NO: 7654 - protein, 12 aa, Homo sapiens
  heavy chain complementarity determining region 3 for antibody 3827
ARLDWNYRAFDI

SEQ ID NO: 7655 - protein, 9 aa, Homo sapiens
  light chain complementarity determining region 3 for antibody 3828
MQTLQSPWT

SEQ ID NO: 7656 - protein, 12 aa, Homo sapiens
  heavy chain complementarity determining region 3 for antibody 3828
ARLDWNYRAFDI

SEQ ID NO: 7657 - protein, 9 aa, Homo sapiens
  light chain complementarity determining region 3 for antibody 3829
MQTLQNPGT

SEQ ID NO: 7658 - protein, 12 aa, Homo sapiens
  heavy chain complementarity determining region 3 for antibody 3829
ARLDWNYRAFDI

SEQ ID NO: 7659 - protein, 9 aa, Homo sapiens
  light chain complementarity determining region 3 for antibody 3830
MQTLHTPGT

SEQ ID NO: 7660 - protein, 12 aa, Homo sapiens
  heavy chain complementarity determining region 3 for antibody 3830
ARLLWQLRGLDV

SEQ ID NO: 7661 - protein, 8 aa, Homo sapiens
  light chain complementarity determining region 3 for antibody 3831
MQSLQSFT

SEQ ID NO: 7662 - protein, 16 aa, Homo sapiens
  heavy chain complementarity determining region 3 for antibody 3831
ARAGYCSYFTCARFDP

SEQ ID NO: 7663 - protein, 9 aa, Homo sapiens
  light chain complementarity determining region 3 for antibody 3832
MQPVQTPWT

SEQ ID NO: 7664 - protein, 12 aa, Homo sapiens
  heavy chain complementarity determining region 3 for antibody 3832
ARLDWNYRAFDI

SEQ ID NO: 7665 - protein, 9 aa, Homo sapiens
  light chain complementarity determining region 3 for antibody 3833
MQPLQTPGT

SEQ ID NO: 7666 - protein, 12 aa, Homo sapiens
  heavy chain complementarity determining region 3 for antibody 3833
ARLDWNYRAFDI

SEQ ID NO: 7667 - protein, 9 aa, Homo sapiens
  light chain complementarity determining region 3 for antibody 3834
MQNLQTPGT

SEQ ID NO: 7668 - protein, 12 aa, Homo sapiens
  heavy chain complementarity determining region 3 for antibody 3834
ARLDWNYRAFDI

SEQ ID NO: 7669 - protein, 9 aa, Homo sapiens
  light chain complementarity determining region 3 for antibody 3835
MQLLQTPLT

SEQ ID NO: 7670 - protein, 10 aa, Homo sapiens
  heavy chain complementarity determining region 3 for antibody 3835
ARERSGSYDI

SEQ ID NO: 7671 - protein, 9 aa, Homo sapiens
  light chain complementarity determining region 3 for antibody 3836
MQGTYWPNT

SEQ ID NO: 7672 - protein, 11 aa, Homo sapiens
  heavy chain complementarity determining region 3 for antibody 3836
AREGWGSLLDY

SEQ ID NO: 7673 - protein, 10 aa, Homo sapiens
  light chain complementarity determining region 3 for antibody 3837
MQGTRWPPPT

SEQ ID NO: 7674 - protein, 9 aa, Homo sapiens
  heavy chain complementarity determining region 3 for antibody 3837
ARSEYQPTY

SEQ ID NO: 7675 - protein, 9 aa, Homo sapiens
  light chain complementarity determining region 3 for antibody 3838
MQGTNWPPS

SEQ ID NO: 7676 - protein, 13 aa, Homo sapiens
  heavy chain complementarity determining region 3 for antibody 3838
ARDTVTNKMGSDY

SEQ ID NO: 7677 - protein, 9 aa, Homo sapiens
  light chain complementarity determining region 3 for antibody 3839
MQGTNWPIN

SEQ ID NO: 7678 - protein, 13 aa, Homo sapiens
  heavy chain complementarity determining region 3 for antibody 3839
AKEGSSAGPDFDY

SEQ ID NO: 7679 - protein, 9 aa, Homo sapiens
  light chain complementarity determining region 3 for antibody 3840
MQGTHWPTT

SEQ ID NO: 7680 - protein, 17 aa, Homo sapiens
  heavy chain complementarity determining region 3 for antibody 3840
ARNTMVGTWQRQGNLDH

SEQ ID NO: 7681 - protein, 9 aa, Homo sapiens
  light chain complementarity determining region 3 for antibody 3841
MQGTHWPRT

SEQ ID NO: 7682 - protein, 11 aa, Homo sapiens
  heavy chain complementarity determining region 3 for antibody 3841
ATFGQQWRLAH

SEQ ID NO: 7683 - protein, 9 aa, Homo sapiens
  light chain complementarity determining region 3 for antibody 3842
MQGTHWPPT

SEQ ID NO: 7684 - protein, 13 aa, Homo sapiens
  heavy chain complementarity determining region 3 for antibody 3842
ARDTVTNKMGSDY

SEQ ID NO: 7685 - protein, 10 aa, Homo sapiens
  light chain complementarity determining region 3 for antibody 3843
MQGTHWPPIT

SEQ ID NO: 7686 - protein, 13 aa, Homo sapiens
  heavy chain complementarity determining region 3 for antibody 3843
AIIEVAGTELPDH

SEQ ID NO: 7687 - protein, 9 aa, Homo sapiens
  light chain complementarity determining region 3 for antibody 3844
MQGTHWPIN

SEQ ID NO: 7688 - protein, 13 aa, Homo sapiens
  heavy chain complementarity determining region 3 for antibody 3844
AKEGSSPGPDFEY

SEQ ID NO: 7689 - protein, 9 aa, Homo sapiens
  light chain complementarity determining region 3 for antibody 3845
MQGTHWPIN

SEQ ID NO: 7690 - protein, 13 aa, Homo sapiens
  heavy chain complementarity determining region 3 for antibody 3845
AKEGSSAGPDCDY

SEQ ID NO: 7691 - protein, 9 aa, Homo sapiens
  light chain complementarity determining region 3 for antibody 3846
MQGTHWPHT

SEQ ID NO: 7692 - protein, 11 aa, Homo sapiens
  heavy chain complementarity determining region 3 for antibody 3846
ATFGQQRRLAH

SEQ ID NO: 7693 - protein, 9 aa, Homo sapiens
  light chain complementarity determining region 3 for antibody 3847
MQGTHWPHT

SEQ ID NO: 7694 - protein, 9 aa, Homo sapiens
  heavy chain complementarity determining region 3 for antibody 3847
ARSEYQPTY

SEQ ID NO: 7695 - protein, 10 aa, Homo sapiens
  light chain complementarity determining region 3 for antibody 3848
MQGTHWPGWT

SEQ ID NO: 7696 - protein, 12 aa, Homo sapiens
  heavy chain complementarity determining region 3 for antibody 3848
TTWIKTSVWLDY

SEQ ID NO: 7697 - protein, 10 aa, Homo sapiens
  light chain complementarity determining region 3 for antibody 3849
MQGTHWPAWT

SEQ ID NO: 7698 - protein, 12 aa, Homo sapiens
  heavy chain complementarity determining region 3 for antibody 3849
ATWIKTSVWLDY

SEQ ID NO: 7699 - protein, 8 aa, Homo sapiens
  light chain complementarity determining region 3 for antibody 3850
MQGTHWPA

SEQ ID NO: 7700 - protein, 15 aa, Homo sapiens
  heavy chain complementarity determining region 3 for antibody 3850
ARDRGDPQLYNWFDP

SEQ ID NO: 7701 - protein, 8 aa, Homo sapiens
  light chain complementarity determining region 3 for antibody 3851
MQGTHWPA

SEQ ID NO: 7702 - protein, 12 aa, Homo sapiens
  heavy chain complementarity determining region 3 for antibody 3851
AIVVPGRGDLDD

SEQ ID NO: 7703 - protein, 9 aa, Homo sapiens
  light chain complementarity determining region 3 for antibody 3852
MQGTHGPWT

SEQ ID NO: 7704 - protein, 12 aa, Homo sapiens
  heavy chain complementarity determining region 3 for antibody 3852
AIVVPGRWDLDD

SEQ ID NO: 7705 - protein, 9 aa, Homo sapiens
  light chain complementarity determining region 3 for antibody 3853
MQGTHGPRT

SEQ ID NO: 7706 - protein, 10 aa, Homo sapiens
  heavy chain complementarity determining region 3 for antibody 3853
VRDYWNSIDY

SEQ ID NO: 7707 - protein, 9 aa, Homo sapiens
  light chain complementarity determining region 3 for antibody 3854
MQGPHWPWT

SEQ ID NO: 7708 - protein, 16 aa, Homo sapiens
  heavy chain complementarity determining region 3 for antibody 3854
ARGHTNPGERRGGSDF

SEQ ID NO: 7709 - protein, 9 aa, Homo sapiens
  light chain complementarity determining region 3 for antibody 3855
MQGLQTPVT

SEQ ID NO: 7710 - protein, 13 aa, Homo sapiens
  heavy chain complementarity determining region 3 for antibody 3855
TREGDSSGPDFHL

SEQ ID NO: 7711 - protein, 9 aa, Homo sapiens
  light chain complementarity determining region 3 for antibody 3856
MQGIHWPWT

SEQ ID NO: 7712 - protein, 11 aa, Homo sapiens
  heavy chain complementarity determining region 3 for antibody 3856
ARSPGTGTVDY

SEQ ID NO: 7713 - protein, 9 aa, Homo sapiens
  light chain complementarity determining region 3 for antibody 3857
MQGIHWPWT

SEQ ID NO: 7714 - protein, 11 aa, Homo sapiens
  heavy chain complementarity determining region 3 for antibody 3857
ARSPATGATDY

SEQ ID NO: 7715 - protein, 9 aa, Homo sapiens
  light chain complementarity determining region 3 for antibody 3858
MQFLQTPLT

SEQ ID NO: 7716 - protein, 17 aa, Homo sapiens
  heavy chain complementarity determining region 3 for antibody 3858
AKGRGSVAMALIYYLDL

SEQ ID NO: 7717 - protein, 9 aa, Homo sapiens
  light chain complementarity determining region 3 for antibody 3859
MQFLQTPLT

SEQ ID NO: 7718 - protein, 12 aa, Homo sapiens
  heavy chain complementarity determining region 3 for antibody 3859
AIVVPGRWDLDD

SEQ ID NO: 7719 - protein, 9 aa, Homo sapiens
  light chain complementarity determining region 3 for antibody 3860
MQFLQTLLT

SEQ ID NO: 7720 - protein, 10 aa, Homo sapiens
  heavy chain complementarity determining region 3 for antibody 3860
ARERSGSYDI

SEQ ID NO: 7721 - protein, 9 aa, Homo sapiens
  light chain complementarity determining region 3 for antibody 3861
MQATHWPWT

SEQ ID NO: 7722 - protein, 14 aa, Homo sapiens
  heavy chain complementarity determining region 3 for antibody 3861
VRDYCSGGACYSGS

SEQ ID NO: 7723 - protein, 9 aa, Homo sapiens
  light chain complementarity determining region 3 for antibody 3862
MQATHWPWT

SEQ ID NO: 7724 - protein, 12 aa, Homo sapiens
  heavy chain complementarity determining region 3 for antibody 3862
ARGPRKMAGGSS

SEQ ID NO: 7725 - protein, 9 aa, Homo sapiens
  light chain complementarity determining region 3 for antibody 3863
MQATHWPRT

SEQ ID NO: 7726 - protein, 12 aa, Homo sapiens
  heavy chain complementarity determining region 3 for antibody 3863
STDVETTVPSVS

SEQ ID NO: 7727 - protein, 9 aa, Homo sapiens
  light chain complementarity determining region 3 for antibody 3864
MQATHWPRT

SEQ ID NO: 7728 - protein, 12 aa, Homo sapiens
  heavy chain complementarity determining region 3 for antibody 3864
STDVETTFPSGS

SEQ ID NO: 7729 - protein, 9 aa, Homo sapiens
  light chain complementarity determining region 3 for antibody 3865
MQATHWPRT

SEQ ID NO: 7730 - protein, 12 aa, Homo sapiens
  heavy chain complementarity determining region 3 for antibody 3865
STDVETAFPSVS

SEQ ID NO: 7731 - protein, 9 aa, Homo sapiens
  light chain complementarity determining region 3 for antibody 3866
MQATHWPGT

SEQ ID NO: 7732 - protein, 14 aa, Homo sapiens
  heavy chain complementarity determining region 3 for antibody 3866
VRDYCSGGTCYSGS

SEQ ID NO: 7733 - protein, 9 aa, Homo sapiens
  light chain complementarity determining region 3 for antibody 3867
MQALQTPYT

SEQ ID NO: 7734 - protein, 12 aa, Homo sapiens
  heavy chain complementarity determining region 3 for antibody 3867
ARLDWNYRAFDI

SEQ ID NO: 7735 - protein, 9 aa, Homo sapiens
  light chain complementarity determining region 3 for antibody 3868
MQALQTPWT

SEQ ID NO: 7736 - protein, 12 aa, Homo sapiens
  heavy chain complementarity determining region 3 for antibody 3868
ARLDWNYRAFDI

SEQ ID NO: 7737 - protein, 9 aa, Homo sapiens
  light chain complementarity determining region 3 for antibody 3869
MQALQTPNT

SEQ ID NO: 7738 - protein, 15 aa, Homo sapiens
  heavy chain complementarity determining region 3 for antibody 3869
ARERRMFGELRGFDV

SEQ ID NO: 7739 - protein, 9 aa, Homo sapiens
  light chain complementarity determining region 3 for antibody 3870
MQAIETPFT

SEQ ID NO: 7740 - protein, 9 aa, Homo sapiens
  heavy chain complementarity determining region 3 for antibody 3870
ASDRWGPEH

SEQ ID NO: 7741 - protein, 9 aa, Homo sapiens
  light chain complementarity determining region 3 for antibody 3871
MPGTHWPRT

SEQ ID NO: 7742 - protein, 10 aa, Homo sapiens
  heavy chain complementarity determining region 3 for antibody 3871
VRDYWNSIDY

SEQ ID NO: 7743 - protein, 9 aa, Homo sapiens
  light chain complementarity determining region 3 for antibody 3872
LQYYTAPWT

SEQ ID NO: 7744 - protein, 17 aa, Homo sapiens
  heavy chain complementarity determining region 3 for antibody 3872
SRGGRTIWPGSQGSLDS

SEQ ID NO: 7745 - protein, 9 aa, Homo sapiens
  light chain complementarity determining region 3 for antibody 3873
LQYNFYPVT

SEQ ID NO: 7746 - protein, 15 aa, Homo sapiens
  heavy chain complementarity determining region 3 for antibody 3873
ARGDYGDFKGVPFDY

SEQ ID NO: 7747 - protein, 9 aa, Homo sapiens
  light chain complementarity determining region 3 for antibody 3874
LQYAHWPHT

SEQ ID NO: 7748 - protein, 15 aa, Homo sapiens
  heavy chain complementarity determining region 3 for antibody 3874
ARVGRRYHNAWYFDN

SEQ ID NO: 7749 - protein, 9 aa, Homo sapiens
  light chain complementarity determining region 3 for antibody 3875
LQYAHWPHT

SEQ ID NO: 7750 - protein, 15 aa, Homo sapiens
  heavy chain complementarity determining region 3 for antibody 3875
ARVGRPYHNAWSFDN

SEQ ID NO: 7751 - protein, 9 aa, Homo sapiens
  light chain complementarity determining region 3 for antibody 3876
LQYAHWPHT

SEQ ID NO: 7752 - protein, 15 aa, Homo sapiens
  heavy chain complementarity determining region 3 for antibody 3876
ARVCRPYHNAWYFDN

SEQ ID NO: 7753 - protein, 9 aa, Homo sapiens
  light chain complementarity determining region 3 for antibody 3877
LQYAHWPHT

SEQ ID NO: 7754 - protein, 9 aa, Homo sapiens
  heavy chain complementarity determining region 3 for antibody 3877
AGWGGPSNY

SEQ ID NO: 7755 - protein, 9 aa, Homo sapiens
  light chain complementarity determining region 3 for antibody 3878
LQYAHWPHP

SEQ ID NO: 7756 - protein, 9 aa, Homo sapiens
  heavy chain complementarity determining region 3 for antibody 3878
AGWGGTSNY

SEQ ID NO: 7757 - protein, 9 aa, Homo sapiens
  light chain complementarity determining region 3 for antibody 3879
LQSNSYPLT

SEQ ID NO: 7758 - protein, 17 aa, Homo sapiens
  heavy chain complementarity determining region 3 for antibody 3879
ARNTMVGTWQRQGNLDH

SEQ ID NO: 7759 - protein, 9 aa, Homo sapiens
  light chain complementarity determining region 3 for antibody 3880
LQLNSYPLT

SEQ ID NO: 7760 - protein, 11 aa, Homo sapiens
  heavy chain complementarity determining region 3 for antibody 3880
VRVSTGWNFDY

SEQ ID NO: 7761 - protein, 9 aa, Homo sapiens
  light chain complementarity determining region 3 for antibody 3881
LQHRSYPWT

SEQ ID NO: 7762 - protein, 18 aa, Homo sapiens
  heavy chain complementarity determining region 3 for antibody 3881
VRGPSGAPGAMAYYDLDV

SEQ ID NO: 7763 - protein, 9 aa, Homo sapiens
  light chain complementarity determining region 3 for antibody 3882
LQHNTYPWT

SEQ ID NO: 7764 - protein, 13 aa, Homo sapiens
  heavy chain complementarity determining region 3 for antibody 3882
AKEGSSPGPDFDY

SEQ ID NO: 7765 - protein, 9 aa, Homo sapiens
  light chain complementarity determining region 3 for antibody 3883
LQHNTYPLT

SEQ ID NO: 7766 - protein, 11 aa, Homo sapiens
  heavy chain complementarity determining region 3 for antibody 3883
VRVSTGWNFDY

SEQ ID NO: 7767 - protein, 9 aa, Homo sapiens
  light chain complementarity determining region 3 for antibody 3884
LQHNSYSLT

SEQ ID NO: 7768 - protein, 11 aa, Homo sapiens
  heavy chain complementarity determining region 3 for antibody 3884
VRVSTGWNFDY

SEQ ID NO: 7769 - protein, 9 aa, Homo sapiens
  light chain complementarity determining region 3 for antibody 3885
LQHNSYPWT

SEQ ID NO: 7770 - protein, 17 aa, Homo sapiens
  heavy chain complementarity determining region 3 for antibody 3885
ARNTMVGAWQRQGNLDH

SEQ ID NO: 7771 - protein, 9 aa, Homo sapiens
  light chain complementarity determining region 3 for antibody 3886
LQHNSYPWT

SEQ ID NO: 7772 - protein, 14 aa, Homo sapiens
  heavy chain complementarity determining region 3 for antibody 3886
ANYRASSGARCFDP

SEQ ID NO: 7773 - protein, 9 aa, Homo sapiens
  light chain complementarity determining region 3 for antibody 3887
LQHNSYPRT

SEQ ID NO: 7774 - protein, 15 aa, Homo sapiens
  heavy chain complementarity determining region 3 for antibody 3887
ATPLGSITWYNAFDV

SEQ ID NO: 7775 - protein, 9 aa, Homo sapiens
  light chain complementarity determining region 3 for antibody 3888
LQHNSYPLT

SEQ ID NO: 7776 - protein, 11 aa, Homo sapiens
  heavy chain complementarity determining region 3 for antibody 3888
VRVSTGWTFDY

SEQ ID NO: 7777 - protein, 9 aa, Homo sapiens
  light chain complementarity determining region 3 for antibody 3889
LQHNSYPLT

SEQ ID NO: 7778 - protein, 11 aa, Homo sapiens
  heavy chain complementarity determining region 3 for antibody 3889
VRVSTGWNFNY

SEQ ID NO: 7779 - protein, 9 aa, Homo sapiens
  light chain complementarity determining region 3 for antibody 3890
LQHNSYPLT

SEQ ID NO: 7780 - protein, 11 aa, Homo sapiens
  heavy chain complementarity determining region 3 for antibody 3890
VRVSTGWNFEY

SEQ ID NO: 7781 - protein, 9 aa, Homo sapiens
  light chain complementarity determining region 3 for antibody 3891
LQHNSYPLT

SEQ ID NO: 7782 - protein, 11 aa, Homo sapiens
  heavy chain complementarity determining region 3 for antibody 3891
VRVSTGWNFDF

SEQ ID NO: 7783 - protein, 9 aa, Homo sapiens
  light chain complementarity determining region 3 for antibody 3892
LQHNSYPLT

SEQ ID NO: 7784 - protein, 11 aa, Homo sapiens
  heavy chain complementarity determining region 3 for antibody 3892
VRVSPGWNFDY

SEQ ID NO: 7785 - protein, 9 aa, Homo sapiens
  light chain complementarity determining region 3 for antibody 3893
LQHNSYPLT

SEQ ID NO: 7786 - protein, 16 aa, Homo sapiens
  heavy chain complementarity determining region 3 for antibody 3893
VRDLAGFTRGGSTFDY

SEQ ID NO: 7787 - protein, 9 aa, Homo sapiens
  light chain complementarity determining region 3 for antibody 3894
LQHNSYPLT

SEQ ID NO: 7788 - protein, 10 aa, Homo sapiens
  heavy chain complementarity determining region 3 for antibody 3894
CRDRWGFGDA

SEQ ID NO: 7789 - protein, 9 aa, Homo sapiens
  light chain complementarity determining region 3 for antibody 3895
LQHNSYPLT

SEQ ID NO: 7790 - protein, 9 aa, Homo sapiens
  heavy chain complementarity determining region 3 for antibody 3895
ARSEYQPTY

SEQ ID NO: 7791 - protein, 9 aa, Homo sapiens
  light chain complementarity determining region 3 for antibody 3896
LQHNSYPFT

SEQ ID NO: 7792 - protein, 10 aa, Homo sapiens
  heavy chain complementarity determining region 3 for antibody 3896
CRDRWGFGDV

SEQ ID NO: 7793 - protein, 9 aa, Homo sapiens
  light chain complementarity determining region 3 for antibody 3897
LQHNNYPLS

SEQ ID NO: 7794 - protein, 11 aa, Homo sapiens
  heavy chain complementarity determining region 3 for antibody 3897
VRVSSGWYFDY

SEQ ID NO: 7795 - protein, 9 aa, Homo sapiens
  light chain complementarity determining region 3 for antibody 3898
LQHNFYPLT

SEQ ID NO: 7796 - protein, 11 aa, Homo sapiens
  heavy chain complementarity determining region 3 for antibody 3898
VRVSTGWNFDY

SEQ ID NO: 7797 - protein, 9 aa, Homo sapiens
  light chain complementarity determining region 3 for antibody 3899
LQHNAYPLS

SEQ ID NO: 7798 - protein, 11 aa, Homo sapiens
  heavy chain complementarity determining region 3 for antibody 3899
VRVSSGWYLDY

SEQ ID NO: 7799 - protein, 9 aa, Homo sapiens
  light chain complementarity determining region 3 for antibody 3900
LQGTHWPHT

SEQ ID NO: 7800 - protein, 11 aa, Homo sapiens
  heavy chain complementarity determining region 3 for antibody 3900
ATFGQQWRLAH

SEQ ID NO: 7801 - protein, 9 aa, Homo sapiens
  light chain complementarity determining region 3 for antibody 3901
LQGLQGPFT

SEQ ID NO: 7802 - protein, 11 aa, Homo sapiens
  heavy chain complementarity determining region 3 for antibody 3901
GRDVDYSTPAF

SEQ ID NO: 7803 - protein, 9 aa, Homo sapiens
  light chain complementarity determining region 3 for antibody 3902
LQGLQAPFT

SEQ ID NO: 7804 - protein, 11 aa, Homo sapiens
  heavy chain complementarity determining region 3 for antibody 3902
GRDVDYSSPGF

SEQ ID NO: 7805 - protein, 9 aa, Homo sapiens
  light chain complementarity determining region 3 for antibody 3903
LQFAHWPHT

SEQ ID NO: 7806 - protein, 10 aa, Homo sapiens
  heavy chain complementarity determining region 3 for antibody 3903
CRDREGFGDV

SEQ ID NO: 7807 - protein, 9 aa, Homo sapiens
  light chain complementarity determining region 3 for antibody 3904
LQFAHWPHT

SEQ ID NO: 7808 - protein, 9 aa, Homo sapiens
  heavy chain complementarity determining region 3 for antibody 3904
AGWGGVSNY

SEQ ID NO: 7809 - protein, 9 aa, Homo sapiens
  light chain complementarity determining region 3 for antibody 3905
LQFAHLPHT

SEQ ID NO: 7810 - protein, 9 aa, Homo sapiens
  heavy chain complementarity determining region 3 for antibody 3905
AGWGGLSNY

SEQ ID NO: 7811 - protein, 9 aa, Homo sapiens
  light chain complementarity determining region 3 for antibody 3906
LQFAHGPHT

SEQ ID NO: 7812 - protein, 9 aa, Homo sapiens
  heavy chain complementarity determining region 3 for antibody 3906
AGWGGLSNY

SEQ ID NO: 7813 - protein, 9 aa, Homo sapiens
  light chain complementarity determining region 3 for antibody 3907
LQDYTYPFS

SEQ ID NO: 7814 - protein, 16 aa, Homo sapiens
  heavy chain complementarity determining region 3 for antibody 3907
VTEVGDHRDSYTTLDY

SEQ ID NO: 7815 - protein, 9 aa, Homo sapiens
  light chain complementarity determining region 3 for antibody 3908
LQDYNYPFT

SEQ ID NO: 7816 - protein, 16 aa, Homo sapiens
  heavy chain complementarity determining region 3 for antibody 3908
SADLGDHVDYYAALDY

SEQ ID NO: 7817 - protein, 9 aa, Homo sapiens
  light chain complementarity determining region 3 for antibody 3909
LQDYNPVGT

SEQ ID NO: 7818 - protein, 9 aa, Homo sapiens
  heavy chain complementarity determining region 3 for antibody 3909
GSRRPYFDS

SEQ ID NO: 7819 - protein, 9 aa, Homo sapiens
  light chain complementarity determining region 3 for antibody 3910
LQDYNNVGT

SEQ ID NO: 7820 - protein, 9 aa, Homo sapiens
  heavy chain complementarity determining region 3 for antibody 3910
GSRRPYFDS

SEQ ID NO: 7821 - protein, 9 aa, Homo sapiens
  light chain complementarity determining region 3 for antibody 3911
LQDYNHVGT

SEQ ID NO: 7822 - protein, 9 aa, Homo sapiens
  heavy chain complementarity determining region 3 for antibody 3911
GSRRPYFDP

SEQ ID NO: 7823 - protein, 9 aa, Homo sapiens
  light chain complementarity determining region 3 for antibody 3912
LQDYNHVGT

SEQ ID NO: 7824 - protein, 9 aa, Homo sapiens
  heavy chain complementarity determining region 3 for antibody 3912
GSRRLYFDS

SEQ ID NO: 7825 - protein, 9 aa, Homo sapiens
  light chain complementarity determining region 3 for antibody 3913
LQDYNHVGT

SEQ ID NO: 7826 - protein, 12 aa, Homo sapiens
  heavy chain complementarity determining region 3 for antibody 3913
ARDKGGRNGMDV

SEQ ID NO: 7827 - protein, 9 aa, Homo sapiens
  light chain complementarity determining region 3 for antibody 3914
LQDYNHSAV

SEQ ID NO: 7828 - protein, 12 aa, Homo sapiens
  heavy chain complementarity determining region 3 for antibody 3914
ARVHITGYKGDY

SEQ ID NO: 7829 - protein, 9 aa, Homo sapiens
  light chain complementarity determining region 3 for antibody 3915
LQDYNHLGT

SEQ ID NO: 7830 - protein, 9 aa, Homo sapiens
  heavy chain complementarity determining region 3 for antibody 3915
GSRRPYFDS

SEQ ID NO: 7831 - protein, 9 aa, Homo sapiens
  light chain complementarity determining region 3 for antibody 3916
LQDYNHFGT

SEQ ID NO: 7832 - protein, 9 aa, Homo sapiens
  heavy chain complementarity determining region 3 for antibody 3916
GSRRPYFDS

SEQ ID NO: 7833 - protein, 9 aa, Homo sapiens
  light chain complementarity determining region 3 for antibody 3917
LQDYIYPFS

SEQ ID NO: 7834 - protein, 16 aa, Homo sapiens
  heavy chain complementarity determining region 3 for antibody 3917
VTDVGDHRDTYTTLDY

SEQ ID NO: 7835 - protein, 9 aa, Homo sapiens
  light chain complementarity determining region 3 for antibody 3918
LQDYDHVGT

SEQ ID NO: 7836 - protein, 9 aa, Homo sapiens
  heavy chain complementarity determining region 3 for antibody 3918
GSRRPYFDS

SEQ ID NO: 7837 - protein, 9 aa, Homo sapiens
  light chain complementarity determining region 3 for antibody 3919
LQDRKYPFS

SEQ ID NO: 7838 - protein, 16 aa, Homo sapiens
  heavy chain complementarity determining region 3 for antibody 3919
GADLGDHGDAYAPLDS

SEQ ID NO: 7839 - protein, 9 aa, Homo sapiens
  light chain complementarity determining region 3 for antibody 3920
LQDHTYPYS

SEQ ID NO: 7840 - protein, 12 aa, Homo sapiens
  heavy chain complementarity determining region 3 for antibody 3920
VRDYSCCIGFDP

SEQ ID NO: 7841 - protein, 9 aa, Homo sapiens
  light chain complementarity determining region 3 for antibody 3921
LQDHTYPFS

SEQ ID NO: 7842 - protein, 16 aa, Homo sapiens
  heavy chain complementarity determining region 3 for antibody 3921
AADLGDHSDTYAALDY

SEQ ID NO: 7843 - protein, 9 aa, Homo sapiens
  light chain complementarity determining region 3 for antibody 3922
LQDHKYPLT

SEQ ID NO: 7844 - protein, 13 aa, Homo sapiens
  heavy chain complementarity determining region 3 for antibody 3922
AGEGPAPGPDFDY

SEQ ID NO: 7845 - protein, 9 aa, Homo sapiens
  light chain complementarity determining region 3 for antibody 3923
LQDHKYPFT

SEQ ID NO: 7846 - protein, 13 aa, Homo sapiens
  heavy chain complementarity determining region 3 for antibody 3923
AKEGSSPGPDFEY

SEQ ID NO: 7847 - protein, 9 aa, Homo sapiens
  light chain complementarity determining region 3 for antibody 3924
LQDHKYPFT

SEQ ID NO: 7848 - protein, 16 aa, Homo sapiens
  heavy chain complementarity determining region 3 for antibody 3924
AADLGDHTDAYASLDN

SEQ ID NO: 7849 - protein, 9 aa, Homo sapiens
  light chain complementarity determining region 3 for antibody 3925
LQDHKYPFT

SEQ ID NO: 7850 - protein, 16 aa, Homo sapiens
  heavy chain complementarity determining region 3 for antibody 3925
AADLGDHADAYAALDN

SEQ ID NO: 7851 - protein, 9 aa, Homo sapiens
  light chain complementarity determining region 3 for antibody 3926
LQDAHWPHT

SEQ ID NO: 7852 - protein, 15 aa, Homo sapiens
  heavy chain complementarity determining region 3 for antibody 3926
ARVGRPYHNAWYFDN

SEQ ID NO: 7853 - protein, 9 aa, Homo sapiens
  light chain complementarity determining region 3 for antibody 3927
LQANSFPRT

SEQ ID NO: 7854 - protein, 15 aa, Homo sapiens
  heavy chain complementarity determining region 3 for antibody 3927
AGDAAGDGYTSRWEY

SEQ ID NO: 7855 - protein, 9 aa, Homo sapiens
  light chain complementarity determining region 3 for antibody 3928
HQYYTSPLP

SEQ ID NO: 7856 - protein, 10 aa, Homo sapiens
  heavy chain complementarity determining region 3 for antibody 3928
VGGEGWLTDF

SEQ ID NO: 7857 - protein, 9 aa, Homo sapiens
  light chain complementarity determining region 3 for antibody 3929
HQYYNSPLT

SEQ ID NO: 7858 - protein, 10 aa, Homo sapiens
  heavy chain complementarity determining region 3 for antibody 3929
AAGSGWLIEY

SEQ ID NO: 7859 - protein, 9 aa, Homo sapiens
  light chain complementarity determining region 3 for antibody 3930
HQYAITPWT

SEQ ID NO: 7860 - protein, 17 aa, Homo sapiens
  heavy chain complementarity determining region 3 for antibody 3930
ARNTMVDGWQRQGSVDH

SEQ ID NO: 7861 - protein, 9 aa, Homo sapiens
  light chain complementarity determining region 3 for antibody 3931
HQSYSAPCT

SEQ ID NO: 7862 - protein, 13 aa, Homo sapiens
  heavy chain complementarity determining region 3 for antibody 3931
ARGIGTVVTPFQH

SEQ ID NO: 7863 - protein, 9 aa, Homo sapiens
  light chain complementarity determining region 3 for antibody 3932
HQHGTTPGT

SEQ ID NO: 7864 - protein, 18 aa, Homo sapiens
  heavy chain complementarity determining region 3 for antibody 3932
AGWAGYCGGDCSSVSLDY

SEQ ID NO: 7865 - protein, 9 aa, Homo sapiens
  light chain complementarity determining region 3 for antibody 3933
HQHGTKPGT

SEQ ID NO: 7866 - protein, 18 aa, Homo sapiens
  heavy chain complementarity determining region 3 for antibody 3933
ASWAGYCGGDCSSVSLDY

SEQ ID NO: 7867 - protein, 9 aa, Homo sapiens
  light chain complementarity determining region 3 for antibody 3934
HHFGSATGT

SEQ ID NO: 7868 - protein, 13 aa, Homo sapiens
  heavy chain complementarity determining region 3 for antibody 3934
AKGGSSPGPDFEY

SEQ ID NO: 7869 - protein, 9 aa, Homo sapiens
  light chain complementarity determining region 3 for antibody 3935
HHFGSATGT

SEQ ID NO: 7870 - protein, 13 aa, Homo sapiens
  heavy chain complementarity determining region 3 for antibody 3935
AKEGSSPGPDLEY

SEQ ID NO: 7871 - protein, 9 aa, Homo sapiens
  light chain complementarity determining region 3 for antibody 3936
EQGSYWPAS

SEQ ID NO: 7872 - protein, 10 aa, Homo sapiens
  heavy chain complementarity determining region 3 for antibody 3936
CRDREGFGDV

SEQ ID NO: 7873 - protein, 9 aa, Homo sapiens
  light chain complementarity determining region 3 for antibody 3937
AQGSYWPAT

SEQ ID NO: 7874 - protein, 14 aa, Homo sapiens
  heavy chain complementarity determining region 3 for antibody 3937
VADVPFVGGTAFDF

SEQ ID NO: 7875 - protein, 9 aa, Homo sapiens
  light chain complementarity determining region 3 for antibody 3938
AQGSYWPAS

SEQ ID NO: 7876 - protein, 16 aa, Homo sapiens
  heavy chain complementarity determining region 3 for antibody 3938
VRDLAGFTRGGSTFDY

SEQ ID NO: 7877 - protein, 9 aa, Homo sapiens
  light chain complementarity determining region 3 for antibody 3939
AQGSYWPAS

SEQ ID NO: 7878 - protein, 10 aa, Homo sapiens
  heavy chain complementarity determining region 3 for antibody 3939
RRDREGFGDV

SEQ ID NO: 7879 - protein, 9 aa, Homo sapiens
  light chain complementarity determining region 3 for antibody 3940
AQGSYWPAS

SEQ ID NO: 7880 - protein, 10 aa, Homo sapiens
  heavy chain complementarity determining region 3 for antibody 3940
CRERRGFGDV

SEQ ID NO: 7881 - protein, 9 aa, Homo sapiens
  light chain complementarity determining region 3 for antibody 3941
AQGSYWPAS

SEQ ID NO: 7882 - protein, 10 aa, Homo sapiens
  heavy chain complementarity determining region 3 for antibody 3941
CRDREGFGNV

SEQ ID NO: 7883 - protein, 9 aa, Homo sapiens
  light chain complementarity determining region 3 for antibody 3942
AQGSYWPAS

SEQ ID NO: 7884 - protein, 11 aa, Homo sapiens
  heavy chain complementarity determining region 3 for antibody 3942
ATFGQQWRLAH

SEQ ID NO: 7885 - protein, 9 aa, Homo sapiens
  light chain complementarity determining region 3 for antibody 3943
AQGSYWPAS

SEQ ID NO: 7886 - protein, 16 aa, Homo sapiens
  heavy chain complementarity determining region 3 for antibody 3943
ASLNRGDKEFGVPPAL

SEQ ID NO: 7887 - protein, 9 aa, Homo sapiens
  light chain complementarity determining region 3 for antibody 3944
AQGSYWHAS

SEQ ID NO: 7888 - protein, 10 aa, Homo sapiens
  heavy chain complementarity determining region 3 for antibody 3944
CRDREGFGDV

SEQ ID NO: 7889 - protein, 9 aa, Homo sapiens
  light chain complementarity determining region 3 for antibody 3945
AQGSFWPAS

SEQ ID NO: 7890 - protein, 10 aa, Homo sapiens
  heavy chain complementarity determining region 3 for antibody 3945
CRDREGCGDV

SEQ ID NO: 7891 - protein, 9 aa, Homo sapiens
  light chain complementarity determining region 3 for antibody 3946
AQGSFGPAS

SEQ ID NO: 7892 - protein, 10 aa, Homo sapiens
  heavy chain complementarity determining region 3 for antibody 3946
CRDREGFGDV

SEQ ID NO: 7893 - protein, 7 aa, Homo sapiens
  light chain complementarity determining region 3 for antibody 3947
YRHGRKK

SEQ ID NO: 7894 - protein, 10 aa, Homo sapiens
  heavy chain complementarity determining region 3 for antibody 3947
AREKLANYDC

SEQ ID NO: 7895 - protein, 9 aa, Homo sapiens
  light chain complementarity determining region 3 for antibody 3948
VQHNSYPVT

SEQ ID NO: 7896 - protein, 13 aa, Homo sapiens
  heavy chain complementarity determining region 3 for antibody 3948
ARVTRGGIFYFDL

SEQ ID NO: 7897 - protein, 9 aa, Homo sapiens
  light chain complementarity determining region 3 for antibody 3949
TQTTHWPGT

SEQ ID NO: 7898 - protein, 11 aa, Homo sapiens
  heavy chain complementarity determining region 3 for antibody 3949
TRDLSGSAAGY

SEQ ID NO: 7899 - protein, 10 aa, Homo sapiens
  light chain complementarity determining region 3 for antibody 3950
RQYDNLASLT

SEQ ID NO: 7900 - protein, 13 aa, Homo sapiens
  heavy chain complementarity determining region 3 for antibody 3950
AKEGSSPGPDFEY

SEQ ID NO: 7901 - protein, 9 aa, Homo sapiens
  light chain complementarity determining region 3 for antibody 3951
RQTLQTPGT

SEQ ID NO: 7902 - protein, 12 aa, Homo sapiens
  heavy chain complementarity determining region 3 for antibody 3951
ARLDWNYRAFDI

SEQ ID NO: 7903 - protein, 10 aa, Homo sapiens
  light chain complementarity determining region 3 for antibody 3952
RQSYSTPLFT

SEQ ID NO: 7904 - protein, 15 aa, Homo sapiens
  heavy chain complementarity determining region 3 for antibody 3952
ARVGRPYHNAWYFDN

SEQ ID NO: 7905 - protein, 9 aa, Homo sapiens
  light chain complementarity determining region 3 for antibody 3953
RQLYRYPIT

SEQ ID NO: 7906 - protein, 14 aa, Homo sapiens
  heavy chain complementarity determining region 3 for antibody 3953
GRDTTHDWSDGGIY

SEQ ID NO: 7907 - protein, 10 aa, Homo sapiens
  light chain complementarity determining region 3 for antibody 3954
RHYGSSQGIT

SEQ ID NO: 7908 - protein, 17 aa, Homo sapiens
  heavy chain complementarity determining region 3 for antibody 3954
ARGTGIGSGSYYADFDY

SEQ ID NO: 7909 - protein, 9 aa, Homo sapiens
  light chain complementarity determining region 3 for antibody 3955
QVYKSAPHT

SEQ ID NO: 7910 - protein, 14 aa, Homo sapiens
  heavy chain complementarity determining region 3 for antibody 3955
CRGWLDPAPPHYDF

SEQ ID NO: 7911 - protein, 9 aa, Homo sapiens
  light chain complementarity determining region 3 for antibody 3956
QVYKSAPHT

SEQ ID NO: 7912 - protein, 14 aa, Homo sapiens
  heavy chain complementarity determining region 3 for antibody 3956
CRGWLAPATPHYDF

SEQ ID NO: 7913 - protein, 9 aa, Homo sapiens
  light chain complementarity determining region 3 for antibody 3957
QVDGTSRGT

SEQ ID NO: 7914 - protein, 15 aa, Homo sapiens
  heavy chain complementarity determining region 3 for antibody 3957
AKPRSNMFAHDAFDI

SEQ ID NO: 7915 - protein, 9 aa, Homo sapiens
  light chain complementarity determining region 3 for antibody 3958
QRYYNVPWT

SEQ ID NO: 7916 - protein, 14 aa, Homo sapiens
  heavy chain complementarity determining region 3 for antibody 3958
TRDGINAVVRGGDS

SEQ ID NO: 7917 - protein, 9 aa, Homo sapiens
  light chain complementarity determining region 3 for antibody 3959
QRYNSYSYT

SEQ ID NO: 7918 - protein, 10 aa, Homo sapiens
  heavy chain complementarity determining region 3 for antibody 3959
ARTRGFVFDY

SEQ ID NO: 7919 - protein, 9 aa, Homo sapiens
  light chain complementarity determining region 3 for antibody 3960
QRYDSYSWK

SEQ ID NO: 7920 - protein, 15 aa, Homo sapiens
  heavy chain complementarity determining region 3 for antibody 3960
ARESMRHGTTGYYSF

SEQ ID NO: 7921 - protein, 9 aa, Homo sapiens
  light chain complementarity determining region 3 for antibody 3961
QRSSNTPLT

SEQ ID NO: 7922 - protein, 16 aa, Homo sapiens
  heavy chain complementarity determining region 3 for antibody 3961
VRDLAGFTRGGSTFDY

SEQ ID NO: 7923 - protein, 10 aa, Homo sapiens
  light chain complementarity determining region 3 for antibody 3962
QRRTNWLPYT

SEQ ID NO: 7924 - protein, 8 aa, Homo sapiens
  heavy chain complementarity determining region 3 for antibody 3962
ARDRAGDH

SEQ ID NO: 7925 - protein, 9 aa, Homo sapiens
  light chain complementarity determining region 3 for antibody 3963
QRNNTVPWA

SEQ ID NO: 7926 - protein, 20 aa, Homo sapiens
  heavy chain complementarity determining region 3 for antibody 3963
TRDQRSIHLWLLAEGGGMDV

SEQ ID NO: 7927 - protein, 9 aa, Homo sapiens
  light chain complementarity determining region 3 for antibody 3964
QRHNSYSYT

SEQ ID NO: 7928 - protein, 10 aa, Homo sapiens
  heavy chain complementarity determining region 3 for antibody 3964
ARTRGFLFDY

SEQ ID NO: 7929 - protein, 9 aa, Homo sapiens
  light chain complementarity determining region 3 for antibody 3965
QQYYTPPYP

SEQ ID NO: 7930 - protein, 10 aa, Homo sapiens
  heavy chain complementarity determining region 3 for antibody 3965
TRSTYAYNDI

SEQ ID NO: 7931 - protein, 9 aa, Homo sapiens
  light chain complementarity determining region 3 for antibody 3966
QQYYTPPNT

SEQ ID NO: 7932 - protein, 10 aa, Homo sapiens
  heavy chain complementarity determining region 3 for antibody 3966
TRSTYAYNDI

SEQ ID NO: 7933 - protein, 9 aa, Homo sapiens
  light chain complementarity determining region 3 for antibody 3967
QQYYTIPFT

SEQ ID NO: 7934 - protein, 14 aa, Homo sapiens
  heavy chain complementarity determining region 3 for antibody 3967
AKGRIASCYDASDI

SEQ ID NO: 7935 - protein, 9 aa, Homo sapiens
  light chain complementarity determining region 3 for antibody 3968
QQYYSTPYT

SEQ ID NO: 7936 - protein, 13 aa, Homo sapiens
  heavy chain complementarity determining region 3 for antibody 3968
AKEGSSPGPDFDS

SEQ ID NO: 7937 - protein, 9 aa, Homo sapiens
  light chain complementarity determining region 3 for antibody 3969
QQYYSTPYP

SEQ ID NO: 7938 - protein, 14 aa, Homo sapiens
  heavy chain complementarity determining region 3 for antibody 3969
AASYSSGWLEYFQH

SEQ ID NO: 7939 - protein, 9 aa, Homo sapiens
  light chain complementarity determining region 3 for antibody 3970
QQYYSTPLT

SEQ ID NO: 7940 - protein, 16 aa, Homo sapiens
  heavy chain complementarity determining region 3 for antibody 3970
SADLGDHVDYYATLDY

SEQ ID NO: 7941 - protein, 9 aa, Homo sapiens
  light chain complementarity determining region 3 for antibody 3971
QQYYSTPGT

SEQ ID NO: 7942 - protein, 18 aa, Homo sapiens
  heavy chain complementarity determining region 3 for antibody 3971
ARGLHQLRLGGYFYGLDV

SEQ ID NO: 7943 - protein, 10 aa, Homo sapiens
  light chain complementarity determining region 3 for antibody 3972
QQYYSSPPWA

SEQ ID NO: 7944 - protein, 12 aa, Homo sapiens
  heavy chain complementarity determining region 3 for antibody 3972
ARDKGGRNGMDV

SEQ ID NO: 7945 - protein, 9 aa, Homo sapiens
  light chain complementarity determining region 3 for antibody 3973
QQYYSAPPT

SEQ ID NO: 7946 - protein, 9 aa, Homo sapiens
  heavy chain complementarity determining region 3 for antibody 3973
ARDVWPEDC

SEQ ID NO: 7947 - protein, 9 aa, Homo sapiens
  light chain complementarity determining region 3 for antibody 3974
QQYYRAPIT

SEQ ID NO: 7948 - protein, 15 aa, Homo sapiens
  heavy chain complementarity determining region 3 for antibody 3974
VRALSPTEMSYAIAY

SEQ ID NO: 7949 - protein, 9 aa, Homo sapiens
  light chain complementarity determining region 3 for antibody 3975
QQYYNKPLT

SEQ ID NO: 7950 - protein, 13 aa, Homo sapiens
  heavy chain complementarity determining region 3 for antibody 3975
GRGSGPGSFLTDN

SEQ ID NO: 7951 - protein, 9 aa, Homo sapiens
  light chain complementarity determining region 3 for antibody 3976
QQYYATPLT

SEQ ID NO: 7952 - protein, 14 aa, Homo sapiens
  heavy chain complementarity determining region 3 for antibody 3976
ASDAFNLGDRAMIP

SEQ ID NO: 7953 - protein, 9 aa, Homo sapiens
  light chain complementarity determining region 3 for antibody 3977
QQYTSYPWT

SEQ ID NO: 7954 - protein, 15 aa, Homo sapiens
  heavy chain complementarity determining region 3 for antibody 3977
GKEGPGSSGWLTGHY

SEQ ID NO: 7955 - protein, 9 aa, Homo sapiens
  light chain complementarity determining region 3 for antibody 3978
QQYTSYPWT

SEQ ID NO: 7956 - protein, 11 aa, Homo sapiens
  heavy chain complementarity determining region 3 for antibody 3978
ARIVARKPDDY

SEQ ID NO: 7957 - protein, 9 aa, Homo sapiens
  light chain complementarity determining region 3 for antibody 3979
QQYSVSPLT

SEQ ID NO: 7958 - protein, 8 aa, Homo sapiens
  heavy chain complementarity determining region 3 for antibody 3979
ARRNDFDY

SEQ ID NO: 7959 - protein, 9 aa, Homo sapiens
  light chain complementarity determining region 3 for antibody 3980
QQYSVSPIP

SEQ ID NO: 7960 - protein, 8 aa, Homo sapiens
  heavy chain complementarity determining region 3 for antibody 3980
ARRNDFDY

SEQ ID NO: 7961 - protein, 9 aa, Homo sapiens
  light chain complementarity determining region 3 for antibody 3981
QQYSSYSLT

SEQ ID NO: 7962 - protein, 15 aa, Homo sapiens
  heavy chain complementarity determining region 3 for antibody 3981
ARSMVSGTTDDAFDI

SEQ ID NO: 7963 - protein, 7 aa, Homo sapiens
  light chain complementarity determining region 3 for antibody 3982
QQYSSWT

SEQ ID NO: 7964 - protein, 15 aa, Homo sapiens
  heavy chain complementarity determining region 3 for antibody 3982
ARDRGDPQLYNWFDP

SEQ ID NO: 7965 - protein, 7 aa, Homo sapiens
  light chain complementarity determining region 3 for antibody 3983
QQYSSWT

SEQ ID NO: 7966 - protein, 12 aa, Homo sapiens
  heavy chain complementarity determining region 3 for antibody 3983
AIVVPGRWDFDD

SEQ ID NO: 7967 - protein, 7 aa, Homo sapiens
  light chain complementarity determining region 3 for antibody 3984
QQYSSWT

SEQ ID NO: 7968 - protein, 12 aa, Homo sapiens
  heavy chain complementarity determining region 3 for antibody 3984
AIVVPGRGDLDD

SEQ ID NO: 7969 - protein, 9 aa, Homo sapiens
  light chain complementarity determining region 3 for antibody 3985
QQYRTVPWT

SEQ ID NO: 7970 - protein, 14 aa, Homo sapiens
  heavy chain complementarity determining region 3 for antibody 3985
ARGHFDSTGFRLDY

SEQ ID NO: 7971 - protein, 8 aa, Homo sapiens
  light chain complementarity determining region 3 for antibody 3986
QQYQSYWT

SEQ ID NO: 7972 - protein, 10 aa, Homo sapiens
  heavy chain complementarity determining region 3 for antibody 3986
ARERSGSYDI

SEQ ID NO: 7973 - protein, 7 aa, Homo sapiens
  light chain complementarity determining region 3 for antibody 3987
QQYNTWT

SEQ ID NO: 7974 - protein, 15 aa, Homo sapiens
  heavy chain complementarity determining region 3 for antibody 3987
VRDPGGLAYFYNMEV

SEQ ID NO: 7975 - protein, 7 aa, Homo sapiens
  light chain complementarity determining region 3 for antibody 3988
QQYNTWT

SEQ ID NO: 7976 - protein, 16 aa, Homo sapiens
  heavy chain complementarity determining region 3 for antibody 3988
VGPHLTYNSGWRYFDY

SEQ ID NO: 7977 - protein, 7 aa, Homo sapiens
  light chain complementarity determining region 3 for antibody 3989
QQYNTWT

SEQ ID NO: 7978 - protein, 12 aa, Homo sapiens
  heavy chain complementarity determining region 3 for antibody 3989
SRDRGGRSGMDV

SEQ ID NO: 7979 - protein, 7 aa, Homo sapiens
  light chain complementarity determining region 3 for antibody 3990
QQYNTWT

SEQ ID NO: 7980 - protein, 11 aa, Homo sapiens
  heavy chain complementarity determining region 3 for antibody 3990
ARIVARKPDDY

SEQ ID NO: 7981 - protein, 7 aa, Homo sapiens
  light chain complementarity determining region 3 for antibody 3991
QQYNTWT

SEQ ID NO: 7982 - protein, 12 aa, Homo sapiens
  heavy chain complementarity determining region 3 for antibody 3991
ARDYSCCNGFDP

SEQ ID NO: 7983 - protein, 7 aa, Homo sapiens
  light chain complementarity determining region 3 for antibody 3992
QQYNTWT

SEQ ID NO: 7984 - protein, 12 aa, Homo sapiens
  heavy chain complementarity determining region 3 for antibody 3992
ARDTGGRNGMDV

SEQ ID NO: 7985 - protein, 7 aa, Homo sapiens
  light chain complementarity determining region 3 for antibody 3993
QQYNTWT

SEQ ID NO: 7986 - protein, 12 aa, Homo sapiens
  heavy chain complementarity determining region 3 for antibody 3993
ARDKGGRYGMDV

SEQ ID NO: 7987 - protein, 7 aa, Homo sapiens
  light chain complementarity determining region 3 for antibody 3994
QQYNTWT

SEQ ID NO: 7988 - protein, 12 aa, Homo sapiens
  heavy chain complementarity determining region 3 for antibody 3994
ARDKGGRNGMYV

SEQ ID NO: 7989 - protein, 7 aa, Homo sapiens
  light chain complementarity determining region 3 for antibody 3995
QQYNTWT

SEQ ID NO: 7990 - protein, 12 aa, Homo sapiens
  heavy chain complementarity determining region 3 for antibody 3995
ARDKGGRNGMEV

SEQ ID NO: 7991 - protein, 7 aa, Homo sapiens
  light chain complementarity determining region 3 for antibody 3996
QQYNTWT

SEQ ID NO: 7992 - protein, 12 aa, Homo sapiens
  heavy chain complementarity determining region 3 for antibody 3996
ARDKGGRNCMDV

SEQ ID NO: 7993 - protein, 7 aa, Homo sapiens
  light chain complementarity determining region 3 for antibody 3997
QQYNTWT

SEQ ID NO: 7994 - protein, 17 aa, Homo sapiens
  heavy chain complementarity determining region 3 for antibody 3997
AKRLPDLLGGGHHYIDV

SEQ ID NO: 7995 - protein, 7 aa, Homo sapiens
  light chain complementarity determining region 3 for antibody 3998
QQYNTWT

SEQ ID NO: 7996 - protein, 11 aa, Homo sapiens
  heavy chain complementarity determining region 3 for antibody 3998
AKGGFYFLTGD

SEQ ID NO: 7997 - protein, 9 aa, Homo sapiens
  light chain complementarity determining region 3 for antibody 3999
QQYNSYSRT

SEQ ID NO: 7998 - protein, 16 aa, Homo sapiens
  heavy chain complementarity determining region 3 for antibody 3999
VGRHLTYNSGWRYFDY

SEQ ID NO: 7999 - protein, 9 aa, Homo sapiens
  light chain complementarity determining region 3 for antibody 4000
QQYNSYSRT

SEQ ID NO: 8000 - protein, 16 aa, Homo sapiens
  heavy chain complementarity determining region 3 for antibody 4000
VGPHLTYSSGWRYFDY

SEQ ID NO: 8001 - protein, 9 aa, Homo sapiens
  light chain complementarity determining region 3 for antibody 4001
QQYNSYSRT

SEQ ID NO: 8002 - protein, 16 aa, Homo sapiens
  heavy chain complementarity determining region 3 for antibody 4001
VGPHLTYNSGWRYLDY

SEQ ID NO: 8003 - protein, 9 aa, Homo sapiens
  light chain complementarity determining region 3 for antibody 4002
QQYNSYSRT

SEQ ID NO: 8004 - protein, 16 aa, Homo sapiens
  heavy chain complementarity determining region 3 for antibody 4002
VGPHLTYNSDWRYFDY

SEQ ID NO: 8005 - protein, 9 aa, Homo sapiens
  light chain complementarity determining region 3 for antibody 4003
QQYNSYSRT

SEQ ID NO: 8006 - protein, 16 aa, Homo sapiens
  heavy chain complementarity determining region 3 for antibody 4003
MGPHLTYNSGWRYFDY

SEQ ID NO: 8007 - protein, 9 aa, Homo sapiens
  light chain complementarity determining region 3 for antibody 4004
QQYNSYSRT

SEQ ID NO: 8008 - protein, 15 aa, Homo sapiens
  heavy chain complementarity determining region 3 for antibody 4004
ARSMVSGTTDDAFDI

SEQ ID NO: 8009 - protein, 9 aa, Homo sapiens
  light chain complementarity determining region 3 for antibody 4005
QQYNSYSRT

SEQ ID NO: 8010 - protein, 12 aa, Homo sapiens
  heavy chain complementarity determining region 3 for antibody 4005
ARLDWNYRAFDI

SEQ ID NO: 8011 - protein, 9 aa, Homo sapiens
  light chain complementarity determining region 3 for antibody 4006
QQYNSYSRT

SEQ ID NO: 8012 - protein, 10 aa, Homo sapiens
  heavy chain complementarity determining region 3 for antibody 4006
ARETSGAYDI

SEQ ID NO: 8013 - protein, 9 aa, Homo sapiens
  light chain complementarity determining region 3 for antibody 4007
QQYNSYSRP

SEQ ID NO: 8014 - protein, 16 aa, Homo sapiens
  heavy chain complementarity determining region 3 for antibody 4007
VGPHLTYNSGWRYFDY

SEQ ID NO: 8015 - protein, 9 aa, Homo sapiens
  light chain complementarity determining region 3 for antibody 4008
QQYNSYSPT

SEQ ID NO: 8016 - protein, 14 aa, Homo sapiens
  heavy chain complementarity determining region 3 for antibody 4008
GRDVHTTGWTLGGY

SEQ ID NO: 8017 - protein, 9 aa, Homo sapiens
  light chain complementarity determining region 3 for antibody 4009
QQYNSYSPT

SEQ ID NO: 8018 - protein, 15 aa, Homo sapiens
  heavy chain complementarity determining region 3 for antibody 4009
ARSMVSGTTDDAFDI

SEQ ID NO: 8019 - protein, 10 aa, Homo sapiens
  light chain complementarity determining region 3 for antibody 4010
QQYNSYSPRP

SEQ ID NO: 8020 - protein, 15 aa, Homo sapiens
  heavy chain complementarity determining region 3 for antibody 4010
ARVGRPYHNAWYCDN

SEQ ID NO: 8021 - protein, 10 aa, Homo sapiens
  light chain complementarity determining region 3 for antibody 4011
QQYNSYSPRP

SEQ ID NO: 8022 - protein, 15 aa, Homo sapiens
  heavy chain complementarity determining region 3 for antibody 4011
ARVCRPYHNAWYFDN

SEQ ID NO: 8023 - protein, 9 aa, Homo sapiens
  light chain complementarity determining region 3 for antibody 4012
QQYNSYSLT

SEQ ID NO: 8024 - protein, 17 aa, Homo sapiens
  heavy chain complementarity determining region 3 for antibody 4012
ARNTMVGTWQRQGNLDH

SEQ ID NO: 8025 - protein, 9 aa, Homo sapiens
  light chain complementarity determining region 3 for antibody 4013
QQYNSYSLP

SEQ ID NO: 8026 - protein, 15 aa, Homo sapiens
  heavy chain complementarity determining region 3 for antibody 4013
ARSMVSGTTDDAFDI

SEQ ID NO: 8027 - protein, 9 aa, Homo sapiens
  light chain complementarity determining region 3 for antibody 4014
QQYNSYSHT

SEQ ID NO: 8028 - protein, 14 aa, Homo sapiens
  heavy chain complementarity determining region 3 for antibody 4014
VRDVHTTGWTLGGY

SEQ ID NO: 8029 - protein, 9 aa, Homo sapiens
  light chain complementarity determining region 3 for antibody 4015
QQYNSYSHT

SEQ ID NO: 8030 - protein, 14 aa, Homo sapiens
  heavy chain complementarity determining region 3 for antibody 4015
TRDVHTTGWTLGGY

SEQ ID NO: 8031 - protein, 9 aa, Homo sapiens
  light chain complementarity determining region 3 for antibody 4016
QQYNSYSHT

SEQ ID NO: 8032 - protein, 15 aa, Homo sapiens
  heavy chain complementarity determining region 3 for antibody 4016
GKEGPGSSGWLTGHY

SEQ ID NO: 8033 - protein, 9 aa, Homo sapiens
  light chain complementarity determining region 3 for antibody 4017
QQYNSYSHT

SEQ ID NO: 8034 - protein, 14 aa, Homo sapiens
  heavy chain complementarity determining region 3 for antibody 4017
ARDVHTTGWTLWGY

SEQ ID NO: 8035 - protein, 9 aa, Homo sapiens
  light chain complementarity determining region 3 for antibody 4018
QQYNSYSHT

SEQ ID NO: 8036 - protein, 14 aa, Homo sapiens
  heavy chain complementarity determining region 3 for antibody 4018
ARDVHTTGWTFGGY

SEQ ID NO: 8037 - protein, 9 aa, Homo sapiens
  light chain complementarity determining region 3 for antibody 4019
QQYNSYSHT

SEQ ID NO: 8038 - protein, 14 aa, Homo sapiens
  heavy chain complementarity determining region 3 for antibody 4019
ARDVHPTGWTLGGY

SEQ ID NO: 8039 - protein, 9 aa, Homo sapiens
  light chain complementarity determining region 3 for antibody 4020
QQYNSYSHT

SEQ ID NO: 8040 - protein, 14 aa, Homo sapiens
  heavy chain complementarity determining region 3 for antibody 4020
ARDGHTTGWTLGGY

SEQ ID NO: 8041 - protein, 9 aa, Homo sapiens
  light chain complementarity determining region 3 for antibody 4021
QQYNSYPWT

SEQ ID NO: 8042 - protein, 9 aa, Homo sapiens
  heavy chain complementarity determining region 3 for antibody 4021
GSRRPYFDS

SEQ ID NO: 8043 - protein, 9 aa, Homo sapiens
  light chain complementarity determining region 3 for antibody 4022
QQYNSYPWT

SEQ ID NO: 8044 - protein, 15 aa, Homo sapiens
  heavy chain complementarity determining region 3 for antibody 4022
GKEGQGSSGWLTGHY

SEQ ID NO: 8045 - protein, 9 aa, Homo sapiens
  light chain complementarity determining region 3 for antibody 4023
QQYNSYPWT

SEQ ID NO: 8046 - protein, 15 aa, Homo sapiens
  heavy chain complementarity determining region 3 for antibody 4023
GKEGPGSSGGLTGHY

SEQ ID NO: 8047 - protein, 9 aa, Homo sapiens
  light chain complementarity determining region 3 for antibody 4024
QQYNSYPWT

SEQ ID NO: 8048 - protein, 15 aa, Homo sapiens
  heavy chain complementarity determining region 3 for antibody 4024
GKEGPGSGGWLTGHY

SEQ ID NO: 8049 - protein, 9 aa, Homo sapiens
  light chain complementarity determining region 3 for antibody 4025
QQYNSYPWT

SEQ ID NO: 8050 - protein, 15 aa, Homo sapiens
  heavy chain complementarity determining region 3 for antibody 4025
GKEGPGCSGWLTGHY

SEQ ID NO: 8051 - protein, 9 aa, Homo sapiens
  light chain complementarity determining region 3 for antibody 4026
QQYNSYPWT

SEQ ID NO: 8052 - protein, 15 aa, Homo sapiens
  heavy chain complementarity determining region 3 for antibody 4026
GKEEPGSSGWLTGHY

SEQ ID NO: 8053 - protein, 9 aa, Homo sapiens
  light chain complementarity determining region 3 for antibody 4027
QQYNSYPWT

SEQ ID NO: 8054 - protein, 10 aa, Homo sapiens
  heavy chain complementarity determining region 3 for antibody 4027
ARTRGFLFDY

SEQ ID NO: 8055 - protein, 9 aa, Homo sapiens
  light chain complementarity determining region 3 for antibody 4028
QQYNSYPWT

SEQ ID NO: 8056 - protein, 12 aa, Homo sapiens
  heavy chain complementarity determining region 3 for antibody 4028
ARLDWNYRAFDI

SEQ ID NO: 8057 - protein, 9 aa, Homo sapiens
  light chain complementarity determining region 3 for antibody 4029
QQYNSYPWT

SEQ ID NO: 8058 - protein, 11 aa, Homo sapiens
  heavy chain complementarity determining region 3 for antibody 4029
ARIVARKPYDY

SEQ ID NO: 8059 - protein, 9 aa, Homo sapiens
  light chain complementarity determining region 3 for antibody 4030
QQYNSYPRT

SEQ ID NO: 8060 - protein, 16 aa, Homo sapiens
  heavy chain complementarity determining region 3 for antibody 4030
VGPHLTYNSGWRYFDY

SEQ ID NO: 8061 - protein, 9 aa, Homo sapiens
  light chain complementarity determining region 3 for antibody 4031
QQYNSYPRT

SEQ ID NO: 8062 - protein, 11 aa, Homo sapiens
  heavy chain complementarity determining region 3 for antibody 4031
ARIVARKPDDY

SEQ ID NO: 8063 - protein, 9 aa, Homo sapiens
  light chain complementarity determining region 3 for antibody 4032
QQYNSYPPT

SEQ ID NO: 8064 - protein, 13 aa, Homo sapiens
  heavy chain complementarity determining region 3 for antibody 4032
AKEGSSPGPGFEY

SEQ ID NO: 8065 - protein, 9 aa, Homo sapiens
  light chain complementarity determining region 3 for antibody 4033
QQYNSYPCT

SEQ ID NO: 8066 - protein, 11 aa, Homo sapiens
  heavy chain complementarity determining region 3 for antibody 4033
ARIVARKPDDY

SEQ ID NO: 8067 - protein, 7 aa, Homo sapiens
  light chain complementarity determining region 3 for antibody 4034
QQYNSWT

SEQ ID NO: 8068 - protein, 12 aa, Homo sapiens
  heavy chain complementarity determining region 3 for antibody 4034
VKDRGGRSGMDV

SEQ ID NO: 8069 - protein, 11 aa, Homo sapiens
  light chain complementarity determining region 3 for antibody 4035
QQYNSWPPSWT

SEQ ID NO: 8070 - protein, 20 aa, Homo sapiens
  heavy chain complementarity determining region 3 for antibody 4035
ARDVMSPEVLWFGESQIFDH

SEQ ID NO: 8071 - protein, 9 aa, Homo sapiens
  light chain complementarity determining region 3 for antibody 4036
QQYNSWPLT

SEQ ID NO: 8072 - protein, 16 aa, Homo sapiens
  heavy chain complementarity determining region 3 for antibody 4036
AKAPDNNYHYYYGMDV

SEQ ID NO: 8073 - protein, 9 aa, Homo sapiens
  light chain complementarity determining region 3 for antibody 4037
QQYNSVPWT

SEQ ID NO: 8074 - protein, 17 aa, Homo sapiens
  heavy chain complementarity determining region 3 for antibody 4037
TRDRADSTWTSANRRDS

SEQ ID NO: 8075 - protein, 9 aa, Homo sapiens
  light chain complementarity determining region 3 for antibody 4038
QQYNNWPWT

SEQ ID NO: 8076 - protein, 16 aa, Homo sapiens
  heavy chain complementarity determining region 3 for antibody 4038
ASLNRGDKEFGVPPAL

SEQ ID NO: 8077 - protein, 8 aa, Homo sapiens
  light chain complementarity determining region 3 for antibody 4039
QQYNNWPT

SEQ ID NO: 8078 - protein, 9 aa, Homo sapiens
  heavy chain complementarity determining region 3 for antibody 4039
ARGGSYPGY

SEQ ID NO: 8079 - protein, 9 aa, Homo sapiens
  light chain complementarity determining region 3 for antibody 4040
QQYNNWPRT

SEQ ID NO: 8080 - protein, 19 aa, Homo sapiens
  heavy chain complementarity determining region 3 for antibody 4040
ARPSKGYCSSTNCPAWFDP

SEQ ID NO: 8081 - protein, 9 aa, Homo sapiens
  light chain complementarity determining region 3 for antibody 4041
QQYNNWPLT

SEQ ID NO: 8082 - protein, 25 aa, Homo sapiens
  heavy chain complementarity determining region 3 for antibody 4041
ARVRRYCTSTVCYTSDYYYYQFMDV

SEQ ID NO: 8083 - protein, 9 aa, Homo sapiens
  light chain complementarity determining region 3 for antibody 4042
QQYNKWPYT

SEQ ID NO: 8084 - protein, 21 aa, Homo sapiens
  heavy chain complementarity determining region 3 for antibody 4042
TRDVRYYDFWSAHHYYYYMDV

SEQ ID NO: 8085 - protein, 7 aa, Homo sapiens
  light chain complementarity determining region 3 for antibody 4043
QQYNIWT

SEQ ID NO: 8086 - protein, 12 aa, Homo sapiens
  heavy chain complementarity determining region 3 for antibody 4043
ARDKGGRNGMDV

SEQ ID NO: 8087 - protein, 10 aa, Homo sapiens
  light chain complementarity determining region 3 for antibody 4044
QQYNIRPPDT

SEQ ID NO: 8088 - protein, 12 aa, Homo sapiens
  heavy chain complementarity determining region 3 for antibody 4044
ARDPPGMASLGD

SEQ ID NO: 8089 - protein, 10 aa, Homo sapiens
  light chain complementarity determining region 3 for antibody 4045
QQYNFYSTLT

SEQ ID NO: 8090 - protein, 16 aa, Homo sapiens
  heavy chain complementarity determining region 3 for antibody 4045
GRQVISATKWPDRLDY

SEQ ID NO: 8091 - protein, 9 aa, Homo sapiens
  light chain complementarity determining region 3 for antibody 4046
QQYLTYPLP

SEQ ID NO: 8092 - protein, 18 aa, Homo sapiens
  heavy chain complementarity determining region 3 for antibody 4046
ARGSYCDSSSWCPYGFDI

SEQ ID NO: 8093 - protein, 8 aa, Homo sapiens
  light chain complementarity determining region 3 for antibody 4047
QQYKSYWT

SEQ ID NO: 8094 - protein, 10 aa, Homo sapiens
  heavy chain complementarity determining region 3 for antibody 4047
ERERSGSYDI

SEQ ID NO: 8095 - protein, 8 aa, Homo sapiens
  light chain complementarity determining region 3 for antibody 4048
QQYKSYWT

SEQ ID NO: 8096 - protein, 10 aa, Homo sapiens
  heavy chain complementarity determining region 3 for antibody 4048
ARETSGSYDI

SEQ ID NO: 8097 - protein, 8 aa, Homo sapiens
  light chain complementarity determining region 3 for antibody 4049
QQYKSYWT

SEQ ID NO: 8098 - protein, 10 aa, Homo sapiens
  heavy chain complementarity determining region 3 for antibody 4049
ARERAGSYDI

SEQ ID NO: 8099 - protein, 8 aa, Homo sapiens
  light chain complementarity determining region 3 for antibody 4050
QQYKSYWT

SEQ ID NO: 8100 - protein, 10 aa, Homo sapiens
  heavy chain complementarity determining region 3 for antibody 4050
AGERSGSYDI

SEQ ID NO: 8101 - protein, 8 aa, Homo sapiens
  light chain complementarity determining region 3 for antibody 4051
QQYKSYWK

SEQ ID NO: 8102 - protein, 10 aa, Homo sapiens
  heavy chain complementarity determining region 3 for antibody 4051
ARERSGSYDI

SEQ ID NO: 8103 - protein, 7 aa, Homo sapiens
  light chain complementarity determining region 3 for antibody 4052
QQYKSWP

SEQ ID NO: 8104 - protein, 12 aa, Homo sapiens
  heavy chain complementarity determining region 3 for antibody 4052
VKDRGGRSGMDV

SEQ ID NO: 8105 - protein, 10 aa, Homo sapiens
  light chain complementarity determining region 3 for antibody 4053
QQYKNWPPYT

SEQ ID NO: 8106 - protein, 14 aa, Homo sapiens
  heavy chain complementarity determining region 3 for antibody 4053
VRENCYGVGSCFDY

SEQ ID NO: 8107 - protein, 9 aa, Homo sapiens
  light chain complementarity determining region 3 for antibody 4054
QQYKIYPWT

SEQ ID NO: 8108 - protein, 13 aa, Homo sapiens
  heavy chain complementarity determining region 3 for antibody 4054
AKEGSSSGPDFDY

SEQ ID NO: 8109 - protein, 9 aa, Homo sapiens
  light chain complementarity determining region 3 for antibody 4055
QQYKIYPWT

SEQ ID NO: 8110 - protein, 13 aa, Homo sapiens
  heavy chain complementarity determining region 3 for antibody 4055
AKEGSSPGPDFDS

SEQ ID NO: 8111 - protein, 9 aa, Homo sapiens
  light chain complementarity determining region 3 for antibody 4056
QQYKIYPWT

SEQ ID NO: 8112 - protein, 13 aa, Homo sapiens
  heavy chain complementarity determining region 3 for antibody 4056
AKEGASPGPDFDY

SEQ ID NO: 8113 - protein, 9 aa, Homo sapiens
  light chain complementarity determining region 3 for antibody 4057
QQYKDAPWT

SEQ ID NO: 8114 - protein, 20 aa, Homo sapiens
  heavy chain complementarity determining region 3 for antibody 4057
TREARGSSSYAYGGGGGLDV

SEQ ID NO: 8115 - protein, 9 aa, Homo sapiens
  light chain complementarity determining region 3 for antibody 4058
QQYKDAPWT

SEQ ID NO: 8116 - protein, 20 aa, Homo sapiens
  heavy chain complementarity determining region 3 for antibody 4058
TRDARGSSAYAYGGGGGLDV

SEQ ID NO: 8117 - protein, 9 aa, Homo sapiens
  light chain complementarity determining region 3 for antibody 4059
QQYKDAPGT

SEQ ID NO: 8118 - protein, 20 aa, Homo sapiens
  heavy chain complementarity determining region 3 for antibody 4059
TRDARGSSSYAYGGGGGLDV

SEQ ID NO: 8119 - protein, 8 aa, Homo sapiens
  light chain complementarity determining region 3 for antibody 4060
QQYHYQFT

SEQ ID NO: 8120 - protein, 6 aa, Homo sapiens
  heavy chain complementarity determining region 3 for antibody 4060
ARHTGS

SEQ ID NO: 8121 - protein, 9 aa, Homo sapiens
  light chain complementarity determining region 3 for antibody 4061
QQYHSAPIT

SEQ ID NO: 8122 - protein, 14 aa, Homo sapiens
  heavy chain complementarity determining region 3 for antibody 4061
AKGEATSCDYIFDF

SEQ ID NO: 8123 - protein, 9 aa, Homo sapiens
  light chain complementarity determining region 3 for antibody 4062
QQYHRYSHT

SEQ ID NO: 8124 - protein, 14 aa, Homo sapiens
  heavy chain complementarity determining region 3 for antibody 4062
GRDVHTTGWTLGDY

SEQ ID NO: 8125 - protein, 9 aa, Homo sapiens
  light chain complementarity determining region 3 for antibody 4063
QQYHNWPGT

SEQ ID NO: 8126 - protein, 11 aa, Homo sapiens
  heavy chain complementarity determining region 3 for antibody 4063
AKGGFYFRTGD

SEQ ID NO: 8127 - protein, 9 aa, Homo sapiens
  light chain complementarity determining region 3 for antibody 4064
QQYHNWPGT

SEQ ID NO: 8128 - protein, 11 aa, Homo sapiens
  heavy chain complementarity determining region 3 for antibody 4064
AKGGFYFLTGY

SEQ ID NO: 8129 - protein, 9 aa, Homo sapiens
  light chain complementarity determining region 3 for antibody 4065
QQYHNWPGT

SEQ ID NO: 8130 - protein, 11 aa, Homo sapiens
  heavy chain complementarity determining region 3 for antibody 4065
AEGGFYFLTGD

SEQ ID NO: 8131 - protein, 9 aa, Homo sapiens
  light chain complementarity determining region 3 for antibody 4066
QQYHGYPWT

SEQ ID NO: 8132 - protein, 11 aa, Homo sapiens
  heavy chain complementarity determining region 3 for antibody 4066
ARIVARKPYDY

SEQ ID NO: 8133 - protein, 9 aa, Homo sapiens
  light chain complementarity determining region 3 for antibody 4067
QQYHGYPWT

SEQ ID NO: 8134 - protein, 11 aa, Homo sapiens
  heavy chain complementarity determining region 3 for antibody 4067
ARIAARKPDDY

SEQ ID NO: 8135 - protein, 9 aa, Homo sapiens
  light chain complementarity determining region 3 for antibody 4068
QQYHGYPWT

SEQ ID NO: 8136 - protein, 9 aa, Homo sapiens
  heavy chain complementarity determining region 3 for antibody 4068
ACWGGLSNY

SEQ ID NO: 8137 - protein, 8 aa, Homo sapiens
  light chain complementarity determining region 3 for antibody 4069
QQYGYSQT

SEQ ID NO: 8138 - protein, 15 aa, Homo sapiens
  heavy chain complementarity determining region 3 for antibody 4069
ARGLLATGGWYYFDY

SEQ ID NO: 8139 - protein, 9 aa, Homo sapiens
  light chain complementarity determining region 3 for antibody 4070
QQYGYSPLT

SEQ ID NO: 8140 - protein, 18 aa, Homo sapiens
  heavy chain complementarity determining region 3 for antibody 4070
ARGDYPEARSGYSLDFDY

SEQ ID NO: 8141 - protein, 8 aa, Homo sapiens
  light chain complementarity determining region 3 for antibody 4071
QQYGYSHT

SEQ ID NO: 8142 - protein, 15 aa, Homo sapiens
  heavy chain complementarity determining region 3 for antibody 4071
ARGRLATGGWYYFDY

SEQ ID NO: 8143 - protein, 8 aa, Homo sapiens
  light chain complementarity determining region 3 for antibody 4072
QQYGYSHT

SEQ ID NO: 8144 - protein, 15 aa, Homo sapiens
  heavy chain complementarity determining region 3 for antibody 4072
ARGLLATGGWCYFDY

SEQ ID NO: 8145 - protein, 8 aa, Homo sapiens
  light chain complementarity determining region 3 for antibody 4073
QQYGYSHT

SEQ ID NO: 8146 - protein, 15 aa, Homo sapiens
  heavy chain complementarity determining region 3 for antibody 4073
ARGLLATGGGYYFDY

SEQ ID NO: 8147 - protein, 8 aa, Homo sapiens
  light chain complementarity determining region 3 for antibody 4074
QQYGYSHP

SEQ ID NO: 8148 - protein, 15 aa, Homo sapiens
  heavy chain complementarity determining region 3 for antibody 4074
ARGLLATGGWYYFDY

SEQ ID NO: 8149 - protein, 9 aa, Homo sapiens
  light chain complementarity determining region 3 for antibody 4075
QQYGTTPLT

SEQ ID NO: 8150 - protein, 6 aa, Homo sapiens
  heavy chain complementarity determining region 3 for antibody 4075
TTGSHA

SEQ ID NO: 8151 - protein, 9 aa, Homo sapiens
  light chain complementarity determining region 3 for antibody 4076
QQYGTSPYT

SEQ ID NO: 8152 - protein, 17 aa, Homo sapiens
  heavy chain complementarity determining region 3 for antibody 4076
VRGGPPPRGYIFGAFDI

SEQ ID NO: 8153 - protein, 9 aa, Homo sapiens
  light chain complementarity determining region 3 for antibody 4077
QQYGTSPVI

SEQ ID NO: 8154 - protein, 13 aa, Homo sapiens
  heavy chain complementarity determining region 3 for antibody 4077
AKDRGSGWYAWGY

SEQ ID NO: 8155 - protein, 9 aa, Homo sapiens
  light chain complementarity determining region 3 for antibody 4078
QQYGTSPVA

SEQ ID NO: 8156 - protein, 13 aa, Homo sapiens
  heavy chain complementarity determining region 3 for antibody 4078
AKDRGSGWYAWGY

SEQ ID NO: 8157 - protein, 9 aa, Homo sapiens
  light chain complementarity determining region 3 for antibody 4079
QQYGTSPTT

SEQ ID NO: 8158 - protein, 15 aa, Homo sapiens
  heavy chain complementarity determining region 3 for antibody 4079
TTEDITGVQGEPLDY

SEQ ID NO: 8159 - protein, 9 aa, Homo sapiens
  light chain complementarity determining region 3 for antibody 4080
QQYGTSPKT

SEQ ID NO: 8160 - protein, 15 aa, Homo sapiens
  heavy chain complementarity determining region 3 for antibody 4080
TTEDITGVQGEPPDY

SEQ ID NO: 8161 - protein, 7 aa, Homo sapiens
  light chain complementarity determining region 3 for antibody 4081
QQYGSYT

SEQ ID NO: 8162 - protein, 13 aa, Homo sapiens
  heavy chain complementarity determining region 3 for antibody 4081
AKEGSAPGPDFEY

SEQ ID NO: 8163 - protein, 8 aa, Homo sapiens
  light chain complementarity determining region 3 for antibody 4082
QQYGSSWT

SEQ ID NO: 8164 - protein, 15 aa, Homo sapiens
  heavy chain complementarity determining region 3 for antibody 4082
ARAGSILAGLSFFDY

SEQ ID NO: 8165 - protein, 9 aa, Homo sapiens
  light chain complementarity determining region 3 for antibody 4083
QQYGSSTWT

SEQ ID NO: 8166 - protein, 17 aa, Homo sapiens
  heavy chain complementarity determining region 3 for antibody 4083
AKGRGSVAMALIDYLDL

SEQ ID NO: 8167 - protein, 9 aa, Homo sapiens
  light chain complementarity determining region 3 for antibody 4084
QQYGSSTWT

SEQ ID NO: 8168 - protein, 17 aa, Homo sapiens
  heavy chain complementarity determining region 3 for antibody 4084
AKGRGSVAIALIYYLDL

SEQ ID NO: 8169 - protein, 9 aa, Homo sapiens
  light chain complementarity determining region 3 for antibody 4085
QQYGSSTRT

SEQ ID NO: 8170 - protein, 17 aa, Homo sapiens
  heavy chain complementarity determining region 3 for antibody 4085
AKGRGSVAMALIYYLDL

SEQ ID NO: 8171 - protein, 9 aa, Homo sapiens
  light chain complementarity determining region 3 for antibody 4086
QQYGSSTLT

SEQ ID NO: 8172 - protein, 17 aa, Homo sapiens
  heavy chain complementarity determining region 3 for antibody 4086
AKGRGSVAMALIYYLDL

SEQ ID NO: 8173 - protein, 8 aa, Homo sapiens
  light chain complementarity determining region 3 for antibody 4087
QQYGSSRR

SEQ ID NO: 8174 - protein, 18 aa, Homo sapiens
  heavy chain complementarity determining region 3 for antibody 4087
TRSYYDDNSASFLYGMDV

SEQ ID NO: 8175 - protein, 9 aa, Homo sapiens
  light chain complementarity determining region 3 for antibody 4088
QQYGSSPYT

SEQ ID NO: 8176 - protein, 19 aa, Homo sapiens
  heavy chain complementarity determining region 3 for antibody 4088
ARERVRCRSGICYDATFDI

SEQ ID NO: 8177 - protein, 9 aa, Homo sapiens
  light chain complementarity determining region 3 for antibody 4089
QQYGSSPWT

SEQ ID NO: 8178 - protein, 13 aa, Homo sapiens
  heavy chain complementarity determining region 3 for antibody 4089
AKEGSSPGPDFEY

SEQ ID NO: 8179 - protein, 9 aa, Homo sapiens
  light chain complementarity determining region 3 for antibody 4090
QQYGSSPWP

SEQ ID NO: 8180 - protein, 10 aa, Homo sapiens
  heavy chain complementarity determining region 3 for antibody 4090
ARERSGSYDI

SEQ ID NO: 8181 - protein, 9 aa, Homo sapiens
  light chain complementarity determining region 3 for antibody 4091
QQYGSSPRT

SEQ ID NO: 8182 - protein, 8 aa, Homo sapiens
  heavy chain complementarity determining region 3 for antibody 4091
LIMRSAGS

SEQ ID NO: 8183 - protein, 9 aa, Homo sapiens
  light chain complementarity determining region 3 for antibody 4092
QQYGSSPQT

SEQ ID NO: 8184 - protein, 9 aa, Homo sapiens
  heavy chain complementarity determining region 3 for antibody 4092
ARDRRYFDY

SEQ ID NO: 8185 - protein, 10 aa, Homo sapiens
  light chain complementarity determining region 3 for antibody 4093
QQYGSSPPYT

SEQ ID NO: 8186 - protein, 13 aa, Homo sapiens
  heavy chain complementarity determining region 3 for antibody 4093
AKEGSSPGPDFDY

SEQ ID NO: 8187 - protein, 10 aa, Homo sapiens
  light chain complementarity determining region 3 for antibody 4094
QQYGSSPPVT

SEQ ID NO: 8188 - protein, 19 aa, Homo sapiens
  heavy chain complementarity determining region 3 for antibody 4094
AREAVRCRDGVCYNAPFDI

SEQ ID NO: 8189 - protein, 11 aa, Homo sapiens
  light chain complementarity determining region 3 for antibody 4095
QQYGSSPPMST

SEQ ID NO: 8190 - protein, 13 aa, Homo sapiens
  heavy chain complementarity determining region 3 for antibody 4095
AKEGSAPGPDFEY

SEQ ID NO: 8191 - protein, 11 aa, Homo sapiens
  light chain complementarity determining region 3 for antibody 4096
QQYGSSPPLYT

SEQ ID NO: 8192 - protein, 13 aa, Homo sapiens
  heavy chain complementarity determining region 3 for antibody 4096
AKEGSAPGPDFEY

SEQ ID NO: 8193 - protein, 11 aa, Homo sapiens
  light chain complementarity determining region 3 for antibody 4097
QQYGSSPPAVT

SEQ ID NO: 8194 - protein, 16 aa, Homo sapiens
  heavy chain complementarity determining region 3 for antibody 4097
ARHGVLPAAIHDAFDI

SEQ ID NO: 8195 - protein, 10 aa, Homo sapiens
  light chain complementarity determining region 3 for antibody 4098
QQYGSSPLYT

SEQ ID NO: 8196 - protein, 11 aa, Homo sapiens
  heavy chain complementarity determining region 3 for antibody 4098
AREGALYAFDF

SEQ ID NO: 8197 - protein, 9 aa, Homo sapiens
  light chain complementarity determining region 3 for antibody 4099
QQYGSSPLT

SEQ ID NO: 8198 - protein, 11 aa, Homo sapiens
  heavy chain complementarity determining region 3 for antibody 4099
ARIVARKPDDY

SEQ ID NO: 8199 - protein, 9 aa, Homo sapiens
  light chain complementarity determining region 3 for antibody 4100
QQYGSSPGT

SEQ ID NO: 8200 - protein, 10 aa, Homo sapiens
  heavy chain complementarity determining region 3 for antibody 4100
ARAAYWAYDY

SEQ ID NO: 8201 - protein, 9 aa, Homo sapiens
  light chain complementarity determining region 3 for antibody 4101
QQYGSSALP

SEQ ID NO: 8202 - protein, 16 aa, Homo sapiens
  heavy chain complementarity determining region 3 for antibody 4101
ARHGVLPAAIHDAFDI

SEQ ID NO: 8203 - protein, 8 aa, Homo sapiens
  light chain complementarity determining region 3 for antibody 4102
QQYGRSVT

SEQ ID NO: 8204 - protein, 17 aa, Homo sapiens
  heavy chain complementarity determining region 3 for antibody 4102
ATDGLPVVVVGLTAPQY

SEQ ID NO: 8205 - protein, 9 aa, Homo sapiens
  light chain complementarity determining region 3 for antibody 4103
QQYGNSRRT

SEQ ID NO: 8206 - protein, 10 aa, Homo sapiens
  heavy chain complementarity determining region 3 for antibody 4103
TTEDWGSGRS

SEQ ID NO: 8207 - protein, 9 aa, Homo sapiens
  light chain complementarity determining region 3 for antibody 4104
QQYGNSPLA

SEQ ID NO: 8208 - protein, 18 aa, Homo sapiens
  heavy chain complementarity determining region 3 for antibody 4104
AGGDCPEARTGYYLDFDY

SEQ ID NO: 8209 - protein, 9 aa, Homo sapiens
  light chain complementarity determining region 3 for antibody 4105
QQYGNSLYT

SEQ ID NO: 8210 - protein, 13 aa, Homo sapiens
  heavy chain complementarity determining region 3 for antibody 4105
TWISSAAYLFLHS

SEQ ID NO: 8211 - protein, 9 aa, Homo sapiens
  light chain complementarity determining region 3 for antibody 4106
QQYGNPVYT

SEQ ID NO: 8212 - protein, 11 aa, Homo sapiens
  heavy chain complementarity determining region 3 for antibody 4106
AAVDSWGTLVH

SEQ ID NO: 8213 - protein, 9 aa, Homo sapiens
  light chain complementarity determining region 3 for antibody 4107
QQYGNPVYT

SEQ ID NO: 8214 - protein, 11 aa, Homo sapiens
  heavy chain complementarity determining region 3 for antibody 4107
AAVDSWGPLVY

SEQ ID NO: 8215 - protein, 10 aa, Homo sapiens
  light chain complementarity determining region 3 for antibody 4108
QQYGGSPPFT

SEQ ID NO: 8216 - protein, 14 aa, Homo sapiens
  heavy chain complementarity determining region 3 for antibody 4108
AKTTLSTTAWGMDV

SEQ ID NO: 8217 - protein, 11 aa, Homo sapiens
  light chain complementarity determining region 3 for antibody 4109
QQYGGSPPEGK

SEQ ID NO: 8218 - protein, 18 aa, Homo sapiens
  heavy chain complementarity determining region 3 for antibody 4109
AKDNRWYCSTTNCYLFDS

SEQ ID NO: 8219 - protein, 9 aa, Homo sapiens
  light chain complementarity determining region 3 for antibody 4110
QQYGGSPGT

SEQ ID NO: 8220 - protein, 13 aa, Homo sapiens
  heavy chain complementarity determining region 3 for antibody 4110
ARGTTATSWNIDY

SEQ ID NO: 8221 - protein, 9 aa, Homo sapiens
  light chain complementarity determining region 3 for antibody 4111
QQYGGSPFT

SEQ ID NO: 8222 - protein, 16 aa, Homo sapiens
  heavy chain complementarity determining region 3 for antibody 4111
TSRYCTSTSCHQYFQH

SEQ ID NO: 8223 - protein, 9 aa, Homo sapiens
  light chain complementarity determining region 3 for antibody 4112
QQYGGSLLN

SEQ ID NO: 8224 - protein, 10 aa, Homo sapiens
  heavy chain complementarity determining region 3 for antibody 4112
CRDRWGFGDV

SEQ ID NO: 8225 - protein, 9 aa, Homo sapiens
  light chain complementarity determining region 3 for antibody 4113
QQYGDSPVP

SEQ ID NO: 8226 - protein, 18 aa, Homo sapiens
  heavy chain complementarity determining region 3 for antibody 4113
ARGDYPEAGTGYFLDFDY

SEQ ID NO: 8227 - protein, 9 aa, Homo sapiens
  light chain complementarity determining region 3 for antibody 4114
QQYESYPWT

SEQ ID NO: 8228 - protein, 14 aa, Homo sapiens
  heavy chain complementarity determining region 3 for antibody 4114
ARERDSGYYRTVDY

SEQ ID NO: 8229 - protein, 10 aa, Homo sapiens
  light chain complementarity determining region 3 for antibody 4115
QQYDYSPPWT

SEQ ID NO: 8230 - protein, 14 aa, Homo sapiens
  heavy chain complementarity determining region 3 for antibody 4115
SPPTRAARLPIFDY

SEQ ID NO: 8231 - protein, 10 aa, Homo sapiens
  light chain complementarity determining region 3 for antibody 4116
QQYDYSPPRT

SEQ ID NO: 8232 - protein, 14 aa, Homo sapiens
  heavy chain complementarity determining region 3 for antibody 4116
SHPTKAARLPIFDY

SEQ ID NO: 8233 - protein, 10 aa, Homo sapiens
  light chain complementarity determining region 3 for antibody 4117
QQYDSLASLT

SEQ ID NO: 8234 - protein, 13 aa, Homo sapiens
  heavy chain complementarity determining region 3 for antibody 4117
AKEGSSPGPDFEY

SEQ ID NO: 8235 - protein, 9 aa, Homo sapiens
  light chain complementarity determining region 3 for antibody 4118
QQYDRYAHT

SEQ ID NO: 8236 - protein, 14 aa, Homo sapiens
  heavy chain complementarity determining region 3 for antibody 4118
ARYVHTTGWTLGGY

SEQ ID NO: 8237 - protein, 9 aa, Homo sapiens
  light chain complementarity determining region 3 for antibody 4119
QQYDRYAHT

SEQ ID NO: 8238 - protein, 14 aa, Homo sapiens
  heavy chain complementarity determining region 3 for antibody 4119
ARDVHATGWTLGGY

SEQ ID NO: 8239 - protein, 9 aa, Homo sapiens
  light chain complementarity determining region 3 for antibody 4120
QQYDNWPWT

SEQ ID NO: 8240 - protein, 17 aa, Homo sapiens
  heavy chain complementarity determining region 3 for antibody 4120
VTNYYHDSGIYHDFFNY

SEQ ID NO: 8241 - protein, 9 aa, Homo sapiens
  light chain complementarity determining region 3 for antibody 4121
QQYDNWPWT

SEQ ID NO: 8242 - protein, 17 aa, Homo sapiens
  heavy chain complementarity determining region 3 for antibody 4121
VTHYYHDSGIYHDFFDY

SEQ ID NO: 8243 - protein, 8 aa, Homo sapiens
  light chain complementarity determining region 3 for antibody 4122
QQYDNPLT

SEQ ID NO: 8244 - protein, 13 aa, Homo sapiens
  heavy chain complementarity determining region 3 for antibody 4122
ARPYGDYGWAFNI

SEQ ID NO: 8245 - protein, 8 aa, Homo sapiens
  light chain complementarity determining region 3 for antibody 4123
QQYDNLYT

SEQ ID NO: 8246 - protein, 23 aa, Homo sapiens
  heavy chain complementarity determining region 3 for antibody 4123
TTDPMVVPTPMGIDHDSWEAFDV

SEQ ID NO: 8247 - protein, 9 aa, Homo sapiens
  light chain complementarity determining region 3 for antibody 4124
QQYDNLPYT

SEQ ID NO: 8248 - protein, 14 aa, Homo sapiens
  heavy chain complementarity determining region 3 for antibody 4124
ARLHGSGLGRWLDP

SEQ ID NO: 8249 - protein, 9 aa, Homo sapiens
  light chain complementarity determining region 3 for antibody 4125
QQYDNLPPA

SEQ ID NO: 8250 - protein, 13 aa, Homo sapiens
  heavy chain complementarity determining region 3 for antibody 4125
TKEVSSAGPDFVY

SEQ ID NO: 8251 - protein, 9 aa, Homo sapiens
  light chain complementarity determining region 3 for antibody 4126
QQYDNLPPA

SEQ ID NO: 8252 - protein, 13 aa, Homo sapiens
  heavy chain complementarity determining region 3 for antibody 4126
TKEGSSAGPDFGY

SEQ ID NO: 8253 - protein, 9 aa, Homo sapiens
  light chain complementarity determining region 3 for antibody 4127
QQYDNLPPA

SEQ ID NO: 8254 - protein, 13 aa, Homo sapiens
  heavy chain complementarity determining region 3 for antibody 4127
TKEGSSAGPDFAY

SEQ ID NO: 8255 - protein, 9 aa, Homo sapiens
  light chain complementarity determining region 3 for antibody 4128
QQYDNLPPA

SEQ ID NO: 8256 - protein, 13 aa, Homo sapiens
  heavy chain complementarity determining region 3 for antibody 4128
SKEGSSAGPDFVY

SEQ ID NO: 8257 - protein, 9 aa, Homo sapiens
  light chain complementarity determining region 3 for antibody 4129
QQYDNLPPA

SEQ ID NO: 8258 - protein, 10 aa, Homo sapiens
  heavy chain complementarity determining region 3 for antibody 4129
ARERSGSYDI

SEQ ID NO: 8259 - protein, 9 aa, Homo sapiens
  light chain complementarity determining region 3 for antibody 4130
QQYDNLPLT

SEQ ID NO: 8260 - protein, 12 aa, Homo sapiens
  heavy chain complementarity determining region 3 for antibody 4130
AVVVPGRWDLDD

SEQ ID NO: 8261 - protein, 9 aa, Homo sapiens
  light chain complementarity determining region 3 for antibody 4131
QQYDNLPLT

SEQ ID NO: 8262 - protein, 15 aa, Homo sapiens
  heavy chain complementarity determining region 3 for antibody 4131
ARDRGDPQLYNWFDP

SEQ ID NO: 8263 - protein, 9 aa, Homo sapiens
  light chain complementarity determining region 3 for antibody 4132
QQYDNLPLT

SEQ ID NO: 8264 - protein, 18 aa, Homo sapiens
  heavy chain complementarity determining region 3 for antibody 4132
ARAPGDYDMLRRGYYFDH

SEQ ID NO: 8265 - protein, 9 aa, Homo sapiens
  light chain complementarity determining region 3 for antibody 4133
QQYDNLPLT

SEQ ID NO: 8266 - protein, 12 aa, Homo sapiens
  heavy chain complementarity determining region 3 for antibody 4133
AIVGPGRWDLDD

SEQ ID NO: 8267 - protein, 9 aa, Homo sapiens
  light chain complementarity determining region 3 for antibody 4134
QQYDNLPLT

SEQ ID NO: 8268 - protein, 12 aa, Homo sapiens
  heavy chain complementarity determining region 3 for antibody 4134
AIGVPGRWDLDD

SEQ ID NO: 8269 - protein, 9 aa, Homo sapiens
  light chain complementarity determining region 3 for antibody 4135
QQYDNLPHT

SEQ ID NO: 8270 - protein, 13 aa, Homo sapiens
  heavy chain complementarity determining region 3 for antibody 4135
AKEGSAPGPDFEY

SEQ ID NO: 8271 - protein, 9 aa, Homo sapiens
  light chain complementarity determining region 3 for antibody 4136
QQYDNLPFT

SEQ ID NO: 8272 - protein, 9 aa, Homo sapiens
  heavy chain complementarity determining region 3 for antibody 4136
ARSEYHPTY

SEQ ID NO: 8273 - protein, 8 aa, Homo sapiens
  light chain complementarity determining region 3 for antibody 4137
QQYDNLLT

SEQ ID NO: 8274 - protein, 13 aa, Homo sapiens
  heavy chain complementarity determining region 3 for antibody 4137
ARPYSDYGWAFNI

SEQ ID NO: 8275 - protein, 10 aa, Homo sapiens
  light chain complementarity determining region 3 for antibody 4138
QQYDNLASLT

SEQ ID NO: 8276 - protein, 17 aa, Homo sapiens
  heavy chain complementarity determining region 3 for antibody 4138
ARNTMVGTWQRQGNLDH

SEQ ID NO: 8277 - protein, 10 aa, Homo sapiens
  light chain complementarity determining region 3 for antibody 4139
QQYDNLASLT

SEQ ID NO: 8278 - protein, 10 aa, Homo sapiens
  heavy chain complementarity determining region 3 for antibody 4139
ARETSGSYDI

SEQ ID NO: 8279 - protein, 10 aa, Homo sapiens
  light chain complementarity determining region 3 for antibody 4140
QQYDNLASLT

SEQ ID NO: 8280 - protein, 17 aa, Homo sapiens
  heavy chain complementarity determining region 3 for antibody 4140
AKGRGSVAMALIYYLDL

SEQ ID NO: 8281 - protein, 10 aa, Homo sapiens
  light chain complementarity determining region 3 for antibody 4141
QQYDNLASLT

SEQ ID NO: 8282 - protein, 13 aa, Homo sapiens
  heavy chain complementarity determining region 3 for antibody 4141
AKGGSSPGPDFEY

SEQ ID NO: 8283 - protein, 10 aa, Homo sapiens
  light chain complementarity determining region 3 for antibody 4142
QQYDNLASLT

SEQ ID NO: 8284 - protein, 13 aa, Homo sapiens
  heavy chain complementarity determining region 3 for antibody 4142
AKERSSPGPDFEY

SEQ ID NO: 8285 - protein, 10 aa, Homo sapiens
  light chain complementarity determining region 3 for antibody 4143
QQYDNLASLT

SEQ ID NO: 8286 - protein, 13 aa, Homo sapiens
  heavy chain complementarity determining region 3 for antibody 4143
AKEGSSPGPDSEY

SEQ ID NO: 8287 - protein, 10 aa, Homo sapiens
  light chain complementarity determining region 3 for antibody 4144
QQYDNLASLT

SEQ ID NO: 8288 - protein, 13 aa, Homo sapiens
  heavy chain complementarity determining region 3 for antibody 4144
AKEGSSPGPDFES

SEQ ID NO: 8289 - protein, 10 aa, Homo sapiens
  light chain complementarity determining region 3 for antibody 4145
QQYDNLASLT

SEQ ID NO: 8290 - protein, 13 aa, Homo sapiens
  heavy chain complementarity determining region 3 for antibody 4145
AEEGSSPGPDFEY

SEQ ID NO: 8291 - protein, 10 aa, Homo sapiens
  light chain complementarity determining region 3 for antibody 4146
QQYDNLASLA

SEQ ID NO: 8292 - protein, 13 aa, Homo sapiens
  heavy chain complementarity determining region 3 for antibody 4146
AKEGSSPGPDFEY

SEQ ID NO: 8293 - protein, 8 aa, Homo sapiens
  light chain complementarity determining region 3 for antibody 4147
QQYDNARP

SEQ ID NO: 8294 - protein, 9 aa, Homo sapiens
  heavy chain complementarity determining region 3 for antibody 4147
ARSEYQPTY

SEQ ID NO: 8295 - protein, 10 aa, Homo sapiens
  light chain complementarity determining region 3 for antibody 4148
QQYDISPPWT

SEQ ID NO: 8296 - protein, 16 aa, Homo sapiens
  heavy chain complementarity determining region 3 for antibody 4148
ASPNALGRLVGVAFDY

SEQ ID NO: 8297 - protein, 10 aa, Homo sapiens
  light chain complementarity determining region 3 for antibody 4149
QQYDISPPCT

SEQ ID NO: 8298 - protein, 16 aa, Homo sapiens
  heavy chain complementarity determining region 3 for antibody 4149
ASPNTLGRLVGVAFDY

SEQ ID NO: 8299 - protein, 9 aa, Homo sapiens
  light chain complementarity determining region 3 for antibody 4150
QQYDHYAHT

SEQ ID NO: 8300 - protein, 14 aa, Homo sapiens
  heavy chain complementarity determining region 3 for antibody 4150
ARDVHTTGWTVGGY

SEQ ID NO: 8301 - protein, 9 aa, Homo sapiens
  light chain complementarity determining region 3 for antibody 4151
QQYATSPPT

SEQ ID NO: 8302 - protein, 14 aa, Homo sapiens
  heavy chain complementarity determining region 3 for antibody 4151
ARASGGDTDFLIDF

SEQ ID NO: 8303 - protein, 9 aa, Homo sapiens
  light chain complementarity determining region 3 for antibody 4152
QQYATSPLT

SEQ ID NO: 8304 - protein, 10 aa, Homo sapiens
  heavy chain complementarity determining region 3 for antibody 4152
TGSRGWLMDV

SEQ ID NO: 8305 - protein, 9 aa, Homo sapiens
  light chain complementarity determining region 3 for antibody 4153
QQYAPDSYT

SEQ ID NO: 8306 - protein, 16 aa, Homo sapiens
  heavy chain complementarity determining region 3 for antibody 4153
ARDHCTTIKCPDAFDI

SEQ ID NO: 8307 - protein, 10 aa, Homo sapiens
  light chain complementarity determining region 3 for antibody 4154
QQYAISPPWT

SEQ ID NO: 8308 - protein, 16 aa, Homo sapiens
  heavy chain complementarity determining region 3 for antibody 4154
ASPNTLGRLVGVAFDY

SEQ ID NO: 8309 - protein, 9 aa, Homo sapiens
  light chain complementarity determining region 3 for antibody 4155
QQVYYTPRT

SEQ ID NO: 8310 - protein, 11 aa, Homo sapiens
  heavy chain complementarity determining region 3 for antibody 4155
ARRSLGGAFDY

SEQ ID NO: 8311 - protein, 9 aa, Homo sapiens
  light chain complementarity determining region 3 for antibody 4156
QQTYSSQWT

SEQ ID NO: 8312 - protein, 15 aa, Homo sapiens
  heavy chain complementarity determining region 3 for antibody 4156
ARIWTSSTNCRYMDV

SEQ ID NO: 8313 - protein, 9 aa, Homo sapiens
  light chain complementarity determining region 3 for antibody 4157
QQTYSSPWT

SEQ ID NO: 8314 - protein, 11 aa, Homo sapiens
  heavy chain complementarity determining region 3 for antibody 4157
TRGGYSVGCDY

SEQ ID NO: 8315 - protein, 9 aa, Homo sapiens
  light chain complementarity determining region 3 for antibody 4158
QQTYSSPWT

SEQ ID NO: 8316 - protein, 15 aa, Homo sapiens
  heavy chain complementarity determining region 3 for antibody 4158
AWIWTSSTNCRYMDV

SEQ ID NO: 8317 - protein, 9 aa, Homo sapiens
  light chain complementarity determining region 3 for antibody 4159
QQTYSSPWT

SEQ ID NO: 8318 - protein, 17 aa, Homo sapiens
  heavy chain complementarity determining region 3 for antibody 4159
ARNTMVGTWQRQGNLDH

SEQ ID NO: 8319 - protein, 9 aa, Homo sapiens
  light chain complementarity determining region 3 for antibody 4160
QQTYSSPWT

SEQ ID NO: 8320 - protein, 15 aa, Homo sapiens
  heavy chain complementarity determining region 3 for antibody 4160
ARIWTSSTNCRHMDV

SEQ ID NO: 8321 - protein, 9 aa, Homo sapiens
  light chain complementarity determining region 3 for antibody 4161
QQTYSSPWT

SEQ ID NO: 8322 - protein, 15 aa, Homo sapiens
  heavy chain complementarity determining region 3 for antibody 4161
ARIWTSSTNCRCMDV

SEQ ID NO: 8323 - protein, 9 aa, Homo sapiens
  light chain complementarity determining region 3 for antibody 4162
QQTYSSPWT

SEQ ID NO: 8324 - protein, 15 aa, Homo sapiens
  heavy chain complementarity determining region 3 for antibody 4162
ARIWTSSSNCRYMDV

SEQ ID NO: 8325 - protein, 9 aa, Homo sapiens
  light chain complementarity determining region 3 for antibody 4163
QQTYSSPWT

SEQ ID NO: 8326 - protein, 15 aa, Homo sapiens
  heavy chain complementarity determining region 3 for antibody 4163
ARIWPSSTTCRYMDV

SEQ ID NO: 8327 - protein, 9 aa, Homo sapiens
  light chain complementarity determining region 3 for antibody 4164
QQTYSSPWT

SEQ ID NO: 8328 - protein, 15 aa, Homo sapiens
  heavy chain complementarity determining region 3 for antibody 4164
ARFWTSSTNCRYMDV

SEQ ID NO: 8329 - protein, 9 aa, Homo sapiens
  light chain complementarity determining region 3 for antibody 4165
QQTYSSPWT

SEQ ID NO: 8330 - protein, 12 aa, Homo sapiens
  heavy chain complementarity determining region 3 for antibody 4165
ARDKGGRNGMDV

SEQ ID NO: 8331 - protein, 9 aa, Homo sapiens
  light chain complementarity determining region 3 for antibody 4166
QQTYSSPWT

SEQ ID NO: 8332 - protein, 10 aa, Homo sapiens
  heavy chain complementarity determining region 3 for antibody 4166
AGGIGWTEQY

SEQ ID NO: 8333 - protein, 9 aa, Homo sapiens
  light chain complementarity determining region 3 for antibody 4167
QQTYSSPLT

SEQ ID NO: 8334 - protein, 15 aa, Homo sapiens
  heavy chain complementarity determining region 3 for antibody 4167
ARIWTSSTNCRYMDV

SEQ ID NO: 8335 - protein, 10 aa, Homo sapiens
  light chain complementarity determining region 3 for antibody 4168
QQTYSHLPLT

SEQ ID NO: 8336 - protein, 13 aa, Homo sapiens
  heavy chain complementarity determining region 3 for antibody 4168
MRVFRGASYPSDI

SEQ ID NO: 8337 - protein, 9 aa, Homo sapiens
  light chain complementarity determining region 3 for antibody 4169
QQTYRTPYT

SEQ ID NO: 8338 - protein, 14 aa, Homo sapiens
  heavy chain complementarity determining region 3 for antibody 4169
ARVHGSGLGRWLDP

SEQ ID NO: 8339 - protein, 9 aa, Homo sapiens
  light chain complementarity determining region 3 for antibody 4170
QQTYRTPYT

SEQ ID NO: 8340 - protein, 9 aa, Homo sapiens
  heavy chain complementarity determining region 3 for antibody 4170
ARSEYQPTY

SEQ ID NO: 8341 - protein, 9 aa, Homo sapiens
  light chain complementarity determining region 3 for antibody 4171
QQTYRTPYT

SEQ ID NO: 8342 - protein, 14 aa, Homo sapiens
  heavy chain complementarity determining region 3 for antibody 4171
ARPHGSGLGRWLDP

SEQ ID NO: 8343 - protein, 9 aa, Homo sapiens
  light chain complementarity determining region 3 for antibody 4172
QQTYRTPYT

SEQ ID NO: 8344 - protein, 13 aa, Homo sapiens
  heavy chain complementarity determining region 3 for antibody 4172
AKEGSSPGPDFEY

SEQ ID NO: 8345 - protein, 9 aa, Homo sapiens
  light chain complementarity determining region 3 for antibody 4173
QQTYRSPWT

SEQ ID NO: 8346 - protein, 15 aa, Homo sapiens
  heavy chain complementarity determining region 3 for antibody 4173
ARIWTSSTNCRYMDV

SEQ ID NO: 8347 - protein, 9 aa, Homo sapiens
  light chain complementarity determining region 3 for antibody 4174
QQTYRIPYT

SEQ ID NO: 8348 - protein, 14 aa, Homo sapiens
  heavy chain complementarity determining region 3 for antibody 4174
ARLHGSGLGRWLDP

SEQ ID NO: 8349 - protein, 9 aa, Homo sapiens
  light chain complementarity determining region 3 for antibody 4175
QQTCRTPYT

SEQ ID NO: 8350 - protein, 14 aa, Homo sapiens
  heavy chain complementarity determining region 3 for antibody 4175
ARLHGSGLGRWLDP

SEQ ID NO: 8351 - protein, 9 aa, Homo sapiens
  light chain complementarity determining region 3 for antibody 4176
QQSYTTPYT

SEQ ID NO: 8352 - protein, 13 aa, Homo sapiens
  heavy chain complementarity determining region 3 for antibody 4176
AKEGSAPGPDLEY

SEQ ID NO: 8353 - protein, 9 aa, Homo sapiens
  light chain complementarity determining region 3 for antibody 4177
QQSYTTPYT

SEQ ID NO: 8354 - protein, 13 aa, Homo sapiens
  heavy chain complementarity determining region 3 for antibody 4177
AKEGSAPGPDFDY

SEQ ID NO: 8355 - protein, 9 aa, Homo sapiens
  light chain complementarity determining region 3 for antibody 4178
QQSYTTPYT

SEQ ID NO: 8356 - protein, 13 aa, Homo sapiens
  heavy chain complementarity determining region 3 for antibody 4178
AKEGSAPGPDCEY

SEQ ID NO: 8357 - protein, 9 aa, Homo sapiens
  light chain complementarity determining region 3 for antibody 4179
QQSYTTPYT

SEQ ID NO: 8358 - protein, 13 aa, Homo sapiens
  heavy chain complementarity determining region 3 for antibody 4179
AKEGSAPGPAFEY

SEQ ID NO: 8359 - protein, 8 aa, Homo sapiens
  light chain complementarity determining region 3 for antibody 4180
QQSYTTPT

SEQ ID NO: 8360 - protein, 12 aa, Homo sapiens
  heavy chain complementarity determining region 3 for antibody 4180
ARLEWNYRAFDI

SEQ ID NO: 8361 - protein, 8 aa, Homo sapiens
  light chain complementarity determining region 3 for antibody 4181
QQSYTTPT

SEQ ID NO: 8362 - protein, 12 aa, Homo sapiens
  heavy chain complementarity determining region 3 for antibody 4181
ARLDWNYGAFDI

SEQ ID NO: 8363 - protein, 8 aa, Homo sapiens
  light chain complementarity determining region 3 for antibody 4182
QQSYTTPT

SEQ ID NO: 8364 - protein, 26 aa, Homo sapiens
  heavy chain complementarity determining region 3 for antibody 4182
ARDLPKGGSYSSGWYGSVGGNYYMDV

SEQ ID NO: 8365 - protein, 8 aa, Homo sapiens
  light chain complementarity determining region 3 for antibody 4183
QQSYTTPT

SEQ ID NO: 8366 - protein, 26 aa, Homo sapiens
  heavy chain complementarity determining region 3 for antibody 4183
ARDLPKGGSYSSGWYGSVGGKYYMDV

SEQ ID NO: 8367 - protein, 8 aa, Homo sapiens
  light chain complementarity determining region 3 for antibody 4184
QQSYTTPT

SEQ ID NO: 8368 - protein, 12 aa, Homo sapiens
  heavy chain complementarity determining region 3 for antibody 4184
ARDKGGRNGMDV

SEQ ID NO: 8369 - protein, 8 aa, Homo sapiens
  light chain complementarity determining region 3 for antibody 4185
QQSYTTPT

SEQ ID NO: 8370 - protein, 26 aa, Homo sapiens
  heavy chain complementarity determining region 3 for antibody 4185
AGDFPKGGSYSSGWYGSVGGNYYMDV

SEQ ID NO: 8371 - protein, 9 aa, Homo sapiens
  light chain complementarity determining region 3 for antibody 4186
QQSYTMPRT

SEQ ID NO: 8372 - protein, 18 aa, Homo sapiens
  heavy chain complementarity determining region 3 for antibody 4186
TTVLSQLLAGDWPLYFQH

SEQ ID NO: 8373 - protein, 9 aa, Homo sapiens
  light chain complementarity determining region 3 for antibody 4187
QQSYTMPRT

SEQ ID NO: 8374 - protein, 18 aa, Homo sapiens
  heavy chain complementarity determining region 3 for antibody 4187
TTVLSQLLAGDWHPYFQH

SEQ ID NO: 8375 - protein, 9 aa, Homo sapiens
  light chain complementarity determining region 3 for antibody 4188
QQSYTMPRT

SEQ ID NO: 8376 - protein, 18 aa, Homo sapiens
  heavy chain complementarity determining region 3 for antibody 4188
TTVLSQLLAGDWHLCFQH

SEQ ID NO: 8377 - protein, 9 aa, Homo sapiens
  light chain complementarity determining region 3 for antibody 4189
QQSYTMPRT

SEQ ID NO: 8378 - protein, 18 aa, Homo sapiens
  heavy chain complementarity determining region 3 for antibody 4189
TTVLSQLLAGDCHLYFQH

SEQ ID NO: 8379 - protein, 9 aa, Homo sapiens
  light chain complementarity determining region 3 for antibody 4190
QQSYTMPRT

SEQ ID NO: 8380 - protein, 18 aa, Homo sapiens
  heavy chain complementarity determining region 3 for antibody 4190
TTGLSQLLAGDWHLYFQH

SEQ ID NO: 8381 - protein, 8 aa, Homo sapiens
  light chain complementarity determining region 3 for antibody 4191
QQSYTKAT

SEQ ID NO: 8382 - protein, 12 aa, Homo sapiens
  heavy chain complementarity determining region 3 for antibody 4191
ASVVPGRWDLDD

SEQ ID NO: 8383 - protein, 8 aa, Homo sapiens
  light chain complementarity determining region 3 for antibody 4192
QQSYTKAT

SEQ ID NO: 8384 - protein, 12 aa, Homo sapiens
  heavy chain complementarity determining region 3 for antibody 4192
AIVVPGRWDFDD

SEQ ID NO: 8385 - protein, 8 aa, Homo sapiens
  light chain complementarity determining region 3 for antibody 4193
QQSYTKAT

SEQ ID NO: 8386 - protein, 12 aa, Homo sapiens
  heavy chain complementarity determining region 3 for antibody 4193
AIVGPGRWDLDD

SEQ ID NO: 8387 - protein, 9 aa, Homo sapiens
  light chain complementarity determining region 3 for antibody 4194
QQSYSTPYT

SEQ ID NO: 8388 - protein, 10 aa, Homo sapiens
  heavy chain complementarity determining region 3 for antibody 4194
ARGGLAGDND

SEQ ID NO: 8389 - protein, 9 aa, Homo sapiens
  light chain complementarity determining region 3 for antibody 4195
QQSYSTPYT

SEQ ID NO: 8390 - protein, 13 aa, Homo sapiens
  heavy chain complementarity determining region 3 for antibody 4195
AKEGSSPGPDFEY

SEQ ID NO: 8391 - protein, 9 aa, Homo sapiens
  light chain complementarity determining region 3 for antibody 4196
QQSYSTPYT

SEQ ID NO: 8392 - protein, 13 aa, Homo sapiens
  heavy chain complementarity determining region 3 for antibody 4196
AKEGASAGPDFDY

SEQ ID NO: 8393 - protein, 9 aa, Homo sapiens
  light chain complementarity determining region 3 for antibody 4197
QQSYSTPWT

SEQ ID NO: 8394 - protein, 15 aa, Homo sapiens
  heavy chain complementarity determining region 3 for antibody 4197
VRRLVFAVITVDVAP

SEQ ID NO: 8395 - protein, 9 aa, Homo sapiens
  light chain complementarity determining region 3 for antibody 4198
QQSYSTPWT

SEQ ID NO: 8396 - protein, 15 aa, Homo sapiens
  heavy chain complementarity determining region 3 for antibody 4198
ARIWTSSPNCRYMDV

SEQ ID NO: 8397 - protein, 9 aa, Homo sapiens
  light chain complementarity determining region 3 for antibody 4199
QQSYSTPST

SEQ ID NO: 8398 - protein, 10 aa, Homo sapiens
  heavy chain complementarity determining region 3 for antibody 4199
CRDRWGFGDV

SEQ ID NO: 8399 - protein, 9 aa, Homo sapiens
  light chain complementarity determining region 3 for antibody 4200
QQSYSTPST

SEQ ID NO: 8400 - protein, 16 aa, Homo sapiens
  heavy chain complementarity determining region 3 for antibody 4200
ARWFSRSSTGVAYMDV

SEQ ID NO: 8401 - protein, 9 aa, Homo sapiens
  light chain complementarity determining region 3 for antibody 4201
QQSYSTPST

SEQ ID NO: 8402 - protein, 16 aa, Homo sapiens
  heavy chain complementarity determining region 3 for antibody 4201
ARWFSRSSAGVSYMDV

SEQ ID NO: 8403 - protein, 9 aa, Homo sapiens
  light chain complementarity determining region 3 for antibody 4202
QQSYSTPST

SEQ ID NO: 8404 - protein, 16 aa, Homo sapiens
  heavy chain complementarity determining region 3 for antibody 4202
ARWCSRSSTGVSYMDV

SEQ ID NO: 8405 - protein, 9 aa, Homo sapiens
  light chain complementarity determining region 3 for antibody 4203
QQSYSTPST

SEQ ID NO: 8406 - protein, 9 aa, Homo sapiens
  heavy chain complementarity determining region 3 for antibody 4203
ARSEYQPTY

SEQ ID NO: 8407 - protein, 9 aa, Homo sapiens
  light chain complementarity determining region 3 for antibody 4204
QQSYSTPST

SEQ ID NO: 8408 - protein, 14 aa, Homo sapiens
  heavy chain complementarity determining region 3 for antibody 4204
ARGHFDSTGFRLDY

SEQ ID NO: 8409 - protein, 9 aa, Homo sapiens
  light chain complementarity determining region 3 for antibody 4205
QQSYSTPST

SEQ ID NO: 8410 - protein, 13 aa, Homo sapiens
  heavy chain complementarity determining region 3 for antibody 4205
AKEGSSPGPDFEY

SEQ ID NO: 8411 - protein, 9 aa, Homo sapiens
  light chain complementarity determining region 3 for antibody 4206
QQSYSTPSI

SEQ ID NO: 8412 - protein, 16 aa, Homo sapiens
  heavy chain complementarity determining region 3 for antibody 4206
ARWFSRSSTGVSYMDV

SEQ ID NO: 8413 - protein, 9 aa, Homo sapiens
  light chain complementarity determining region 3 for antibody 4207
QQSYSTPSA

SEQ ID NO: 8414 - protein, 16 aa, Homo sapiens
  heavy chain complementarity determining region 3 for antibody 4207
ARWFSRSSTGVSYMDV

SEQ ID NO: 8415 - protein, 9 aa, Homo sapiens
  light chain complementarity determining region 3 for antibody 4208
QQSYSTPRT

SEQ ID NO: 8416 - protein, 16 aa, Homo sapiens
  heavy chain complementarity determining region 3 for antibody 4208
ARSYGRSNTKVWYFDL

SEQ ID NO: 8417 - protein, 9 aa, Homo sapiens
  light chain complementarity determining region 3 for antibody 4209
QQSYSTPRT

SEQ ID NO: 8418 - protein, 16 aa, Homo sapiens
  heavy chain complementarity determining region 3 for antibody 4209
ARSYDRSNTKIWYFDL

SEQ ID NO: 8419 - protein, 9 aa, Homo sapiens
  light chain complementarity determining region 3 for antibody 4210
QQSYSTPRT

SEQ ID NO: 8420 - protein, 16 aa, Homo sapiens
  heavy chain complementarity determining region 3 for antibody 4210
ARSYDRSNAKVWYFDL

SEQ ID NO: 8421 - protein, 9 aa, Homo sapiens
  light chain complementarity determining region 3 for antibody 4211
QQSYSTPRT

SEQ ID NO: 8422 - protein, 11 aa, Homo sapiens
  heavy chain complementarity determining region 3 for antibody 4211
AREHHGQAPDY

SEQ ID NO: 8423 - protein, 9 aa, Homo sapiens
  light chain complementarity determining region 3 for antibody 4212
QQSYSTPRT

SEQ ID NO: 8424 - protein, 20 aa, Homo sapiens
  heavy chain complementarity determining region 3 for antibody 4212
ARDFPRGGSVRPRANYYFDV

SEQ ID NO: 8425 - protein, 9 aa, Homo sapiens
  light chain complementarity determining region 3 for antibody 4213
QQSYSTPRP

SEQ ID NO: 8426 - protein, 16 aa, Homo sapiens
  heavy chain complementarity determining region 3 for antibody 4213
ARSYDRSNTKVWYFDL

SEQ ID NO: 8427 - protein, 9 aa, Homo sapiens
  light chain complementarity determining region 3 for antibody 4214
QQSYSTPPT

SEQ ID NO: 8428 - protein, 16 aa, Homo sapiens
  heavy chain complementarity determining region 3 for antibody 4214
ARWFSRSSTGVSYMDV

SEQ ID NO: 8429 - protein, 9 aa, Homo sapiens
  light chain complementarity determining region 3 for antibody 4215
QQSYSTPLT

SEQ ID NO: 8430 - protein, 13 aa, Homo sapiens
  heavy chain complementarity determining region 3 for antibody 4215
AKEGSSAGPDFDD

SEQ ID NO: 8431 - protein, 10 aa, Homo sapiens
  light chain complementarity determining region 3 for antibody 4216
QQSYSTPLLT

SEQ ID NO: 8432 - protein, 23 aa, Homo sapiens
  heavy chain complementarity determining region 3 for antibody 4216
ARHFPKGGSTVTGTQSLLYYMDV

SEQ ID NO: 8433 - protein, 10 aa, Homo sapiens
  light chain complementarity determining region 3 for antibody 4217
QQSYSTPLFT

SEQ ID NO: 8434 - protein, 10 aa, Homo sapiens
  heavy chain complementarity determining region 3 for antibody 4217
CRDREGFGDV

SEQ ID NO: 8435 - protein, 10 aa, Homo sapiens
  light chain complementarity determining region 3 for antibody 4218
QQSYSTPLFT

SEQ ID NO: 8436 - protein, 15 aa, Homo sapiens
  heavy chain complementarity determining region 3 for antibody 4218
ARVGRPYHNAWYFDI

SEQ ID NO: 8437 - protein, 10 aa, Homo sapiens
  light chain complementarity determining region 3 for antibody 4219
QQSYSTPLFT

SEQ ID NO: 8438 - protein, 15 aa, Homo sapiens
  heavy chain complementarity determining region 3 for antibody 4219
ARVGRPYHNAWYFDD

SEQ ID NO: 8439 - protein, 10 aa, Homo sapiens
  light chain complementarity determining region 3 for antibody 4220
QQSYSTPLFT

SEQ ID NO: 8440 - protein, 15 aa, Homo sapiens
  heavy chain complementarity determining region 3 for antibody 4220
ARVCRPYHNAWYFDN

SEQ ID NO: 8441 - protein, 10 aa, Homo sapiens
  light chain complementarity determining region 3 for antibody 4221
QQSYSTPLFT

SEQ ID NO: 8442 - protein, 12 aa, Homo sapiens
  heavy chain complementarity determining region 3 for antibody 4221
ARLDWNYRAFDI

SEQ ID NO: 8443 - protein, 10 aa, Homo sapiens
  light chain complementarity determining region 3 for antibody 4222
QQSYSTPLFT

SEQ ID NO: 8444 - protein, 23 aa, Homo sapiens
  heavy chain complementarity determining region 3 for antibody 4222
ARHVPMGGSTVTGTQSLLYYMDV

SEQ ID NO: 8445 - protein, 10 aa, Homo sapiens
  light chain complementarity determining region 3 for antibody 4223
QQSYSTPLFT

SEQ ID NO: 8446 - protein, 23 aa, Homo sapiens
  heavy chain complementarity determining region 3 for antibody 4223
ARHFPMGGSTVTGTQSLLYYMGV

SEQ ID NO: 8447 - protein, 10 aa, Homo sapiens
  light chain complementarity determining region 3 for antibody 4224
QQSYSTPLFT

SEQ ID NO: 8448 - protein, 15 aa, Homo sapiens
  heavy chain complementarity determining region 3 for antibody 4224
AKVGRPYHNAWYFDN

SEQ ID NO: 8449 - protein, 10 aa, Homo sapiens
  light chain complementarity determining region 3 for antibody 4225
QQSYSTPLFP

SEQ ID NO: 8450 - protein, 15 aa, Homo sapiens
  heavy chain complementarity determining region 3 for antibody 4225
ARVGRPYHNAWYFDN

SEQ ID NO: 8451 - protein, 9 aa, Homo sapiens
  light chain complementarity determining region 3 for antibody 4226
QQSYSTPIT

SEQ ID NO: 8452 - protein, 17 aa, Homo sapiens
  heavy chain complementarity determining region 3 for antibody 4226
ARSTMVGTWQRQGNLDH

SEQ ID NO: 8453 - protein, 9 aa, Homo sapiens
  light chain complementarity determining region 3 for antibody 4227
QQSYSTPFT

SEQ ID NO: 8454 - protein, 16 aa, Homo sapiens
  heavy chain complementarity determining region 3 for antibody 4227
ARWFSRSSTGVSYMDV

SEQ ID NO: 8455 - protein, 7 aa, Homo sapiens
  light chain complementarity determining region 3 for antibody 4228
QQSYSTP

SEQ ID NO: 8456 - protein, 20 aa, Homo sapiens
  heavy chain complementarity determining region 3 for antibody 4228
ARDVLYCSGGSCGRGGTFDI

SEQ ID NO: 8457 - protein, 10 aa, Homo sapiens
  light chain complementarity determining region 3 for antibody 4229
QQSYSTLPST

SEQ ID NO: 8458 - protein, 18 aa, Homo sapiens
  heavy chain complementarity determining region 3 for antibody 4229
ARGVVVPVATPVPYFFDF

SEQ ID NO: 8459 - protein, 8 aa, Homo sapiens
  light chain complementarity determining region 3 for antibody 4230
QQSYSSPT

SEQ ID NO: 8460 - protein, 12 aa, Homo sapiens
  heavy chain complementarity determining region 3 for antibody 4230
AIVVPGRWDLDD

SEQ ID NO: 8461 - protein, 9 aa, Homo sapiens
  light chain complementarity determining region 3 for antibody 4231
QQSYSSPRT

SEQ ID NO: 8462 - protein, 12 aa, Homo sapiens
  heavy chain complementarity determining region 3 for antibody 4231
NADHGYVDGFDT

SEQ ID NO: 8463 - protein, 9 aa, Homo sapiens
  light chain complementarity determining region 3 for antibody 4232
QQSYSSPRT

SEQ ID NO: 8464 - protein, 16 aa, Homo sapiens
  heavy chain complementarity determining region 3 for antibody 4232
ARDFSYSSTSGWYFDV

SEQ ID NO: 8465 - protein, 9 aa, Homo sapiens
  light chain complementarity determining region 3 for antibody 4233
QQSYSSPFT

SEQ ID NO: 8466 - protein, 20 aa, Homo sapiens
  heavy chain complementarity determining region 3 for antibody 4233
ARRQAEVRYNPRHHHYFLDV

SEQ ID NO: 8467 - protein, 9 aa, Homo sapiens
  light chain complementarity determining region 3 for antibody 4234
QQSYSSPFT

SEQ ID NO: 8468 - protein, 20 aa, Homo sapiens
  heavy chain complementarity determining region 3 for antibody 4234
ARRQAEVAYNPRHHHYFLDV

SEQ ID NO: 8469 - protein, 10 aa, Homo sapiens
  light chain complementarity determining region 3 for antibody 4235
QQSYSNPLFT

SEQ ID NO: 8470 - protein, 23 aa, Homo sapiens
  heavy chain complementarity determining region 3 for antibody 4235
ARHFPMGGSTVTGTQSLLYYMDV

SEQ ID NO: 8471 - protein, 9 aa, Homo sapiens
  light chain complementarity determining region 3 for antibody 4236
QQSYSMPRT

SEQ ID NO: 8472 - protein, 18 aa, Homo sapiens
  heavy chain complementarity determining region 3 for antibody 4236
VTVLSLFLSGDWRLYFHH

SEQ ID NO: 8473 - protein, 9 aa, Homo sapiens
  light chain complementarity determining region 3 for antibody 4237
QQSYRTPWT

SEQ ID NO: 8474 - protein, 11 aa, Homo sapiens
  heavy chain complementarity determining region 3 for antibody 4237
AREHSYGYPDL

SEQ ID NO: 8475 - protein, 9 aa, Homo sapiens
  light chain complementarity determining region 3 for antibody 4238
QQSYNWPRT

SEQ ID NO: 8476 - protein, 14 aa, Homo sapiens
  heavy chain complementarity determining region 3 for antibody 4238
ATAPGFWSSAPFDY

SEQ ID NO: 8477 - protein, 9 aa, Homo sapiens
  light chain complementarity determining region 3 for antibody 4239
QQSYNTPLT

SEQ ID NO: 8478 - protein, 11 aa, Homo sapiens
  heavy chain complementarity determining region 3 for antibody 4239
ARGGTLAWFDP

SEQ ID NO: 8479 - protein, 9 aa, Homo sapiens
  light chain complementarity determining region 3 for antibody 4240
QQSYNSHPP

SEQ ID NO: 8480 - protein, 19 aa, Homo sapiens
  heavy chain complementarity determining region 3 for antibody 4240
AHTKYFYDSTGYYYADFDY

SEQ ID NO: 8481 - protein, 9 aa, Homo sapiens
  light chain complementarity determining region 3 for antibody 4241
QQSYNPPRA

SEQ ID NO: 8482 - protein, 11 aa, Homo sapiens
  heavy chain complementarity determining region 3 for antibody 4241
ARDRADDYFDS

SEQ ID NO: 8483 - protein, 9 aa, Homo sapiens
  light chain complementarity determining region 3 for antibody 4242
QQSYNIPFT

SEQ ID NO: 8484 - protein, 14 aa, Homo sapiens
  heavy chain complementarity determining region 3 for antibody 4242
AKGRIASCYDASDI

SEQ ID NO: 8485 - protein, 9 aa, Homo sapiens
  light chain complementarity determining region 3 for antibody 4243
QQSYNIPFA

SEQ ID NO: 8486 - protein, 14 aa, Homo sapiens
  heavy chain complementarity determining region 3 for antibody 4243
VKGRIASCYSEADY

SEQ ID NO: 8487 - protein, 10 aa, Homo sapiens
  light chain complementarity determining region 3 for antibody 4244
QQSYGTPLFT

SEQ ID NO: 8488 - protein, 15 aa, Homo sapiens
  heavy chain complementarity determining region 3 for antibody 4244
ARVGRPYHNAWYFDN

SEQ ID NO: 8489 - protein, 10 aa, Homo sapiens
  light chain complementarity determining region 3 for antibody 4245
QQSYGNPPYT

SEQ ID NO: 8490 - protein, 20 aa, Homo sapiens
  heavy chain complementarity determining region 3 for antibody 4245
ARARSSGPGLYYDILTAFDC

SEQ ID NO: 8491 - protein, 9 aa, Homo sapiens
  light chain complementarity determining region 3 for antibody 4246
QQSSSTPLT

SEQ ID NO: 8492 - protein, 16 aa, Homo sapiens
  heavy chain complementarity determining region 3 for antibody 4246
VRDLAGFTRGGSTFDY

SEQ ID NO: 8493 - protein, 9 aa, Homo sapiens
  light chain complementarity determining region 3 for antibody 4247
QQSSNTPLT

SEQ ID NO: 8494 - protein, 16 aa, Homo sapiens
  heavy chain complementarity determining region 3 for antibody 4247
VRDSAGFTRGGSTFDY

SEQ ID NO: 8495 - protein, 9 aa, Homo sapiens
  light chain complementarity determining region 3 for antibody 4248
QQSSNTPLT

SEQ ID NO: 8496 - protein, 16 aa, Homo sapiens
  heavy chain complementarity determining region 3 for antibody 4248
VRDLAGFTRGGSTFDS

SEQ ID NO: 8497 - protein, 9 aa, Homo sapiens
  light chain complementarity determining region 3 for antibody 4249
QQSSNTPLT

SEQ ID NO: 8498 - protein, 13 aa, Homo sapiens
  heavy chain complementarity determining region 3 for antibody 4249
AKEGSAPGPDFEY

SEQ ID NO: 8499 - protein, 9 aa, Homo sapiens
  light chain complementarity determining region 3 for antibody 4250
QQSSNTHLT

SEQ ID NO: 8500 - protein, 16 aa, Homo sapiens
  heavy chain complementarity determining region 3 for antibody 4250
VRDLAGFTRGGSTFDY

SEQ ID NO: 8501 - protein, 9 aa, Homo sapiens
  light chain complementarity determining region 3 for antibody 4251
QQSPNTPLT

SEQ ID NO: 8502 - protein, 16 aa, Homo sapiens
  heavy chain complementarity determining region 3 for antibody 4251
VRDLAGFTRGGSTFDY

SEQ ID NO: 8503 - protein, 9 aa, Homo sapiens
  light chain complementarity determining region 3 for antibody 4252
QQSNSYPWT

SEQ ID NO: 8504 - protein, 15 aa, Homo sapiens
  heavy chain complementarity determining region 3 for antibody 4252
GKEGPGSSGWLTGHY

SEQ ID NO: 8505 - protein, 8 aa, Homo sapiens
  light chain complementarity determining region 3 for antibody 4253
QQSKSYWT

SEQ ID NO: 8506 - protein, 10 aa, Homo sapiens
  heavy chain complementarity determining region 3 for antibody 4253
ARERSGSYDI

SEQ ID NO: 8507 - protein, 9 aa, Homo sapiens
  light chain complementarity determining region 3 for antibody 4254
QQSHTMPRT

SEQ ID NO: 8508 - protein, 18 aa, Homo sapiens
  heavy chain complementarity determining region 3 for antibody 4254
TTVLSQLLAGDWHLYFQH

SEQ ID NO: 8509 - protein, 9 aa, Homo sapiens
  light chain complementarity determining region 3 for antibody 4255
QQSGAWPRT

SEQ ID NO: 8510 - protein, 18 aa, Homo sapiens
  heavy chain complementarity determining region 3 for antibody 4255
SRMGTTMSKGRDHCFMDV

SEQ ID NO: 8511 - protein, 9 aa, Homo sapiens
  light chain complementarity determining region 3 for antibody 4256
QQRYNPPLT

SEQ ID NO: 8512 - protein, 11 aa, Homo sapiens
  heavy chain complementarity determining region 3 for antibody 4256
ARGGTLAWFDP

SEQ ID NO: 8513 - protein, 9 aa, Homo sapiens
  light chain complementarity determining region 3 for antibody 4257
QQRSTWPIT

SEQ ID NO: 8514 - protein, 12 aa, Homo sapiens
  heavy chain complementarity determining region 3 for antibody 4257
NADHGYVDGFDI

SEQ ID NO: 8515 - protein, 9 aa, Homo sapiens
  light chain complementarity determining region 3 for antibody 4258
QQRSRWPGT

SEQ ID NO: 8516 - protein, 10 aa, Homo sapiens
  heavy chain complementarity determining region 3 for antibody 4258
ARGGLAGDND

SEQ ID NO: 8517 - protein, 8 aa, Homo sapiens
  light chain complementarity determining region 3 for antibody 4259
QQRSNWPT

SEQ ID NO: 8518 - protein, 13 aa, Homo sapiens
  heavy chain complementarity determining region 3 for antibody 4259
AKEGSSPGPDFDY

SEQ ID NO: 8519 - protein, 8 aa, Homo sapiens
  light chain complementarity determining region 3 for antibody 4260
QQRSNWPT

SEQ ID NO: 8520 - protein, 12 aa, Homo sapiens
  heavy chain complementarity determining region 3 for antibody 4260
AIVVPGRWDLDD

SEQ ID NO: 8521 - protein, 9 aa, Homo sapiens
  light chain complementarity determining region 3 for antibody 4261
QQRSNWPRT

SEQ ID NO: 8522 - protein, 12 aa, Homo sapiens
  heavy chain complementarity determining region 3 for antibody 4261
AIVVPGRWDLDD

SEQ ID NO: 8523 - protein, 10 aa, Homo sapiens
  light chain complementarity determining region 3 for antibody 4262
QQRSNWPPYT

SEQ ID NO: 8524 - protein, 17 aa, Homo sapiens
  heavy chain complementarity determining region 3 for antibody 4262
AKGRGSVAMALIYYLDL

SEQ ID NO: 8525 - protein, 10 aa, Homo sapiens
  light chain complementarity determining region 3 for antibody 4263
QQRSNWPPWT

SEQ ID NO: 8526 - protein, 11 aa, Homo sapiens
  heavy chain complementarity determining region 3 for antibody 4263
ARDWEGRQFDY

SEQ ID NO: 8527 - protein, 9 aa, Homo sapiens
  light chain complementarity determining region 3 for antibody 4264
QQRSNWPPT

SEQ ID NO: 8528 - protein, 12 aa, Homo sapiens
  heavy chain complementarity determining region 3 for antibody 4264
ARLDWNYRAFDI

SEQ ID NO: 8529 - protein, 12 aa, Homo sapiens
  light chain complementarity determining region 3 for antibody 4265
QQRSNWPPSLFT

SEQ ID NO: 8530 - protein, 12 aa, Homo sapiens
  heavy chain complementarity determining region 3 for antibody 4265
AIVVPGRWDLDD

SEQ ID NO: 8531 - protein, 11 aa, Homo sapiens
  light chain complementarity determining region 3 for antibody 4266
QQRSNWPPMYT

SEQ ID NO: 8532 - protein, 7 aa, Homo sapiens
  heavy chain complementarity determining region 3 for antibody 4266
TTGDLRN

SEQ ID NO: 8533 - protein, 10 aa, Homo sapiens
  light chain complementarity determining region 3 for antibody 4267
QQRSNWPPLT

SEQ ID NO: 8534 - protein, 15 aa, Homo sapiens
  heavy chain complementarity determining region 3 for antibody 4267
ACANGRYDHPYYFDY

SEQ ID NO: 8535 - protein, 9 aa, Homo sapiens
  light chain complementarity determining region 3 for antibody 4268
QQRSNWPIP

SEQ ID NO: 8536 - protein, 12 aa, Homo sapiens
  heavy chain complementarity determining region 3 for antibody 4268
NADHGYVDGFDI

SEQ ID NO: 8537 - protein, 7 aa, Homo sapiens
  light chain complementarity determining region 3 for antibody 4269
QQRSNWF

SEQ ID NO: 8538 - protein, 20 aa, Homo sapiens
  heavy chain complementarity determining region 3 for antibody 4269
ARVGLQWTPGPSGYYYYMDV

SEQ ID NO: 8539 - protein, 9 aa, Homo sapiens
  light chain complementarity determining region 3 for antibody 4270
QQRSNQRLT

SEQ ID NO: 8540 - protein, 7 aa, Homo sapiens
  heavy chain complementarity determining region 3 for antibody 4270
TTEDGRN

SEQ ID NO: 8541 - protein, 9 aa, Homo sapiens
  light chain complementarity determining region 3 for antibody 4271
QQRNTWPLT

SEQ ID NO: 8542 - protein, 12 aa, Homo sapiens
  heavy chain complementarity determining region 3 for antibody 4271
AIVVPGRWDLDD

SEQ ID NO: 8543 - protein, 9 aa, Homo sapiens
  light chain complementarity determining region 3 for antibody 4272
QQRGYWPPT

SEQ ID NO: 8544 - protein, 14 aa, Homo sapiens
  heavy chain complementarity determining region 3 for antibody 4272
AKHTRNWYLGVLDC

SEQ ID NO: 8545 - protein, 9 aa, Homo sapiens
  light chain complementarity determining region 3 for antibody 4273
QQRGYWPPT

SEQ ID NO: 8546 - protein, 14 aa, Homo sapiens
  heavy chain complementarity determining region 3 for antibody 4273
AKHTHSWYLGVLDC

SEQ ID NO: 8547 - protein, 9 aa, Homo sapiens
  light chain complementarity determining region 3 for antibody 4274
QQRGSWPPT

SEQ ID NO: 8548 - protein, 11 aa, Homo sapiens
  heavy chain complementarity determining region 3 for antibody 4274
ATFGQQWRLAH

SEQ ID NO: 8549 - protein, 9 aa, Homo sapiens
  light chain complementarity determining region 3 for antibody 4275
QQRGSWPPT

SEQ ID NO: 8550 - protein, 14 aa, Homo sapiens
  heavy chain complementarity determining region 3 for antibody 4275
AKHTHSWYLGVLDC

SEQ ID NO: 8551 - protein, 9 aa, Homo sapiens
  light chain complementarity determining region 3 for antibody 4276
QQRGSWPPT

SEQ ID NO: 8552 - protein, 14 aa, Homo sapiens
  heavy chain complementarity determining region 3 for antibody 4276
AKHAHNWYLGVLDC

SEQ ID NO: 8553 - protein, 9 aa, Homo sapiens
  light chain complementarity determining region 3 for antibody 4277
QQRAHWPLT

SEQ ID NO: 8554 - protein, 14 aa, Homo sapiens
  heavy chain complementarity determining region 3 for antibody 4277
ARTYVYYDGSGSVP

SEQ ID NO: 8555 - protein, 10 aa, Homo sapiens
  light chain complementarity determining region 3 for antibody 4278
QQPNNWPTIT

SEQ ID NO: 8556 - protein, 13 aa, Homo sapiens
  heavy chain complementarity determining region 3 for antibody 4278
AKPHYYGSGSGDY

SEQ ID NO: 8557 - protein, 9 aa, Homo sapiens
  light chain complementarity determining region 3 for antibody 4279
QQNYRTPYT

SEQ ID NO: 8558 - protein, 14 aa, Homo sapiens
  heavy chain complementarity determining region 3 for antibody 4279
ARLHGSGLGRWLDP

SEQ ID NO: 8559 - protein, 9 aa, Homo sapiens
  light chain complementarity determining region 3 for antibody 4280
QQNYNIPFT

SEQ ID NO: 8560 - protein, 14 aa, Homo sapiens
  heavy chain complementarity determining region 3 for antibody 4280
AKGRIASCYDASDI

SEQ ID NO: 8561 - protein, 8 aa, Homo sapiens
  light chain complementarity determining region 3 for antibody 4281
QQNKSYWT

SEQ ID NO: 8562 - protein, 10 aa, Homo sapiens
  heavy chain complementarity determining region 3 for antibody 4281
ARERSGSYDI

SEQ ID NO: 8563 - protein, 8 aa, Homo sapiens
  light chain complementarity determining region 3 for antibody 4282
QQNGYSHT

SEQ ID NO: 8564 - protein, 15 aa, Homo sapiens
  heavy chain complementarity determining region 3 for antibody 4282
ARGLLATGGWYYFDY

SEQ ID NO: 8565 - protein, 8 aa, Homo sapiens
  light chain complementarity determining region 3 for antibody 4283
QQNGNSFP

SEQ ID NO: 8566 - protein, 16 aa, Homo sapiens
  heavy chain complementarity determining region 3 for antibody 4283
AIWAAVSSGWSGPFDF

SEQ ID NO: 8567 - protein, 9 aa, Homo sapiens
  light chain complementarity determining region 3 for antibody 4284
QQLYRYPIT

SEQ ID NO: 8568 - protein, 14 aa, Homo sapiens
  heavy chain complementarity determining region 3 for antibody 4284
GRDTTHDWSDGRIY

SEQ ID NO: 8569 - protein, 9 aa, Homo sapiens
  light chain complementarity determining region 3 for antibody 4285
QQLYNYPLT

SEQ ID NO: 8570 - protein, 14 aa, Homo sapiens
  heavy chain complementarity determining region 3 for antibody 4285
ARDTAYNWNDGGIS

SEQ ID NO: 8571 - protein, 9 aa, Homo sapiens
  light chain complementarity determining region 3 for antibody 4286
QQLYNYPIT

SEQ ID NO: 8572 - protein, 14 aa, Homo sapiens
  heavy chain complementarity determining region 3 for antibody 4286
ARDTTYKWNDGGIS

SEQ ID NO: 8573 - protein, 9 aa, Homo sapiens
  light chain complementarity determining region 3 for antibody 4287
QQLYNYPIT

SEQ ID NO: 8574 - protein, 14 aa, Homo sapiens
  heavy chain complementarity determining region 3 for antibody 4287
ARDTTHNRNDGGIS

SEQ ID NO: 8575 - protein, 9 aa, Homo sapiens
  light chain complementarity determining region 3 for antibody 4288
QQLSSFPRT

SEQ ID NO: 8576 - protein, 9 aa, Homo sapiens
  heavy chain complementarity determining region 3 for antibody 4288
ARGRNNFRY

SEQ ID NO: 8577 - protein, 9 aa, Homo sapiens
  light chain complementarity determining region 3 for antibody 4289
QQLSNDPLT

SEQ ID NO: 8578 - protein, 17 aa, Homo sapiens
  heavy chain complementarity determining region 3 for antibody 4289
AKRLPDLLGGGHHYIDV

SEQ ID NO: 8579 - protein, 9 aa, Homo sapiens
  light chain complementarity determining region 3 for antibody 4290
QQLSNAPPT

SEQ ID NO: 8580 - protein, 17 aa, Homo sapiens
  heavy chain complementarity determining region 3 for antibody 4290
AKRLPDLLGGGHHYIDV

SEQ ID NO: 8581 - protein, 9 aa, Homo sapiens
  light chain complementarity determining region 3 for antibody 4291
QQLSNAPLT

SEQ ID NO: 8582 - protein, 11 aa, Homo sapiens
  heavy chain complementarity determining region 3 for antibody 4291
VRVSTGWNFDY

SEQ ID NO: 8583 - protein, 9 aa, Homo sapiens
  light chain complementarity determining region 3 for antibody 4292
QQLSNAPLT

SEQ ID NO: 8584 - protein, 17 aa, Homo sapiens
  heavy chain complementarity determining region 3 for antibody 4292
TKRLPDLLGGGHHYIDV

SEQ ID NO: 8585 - protein, 9 aa, Homo sapiens
  light chain complementarity determining region 3 for antibody 4293
QQLSNAPLT

SEQ ID NO: 8586 - protein, 16 aa, Homo sapiens
  heavy chain complementarity determining region 3 for antibody 4293
ARWFSRSSTGVSYMDV

SEQ ID NO: 8587 - protein, 9 aa, Homo sapiens
  light chain complementarity determining region 3 for antibody 4294
QQLSNAPLT

SEQ ID NO: 8588 - protein, 18 aa, Homo sapiens
  heavy chain complementarity determining region 3 for antibody 4294
ARGDYPEARTGYFLDFDY

SEQ ID NO: 8589 - protein, 9 aa, Homo sapiens
  light chain complementarity determining region 3 for antibody 4295
QQLSNAPLT

SEQ ID NO: 8590 - protein, 17 aa, Homo sapiens
  heavy chain complementarity determining region 3 for antibody 4295
AKRLPDLLGGGYHYIDV

SEQ ID NO: 8591 - protein, 9 aa, Homo sapiens
  light chain complementarity determining region 3 for antibody 4296
QQLSNAPLT

SEQ ID NO: 8592 - protein, 17 aa, Homo sapiens
  heavy chain complementarity determining region 3 for antibody 4296
AKRLPDLLGGGHHYMDV

SEQ ID NO: 8593 - protein, 9 aa, Homo sapiens
  light chain complementarity determining region 3 for antibody 4297
QQLSNAPLT

SEQ ID NO: 8594 - protein, 17 aa, Homo sapiens
  heavy chain complementarity determining region 3 for antibody 4297
AKRLPDLLGDGHHYIDV

SEQ ID NO: 8595 - protein, 9 aa, Homo sapiens
  light chain complementarity determining region 3 for antibody 4298
QQLSNAHLT

SEQ ID NO: 8596 - protein, 17 aa, Homo sapiens
  heavy chain complementarity determining region 3 for antibody 4298
AKRLPDLLGGGHHYIDV

SEQ ID NO: 8597 - protein, 9 aa, Homo sapiens
  light chain complementarity determining region 3 for antibody 4299
QQLNTYPLT

SEQ ID NO: 8598 - protein, 13 aa, Homo sapiens
  heavy chain complementarity determining region 3 for antibody 4299
TREGDSSGPDFRL

SEQ ID NO: 8599 - protein, 9 aa, Homo sapiens
  light chain complementarity determining region 3 for antibody 4300
QQLNSYPYT

SEQ ID NO: 8600 - protein, 14 aa, Homo sapiens
  heavy chain complementarity determining region 3 for antibody 4300
TRGHFDSTGFRLDY

SEQ ID NO: 8601 - protein, 9 aa, Homo sapiens
  light chain complementarity determining region 3 for antibody 4301
QQLNSYPYT

SEQ ID NO: 8602 - protein, 12 aa, Homo sapiens
  heavy chain complementarity determining region 3 for antibody 4301
NADHGYVDGFDI

SEQ ID NO: 8603 - protein, 9 aa, Homo sapiens
  light chain complementarity determining region 3 for antibody 4302
QQLNSYPYT

SEQ ID NO: 8604 - protein, 9 aa, Homo sapiens
  heavy chain complementarity determining region 3 for antibody 4302
ARGSGYNHY

SEQ ID NO: 8605 - protein, 9 aa, Homo sapiens
  light chain complementarity determining region 3 for antibody 4303
QQLNSYPYT

SEQ ID NO: 8606 - protein, 14 aa, Homo sapiens
  heavy chain complementarity determining region 3 for antibody 4303
ARGQFDSTGFRLDY

SEQ ID NO: 8607 - protein, 9 aa, Homo sapiens
  light chain complementarity determining region 3 for antibody 4304
QQLNSYPYT

SEQ ID NO: 8608 - protein, 14 aa, Homo sapiens
  heavy chain complementarity determining region 3 for antibody 4304
ARGPFDSTGFRLDY

SEQ ID NO: 8609 - protein, 9 aa, Homo sapiens
  light chain complementarity determining region 3 for antibody 4305
QQLNSYPYT

SEQ ID NO: 8610 - protein, 14 aa, Homo sapiens
  heavy chain complementarity determining region 3 for antibody 4305
ARGHFDSTGFRLDD

SEQ ID NO: 8611 - protein, 9 aa, Homo sapiens
  light chain complementarity determining region 3 for antibody 4306
QQLNSYPYT

SEQ ID NO: 8612 - protein, 14 aa, Homo sapiens
  heavy chain complementarity determining region 3 for antibody 4306
ARGHFDSTGFRFDY

SEQ ID NO: 8613 - protein, 9 aa, Homo sapiens
  light chain complementarity determining region 3 for antibody 4307
QQLNSYPYT

SEQ ID NO: 8614 - protein, 12 aa, Homo sapiens
  heavy chain complementarity determining region 3 for antibody 4307
ARDKGGRNGMDV

SEQ ID NO: 8615 - protein, 9 aa, Homo sapiens
  light chain complementarity determining region 3 for antibody 4308
QQLNSYPYP

SEQ ID NO: 8616 - protein, 10 aa, Homo sapiens
  heavy chain complementarity determining region 3 for antibody 4308
ARETSGAYDI

SEQ ID NO: 8617 - protein, 9 aa, Homo sapiens
  light chain complementarity determining region 3 for antibody 4309
QQLNSYPST

SEQ ID NO: 8618 - protein, 10 aa, Homo sapiens
  heavy chain complementarity determining region 3 for antibody 4309
ARETSGAYDI

SEQ ID NO: 8619 - protein, 9 aa, Homo sapiens
  light chain complementarity determining region 3 for antibody 4310
QQLNSYPHT

SEQ ID NO: 8620 - protein, 14 aa, Homo sapiens
  heavy chain complementarity determining region 3 for antibody 4310
ARGHFDSTGFRLDY

SEQ ID NO: 8621 - protein, 9 aa, Homo sapiens
  light chain complementarity determining region 3 for antibody 4311
QQLNSYPDT

SEQ ID NO: 8622 - protein, 10 aa, Homo sapiens
  heavy chain complementarity determining region 3 for antibody 4311
ARETSGAYDI

SEQ ID NO: 8623 - protein, 9 aa, Homo sapiens
  light chain complementarity determining region 3 for antibody 4312
QQLNSSPYT

SEQ ID NO: 8624 - protein, 14 aa, Homo sapiens
  heavy chain complementarity determining region 3 for antibody 4312
ARGHSDSTGFRLDY

SEQ ID NO: 8625 - protein, 9 aa, Homo sapiens
  light chain complementarity determining region 3 for antibody 4313
QQLNSSPYT

SEQ ID NO: 8626 - protein, 14 aa, Homo sapiens
  heavy chain complementarity determining region 3 for antibody 4313
ARGHFNSTGFRLDY

SEQ ID NO: 8627 - protein, 9 aa, Homo sapiens
  light chain complementarity determining region 3 for antibody 4314
QQLNSSPYT

SEQ ID NO: 8628 - protein, 14 aa, Homo sapiens
  heavy chain complementarity determining region 3 for antibody 4314
ARGHFDSTSFRLDY

SEQ ID NO: 8629 - protein, 9 aa, Homo sapiens
  light chain complementarity determining region 3 for antibody 4315
QQLNSSPYT

SEQ ID NO: 8630 - protein, 14 aa, Homo sapiens
  heavy chain complementarity determining region 3 for antibody 4315
ARGHFDSPGFRLDY

SEQ ID NO: 8631 - protein, 9 aa, Homo sapiens
  light chain complementarity determining region 3 for antibody 4316
QQLNSSPYT

SEQ ID NO: 8632 - protein, 14 aa, Homo sapiens
  heavy chain complementarity determining region 3 for antibody 4316
ARGHFDGTGFRLDY

SEQ ID NO: 8633 - protein, 9 aa, Homo sapiens
  light chain complementarity determining region 3 for antibody 4317
QQLNSSPYT

SEQ ID NO: 8634 - protein, 10 aa, Homo sapiens
  heavy chain complementarity determining region 3 for antibody 4317
ARETSGAYDI

SEQ ID NO: 8635 - protein, 9 aa, Homo sapiens
  light chain complementarity determining region 3 for antibody 4318
QQLNSSPYA

SEQ ID NO: 8636 - protein, 14 aa, Homo sapiens
  heavy chain complementarity determining region 3 for antibody 4318
ARGHFDSTGFRLDY

SEQ ID NO: 8637 - protein, 9 aa, Homo sapiens
  light chain complementarity determining region 3 for antibody 4319
QQLNSSPHT

SEQ ID NO: 8638 - protein, 14 aa, Homo sapiens
  heavy chain complementarity determining region 3 for antibody 4319
ARGHFDSTGFRLDY

SEQ ID NO: 8639 - protein, 9 aa, Homo sapiens
  light chain complementarity determining region 3 for antibody 4320
QQLNSFPST

SEQ ID NO: 8640 - protein, 21 aa, Homo sapiens
  heavy chain complementarity determining region 3 for antibody 4320
ARGSRTDCRSDDTGCRPMFDS

SEQ ID NO: 8641 - protein, 9 aa, Homo sapiens
  light chain complementarity determining region 3 for antibody 4321
QQLNSDPYT

SEQ ID NO: 8642 - protein, 14 aa, Homo sapiens
  heavy chain complementarity determining region 3 for antibody 4321
ARGHCDSTGFRLDY

SEQ ID NO: 8643 - protein, 9 aa, Homo sapiens
  light chain complementarity determining region 3 for antibody 4322
QQLMVYPYT

SEQ ID NO: 8644 - protein, 14 aa, Homo sapiens
  heavy chain complementarity determining region 3 for antibody 4322
TRGHFDSTGLRLDY

SEQ ID NO: 8645 - protein, 9 aa, Homo sapiens
  light chain complementarity determining region 3 for antibody 4323
QQLMVYPYT

SEQ ID NO: 8646 - protein, 14 aa, Homo sapiens
  heavy chain complementarity determining region 3 for antibody 4323
TRGHFDSTGFRLDS

SEQ ID NO: 8647 - protein, 9 aa, Homo sapiens
  light chain complementarity determining region 3 for antibody 4324
QQLMVYPYT

SEQ ID NO: 8648 - protein, 14 aa, Homo sapiens
  heavy chain complementarity determining region 3 for antibody 4324
TRGHFDSTGFRLDH

SEQ ID NO: 8649 - protein, 9 aa, Homo sapiens
  light chain complementarity determining region 3 for antibody 4325
QQLMVYPYT

SEQ ID NO: 8650 - protein, 14 aa, Homo sapiens
  heavy chain complementarity determining region 3 for antibody 4325
TRGHFDSAGFRLDY

SEQ ID NO: 8651 - protein, 9 aa, Homo sapiens
  light chain complementarity determining region 3 for antibody 4326
QQLMSYPYT

SEQ ID NO: 8652 - protein, 17 aa, Homo sapiens
  heavy chain complementarity determining region 3 for antibody 4326
ARNTMVHGWQRRGSVDH

SEQ ID NO: 8653 - protein, 9 aa, Homo sapiens
  light chain complementarity determining region 3 for antibody 4327
QQLMSYPYT

SEQ ID NO: 8654 - protein, 17 aa, Homo sapiens
  heavy chain complementarity determining region 3 for antibody 4327
ARNTMVHGWHRQGSVDH

SEQ ID NO: 8655 - protein, 9 aa, Homo sapiens
  light chain complementarity determining region 3 for antibody 4328
QQLMSYPYT

SEQ ID NO: 8656 - protein, 17 aa, Homo sapiens
  heavy chain complementarity determining region 3 for antibody 4328
ARNPMVHGWQRQGSVDH

SEQ ID NO: 8657 - protein, 9 aa, Homo sapiens
  light chain complementarity determining region 3 for antibody 4329
QQLMSYPYT

SEQ ID NO: 8658 - protein, 14 aa, Homo sapiens
  heavy chain complementarity determining region 3 for antibody 4329
ARGHFDSTGLRLDY

SEQ ID NO: 8659 - protein, 9 aa, Homo sapiens
  light chain complementarity determining region 3 for antibody 4330
QQLMSYPST

SEQ ID NO: 8660 - protein, 17 aa, Homo sapiens
  heavy chain complementarity determining region 3 for antibody 4330
ARNTMVHGWQRQGSVDH

SEQ ID NO: 8661 - protein, 9 aa, Homo sapiens
  light chain complementarity determining region 3 for antibody 4331
QQLMGYPYT

SEQ ID NO: 8662 - protein, 14 aa, Homo sapiens
  heavy chain complementarity determining region 3 for antibody 4331
ARGHFDTTGFRLDY

SEQ ID NO: 8663 - protein, 9 aa, Homo sapiens
  light chain complementarity determining region 3 for antibody 4332
QQLHSSPYT

SEQ ID NO: 8664 - protein, 14 aa, Homo sapiens
  heavy chain complementarity determining region 3 for antibody 4332
ARGHFDSTGCRLDY

SEQ ID NO: 8665 - protein, 9 aa, Homo sapiens
  light chain complementarity determining region 3 for antibody 4333
QQLHSSPHT

SEQ ID NO: 8666 - protein, 14 aa, Homo sapiens
  heavy chain complementarity determining region 3 for antibody 4333
ARGHFDSTGFRLDY

SEQ ID NO: 8667 - protein, 9 aa, Homo sapiens
  light chain complementarity determining region 3 for antibody 4334
QQLHGYPIT

SEQ ID NO: 8668 - protein, 11 aa, Homo sapiens
  heavy chain complementarity determining region 3 for antibody 4334
ATFGQQWRLAH

SEQ ID NO: 8669 - protein, 9 aa, Homo sapiens
  light chain complementarity determining region 3 for antibody 4335
QQLHGYPIT

SEQ ID NO: 8670 - protein, 12 aa, Homo sapiens
  heavy chain complementarity determining region 3 for antibody 4335
ARLDWNYRAFDI

SEQ ID NO: 8671 - protein, 9 aa, Homo sapiens
  light chain complementarity determining region 3 for antibody 4336
QQHYETPYT

SEQ ID NO: 8672 - protein, 18 aa, Homo sapiens
  heavy chain complementarity determining region 3 for antibody 4336
ARAADCIGDKCFQSHFDF

SEQ ID NO: 8673 - protein, 7 aa, Homo sapiens
  light chain complementarity determining region 3 for antibody 4337
QQHNTWT

SEQ ID NO: 8674 - protein, 12 aa, Homo sapiens
  heavy chain complementarity determining region 3 for antibody 4337
SRDKGGRNGMDV

SEQ ID NO: 8675 - protein, 7 aa, Homo sapiens
  light chain complementarity determining region 3 for antibody 4338
QQHNTWT

SEQ ID NO: 8676 - protein, 12 aa, Homo sapiens
  heavy chain complementarity determining region 3 for antibody 4338
ARDKGGRNGMDV

SEQ ID NO: 8677 - protein, 9 aa, Homo sapiens
  light chain complementarity determining region 3 for antibody 4339
QQHNSYSLT

SEQ ID NO: 8678 - protein, 15 aa, Homo sapiens
  heavy chain complementarity determining region 3 for antibody 4339
ARSMVSGTTDDAFDI

SEQ ID NO: 8679 - protein, 9 aa, Homo sapiens
  light chain complementarity determining region 3 for antibody 4340
QQHNSYPWT

SEQ ID NO: 8680 - protein, 11 aa, Homo sapiens
  heavy chain complementarity determining region 3 for antibody 4340
ARIVARKPDDY

SEQ ID NO: 8681 - protein, 10 aa, Homo sapiens
  light chain complementarity determining region 3 for antibody 4341
QQHNNWPTTT

SEQ ID NO: 8682 - protein, 13 aa, Homo sapiens
  heavy chain complementarity determining region 3 for antibody 4341
AKPHYYGSGSGDY

SEQ ID NO: 8683 - protein, 9 aa, Homo sapiens
  light chain complementarity determining region 3 for antibody 4342
QQHHRYSHT

SEQ ID NO: 8684 - protein, 14 aa, Homo sapiens
  heavy chain complementarity determining region 3 for antibody 4342
GRDVHTTGWTLGGY

SEQ ID NO: 8685 - protein, 9 aa, Homo sapiens
  light chain complementarity determining region 3 for antibody 4343
QQHGTFPPS

SEQ ID NO: 8686 - protein, 13 aa, Homo sapiens
  heavy chain complementarity determining region 3 for antibody 4343
ARGINILSNNFLH

SEQ ID NO: 8687 - protein, 9 aa, Homo sapiens
  light chain complementarity determining region 3 for antibody 4344
QQHGSSTWT

SEQ ID NO: 8688 - protein, 17 aa, Homo sapiens
  heavy chain complementarity determining region 3 for antibody 4344
AKGRGSVAMALIYYLDL

SEQ ID NO: 8689 - protein, 9 aa, Homo sapiens
  light chain complementarity determining region 3 for antibody 4345
QQHDNWPWT

SEQ ID NO: 8690 - protein, 17 aa, Homo sapiens
  heavy chain complementarity determining region 3 for antibody 4345
VTHYYHDSGIYHDFFNY

SEQ ID NO: 8691 - protein, 9 aa, Homo sapiens
  light chain complementarity determining region 3 for antibody 4346
QQHDNLPPA

SEQ ID NO: 8692 - protein, 13 aa, Homo sapiens
  heavy chain complementarity determining region 3 for antibody 4346
TKEGSSAGPDFVY

SEQ ID NO: 8693 - protein, 9 aa, Homo sapiens
  light chain complementarity determining region 3 for antibody 4347
QQGYTTPYT

SEQ ID NO: 8694 - protein, 23 aa, Homo sapiens
  heavy chain complementarity determining region 3 for antibody 4347
ARHFPKGGSAITGMQSLYYYMDV

SEQ ID NO: 8695 - protein, 10 aa, Homo sapiens
  light chain complementarity determining region 3 for antibody 4348
QQGYSTPLFT

SEQ ID NO: 8696 - protein, 15 aa, Homo sapiens
  heavy chain complementarity determining region 3 for antibody 4348
ARVGRPYHNAWYFDN

SEQ ID NO: 8697 - protein, 9 aa, Homo sapiens
  light chain complementarity determining region 3 for antibody 4349
QQGAHSPLT

SEQ ID NO: 8698 - protein, 13 aa, Homo sapiens
  heavy chain complementarity determining region 3 for antibody 4349
VGGLYSGTWYGGY

SEQ ID NO: 8699 - protein, 9 aa, Homo sapiens
  light chain complementarity determining region 3 for antibody 4350
QQFYTYPLT

SEQ ID NO: 8700 - protein, 20 aa, Homo sapiens
  heavy chain complementarity determining region 3 for antibody 4350
ARNLQYCSGGSCYGPFYFDY

SEQ ID NO: 8701 - protein, 9 aa, Homo sapiens
  light chain complementarity determining region 3 for antibody 4351
QQFYDIPPT

SEQ ID NO: 8702 - protein, 16 aa, Homo sapiens
  heavy chain complementarity determining region 3 for antibody 4351
ARDGRGASSQFNLFDP

SEQ ID NO: 8703 - protein, 9 aa, Homo sapiens
  light chain complementarity determining region 3 for antibody 4352
QQFSSFPRT

SEQ ID NO: 8704 - protein, 9 aa, Homo sapiens
  heavy chain complementarity determining region 3 for antibody 4352
ARGRNNSRY

SEQ ID NO: 8705 - protein, 9 aa, Homo sapiens
  light chain complementarity determining region 3 for antibody 4353
QQFSNPPRT

SEQ ID NO: 8706 - protein, 13 aa, Homo sapiens
  heavy chain complementarity determining region 3 for antibody 4353
AKEGSSPGPDFDS

SEQ ID NO: 8707 - protein, 9 aa, Homo sapiens
  light chain complementarity determining region 3 for antibody 4354
QQFSNLPRT

SEQ ID NO: 8708 - protein, 13 aa, Homo sapiens
  heavy chain complementarity determining region 3 for antibody 4354
TKEGSSPGPDFDS

SEQ ID NO: 8709 - protein, 9 aa, Homo sapiens
  light chain complementarity determining region 3 for antibody 4355
QQFSNLPRT

SEQ ID NO: 8710 - protein, 13 aa, Homo sapiens
  heavy chain complementarity determining region 3 for antibody 4355
AKEGSSPGPVFDS

SEQ ID NO: 8711 - protein, 9 aa, Homo sapiens
  light chain complementarity determining region 3 for antibody 4356
QQFSNLPRT

SEQ ID NO: 8712 - protein, 13 aa, Homo sapiens
  heavy chain complementarity determining region 3 for antibody 4356
AKEGSSPGPDVDS

SEQ ID NO: 8713 - protein, 9 aa, Homo sapiens
  light chain complementarity determining region 3 for antibody 4357
QQFSNLPRT

SEQ ID NO: 8714 - protein, 13 aa, Homo sapiens
  heavy chain complementarity determining region 3 for antibody 4357
AKEGSSPGPAFDS

SEQ ID NO: 8715 - protein, 9 aa, Homo sapiens
  light chain complementarity determining region 3 for antibody 4358
QQFSNLPRT

SEQ ID NO: 8716 - protein, 13 aa, Homo sapiens
  heavy chain complementarity determining region 3 for antibody 4358
AKEGSSHGPDFDS

SEQ ID NO: 8717 - protein, 9 aa, Homo sapiens
  light chain complementarity determining region 3 for antibody 4359
QQFSNLPRT

SEQ ID NO: 8718 - protein, 13 aa, Homo sapiens
  heavy chain complementarity determining region 3 for antibody 4359
AKEGCSPGPDFDS

SEQ ID NO: 8719 - protein, 9 aa, Homo sapiens
  light chain complementarity determining region 3 for antibody 4360
QQFSDFLRT

SEQ ID NO: 8720 - protein, 9 aa, Homo sapiens
  heavy chain complementarity determining region 3 for antibody 4360
VRGRNNFRY

SEQ ID NO: 8721 - protein, 9 aa, Homo sapiens
  light chain complementarity determining region 3 for antibody 4361
QQFRDLPRT

SEQ ID NO: 8722 - protein, 9 aa, Homo sapiens
  heavy chain complementarity determining region 3 for antibody 4361
VRGRSNFSH

SEQ ID NO: 8723 - protein, 9 aa, Homo sapiens
  light chain complementarity determining region 3 for antibody 4362
QQFNSYPYT

SEQ ID NO: 8724 - protein, 9 aa, Homo sapiens
  heavy chain complementarity determining region 3 for antibody 4362
ARFWTYGRN

SEQ ID NO: 8725 - protein, 9 aa, Homo sapiens
  light chain complementarity determining region 3 for antibody 4363
QQFNSYPYT

SEQ ID NO: 8726 - protein, 9 aa, Homo sapiens
  heavy chain complementarity determining region 3 for antibody 4363
ARCWTYGRK

SEQ ID NO: 8727 - protein, 9 aa, Homo sapiens
  light chain complementarity determining region 3 for antibody 4364
QQFNSHPRT

SEQ ID NO: 8728 - protein, 13 aa, Homo sapiens
  heavy chain complementarity determining region 3 for antibody 4364
AADGPYGSSAFDY

SEQ ID NO: 8729 - protein, 10 aa, Homo sapiens
  light chain complementarity determining region 3 for antibody 4365
QQFGDSPMYT

SEQ ID NO: 8730 - protein, 13 aa, Homo sapiens
  heavy chain complementarity determining region 3 for antibody 4365
TADFYDYVWGPRY

SEQ ID NO: 8731 - protein, 9 aa, Homo sapiens
  light chain complementarity determining region 3 for antibody 4366
QQFDSLPRT

SEQ ID NO: 8732 - protein, 11 aa, Homo sapiens
  heavy chain complementarity determining region 3 for antibody 4366
ARDFDGAGYDY

SEQ ID NO: 8733 - protein, 9 aa, Homo sapiens
  light chain complementarity determining region 3 for antibody 4367
QQFDDLPRT

SEQ ID NO: 8734 - protein, 9 aa, Homo sapiens
  heavy chain complementarity determining region 3 for antibody 4367
VRGRDNWRV

SEQ ID NO: 8735 - protein, 9 aa, Homo sapiens
  light chain complementarity determining region 3 for antibody 4368
QQFANLPRT

SEQ ID NO: 8736 - protein, 9 aa, Homo sapiens
  heavy chain complementarity determining region 3 for antibody 4368
VRGRSTFRY

SEQ ID NO: 8737 - protein, 9 aa, Homo sapiens
  light chain complementarity determining region 3 for antibody 4369
QQFANLPRT

SEQ ID NO: 8738 - protein, 9 aa, Homo sapiens
  heavy chain complementarity determining region 3 for antibody 4369
VRGRSNLRY

SEQ ID NO: 8739 - protein, 9 aa, Homo sapiens
  light chain complementarity determining region 3 for antibody 4370
QQDYYTPRT

SEQ ID NO: 8740 - protein, 11 aa, Homo sapiens
  heavy chain complementarity determining region 3 for antibody 4370
ATFGQQWRLAH

SEQ ID NO: 8741 - protein, 9 aa, Homo sapiens
  light chain complementarity determining region 3 for antibody 4371
QQDYYTPRT

SEQ ID NO: 8742 - protein, 11 aa, Homo sapiens
  heavy chain complementarity determining region 3 for antibody 4371
ARRSPGGAFDY

SEQ ID NO: 8743 - protein, 9 aa, Homo sapiens
  light chain complementarity determining region 3 for antibody 4372
QQDYYTPRT

SEQ ID NO: 8744 - protein, 11 aa, Homo sapiens
  heavy chain complementarity determining region 3 for antibody 4372
ARRSLGGAFDS

SEQ ID NO: 8745 - protein, 9 aa, Homo sapiens
  light chain complementarity determining region 3 for antibody 4373
QQDYYTPRT

SEQ ID NO: 8746 - protein, 12 aa, Homo sapiens
  heavy chain complementarity determining region 3 for antibody 4373
AIVVPGRWDLDD

SEQ ID NO: 8747 - protein, 9 aa, Homo sapiens
  light chain complementarity determining region 3 for antibody 4374
QQDYYHPRT

SEQ ID NO: 8748 - protein, 11 aa, Homo sapiens
  heavy chain complementarity determining region 3 for antibody 4374
ARRSLGGAFDY

SEQ ID NO: 8749 - protein, 8 aa, Homo sapiens
  light chain complementarity determining region 3 for antibody 4375
QQDGYSHT

SEQ ID NO: 8750 - protein, 15 aa, Homo sapiens
  heavy chain complementarity determining region 3 for antibody 4375
ARGLLAAGGWYYFDY

SEQ ID NO: 8751 - protein, 9 aa, Homo sapiens
  light chain complementarity determining region 3 for antibody 4376
QQDGTTPLT

SEQ ID NO: 8752 - protein, 6 aa, Homo sapiens
  heavy chain complementarity determining region 3 for antibody 4376
TTGYHA

SEQ ID NO: 8753 - protein, 9 aa, Homo sapiens
  light chain complementarity determining region 3 for antibody 4377
QQDGTLPGT

SEQ ID NO: 8754 - protein, 10 aa, Homo sapiens
  heavy chain complementarity determining region 3 for antibody 4377
ARAALWSYDY

SEQ ID NO: 8755 - protein, 10 aa, Homo sapiens
  light chain complementarity determining region 3 for antibody 4378
QQDDNLASLT

SEQ ID NO: 8756 - protein, 13 aa, Homo sapiens
  heavy chain complementarity determining region 3 for antibody 4378
AKEGSSPGPDFEY

SEQ ID NO: 8757 - protein, 10 aa, Homo sapiens
  light chain complementarity determining region 3 for antibody 4379
QQCGNWPQGT

SEQ ID NO: 8758 - protein, 12 aa, Homo sapiens
  heavy chain complementarity determining region 3 for antibody 4379
AKPAYGSGSPDY

SEQ ID NO: 8759 - protein, 9 aa, Homo sapiens
  light chain complementarity determining region 3 for antibody 4380
QQAYRTPYT

SEQ ID NO: 8760 - protein, 14 aa, Homo sapiens
  heavy chain complementarity determining region 3 for antibody 4380
ARLHGSGLGRWLDP

SEQ ID NO: 8761 - protein, 9 aa, Homo sapiens
  light chain complementarity determining region 3 for antibody 4381
QQAYFTPRT

SEQ ID NO: 8762 - protein, 11 aa, Homo sapiens
  heavy chain complementarity determining region 3 for antibody 4381
ARRSLGGAFDY

SEQ ID NO: 8763 - protein, 9 aa, Homo sapiens
  light chain complementarity determining region 3 for antibody 4382
QQANSLPLT

SEQ ID NO: 8764 - protein, 17 aa, Homo sapiens
  heavy chain complementarity determining region 3 for antibody 4382
ARNTMVHGWQRQGSVDH

SEQ ID NO: 8765 - protein, 10 aa, Homo sapiens
  light chain complementarity determining region 3 for antibody 4383
QPYNFYSTLT

SEQ ID NO: 8766 - protein, 16 aa, Homo sapiens
  heavy chain complementarity determining region 3 for antibody 4383
GRQVISATKWPNRLDY

SEQ ID NO: 8767 - protein, 9 aa, Homo sapiens
  light chain complementarity determining region 3 for antibody 4384
QPYGNSPVP

SEQ ID NO: 8768 - protein, 18 aa, Homo sapiens
  heavy chain complementarity determining region 3 for antibody 4384
ARGDYPEARTGYFLDFDY

SEQ ID NO: 8769 - protein, 9 aa, Homo sapiens
  light chain complementarity determining region 3 for antibody 4385
QPYGGSLLT

SEQ ID NO: 8770 - protein, 10 aa, Homo sapiens
  heavy chain complementarity determining region 3 for antibody 4385
CRDRWGFGDV

SEQ ID NO: 8771 - protein, 9 aa, Homo sapiens
  light chain complementarity determining region 3 for antibody 4386
QPLSNAPLT

SEQ ID NO: 8772 - protein, 17 aa, Homo sapiens
  heavy chain complementarity determining region 3 for antibody 4386
AKRLPDLLGGGHHYIDV

SEQ ID NO: 8773 - protein, 10 aa, Homo sapiens
  light chain complementarity determining region 3 for antibody 4387
QNYGSSQGIT

SEQ ID NO: 8774 - protein, 17 aa, Homo sapiens
  heavy chain complementarity determining region 3 for antibody 4387
ARGTGIGSGSYYADFDY

SEQ ID NO: 8775 - protein, 9 aa, Homo sapiens
  light chain complementarity determining region 3 for antibody 4388
QMYGSSPVP

SEQ ID NO: 8776 - protein, 18 aa, Homo sapiens
  heavy chain complementarity determining region 3 for antibody 4388
ARGDYPEARTGYFLDFDY

SEQ ID NO: 8777 - protein, 9 aa, Homo sapiens
  light chain complementarity determining region 3 for antibody 4389
QLSGSSLLT

SEQ ID NO: 8778 - protein, 12 aa, Homo sapiens
  heavy chain complementarity determining region 3 for antibody 4389
ALDGWHPSWYKY

SEQ ID NO: 8779 - protein, 9 aa, Homo sapiens
  light chain complementarity determining region 3 for antibody 4390
QLSGSSLLT

SEQ ID NO: 8780 - protein, 12 aa, Homo sapiens
  heavy chain complementarity determining region 3 for antibody 4390
ALDEWHLSWYKY

SEQ ID NO: 8781 - protein, 9 aa, Homo sapiens
  light chain complementarity determining region 3 for antibody 4391
QLSGSSLFT

SEQ ID NO: 8782 - protein, 12 aa, Homo sapiens
  heavy chain complementarity determining region 3 for antibody 4391
ALDEWHPSWYKY

SEQ ID NO: 8783 - protein, 9 aa, Homo sapiens
  light chain complementarity determining region 3 for antibody 4392
QLSGSLLLT

SEQ ID NO: 8784 - protein, 12 aa, Homo sapiens
  heavy chain complementarity determining region 3 for antibody 4392
ALDEWHPSWYKY

SEQ ID NO: 8785 - protein, 9 aa, Homo sapiens
  light chain complementarity determining region 3 for antibody 4393
QKYYSVQLT

SEQ ID NO: 8786 - protein, 12 aa, Homo sapiens
  heavy chain complementarity determining region 3 for antibody 4393
SRDKGGRNGMDV

SEQ ID NO: 8787 - protein, 9 aa, Homo sapiens
  light chain complementarity determining region 3 for antibody 4394
QKYYSVPLT

SEQ ID NO: 8788 - protein, 12 aa, Homo sapiens
  heavy chain complementarity determining region 3 for antibody 4394
ARDKGGRNGMDV

SEQ ID NO: 8789 - protein, 9 aa, Homo sapiens
  light chain complementarity determining region 3 for antibody 4395
QKYNHVPWT

SEQ ID NO: 8790 - protein, 10 aa, Homo sapiens
  heavy chain complementarity determining region 3 for antibody 4395
ARERSGSYDI

SEQ ID NO: 8791 - protein, 9 aa, Homo sapiens
  light chain complementarity determining region 3 for antibody 4396
QKYKSAPFT

SEQ ID NO: 8792 - protein, 10 aa, Homo sapiens
  heavy chain complementarity determining region 3 for antibody 4396
ARERSGSYDI

SEQ ID NO: 8793 - protein, 9 aa, Homo sapiens
  light chain complementarity determining region 3 for antibody 4397
QKYKSAPFT

SEQ ID NO: 8794 - protein, 13 aa, Homo sapiens
  heavy chain complementarity determining region 3 for antibody 4397
AKEGSSPGPDLEY

SEQ ID NO: 8795 - protein, 9 aa, Homo sapiens
  light chain complementarity determining region 3 for antibody 4398
QKYKSAPFT

SEQ ID NO: 8796 - protein, 13 aa, Homo sapiens
  heavy chain complementarity determining region 3 for antibody 4398
AKEGSSPGPDFEC

SEQ ID NO: 8797 - protein, 9 aa, Homo sapiens
  light chain complementarity determining region 3 for antibody 4399
QKYKSAPFT

SEQ ID NO: 8798 - protein, 13 aa, Homo sapiens
  heavy chain complementarity determining region 3 for antibody 4399
AKEGSPPGPDFEY

SEQ ID NO: 8799 - protein, 9 aa, Homo sapiens
  light chain complementarity determining region 3 for antibody 4400
QKYKSAPFT

SEQ ID NO: 8800 - protein, 12 aa, Homo sapiens
  heavy chain complementarity determining region 3 for antibody 4400
AIVVPGRWDLDD

SEQ ID NO: 8801 - protein, 9 aa, Homo sapiens
  light chain complementarity determining region 3 for antibody 4401
QKYKHVPWT

SEQ ID NO: 8802 - protein, 10 aa, Homo sapiens
  heavy chain complementarity determining region 3 for antibody 4401
ARERSGAYDI

SEQ ID NO: 8803 - protein, 9 aa, Homo sapiens
  light chain complementarity determining region 3 for antibody 4402
QKYGSSPVP

SEQ ID NO: 8804 - protein, 18 aa, Homo sapiens
  heavy chain complementarity determining region 3 for antibody 4402
TRGDYPEARTGYFLDFDY

SEQ ID NO: 8805 - protein, 9 aa, Homo sapiens
  light chain complementarity determining region 3 for antibody 4403
QKYGSSPVP

SEQ ID NO: 8806 - protein, 18 aa, Homo sapiens
  heavy chain complementarity determining region 3 for antibody 4403
ARGDYTEARTGYFLDFDY

SEQ ID NO: 8807 - protein, 9 aa, Homo sapiens
  light chain complementarity determining region 3 for antibody 4404
QKYGSSPVP

SEQ ID NO: 8808 - protein, 18 aa, Homo sapiens
  heavy chain complementarity determining region 3 for antibody 4404
ARGDYPEARTGYFLDSDY

SEQ ID NO: 8809 - protein, 9 aa, Homo sapiens
  light chain complementarity determining region 3 for antibody 4405
QKYGSSPVP

SEQ ID NO: 8810 - protein, 18 aa, Homo sapiens
  heavy chain complementarity determining region 3 for antibody 4405
ARGDYPEARTGYFLDFDH

SEQ ID NO: 8811 - protein, 9 aa, Homo sapiens
  light chain complementarity determining region 3 for antibody 4406
QKYGSSPVP

SEQ ID NO: 8812 - protein, 18 aa, Homo sapiens
  heavy chain complementarity determining region 3 for antibody 4406
ARGDYPEARAGYFLDFDY

SEQ ID NO: 8813 - protein, 9 aa, Homo sapiens
  light chain complementarity determining region 3 for antibody 4407
QKYGSSPVP

SEQ ID NO: 8814 - protein, 12 aa, Homo sapiens
  heavy chain complementarity determining region 3 for antibody 4407
AIVVPGRWDLDD

SEQ ID NO: 8815 - protein, 9 aa, Homo sapiens
  light chain complementarity determining region 3 for antibody 4408
QKYGSAPVP

SEQ ID NO: 8816 - protein, 18 aa, Homo sapiens
  heavy chain complementarity determining region 3 for antibody 4408
ARGDYPEARTGYFLDLDY

SEQ ID NO: 8817 - protein, 9 aa, Homo sapiens
  light chain complementarity determining region 3 for antibody 4409
QKYGGSLLT

SEQ ID NO: 8818 - protein, 10 aa, Homo sapiens
  heavy chain complementarity determining region 3 for antibody 4409
CRDRWGFGDV

SEQ ID NO: 8819 - protein, 9 aa, Homo sapiens
  light chain complementarity determining region 3 for antibody 4410
QKYGDSPVP

SEQ ID NO: 8820 - protein, 18 aa, Homo sapiens
  heavy chain complementarity determining region 3 for antibody 4410
ARGDCPEGRTGYFLDFDY

SEQ ID NO: 8821 - protein, 9 aa, Homo sapiens
  light chain complementarity determining region 3 for antibody 4411
QKYGDSPVP

SEQ ID NO: 8822 - protein, 18 aa, Homo sapiens
  heavy chain complementarity determining region 3 for antibody 4411
AGGDYPEGRTGYFLDFDY

SEQ ID NO: 8823 - protein, 9 aa, Homo sapiens
  light chain complementarity determining region 3 for antibody 4412
QKSYNPPLT

SEQ ID NO: 8824 - protein, 11 aa, Homo sapiens
  heavy chain complementarity determining region 3 for antibody 4412
ARGGTLAWFDP

SEQ ID NO: 8825 - protein, 10 aa, Homo sapiens
  light chain complementarity determining region 3 for antibody 4413
QKSYGAPPYT

SEQ ID NO: 8826 - protein, 13 aa, Homo sapiens
  heavy chain complementarity determining region 3 for antibody 4413
TREGDSSGPDFHL

SEQ ID NO: 8827 - protein, 9 aa, Homo sapiens
  light chain complementarity determining region 3 for antibody 4414
QKRSTWPGS

SEQ ID NO: 8828 - protein, 13 aa, Homo sapiens
  heavy chain complementarity determining region 3 for antibody 4414
ATGAWGSSWWGDY

SEQ ID NO: 8829 - protein, 9 aa, Homo sapiens
  light chain complementarity determining region 3 for antibody 4415
QKNNSAFLT

SEQ ID NO: 8830 - protein, 18 aa, Homo sapiens
  heavy chain complementarity determining region 3 for antibody 4415
ARWAGSCSGRSCYAPFDF

SEQ ID NO: 8831 - protein, 9 aa, Homo sapiens
  light chain complementarity determining region 3 for antibody 4416
QKNKHVPWT

SEQ ID NO: 8832 - protein, 10 aa, Homo sapiens
  heavy chain complementarity determining region 3 for antibody 4416
ARERSGSYDI

SEQ ID NO: 8833 - protein, 9 aa, Homo sapiens
  light chain complementarity determining region 3 for antibody 4417
QKLYRYPIT

SEQ ID NO: 8834 - protein, 14 aa, Homo sapiens
  heavy chain complementarity determining region 3 for antibody 4417
GRDTTHDWSDGGIY

SEQ ID NO: 8835 - protein, 9 aa, Homo sapiens
  light chain complementarity determining region 3 for antibody 4418
QKLNSYPYT

SEQ ID NO: 8836 - protein, 14 aa, Homo sapiens
  heavy chain complementarity determining region 3 for antibody 4418
ARGHFDSTGFRLDY

SEQ ID NO: 8837 - protein, 9 aa, Homo sapiens
  light chain complementarity determining region 3 for antibody 4419
QKLNSYPYT

SEQ ID NO: 8838 - protein, 10 aa, Homo sapiens
  heavy chain complementarity determining region 3 for antibody 4419
ARETSGAYDI

SEQ ID NO: 8839 - protein, 9 aa, Homo sapiens
  light chain complementarity determining region 3 for antibody 4420
QKHKSAPFT

SEQ ID NO: 8840 - protein, 13 aa, Homo sapiens
  heavy chain complementarity determining region 3 for antibody 4420
AKEGSSPGPDFEY

SEQ ID NO: 8841 - protein, 9 aa, Homo sapiens
  light chain complementarity determining region 3 for antibody 4421
QKDGDSPVP

SEQ ID NO: 8842 - protein, 18 aa, Homo sapiens
  heavy chain complementarity determining region 3 for antibody 4421
ARGDYPEGRTGYFLDFDY

SEQ ID NO: 8843 - protein, 9 aa, Homo sapiens
  light chain complementarity determining region 3 for antibody 4422
QKAKSFPRT

SEQ ID NO: 8844 - protein, 15 aa, Homo sapiens
  heavy chain complementarity determining region 3 for antibody 4422
AREVGSVTTSWHFDL

SEQ ID NO: 8845 - protein, 10 aa, Homo sapiens
  light chain complementarity determining region 3 for antibody 4423
QHYYSTPPGT

SEQ ID NO: 8846 - protein, 14 aa, Homo sapiens
  heavy chain complementarity determining region 3 for antibody 4423
VSQSRSAVNGGGVY

SEQ ID NO: 8847 - protein, 9 aa, Homo sapiens
  light chain complementarity determining region 3 for antibody 4424
QHYYSSPLT

SEQ ID NO: 8848 - protein, 10 aa, Homo sapiens
  heavy chain complementarity determining region 3 for antibody 4424
ATGGLSGETS

SEQ ID NO: 8849 - protein, 9 aa, Homo sapiens
  light chain complementarity determining region 3 for antibody 4425
QHYYSAPQA

SEQ ID NO: 8850 - protein, 9 aa, Homo sapiens
  heavy chain complementarity determining region 3 for antibody 4425
ARDVWPEDY

SEQ ID NO: 8851 - protein, 9 aa, Homo sapiens
  light chain complementarity determining region 3 for antibody 4426
QHYYSAPIT

SEQ ID NO: 8852 - protein, 14 aa, Homo sapiens
  heavy chain complementarity determining region 3 for antibody 4426
AKGESTSCDYIFDF

SEQ ID NO: 8853 - protein, 9 aa, Homo sapiens
  light chain complementarity determining region 3 for antibody 4427
QHYYGVPIT

SEQ ID NO: 8854 - protein, 8 aa, Homo sapiens
  heavy chain complementarity determining region 3 for antibody 4427
ARDFSLTA

SEQ ID NO: 8855 - protein, 9 aa, Homo sapiens
  light chain complementarity determining region 3 for antibody 4428
QHYYGTPLT

SEQ ID NO: 8856 - protein, 17 aa, Homo sapiens
  heavy chain complementarity determining region 3 for antibody 4428
ATGLGFCGDSSATCDDW

SEQ ID NO: 8857 - protein, 9 aa, Homo sapiens
  light chain complementarity determining region 3 for antibody 4429
QHYSSFSPT

SEQ ID NO: 8858 - protein, 19 aa, Homo sapiens
  heavy chain complementarity determining region 3 for antibody 4429
ARDSRPYSENSGYTRFFDH

SEQ ID NO: 8859 - protein, 7 aa, Homo sapiens
  light chain complementarity determining region 3 for antibody 4430
QHYNSWP

SEQ ID NO: 8860 - protein, 13 aa, Homo sapiens
  heavy chain complementarity determining region 3 for antibody 4430
AKEGSSPGPDFEY

SEQ ID NO: 8861 - protein, 9 aa, Homo sapiens
  light chain complementarity determining region 3 for antibody 4431
QHYNAYPHT

SEQ ID NO: 8862 - protein, 17 aa, Homo sapiens
  heavy chain complementarity determining region 3 for antibody 4431
ARNTMVGTWQRQGNLDH

SEQ ID NO: 8863 - protein, 10 aa, Homo sapiens
  light chain complementarity determining region 3 for antibody 4432
QHYGSSQGIT

SEQ ID NO: 8864 - protein, 17 aa, Homo sapiens
  heavy chain complementarity determining region 3 for antibody 4432
ARGTGSGSGSYYADFDY

SEQ ID NO: 8865 - protein, 8 aa, Homo sapiens
  light chain complementarity determining region 3 for antibody 4433
QHYGGSPT

SEQ ID NO: 8866 - protein, 14 aa, Homo sapiens
  heavy chain complementarity determining region 3 for antibody 4433
SPPTRAARLPIFDY

SEQ ID NO: 8867 - protein, 8 aa, Homo sapiens
  light chain complementarity determining region 3 for antibody 4434
QHYGGSPT

SEQ ID NO: 8868 - protein, 23 aa, Homo sapiens
  heavy chain complementarity determining region 3 for antibody 4434
ARHLPKGGSGVTGTQSLLYYMDV

SEQ ID NO: 8869 - protein, 8 aa, Homo sapiens
  light chain complementarity determining region 3 for antibody 4435
QHYGGSPT

SEQ ID NO: 8870 - protein, 23 aa, Homo sapiens
  heavy chain complementarity determining region 3 for antibody 4435
ARHFPKGGSGVTGTQSLPYYMDV

SEQ ID NO: 8871 - protein, 8 aa, Homo sapiens
  light chain complementarity determining region 3 for antibody 4436
QHYGGSPT

SEQ ID NO: 8872 - protein, 23 aa, Homo sapiens
  heavy chain complementarity determining region 3 for antibody 4436
ARHFPKGGSGVAGTQSLLYYMDV

SEQ ID NO: 8873 - protein, 8 aa, Homo sapiens
  light chain complementarity determining region 3 for antibody 4437
QHYGGSPT

SEQ ID NO: 8874 - protein, 23 aa, Homo sapiens
  heavy chain complementarity determining region 3 for antibody 4437
ARHFPKGGAGVTGTQSLLYYMDV

SEQ ID NO: 8875 - protein, 10 aa, Homo sapiens
  light chain complementarity determining region 3 for antibody 4438
QHYFSTPPGT

SEQ ID NO: 8876 - protein, 13 aa, Homo sapiens
  heavy chain complementarity determining region 3 for antibody 4438
ASLRRDNSGHFNY

SEQ ID NO: 8877 - protein, 10 aa, Homo sapiens
  light chain complementarity determining region 3 for antibody 4439
QHYDYSPPWT

SEQ ID NO: 8878 - protein, 14 aa, Homo sapiens
  heavy chain complementarity determining region 3 for antibody 4439
SHPTRAARLPIFDY

SEQ ID NO: 8879 - protein, 10 aa, Homo sapiens
  light chain complementarity determining region 3 for antibody 4440
QHYDTSPGGT

SEQ ID NO: 8880 - protein, 9 aa, Homo sapiens
  heavy chain complementarity determining region 3 for antibody 4440
VGSSPDFDY

SEQ ID NO: 8881 - protein, 10 aa, Homo sapiens
  light chain complementarity determining region 3 for antibody 4441
QHYDISPPWT

SEQ ID NO: 8882 - protein, 16 aa, Homo sapiens
  heavy chain complementarity determining region 3 for antibody 4441
ASPNTLGRLVGVAFDY

SEQ ID NO: 8883 - protein, 9 aa, Homo sapiens
  light chain complementarity determining region 3 for antibody 4442
QHTYSSPWT

SEQ ID NO: 8884 - protein, 15 aa, Homo sapiens
  heavy chain complementarity determining region 3 for antibody 4442
ARIWTSSTNCRYMDV

SEQ ID NO: 8885 - protein, 9 aa, Homo sapiens
  light chain complementarity determining region 3 for antibody 4443
QHSYSTPST

SEQ ID NO: 8886 - protein, 16 aa, Homo sapiens
  heavy chain complementarity determining region 3 for antibody 4443
ARWFSRSSTGVSYMDV

SEQ ID NO: 8887 - protein, 9 aa, Homo sapiens
  light chain complementarity determining region 3 for antibody 4444
QHSYNTPWT

SEQ ID NO: 8888 - protein, 17 aa, Homo sapiens
  heavy chain complementarity determining region 3 for antibody 4444
ARNTMVHGWQRQGSVDH

SEQ ID NO: 8889 - protein, 7 aa, Homo sapiens
  light chain complementarity determining region 3 for antibody 4445
QHRSNWG

SEQ ID NO: 8890 - protein, 13 aa, Homo sapiens
  heavy chain complementarity determining region 3 for antibody 4445
AKDRGSGWYAWGY

SEQ ID NO: 8891 - protein, 9 aa, Homo sapiens
  light chain complementarity determining region 3 for antibody 4446
QHFNNYLVK

SEQ ID NO: 8892 - protein, 25 aa, Homo sapiens
  heavy chain complementarity determining region 3 for antibody 4446
AREICHTAACYEILWFGQTPYYFDS

SEQ ID NO: 8893 - protein, 9 aa, Homo sapiens
  light chain complementarity determining region 3 for antibody 4447
QHFENFPPT

SEQ ID NO: 8894 - protein, 15 aa, Homo sapiens
  heavy chain complementarity determining region 3 for antibody 4447
ARQSYGSGIYMVFDS

SEQ ID NO: 8895 - protein, 9 aa, Homo sapiens
  light chain complementarity determining region 3 for antibody 4448
QGYATSRGT

SEQ ID NO: 8896 - protein, 12 aa, Homo sapiens
  heavy chain complementarity determining region 3 for antibody 4448
AKAQTYYYAFDV

SEQ ID NO: 8897 - protein, 7 aa, Homo sapiens
  light chain complementarity determining region 3 for antibody 4449
QGNRNWA

SEQ ID NO: 8898 - protein, 20 aa, Homo sapiens
  heavy chain complementarity determining region 3 for antibody 4449
STYLPGDCTCTGCFYWYSDF

SEQ ID NO: 8899 - protein, 9 aa, Homo sapiens
  light chain complementarity determining region 3 for antibody 4450
QEYSTYSRT

SEQ ID NO: 8900 - protein, 15 aa, Homo sapiens
  heavy chain complementarity determining region 3 for antibody 4450
ARDCISANCYLIFDN

SEQ ID NO: 8901 - protein, 9 aa, Homo sapiens
  light chain complementarity determining region 3 for antibody 4451
QEYKTVPWT

SEQ ID NO: 8902 - protein, 10 aa, Homo sapiens
  heavy chain complementarity determining region 3 for antibody 4451
CRDRWGFGDV

SEQ ID NO: 8903 - protein, 9 aa, Homo sapiens
  light chain complementarity determining region 3 for antibody 4452
QEYKTVPWT

SEQ ID NO: 8904 - protein, 20 aa, Homo sapiens
  heavy chain complementarity determining region 3 for antibody 4452
AKEGRGTANYHSAGGGGLDV

SEQ ID NO: 8905 - protein, 9 aa, Homo sapiens
  light chain complementarity determining region 3 for antibody 4453
QEYKTVPWT

SEQ ID NO: 8906 - protein, 20 aa, Homo sapiens
  heavy chain complementarity determining region 3 for antibody 4453
AKDGRGTANYRSAGGGGLDV

SEQ ID NO: 8907 - protein, 9 aa, Homo sapiens
  light chain complementarity determining region 3 for antibody 4454
QEYKTVPWR

SEQ ID NO: 8908 - protein, 20 aa, Homo sapiens
  heavy chain complementarity determining region 3 for antibody 4454
AKDGRGTAFYHGAGGGGLDV

SEQ ID NO: 8909 - protein, 9 aa, Homo sapiens
  light chain complementarity determining region 3 for antibody 4455
QEYKTVPRT

SEQ ID NO: 8910 - protein, 20 aa, Homo sapiens
  heavy chain complementarity determining region 3 for antibody 4455
AKDGRGTAFYHGAGGGGLDV

SEQ ID NO: 8911 - protein, 9 aa, Homo sapiens
  light chain complementarity determining region 3 for antibody 4456
QEYGSSPVP

SEQ ID NO: 8912 - protein, 18 aa, Homo sapiens
  heavy chain complementarity determining region 3 for antibody 4456
ARGDYPEARTGYFLDFDY

SEQ ID NO: 8913 - protein, 10 aa, Homo sapiens
  light chain complementarity determining region 3 for antibody 4457
QESYSTPLFT

SEQ ID NO: 8914 - protein, 16 aa, Homo sapiens
  heavy chain complementarity determining region 3 for antibody 4457
ARDWVGQLRRGHTFDI

SEQ ID NO: 8915 - protein, 9 aa, Homo sapiens
  light chain complementarity determining region 3 for antibody 4458
QERSTWPGS

SEQ ID NO: 8916 - protein, 10 aa, Homo sapiens
  heavy chain complementarity determining region 3 for antibody 4458
CRDREGFGDV

SEQ ID NO: 8917 - protein, 9 aa, Homo sapiens
  light chain complementarity determining region 3 for antibody 4459
QERSTWPGS

SEQ ID NO: 8918 - protein, 13 aa, Homo sapiens
  heavy chain complementarity determining region 3 for antibody 4459
ATGAWGSSWWVDY

SEQ ID NO: 8919 - protein, 9 aa, Homo sapiens
  light chain complementarity determining region 3 for antibody 4460
QERSTWPGS

SEQ ID NO: 8920 - protein, 13 aa, Homo sapiens
  heavy chain complementarity determining region 3 for antibody 4460
ATGAWGSSCWGDY

SEQ ID NO: 8921 - protein, 9 aa, Homo sapiens
  light chain complementarity determining region 3 for antibody 4461
QERSTWPGS

SEQ ID NO: 8922 - protein, 10 aa, Homo sapiens
  heavy chain complementarity determining region 3 for antibody 4461
ARERSGSYDI

SEQ ID NO: 8923 - protein, 9 aa, Homo sapiens
  light chain complementarity determining region 3 for antibody 4462
QERSTWPGA

SEQ ID NO: 8924 - protein, 13 aa, Homo sapiens
  heavy chain complementarity determining region 3 for antibody 4462
ATGAWGSSWWGDY

SEQ ID NO: 8925 - protein, 9 aa, Homo sapiens
  light chain complementarity determining region 3 for antibody 4463
QERSTLPGS

SEQ ID NO: 8926 - protein, 13 aa, Homo sapiens
  heavy chain complementarity determining region 3 for antibody 4463
ATGAWGSSWWGDY

SEQ ID NO: 8927 - protein, 9 aa, Homo sapiens
  light chain complementarity determining region 3 for antibody 4464
QERSTCPGS

SEQ ID NO: 8928 - protein, 13 aa, Homo sapiens
  heavy chain complementarity determining region 3 for antibody 4464
ATGAWGSSWWGDY

SEQ ID NO: 8929 - protein, 9 aa, Homo sapiens
  light chain complementarity determining region 3 for antibody 4465
QENKTVPWT

SEQ ID NO: 8930 - protein, 20 aa, Homo sapiens
  heavy chain complementarity determining region 3 for antibody 4465
AKDGRGTAFYHGAGGGGLDV

SEQ ID NO: 8931 - protein, 9 aa, Homo sapiens
  light chain complementarity determining region 3 for antibody 4466
QEHSTYSRT

SEQ ID NO: 8932 - protein, 15 aa, Homo sapiens
  heavy chain complementarity determining region 3 for antibody 4466
ARDCISTNCYLIFDN

SEQ ID NO: 8933 - protein, 9 aa, Homo sapiens
  light chain complementarity determining region 3 for antibody 4467
QEDSTYSRT

SEQ ID NO: 8934 - protein, 15 aa, Homo sapiens
  heavy chain complementarity determining region 3 for antibody 4467
ARDCISTNCYLIFDN

SEQ ID NO: 8935 - protein, 9 aa, Homo sapiens
  light chain complementarity determining region 3 for antibody 4468
QEDKTVPWA

SEQ ID NO: 8936 - protein, 20 aa, Homo sapiens
  heavy chain complementarity determining region 3 for antibody 4468
AKDGRGTAFYHGAGGGGLDV

SEQ ID NO: 8937 - protein, 7 aa, Homo sapiens
  light chain complementarity determining region 3 for antibody 4469
QCNRNWA

SEQ ID NO: 8938 - protein, 20 aa, Homo sapiens
  heavy chain complementarity determining region 3 for antibody 4469
STYLPGDCTCAGCFYWYSDF

SEQ ID NO: 8939 - protein, 6 aa, Homo sapiens
  light chain complementarity determining region 3 for antibody 4470
QAPFFT

SEQ ID NO: 8940 - protein, 14 aa, Homo sapiens
  heavy chain complementarity determining region 3 for antibody 4470
ARLKEVVGAFYFDI

SEQ ID NO: 8941 - protein, 9 aa, Homo sapiens
  light chain complementarity determining region 3 for antibody 4471
PVYKSAPHT

SEQ ID NO: 8942 - protein, 14 aa, Homo sapiens
  heavy chain complementarity determining region 3 for antibody 4471
CRGWLDPATPHYDF

SEQ ID NO: 8943 - protein, 9 aa, Homo sapiens
  light chain complementarity determining region 3 for antibody 4472
PQYNSYSLT

SEQ ID NO: 8944 - protein, 15 aa, Homo sapiens
  heavy chain complementarity determining region 3 for antibody 4472
ARSMVSGTTDDAFDI

SEQ ID NO: 8945 - protein, 10 aa, Homo sapiens
  light chain complementarity determining region 3 for antibody 4473
PQYDISPPWT

SEQ ID NO: 8946 - protein, 16 aa, Homo sapiens
  heavy chain complementarity determining region 3 for antibody 4473
ASPNTLGRLVGVAFDY

SEQ ID NO: 8947 - protein, 9 aa, Homo sapiens
  light chain complementarity determining region 3 for antibody 4474
PQLNSSPYT

SEQ ID NO: 8948 - protein, 14 aa, Homo sapiens
  heavy chain complementarity determining region 3 for antibody 4474
ARGHFDSTGFRLDY

SEQ ID NO: 8949 - protein, 9 aa, Homo sapiens
  light chain complementarity determining region 3 for antibody 4475
PHFGSATGT

SEQ ID NO: 8950 - protein, 13 aa, Homo sapiens
  heavy chain complementarity determining region 3 for antibody 4475
AKEGSSPGPDFEY

SEQ ID NO: 8951 - protein, 9 aa, Homo sapiens
  light chain complementarity determining region 3 for antibody 4476
MRGTHWPIT

SEQ ID NO: 8952 - protein, 15 aa, Homo sapiens
  heavy chain complementarity determining region 3 for antibody 4476
ARELPQRTYSDGWDH

SEQ ID NO: 8953 - protein, 6 aa, Homo sapiens
  light chain complementarity determining region 3 for antibody 4477
MQYTNW

SEQ ID NO: 8954 - protein, 19 aa, Homo sapiens
  heavy chain complementarity determining region 3 for antibody 4477
ARERVRCRSGICYDATFDI

SEQ ID NO: 8955 - protein, 9 aa, Homo sapiens
  light chain complementarity determining region 3 for antibody 4478
MQYTHRPNT

SEQ ID NO: 8956 - protein, 8 aa, Homo sapiens
  heavy chain complementarity determining region 3 for antibody 4478
AGWGYANY

SEQ ID NO: 8957 - protein, 9 aa, Homo sapiens
  light chain complementarity determining region 3 for antibody 4479
MQYPHRPHT

SEQ ID NO: 8958 - protein, 8 aa, Homo sapiens
  heavy chain complementarity determining region 3 for antibody 4479
AGWGYANY

SEQ ID NO: 8959 - protein, 9 aa, Homo sapiens
  light chain complementarity determining region 3 for antibody 4480
MQYANGPHT

SEQ ID NO: 8960 - protein, 8 aa, Homo sapiens
  heavy chain complementarity determining region 3 for antibody 4480
AGWGYGNY

SEQ ID NO: 8961 - protein, 9 aa, Homo sapiens
  light chain complementarity determining region 3 for antibody 4481
MQYAHGPHT

SEQ ID NO: 8962 - protein, 10 aa, Homo sapiens
  heavy chain complementarity determining region 3 for antibody 4481
ARERSGSYDI

SEQ ID NO: 8963 - protein, 9 aa, Homo sapiens
  light chain complementarity determining region 3 for antibody 4482
MQYAHGPHT

SEQ ID NO: 8964 - protein, 8 aa, Homo sapiens
  heavy chain complementarity determining region 3 for antibody 4482
AGWGYVNY

SEQ ID NO: 8965 - protein, 9 aa, Homo sapiens
  light chain complementarity determining region 3 for antibody 4483
MQYAHGPHT

SEQ ID NO: 8966 - protein, 8 aa, Homo sapiens
  heavy chain complementarity determining region 3 for antibody 4483
AGWGYGDY

SEQ ID NO: 8967 - protein, 9 aa, Homo sapiens
  light chain complementarity determining region 3 for antibody 4484
MQYAHGPHT

SEQ ID NO: 8968 - protein, 8 aa, Homo sapiens
  heavy chain complementarity determining region 3 for antibody 4484
ADWGYGNY

SEQ ID NO: 8969 - protein, 9 aa, Homo sapiens
  light chain complementarity determining region 3 for antibody 4485
MQTVQTQWT

SEQ ID NO: 8970 - protein, 12 aa, Homo sapiens
  heavy chain complementarity determining region 3 for antibody 4485
ARLDWNYRAFDI

SEQ ID NO: 8971 - protein, 9 aa, Homo sapiens
  light chain complementarity determining region 3 for antibody 4486
MQTVQTPWT

SEQ ID NO: 8972 - protein, 10 aa, Homo sapiens
  heavy chain complementarity determining region 3 for antibody 4486
CRDREGFGDV

SEQ ID NO: 8973 - protein, 9 aa, Homo sapiens
  light chain complementarity determining region 3 for antibody 4487
MQTVQTPWT

SEQ ID NO: 8974 - protein, 12 aa, Homo sapiens
  heavy chain complementarity determining region 3 for antibody 4487
ARVDWNYRAFDI

SEQ ID NO: 8975 - protein, 9 aa, Homo sapiens
  light chain complementarity determining region 3 for antibody 4488
MQTVQTPWT

SEQ ID NO: 8976 - protein, 12 aa, Homo sapiens
  heavy chain complementarity determining region 3 for antibody 4488
ARLGWNYRAFDI

SEQ ID NO: 8977 - protein, 9 aa, Homo sapiens
  light chain complementarity determining region 3 for antibody 4489
MQTVQTPWT

SEQ ID NO: 8978 - protein, 12 aa, Homo sapiens
  heavy chain complementarity determining region 3 for antibody 4489
ARLDWNYRALDI

SEQ ID NO: 8979 - protein, 9 aa, Homo sapiens
  light chain complementarity determining region 3 for antibody 4490
MQTVQTPRT

SEQ ID NO: 8980 - protein, 12 aa, Homo sapiens
  heavy chain complementarity determining region 3 for antibody 4490
ARLDWNYRAFDI

SEQ ID NO: 8981 - protein, 9 aa, Homo sapiens
  light chain complementarity determining region 3 for antibody 4491
MQTVQAPWT

SEQ ID NO: 8982 - protein, 12 aa, Homo sapiens
  heavy chain complementarity determining region 3 for antibody 4491
ARLDWNYRAFDI

SEQ ID NO: 8983 - protein, 9 aa, Homo sapiens
  light chain complementarity determining region 3 for antibody 4492
MQTVKTPWT

SEQ ID NO: 8984 - protein, 12 aa, Homo sapiens
  heavy chain complementarity determining region 3 for antibody 4492
ARLDWNYRAFDI

SEQ ID NO: 8985 - protein, 9 aa, Homo sapiens
  light chain complementarity determining region 3 for antibody 4493
MQTLQTTWT

SEQ ID NO: 8986 - protein, 12 aa, Homo sapiens
  heavy chain complementarity determining region 3 for antibody 4493
ARLDWNYRAFDI

SEQ ID NO: 8987 - protein, 9 aa, Homo sapiens
  light chain complementarity determining region 3 for antibody 4494
MQTLQTRWT

SEQ ID NO: 8988 - protein, 12 aa, Homo sapiens
  heavy chain complementarity determining region 3 for antibody 4494
ARLDWNYRAFDI

SEQ ID NO: 8989 - protein, 9 aa, Homo sapiens
  light chain complementarity determining region 3 for antibody 4495
MQTLQTQGT

SEQ ID NO: 8990 - protein, 12 aa, Homo sapiens
  heavy chain complementarity determining region 3 for antibody 4495
ARLDWNYRAFDI

SEQ ID NO: 8991 - protein, 9 aa, Homo sapiens
  light chain complementarity determining region 3 for antibody 4496
MQTLQTPWT

SEQ ID NO: 8992 - protein, 12 aa, Homo sapiens
  heavy chain complementarity determining region 3 for antibody 4496
VRLDWNYRAFDI

SEQ ID NO: 8993 - protein, 9 aa, Homo sapiens
  light chain complementarity determining region 3 for antibody 4497
MQTLQTPWT

SEQ ID NO: 8994 - protein, 12 aa, Homo sapiens
  heavy chain complementarity determining region 3 for antibody 4497
TRLDWNYRAFDI

SEQ ID NO: 8995 - protein, 9 aa, Homo sapiens
  light chain complementarity determining region 3 for antibody 4498
MQTLQTPWT

SEQ ID NO: 8996 - protein, 12 aa, Homo sapiens
  heavy chain complementarity determining region 3 for antibody 4498
SRLDWNYRAFDI

SEQ ID NO: 8997 - protein, 9 aa, Homo sapiens
  light chain complementarity determining region 3 for antibody 4499
MQTLQTPWT

SEQ ID NO: 8998 - protein, 10 aa, Homo sapiens
  heavy chain complementarity determining region 3 for antibody 4499
CRDRGGFGDV

SEQ ID NO: 8999 - protein, 9 aa, Homo sapiens
  light chain complementarity determining region 3 for antibody 4500
MQTLQTPWT

SEQ ID NO: 9000 - protein, 11 aa, Homo sapiens
  heavy chain complementarity determining region 3 for antibody 4500
ATFGQQWRLAH

SEQ ID NO: 9001 - protein, 9 aa, Homo sapiens
  light chain complementarity determining region 3 for antibody 4501
MQTLQTPWT

SEQ ID NO: 9002 - protein, 12 aa, Homo sapiens
  heavy chain complementarity determining region 3 for antibody 4501
ARLDWTYRAFDI

SEQ ID NO: 9003 - protein, 9 aa, Homo sapiens
  light chain complementarity determining region 3 for antibody 4502
MQTLQTPWT

SEQ ID NO: 9004 - protein, 12 aa, Homo sapiens
  heavy chain complementarity determining region 3 for antibody 4502
ARLDWNYRAVDI

SEQ ID NO: 9005 - protein, 9 aa, Homo sapiens
  light chain complementarity determining region 3 for antibody 4503
MQTLQTPWT

SEQ ID NO: 9006 - protein, 12 aa, Homo sapiens
  heavy chain complementarity determining region 3 for antibody 4503
ARLDWNCRAFDI

SEQ ID NO: 9007 - protein, 9 aa, Homo sapiens
  light chain complementarity determining region 3 for antibody 4504
MQTLQTPWT

SEQ ID NO: 9008 - protein, 12 aa, Homo sapiens
  heavy chain complementarity determining region 3 for antibody 4504
ARLDWKYRAFDI

SEQ ID NO: 9009 - protein, 9 aa, Homo sapiens
  light chain complementarity determining region 3 for antibody 4505
MQTLQTPWT

SEQ ID NO: 9010 - protein, 12 aa, Homo sapiens
  heavy chain complementarity determining region 3 for antibody 4505
ARFDWNYRAFDI

SEQ ID NO: 9011 - protein, 9 aa, Homo sapiens
  light chain complementarity determining region 3 for antibody 4506
MQTLQTPVT

SEQ ID NO: 9012 - protein, 11 aa, Homo sapiens
  heavy chain complementarity determining region 3 for antibody 4506
ARHPPYSPFDH

SEQ ID NO: 9013 - protein, 9 aa, Homo sapiens
  light chain complementarity determining region 3 for antibody 4507
MQTLQTPVT

SEQ ID NO: 9014 - protein, 13 aa, Homo sapiens
  heavy chain complementarity determining region 3 for antibody 4507
AKEGSSAGPDFVY

SEQ ID NO: 9015 - protein, 9 aa, Homo sapiens
  light chain complementarity determining region 3 for antibody 4508
MQTLQTPGT

SEQ ID NO: 9016 - protein, 12 aa, Homo sapiens
  heavy chain complementarity determining region 3 for antibody 4508
ARVDWNYRAFDI

SEQ ID NO: 9017 - protein, 9 aa, Homo sapiens
  light chain complementarity determining region 3 for antibody 4509
MQTLQTPGT

SEQ ID NO: 9018 - protein, 12 aa, Homo sapiens
  heavy chain complementarity determining region 3 for antibody 4509
ARLDWNYRAFHI

SEQ ID NO: 9019 - protein, 9 aa, Homo sapiens
  light chain complementarity determining region 3 for antibody 4510
MQTLQTPGP

SEQ ID NO: 9020 - protein, 12 aa, Homo sapiens
  heavy chain complementarity determining region 3 for antibody 4510
ARLDWNYRAFDI

SEQ ID NO: 9021 - protein, 9 aa, Homo sapiens
  light chain complementarity determining region 3 for antibody 4511
MQTLQTPGK

SEQ ID NO: 9022 - protein, 12 aa, Homo sapiens
  heavy chain complementarity determining region 3 for antibody 4511
ARLDWNYRAFDI

SEQ ID NO: 9023 - protein, 9 aa, Homo sapiens
  light chain complementarity determining region 3 for antibody 4512
MQTLQIPGT

SEQ ID NO: 9024 - protein, 12 aa, Homo sapiens
  heavy chain complementarity determining region 3 for antibody 4512
ARLDWNYRAFDI

SEQ ID NO: 9025 - protein, 8 aa, Homo sapiens
  light chain complementarity determining region 3 for antibody 4513
MQTLQGHT

SEQ ID NO: 9026 - protein, 19 aa, Homo sapiens
  heavy chain complementarity determining region 3 for antibody 4513
ARKTAFSLSKGGTYYYMGV

SEQ ID NO: 9027 - protein, 9 aa, Homo sapiens
  light chain complementarity determining region 3 for antibody 4514
MQTLKTPGT

SEQ ID NO: 9028 - protein, 12 aa, Homo sapiens
  heavy chain complementarity determining region 3 for antibody 4514
ARLDWNYRAFDI

SEQ ID NO: 9029 - protein, 9 aa, Homo sapiens
  light chain complementarity determining region 3 for antibody 4515
MQTIQTPGT

SEQ ID NO: 9030 - protein, 12 aa, Homo sapiens
  heavy chain complementarity determining region 3 for antibody 4515
ARLDWNYRAFDI

SEQ ID NO: 9031 - protein, 6 aa, Homo sapiens
  light chain complementarity determining region 3 for antibody 4516
MQSTNW

SEQ ID NO: 9032 - protein, 19 aa, Homo sapiens
  heavy chain complementarity determining region 3 for antibody 4516
ARERVRCRSGICYDAAFDI

SEQ ID NO: 9033 - protein, 6 aa, Homo sapiens
  light chain complementarity determining region 3 for antibody 4517
MQSTNW

SEQ ID NO: 9034 - protein, 19 aa, Homo sapiens
  heavy chain complementarity determining region 3 for antibody 4517
AREGVRCRSGICYDATFDI

SEQ ID NO: 9035 - protein, 9 aa, Homo sapiens
  light chain complementarity determining region 3 for antibody 4518
MQSLQTPLT

SEQ ID NO: 9036 - protein, 10 aa, Homo sapiens
  heavy chain complementarity determining region 3 for antibody 4518
ARERSGSYDI

SEQ ID NO: 9037 - protein, 9 aa, Homo sapiens
  light chain complementarity determining region 3 for antibody 4519
MQPLQTSWT

SEQ ID NO: 9038 - protein, 17 aa, Homo sapiens
  heavy chain complementarity determining region 3 for antibody 4519
ARNTMVGTWQRQGNLDH

SEQ ID NO: 9039 - protein, 9 aa, Homo sapiens
  light chain complementarity determining region 3 for antibody 4520
MQNTHWPWT

SEQ ID NO: 9040 - protein, 16 aa, Homo sapiens
  heavy chain complementarity determining region 3 for antibody 4520
ARGHTLPGERRGGSDF

SEQ ID NO: 9041 - protein, 9 aa, Homo sapiens
  light chain complementarity determining region 3 for antibody 4521
MQNTHWPWT

SEQ ID NO: 9042 - protein, 16 aa, Homo sapiens
  heavy chain complementarity determining region 3 for antibody 4521
ARGHAFPGERRGGSDF

SEQ ID NO: 9043 - protein, 9 aa, Homo sapiens
  light chain complementarity determining region 3 for antibody 4522
MQILQTPWT

SEQ ID NO: 9044 - protein, 12 aa, Homo sapiens
  heavy chain complementarity determining region 3 for antibody 4522
ARLDWNYRAFDI

SEQ ID NO: 9045 - protein, 9 aa, Homo sapiens
  light chain complementarity determining region 3 for antibody 4523
MQGTYWPHT

SEQ ID NO: 9046 - protein, 11 aa, Homo sapiens
  heavy chain complementarity determining region 3 for antibody 4523
ATFGQQWRLAH

SEQ ID NO: 9047 - protein, 9 aa, Homo sapiens
  light chain complementarity determining region 3 for antibody 4524
MQGTWGPYT

SEQ ID NO: 9048 - protein, 11 aa, Homo sapiens
  heavy chain complementarity determining region 3 for antibody 4524
AREGWGTLLDY

SEQ ID NO: 9049 - protein, 9 aa, Homo sapiens
  light chain complementarity determining region 3 for antibody 4525
MQGTPWPWT

SEQ ID NO: 9050 - protein, 12 aa, Homo sapiens
  heavy chain complementarity determining region 3 for antibody 4525
AIVVPGRWDLDD

SEQ ID NO: 9051 - protein, 9 aa, Homo sapiens
  light chain complementarity determining region 3 for antibody 4526
MQGTPWPIT

SEQ ID NO: 9052 - protein, 17 aa, Homo sapiens
  heavy chain complementarity determining region 3 for antibody 4526
ARNTMVGTWQRQGNLDH

SEQ ID NO: 9053 - protein, 9 aa, Homo sapiens
  light chain complementarity determining region 3 for antibody 4527
MQGTHWPYT

SEQ ID NO: 9054 - protein, 15 aa, Homo sapiens
  heavy chain complementarity determining region 3 for antibody 4527
ATLLTWGSRTTNFDY

SEQ ID NO: 9055 - protein, 9 aa, Homo sapiens
  light chain complementarity determining region 3 for antibody 4528
MQGTHWPWT

SEQ ID NO: 9056 - protein, 16 aa, Homo sapiens
  heavy chain complementarity determining region 3 for antibody 4528
VRDLAGFTRGGSTFDY

SEQ ID NO: 9057 - protein, 9 aa, Homo sapiens
  light chain complementarity determining region 3 for antibody 4529
MQGTHWPWT

SEQ ID NO: 9058 - protein, 10 aa, Homo sapiens
  heavy chain complementarity determining region 3 for antibody 4529
CRDREGFGDV

SEQ ID NO: 9059 - protein, 9 aa, Homo sapiens
  light chain complementarity determining region 3 for antibody 4530
MQGTHWPWT

SEQ ID NO: 9060 - protein, 13 aa, Homo sapiens
  heavy chain complementarity determining region 3 for antibody 4530
AKEGSSPGPDFEY

SEQ ID NO: 9061 - protein, 9 aa, Homo sapiens
  light chain complementarity determining region 3 for antibody 4531
MQGTHWPWT

SEQ ID NO: 9062 - protein, 12 aa, Homo sapiens
  heavy chain complementarity determining region 3 for antibody 4531
AIVVPGRWDRDD

SEQ ID NO: 9063 - protein, 9 aa, Homo sapiens
  light chain complementarity determining region 3 for antibody 4532
MQGTHWPWR

SEQ ID NO: 9064 - protein, 16 aa, Homo sapiens
  heavy chain complementarity determining region 3 for antibody 4532
ARGHTNPGERRGGSDF

SEQ ID NO: 9065 - protein, 9 aa, Homo sapiens
  light chain complementarity determining region 3 for antibody 4533
MQGTHWPWP

SEQ ID NO: 9066 - protein, 12 aa, Homo sapiens
  heavy chain complementarity determining region 3 for antibody 4533
AIVVPGRWDLDD

SEQ ID NO: 9067 - protein, 10 aa, Homo sapiens
  light chain complementarity determining region 3 for antibody 4534
MQGTHWPPTT

SEQ ID NO: 9068 - protein, 11 aa, Homo sapiens
  heavy chain complementarity determining region 3 for antibody 4534
AGGGAGTKVDS

SEQ ID NO: 9069 - protein, 9 aa, Homo sapiens
  light chain complementarity determining region 3 for antibody 4535
MQGTHWPPS

SEQ ID NO: 9070 - protein, 11 aa, Homo sapiens
  heavy chain complementarity determining region 3 for antibody 4535
ATFGQQWRLAH

SEQ ID NO: 9071 - protein, 9 aa, Homo sapiens
  light chain complementarity determining region 3 for antibody 4536
MQGTHWPKT

SEQ ID NO: 9072 - protein, 10 aa, Homo sapiens
  heavy chain complementarity determining region 3 for antibody 4536
ARDFREGEVD

SEQ ID NO: 9073 - protein, 9 aa, Homo sapiens
  light chain complementarity determining region 3 for antibody 4537
MQGTHWPIT

SEQ ID NO: 9074 - protein, 16 aa, Homo sapiens
  heavy chain complementarity determining region 3 for antibody 4537
VRDLAGFTRGGSTFDY

SEQ ID NO: 9075 - protein, 9 aa, Homo sapiens
  light chain complementarity determining region 3 for antibody 4538
MQGTHWPIT

SEQ ID NO: 9076 - protein, 17 aa, Homo sapiens
  heavy chain complementarity determining region 3 for antibody 4538
ARNAMVGTWQRQGNLDH

SEQ ID NO: 9077 - protein, 9 aa, Homo sapiens
  light chain complementarity determining region 3 for antibody 4539
MQGTHWPIT

SEQ ID NO: 9078 - protein, 13 aa, Homo sapiens
  heavy chain complementarity determining region 3 for antibody 4539
AKEGSSAGPDFDY

SEQ ID NO: 9079 - protein, 9 aa, Homo sapiens
  light chain complementarity determining region 3 for antibody 4540
MQGTHWPIN

SEQ ID NO: 9080 - protein, 10 aa, Homo sapiens
  heavy chain complementarity determining region 3 for antibody 4540
CRDRWGFGDV

SEQ ID NO: 9081 - protein, 9 aa, Homo sapiens
  light chain complementarity determining region 3 for antibody 4541
MQGTHWPHT

SEQ ID NO: 9082 - protein, 11 aa, Homo sapiens
  heavy chain complementarity determining region 3 for antibody 4541
ATFGISWYFSA

SEQ ID NO: 9083 - protein, 9 aa, Homo sapiens
  light chain complementarity determining region 3 for antibody 4542
MQGTHWPHT

SEQ ID NO: 9084 - protein, 17 aa, Homo sapiens
  heavy chain complementarity determining region 3 for antibody 4542
ARNTMVGTWQRQGNLDH

SEQ ID NO: 9085 - protein, 9 aa, Homo sapiens
  light chain complementarity determining region 3 for antibody 4543
MQGTHWPHT

SEQ ID NO: 9086 - protein, 11 aa, Homo sapiens
  heavy chain complementarity determining region 3 for antibody 4543
ARIVARKPDDY

SEQ ID NO: 9087 - protein, 9 aa, Homo sapiens
  light chain complementarity determining region 3 for antibody 4544
MQGTHWPHT

SEQ ID NO: 9088 - protein, 16 aa, Homo sapiens
  heavy chain complementarity determining region 3 for antibody 4544
ARGHTNPGERRGGSDF

SEQ ID NO: 9089 - protein, 9 aa, Homo sapiens
  light chain complementarity determining region 3 for antibody 4545
MQGTHWPHT

SEQ ID NO: 9090 - protein, 11 aa, Homo sapiens
  heavy chain complementarity determining region 3 for antibody 4545
APFGQQWRLAH

SEQ ID NO: 9091 - protein, 9 aa, Homo sapiens
  light chain complementarity determining region 3 for antibody 4546
MQGTHWPHT

SEQ ID NO: 9092 - protein, 13 aa, Homo sapiens
  heavy chain complementarity determining region 3 for antibody 4546
AKEGSAPGPDFEY

SEQ ID NO: 9093 - protein, 9 aa, Homo sapiens
  light chain complementarity determining region 3 for antibody 4547
MQGTHWPGT

SEQ ID NO: 9094 - protein, 12 aa, Homo sapiens
  heavy chain complementarity determining region 3 for antibody 4547
TRDPDTSSKVDY

SEQ ID NO: 9095 - protein, 9 aa, Homo sapiens
  light chain complementarity determining region 3 for antibody 4548
MQGTHWPDT

SEQ ID NO: 9096 - protein, 11 aa, Homo sapiens
  heavy chain complementarity determining region 3 for antibody 4548
ATFGQQWRLAH

SEQ ID NO: 9097 - protein, 10 aa, Homo sapiens
  light chain complementarity determining region 3 for antibody 4549
MQGTHWPAWT

SEQ ID NO: 9098 - protein, 13 aa, Homo sapiens
  heavy chain complementarity determining region 3 for antibody 4549
VAWVESNTGWLDY

SEQ ID NO: 9099 - protein, 10 aa, Homo sapiens
  light chain complementarity determining region 3 for antibody 4550
MQGTHWPAWT

SEQ ID NO: 9100 - protein, 12 aa, Homo sapiens
  heavy chain complementarity determining region 3 for antibody 4550
ARLDWNYRAFDI

SEQ ID NO: 9101 - protein, 8 aa, Homo sapiens
  light chain complementarity determining region 3 for antibody 4551
MQGTHWPA

SEQ ID NO: 9102 - protein, 12 aa, Homo sapiens
  heavy chain complementarity determining region 3 for antibody 4551
ASVVPGRWDLDD

SEQ ID NO: 9103 - protein, 8 aa, Homo sapiens
  light chain complementarity determining region 3 for antibody 4552
MQGTHWPA

SEQ ID NO: 9104 - protein, 13 aa, Homo sapiens
  heavy chain complementarity determining region 3 for antibody 4552
AKEGSSPGPDFEY

SEQ ID NO: 9105 - protein, 9 aa, Homo sapiens
  light chain complementarity determining region 3 for antibody 4553
MQGTHWLHT

SEQ ID NO: 9106 - protein, 11 aa, Homo sapiens
  heavy chain complementarity determining region 3 for antibody 4553
ATFGQQWRLAH

SEQ ID NO: 9107 - protein, 10 aa, Homo sapiens
  light chain complementarity determining region 3 for antibody 4554
MQGTHGPAWT

SEQ ID NO: 9108 - protein, 12 aa, Homo sapiens
  heavy chain complementarity determining region 3 for antibody 4554
VTWIKTSVWLDY

SEQ ID NO: 9109 - protein, 9 aa, Homo sapiens
  light chain complementarity determining region 3 for antibody 4555
MQGLQTPIT

SEQ ID NO: 9110 - protein, 21 aa, Homo sapiens
  heavy chain complementarity determining region 3 for antibody 4555
ARDPLYCTGGRCYRSGNKFDS

SEQ ID NO: 9111 - protein, 9 aa, Homo sapiens
  light chain complementarity determining region 3 for antibody 4556
MQGLQIPRT

SEQ ID NO: 9112 - protein, 14 aa, Homo sapiens
  heavy chain complementarity determining region 3 for antibody 4556
AREGVLIRQPYRDY

SEQ ID NO: 9113 - protein, 9 aa, Homo sapiens
  light chain complementarity determining region 3 for antibody 4557
MQGLHGLPG

SEQ ID NO: 9114 - protein, 15 aa, Homo sapiens
  heavy chain complementarity determining region 3 for antibody 4557
SRDASADSFPDAFDV

SEQ ID NO: 9115 - protein, 9 aa, Homo sapiens
  light chain complementarity determining region 3 for antibody 4558
MQGKHWPWT

SEQ ID NO: 9116 - protein, 12 aa, Homo sapiens
  heavy chain complementarity determining region 3 for antibody 4558
AIVVPGRWDLDD

SEQ ID NO: 9117 - protein, 9 aa, Homo sapiens
  light chain complementarity determining region 3 for antibody 4559
MQGIHWPGT

SEQ ID NO: 9118 - protein, 14 aa, Homo sapiens
  heavy chain complementarity determining region 3 for antibody 4559
VRDYCSGGTCYSGS

SEQ ID NO: 9119 - protein, 8 aa, Homo sapiens
  light chain complementarity determining region 3 for antibody 4560
MQGAQWPT

SEQ ID NO: 9120 - protein, 13 aa, Homo sapiens
  heavy chain complementarity determining region 3 for antibody 4560
VRGPYYGSAIEDS

SEQ ID NO: 9121 - protein, 9 aa, Homo sapiens
  light chain complementarity determining region 3 for antibody 4561
MQFLQTPRT

SEQ ID NO: 9122 - protein, 10 aa, Homo sapiens
  heavy chain complementarity determining region 3 for antibody 4561
ARERSGSYDI

SEQ ID NO: 9123 - protein, 9 aa, Homo sapiens
  light chain complementarity determining region 3 for antibody 4562
MQFLQTPPP

SEQ ID NO: 9124 - protein, 10 aa, Homo sapiens
  heavy chain complementarity determining region 3 for antibody 4562
ARERSGSYDI

SEQ ID NO: 9125 - protein, 9 aa, Homo sapiens
  light chain complementarity determining region 3 for antibody 4563
MQFLQTPLT

SEQ ID NO: 9126 - protein, 10 aa, Homo sapiens
  heavy chain complementarity determining region 3 for antibody 4563
VRERSGSYDI

SEQ ID NO: 9127 - protein, 9 aa, Homo sapiens
  light chain complementarity determining region 3 for antibody 4564
MQFLQTPLT

SEQ ID NO: 9128 - protein, 11 aa, Homo sapiens
  heavy chain complementarity determining region 3 for antibody 4564
FKGLGGDSTEY

SEQ ID NO: 9129 - protein, 9 aa, Homo sapiens
  light chain complementarity determining region 3 for antibody 4565
MQFLQTPLT

SEQ ID NO: 9130 - protein, 12 aa, Homo sapiens
  heavy chain complementarity determining region 3 for antibody 4565
ARLDWNYRAFDI

SEQ ID NO: 9131 - protein, 9 aa, Homo sapiens
  light chain complementarity determining region 3 for antibody 4566
MQFLQTPLT

SEQ ID NO: 9132 - protein, 13 aa, Homo sapiens
  heavy chain complementarity determining region 3 for antibody 4566
AKEGSSAGPDFDY

SEQ ID NO: 9133 - protein, 9 aa, Homo sapiens
  light chain complementarity determining region 3 for antibody 4567
MQCTHWPHT

SEQ ID NO: 9134 - protein, 11 aa, Homo sapiens
  heavy chain complementarity determining region 3 for antibody 4567
ATFGQQWRLAH

SEQ ID NO: 9135 - protein, 9 aa, Homo sapiens
  light chain complementarity determining region 3 for antibody 4568
MQCLQTPLT

SEQ ID NO: 9136 - protein, 10 aa, Homo sapiens
  heavy chain complementarity determining region 3 for antibody 4568
ARERSGSYDI

SEQ ID NO: 9137 - protein, 9 aa, Homo sapiens
  light chain complementarity determining region 3 for antibody 4569
MQATRWPWT

SEQ ID NO: 9138 - protein, 14 aa, Homo sapiens
  heavy chain complementarity determining region 3 for antibody 4569
VRDYCSGGTCYSGS

SEQ ID NO: 9139 - protein, 9 aa, Homo sapiens
  light chain complementarity determining region 3 for antibody 4570
MQATPWPRT

SEQ ID NO: 9140 - protein, 12 aa, Homo sapiens
  heavy chain complementarity determining region 3 for antibody 4570
STDVETTFPSVS

SEQ ID NO: 9141 - protein, 9 aa, Homo sapiens
  light chain complementarity determining region 3 for antibody 4571
MQATHWPWT

SEQ ID NO: 9142 - protein, 4 aa, Homo sapiens
  heavy chain complementarity determining region 3 for antibody 4571
VRDY

SEQ ID NO: 9143 - protein, 9 aa, Homo sapiens
  light chain complementarity determining region 3 for antibody 4572
MQATHWPRT

SEQ ID NO: 9144 - protein, 9 aa, Homo sapiens
  heavy chain complementarity determining region 3 for antibody 4572
VEGVISLDY

SEQ ID NO: 9145 - protein, 9 aa, Homo sapiens
  light chain complementarity determining region 3 for antibody 4573
MQATHWPRT

SEQ ID NO: 9146 - protein, 11 aa, Homo sapiens
  heavy chain complementarity determining region 3 for antibody 4573
ARDHGRSTLFL

SEQ ID NO: 9147 - protein, 9 aa, Homo sapiens
  light chain complementarity determining region 3 for antibody 4574
MQATHWPRT

SEQ ID NO: 9148 - protein, 12 aa, Homo sapiens
  heavy chain complementarity determining region 3 for antibody 4574
AIVVPGRWDLDD

SEQ ID NO: 9149 - protein, 9 aa, Homo sapiens
  light chain complementarity determining region 3 for antibody 4575
MQATHGPWT

SEQ ID NO: 9150 - protein, 12 aa, Homo sapiens
  heavy chain complementarity determining region 3 for antibody 4575
ARGPLKMAGGSS

SEQ ID NO: 9151 - protein, 9 aa, Homo sapiens
  light chain complementarity determining region 3 for antibody 4576
MQASYWPNT

SEQ ID NO: 9152 - protein, 11 aa, Homo sapiens
  heavy chain complementarity determining region 3 for antibody 4576
ARGEGWNGLEY

SEQ ID NO: 9153 - protein, 9 aa, Homo sapiens
  light chain complementarity determining region 3 for antibody 4577
MQAPHWPRT

SEQ ID NO: 9154 - protein, 12 aa, Homo sapiens
  heavy chain complementarity determining region 3 for antibody 4577
AGSRSWGGSIDY

SEQ ID NO: 9155 - protein, 9 aa, Homo sapiens
  light chain complementarity determining region 3 for antibody 4578
MQALQTPYT

SEQ ID NO: 9156 - protein, 16 aa, Homo sapiens
  heavy chain complementarity determining region 3 for antibody 4578
VRDLAGFTRGGSTFDY

SEQ ID NO: 9157 - protein, 9 aa, Homo sapiens
  light chain complementarity determining region 3 for antibody 4579
MQALQTPYT

SEQ ID NO: 9158 - protein, 10 aa, Homo sapiens
  heavy chain complementarity determining region 3 for antibody 4579
GRDIRAPGDY

SEQ ID NO: 9159 - protein, 9 aa, Homo sapiens
  light chain complementarity determining region 3 for antibody 4580
MQALQTPYT

SEQ ID NO: 9160 - protein, 12 aa, Homo sapiens
  heavy chain complementarity determining region 3 for antibody 4580
ARDKGGRNGMDV

SEQ ID NO: 9161 - protein, 9 aa, Homo sapiens
  light chain complementarity determining region 3 for antibody 4581
MQALQTPYT

SEQ ID NO: 9162 - protein, 11 aa, Homo sapiens
  heavy chain complementarity determining region 3 for antibody 4581
AAFGQQWRLAH

SEQ ID NO: 9163 - protein, 9 aa, Homo sapiens
  light chain complementarity determining region 3 for antibody 4582
MQALQTPNT

SEQ ID NO: 9164 - protein, 11 aa, Homo sapiens
  heavy chain complementarity determining region 3 for antibody 4582
ATFGQQWRLAH

SEQ ID NO: 9165 - protein, 9 aa, Homo sapiens
  light chain complementarity determining region 3 for antibody 4583
MQALQTPLT

SEQ ID NO: 9166 - protein, 17 aa, Homo sapiens
  heavy chain complementarity determining region 3 for antibody 4583
ARNTMVGAWQRQGNLDH

SEQ ID NO: 9167 - protein, 9 aa, Homo sapiens
  light chain complementarity determining region 3 for antibody 4584
MQALQTPGT

SEQ ID NO: 9168 - protein, 17 aa, Homo sapiens
  heavy chain complementarity determining region 3 for antibody 4584
ARAGIEGTTIRMAFFDY

SEQ ID NO: 9169 - protein, 8 aa, Homo sapiens
  light chain complementarity determining region 3 for antibody 4585
MQALQTLT

SEQ ID NO: 9170 - protein, 14 aa, Homo sapiens
  heavy chain complementarity determining region 3 for antibody 4585
ARDTTYNWNDGGIS

SEQ ID NO: 9171 - protein, 9 aa, Homo sapiens
  light chain complementarity determining region 3 for antibody 4586
MQALPTPYT

SEQ ID NO: 9172 - protein, 15 aa, Homo sapiens
  heavy chain complementarity determining region 3 for antibody 4586
ARERRMFGELRGFDV

SEQ ID NO: 9173 - protein, 9 aa, Homo sapiens
  light chain complementarity determining region 3 for antibody 4587
MQALPTPYT

SEQ ID NO: 9174 - protein, 10 aa, Homo sapiens
  heavy chain complementarity determining region 3 for antibody 4587
AKDLSGGGGY

SEQ ID NO: 9175 - protein, 9 aa, Homo sapiens
  light chain complementarity determining region 3 for antibody 4588
MQALLAPPT

SEQ ID NO: 9176 - protein, 10 aa, Homo sapiens
  heavy chain complementarity determining region 3 for antibody 4588
ARHYNWHFDY

SEQ ID NO: 9177 - protein, 9 aa, Homo sapiens
  light chain complementarity determining region 3 for antibody 4589
MQALKTPYT

SEQ ID NO: 9178 - protein, 10 aa, Homo sapiens
  heavy chain complementarity determining region 3 for antibody 4589
AKDLSGGGGY

SEQ ID NO: 9179 - protein, 8 aa, Homo sapiens
  light chain complementarity determining region 3 for antibody 4590
MQALHRRT

SEQ ID NO: 9180 - protein, 8 aa, Homo sapiens
  heavy chain complementarity determining region 3 for antibody 4590
VSQTGQNY

SEQ ID NO: 9181 - protein, 8 aa, Homo sapiens
  light chain complementarity determining region 3 for antibody 4591
MQALHRLT

SEQ ID NO: 9182 - protein, 8 aa, Homo sapiens
  heavy chain complementarity determining region 3 for antibody 4591
VSQTGLNY

SEQ ID NO: 9183 - protein, 9 aa, Homo sapiens
  light chain complementarity determining region 3 for antibody 4592
MPYTHRPHT

SEQ ID NO: 9184 - protein, 8 aa, Homo sapiens
  heavy chain complementarity determining region 3 for antibody 4592
AGWGYANY

SEQ ID NO: 9185 - protein, 9 aa, Homo sapiens
  light chain complementarity determining region 3 for antibody 4593
MHGTHWPWT

SEQ ID NO: 9186 - protein, 16 aa, Homo sapiens
  heavy chain complementarity determining region 3 for antibody 4593
ARGHTNPGERRGGSDF

SEQ ID NO: 9187 - protein, 9 aa, Homo sapiens
  light chain complementarity determining region 3 for antibody 4594
MHGTHWPPS

SEQ ID NO: 9188 - protein, 13 aa, Homo sapiens
  heavy chain complementarity determining region 3 for antibody 4594
ARDTVTNKMGSDY

SEQ ID NO: 9189 - protein, 9 aa, Homo sapiens
  light chain complementarity determining region 3 for antibody 4595
MHGTHWPHT

SEQ ID NO: 9190 - protein, 11 aa, Homo sapiens
  heavy chain complementarity determining region 3 for antibody 4595
ATFGQQWRLAH

SEQ ID NO: 9191 - protein, 8 aa, Homo sapiens
  light chain complementarity determining region 3 for antibody 4596
MAAAQTRT

SEQ ID NO: 9192 - protein, 13 aa, Homo sapiens
  heavy chain complementarity determining region 3 for antibody 4596
NSRYSSGQSTFDY

SEQ ID NO: 9193 - protein, 9 aa, Homo sapiens
  light chain complementarity determining region 3 for antibody 4597
LRDYNHVGT

SEQ ID NO: 9194 - protein, 9 aa, Homo sapiens
  heavy chain complementarity determining region 3 for antibody 4597
GSRRPYFDS

SEQ ID NO: 9195 - protein, 9 aa, Homo sapiens
  light chain complementarity determining region 3 for antibody 4598
LQYYTAPWT

SEQ ID NO: 9196 - protein, 17 aa, Homo sapiens
  heavy chain complementarity determining region 3 for antibody 4598
SRDGRIIWPGAQGSLDS

SEQ ID NO: 9197 - protein, 7 aa, Homo sapiens
  light chain complementarity determining region 3 for antibody 4599
LQYNTWT

SEQ ID NO: 9198 - protein, 12 aa, Homo sapiens
  heavy chain complementarity determining region 3 for antibody 4599
ARDKGGRNGMDV

SEQ ID NO: 9199 - protein, 9 aa, Homo sapiens
  light chain complementarity determining region 3 for antibody 4600
LQYGSPPRT

SEQ ID NO: 9200 - protein, 11 aa, Homo sapiens
  heavy chain complementarity determining region 3 for antibody 4600
TRGRYSVGYDY

SEQ ID NO: 9201 - protein, 9 aa, Homo sapiens
  light chain complementarity determining region 3 for antibody 4601
LQYEHWPHT

SEQ ID NO: 9202 - protein, 15 aa, Homo sapiens
  heavy chain complementarity determining region 3 for antibody 4601
ARVGRPYHNAWYFDN

SEQ ID NO: 9203 - protein, 9 aa, Homo sapiens
  light chain complementarity determining region 3 for antibody 4602
LQYEHWPHT

SEQ ID NO: 9204 - protein, 9 aa, Homo sapiens
  heavy chain complementarity determining region 3 for antibody 4602
AGWGGTSNY

SEQ ID NO: 9205 - protein, 9 aa, Homo sapiens
  light chain complementarity determining region 3 for antibody 4603
LQYDSYPWT

SEQ ID NO: 9206 - protein, 9 aa, Homo sapiens
  heavy chain complementarity determining region 3 for antibody 4603
ARGHCGPDY

SEQ ID NO: 9207 - protein, 9 aa, Homo sapiens
  light chain complementarity determining region 3 for antibody 4604
LQYDSYPCT

SEQ ID NO: 9208 - protein, 9 aa, Homo sapiens
  heavy chain complementarity determining region 3 for antibody 4604
ARGHYGPDY

SEQ ID NO: 9209 - protein, 9 aa, Homo sapiens
  light chain complementarity determining region 3 for antibody 4605
LQYAPWPHT

SEQ ID NO: 9210 - protein, 9 aa, Homo sapiens
  heavy chain complementarity determining region 3 for antibody 4605
AGWGGTSNY

SEQ ID NO: 9211 - protein, 9 aa, Homo sapiens
  light chain complementarity determining region 3 for antibody 4606
LQYAHWPHT

SEQ ID NO: 9212 - protein, 13 aa, Homo sapiens
  heavy chain complementarity determining region 3 for antibody 4606
TREGDSSGPDFHL

SEQ ID NO: 9213 - protein, 9 aa, Homo sapiens
  light chain complementarity determining region 3 for antibody 4607
LQYAHWPHT

SEQ ID NO: 9214 - protein, 15 aa, Homo sapiens
  heavy chain complementarity determining region 3 for antibody 4607
ARVGRTYHNAWYFDN

SEQ ID NO: 9215 - protein, 9 aa, Homo sapiens
  light chain complementarity determining region 3 for antibody 4608
LQYAHWPHT

SEQ ID NO: 9216 - protein, 15 aa, Homo sapiens
  heavy chain complementarity determining region 3 for antibody 4608
ARVGRSYHNAWYFDN

SEQ ID NO: 9217 - protein, 9 aa, Homo sapiens
  light chain complementarity determining region 3 for antibody 4609
LQYAHWPHT

SEQ ID NO: 9218 - protein, 15 aa, Homo sapiens
  heavy chain complementarity determining region 3 for antibody 4609
ARVGRPYHSAWYFDN

SEQ ID NO: 9219 - protein, 9 aa, Homo sapiens
  light chain complementarity determining region 3 for antibody 4610
LQYAHWPHT

SEQ ID NO: 9220 - protein, 15 aa, Homo sapiens
  heavy chain complementarity determining region 3 for antibody 4610
ARVGRPYHNAWYFDT

SEQ ID NO: 9221 - protein, 9 aa, Homo sapiens
  light chain complementarity determining region 3 for antibody 4611
LQYAHWPHT

SEQ ID NO: 9222 - protein, 15 aa, Homo sapiens
  heavy chain complementarity determining region 3 for antibody 4611
ARVGRPYHNAWYFDD

SEQ ID NO: 9223 - protein, 9 aa, Homo sapiens
  light chain complementarity determining region 3 for antibody 4612
LQYAHWPHT

SEQ ID NO: 9224 - protein, 15 aa, Homo sapiens
  heavy chain complementarity determining region 3 for antibody 4612
ARVGRHYHNAWYFDN

SEQ ID NO: 9225 - protein, 9 aa, Homo sapiens
  light chain complementarity determining region 3 for antibody 4613
LQYAHWPHT

SEQ ID NO: 9226 - protein, 12 aa, Homo sapiens
  heavy chain complementarity determining region 3 for antibody 4613
ARLDWNYRAFDI

SEQ ID NO: 9227 - protein, 9 aa, Homo sapiens
  light chain complementarity determining region 3 for antibody 4614
LQYAHWPHT

SEQ ID NO: 9228 - protein, 14 aa, Homo sapiens
  heavy chain complementarity determining region 3 for antibody 4614
ARGHFDSTGFRLDY

SEQ ID NO: 9229 - protein, 9 aa, Homo sapiens
  light chain complementarity determining region 3 for antibody 4615
LQYAHWPHT

SEQ ID NO: 9230 - protein, 15 aa, Homo sapiens
  heavy chain complementarity determining region 3 for antibody 4615
ARGGRPYHNAWYFDN

SEQ ID NO: 9231 - protein, 9 aa, Homo sapiens
  light chain complementarity determining region 3 for antibody 4616
LQYAHWPHT

SEQ ID NO: 9232 - protein, 15 aa, Homo sapiens
  heavy chain complementarity determining region 3 for antibody 4616
ARAGRPYHNAWYFDN

SEQ ID NO: 9233 - protein, 9 aa, Homo sapiens
  light chain complementarity determining region 3 for antibody 4617
LQYAHWPHT

SEQ ID NO: 9234 - protein, 12 aa, Homo sapiens
  heavy chain complementarity determining region 3 for antibody 4617
AIVVPGRWDLDD

SEQ ID NO: 9235 - protein, 9 aa, Homo sapiens
  light chain complementarity determining region 3 for antibody 4618
LQYAHWPHT

SEQ ID NO: 9236 - protein, 8 aa, Homo sapiens
  heavy chain complementarity determining region 3 for antibody 4618
AGWGYGNY

SEQ ID NO: 9237 - protein, 9 aa, Homo sapiens
  light chain complementarity determining region 3 for antibody 4619
LQTVQTPWT

SEQ ID NO: 9238 - protein, 12 aa, Homo sapiens
  heavy chain complementarity determining region 3 for antibody 4619
ARLDWNYRAFDI

SEQ ID NO: 9239 - protein, 9 aa, Homo sapiens
  light chain complementarity determining region 3 for antibody 4620
LQTIHWPWT

SEQ ID NO: 9240 - protein, 11 aa, Homo sapiens
  heavy chain complementarity determining region 3 for antibody 4620
ARDFDGAGYDY

SEQ ID NO: 9241 - protein, 9 aa, Homo sapiens
  light chain complementarity determining region 3 for antibody 4621
LQNYNHVGT

SEQ ID NO: 9242 - protein, 9 aa, Homo sapiens
  heavy chain complementarity determining region 3 for antibody 4621
GSRRPYFDY

SEQ ID NO: 9243 - protein, 9 aa, Homo sapiens
  light chain complementarity determining region 3 for antibody 4622
LQNAHWPHT

SEQ ID NO: 9244 - protein, 15 aa, Homo sapiens
  heavy chain complementarity determining region 3 for antibody 4622
ARVGRPYHNAWYFDN

SEQ ID NO: 9245 - protein, 9 aa, Homo sapiens
  light chain complementarity determining region 3 for antibody 4623
LQHTSYPLT

SEQ ID NO: 9246 - protein, 11 aa, Homo sapiens
  heavy chain complementarity determining region 3 for antibody 4623
VRVSTGWNFDY

SEQ ID NO: 9247 - protein, 11 aa, Homo sapiens
  light chain complementarity determining region 3 for antibody 4624
LQHSSYPPMYT

SEQ ID NO: 9248 - protein, 13 aa, Homo sapiens
  heavy chain complementarity determining region 3 for antibody 4624
AKEGSSPGPDFEY

SEQ ID NO: 9249 - protein, 9 aa, Homo sapiens
  light chain complementarity determining region 3 for antibody 4625
LQHRSYPWM

SEQ ID NO: 9250 - protein, 18 aa, Homo sapiens
  heavy chain complementarity determining region 3 for antibody 4625
VRGPSGAPGAMAYYYLDV

SEQ ID NO: 9251 - protein, 9 aa, Homo sapiens
  light chain complementarity determining region 3 for antibody 4626
LQHNTYPWT

SEQ ID NO: 9252 - protein, 12 aa, Homo sapiens
  heavy chain complementarity determining region 3 for antibody 4626
AGSRSWGGSIDY

SEQ ID NO: 9253 - protein, 9 aa, Homo sapiens
  light chain complementarity determining region 3 for antibody 4627
LQHNSYTLT

SEQ ID NO: 9254 - protein, 11 aa, Homo sapiens
  heavy chain complementarity determining region 3 for antibody 4627
VRVSTGWNFDY

SEQ ID NO: 9255 - protein, 9 aa, Homo sapiens
  light chain complementarity determining region 3 for antibody 4628
LQHNSYPWT

SEQ ID NO: 9256 - protein, 17 aa, Homo sapiens
  heavy chain complementarity determining region 3 for antibody 4628
ARNAMVGTWQRQGNLDH

SEQ ID NO: 9257 - protein, 9 aa, Homo sapiens
  light chain complementarity determining region 3 for antibody 4629
LQHNSYPWT

SEQ ID NO: 9258 - protein, 14 aa, Homo sapiens
  heavy chain complementarity determining region 3 for antibody 4629
ARGHFDSTGFRLDY

SEQ ID NO: 9259 - protein, 9 aa, Homo sapiens
  light chain complementarity determining region 3 for antibody 4630
LQHNSYPWT

SEQ ID NO: 9260 - protein, 12 aa, Homo sapiens
  heavy chain complementarity determining region 3 for antibody 4630
AKKGATTGDFDY

SEQ ID NO: 9261 - protein, 9 aa, Homo sapiens
  light chain complementarity determining region 3 for antibody 4631
LQHNSYPWT

SEQ ID NO: 9262 - protein, 13 aa, Homo sapiens
  heavy chain complementarity determining region 3 for antibody 4631
AKEGASPGPDFDY

SEQ ID NO: 9263 - protein, 11 aa, Homo sapiens
  light chain complementarity determining region 3 for antibody 4632
LQHNSYPPMYT

SEQ ID NO: 9264 - protein, 13 aa, Homo sapiens
  heavy chain complementarity determining region 3 for antibody 4632
AKGGSSPGPDFEY

SEQ ID NO: 9265 - protein, 9 aa, Homo sapiens
  light chain complementarity determining region 3 for antibody 4633
LQHNSYPLT

SEQ ID NO: 9266 - protein, 11 aa, Homo sapiens
  heavy chain complementarity determining region 3 for antibody 4633
VRVSTSWNFDY

SEQ ID NO: 9267 - protein, 9 aa, Homo sapiens
  light chain complementarity determining region 3 for antibody 4634
LQHNSYPLT

SEQ ID NO: 9268 - protein, 11 aa, Homo sapiens
  heavy chain complementarity determining region 3 for antibody 4634
VRVSTGWKFDY

SEQ ID NO: 9269 - protein, 9 aa, Homo sapiens
  light chain complementarity determining region 3 for antibody 4635
LQHNSYPLT

SEQ ID NO: 9270 - protein, 11 aa, Homo sapiens
  heavy chain complementarity determining region 3 for antibody 4635
VRVSTDWNFDY

SEQ ID NO: 9271 - protein, 9 aa, Homo sapiens
  light chain complementarity determining region 3 for antibody 4636
LQHNSYPLT

SEQ ID NO: 9272 - protein, 11 aa, Homo sapiens
  heavy chain complementarity determining region 3 for antibody 4636
TRGGYSVGYDY

SEQ ID NO: 9273 - protein, 9 aa, Homo sapiens
  light chain complementarity determining region 3 for antibody 4637
LQHNSYPLT

SEQ ID NO: 9274 - protein, 11 aa, Homo sapiens
  heavy chain complementarity determining region 3 for antibody 4637
ERVSTGWNFDY

SEQ ID NO: 9275 - protein, 9 aa, Homo sapiens
  light chain complementarity determining region 3 for antibody 4638
LQHNSYPLT

SEQ ID NO: 9276 - protein, 10 aa, Homo sapiens
  heavy chain complementarity determining region 3 for antibody 4638
CSDRWGFGDV

SEQ ID NO: 9277 - protein, 9 aa, Homo sapiens
  light chain complementarity determining region 3 for antibody 4639
LQHNSYPLT

SEQ ID NO: 9278 - protein, 10 aa, Homo sapiens
  heavy chain complementarity determining region 3 for antibody 4639
CRDRWWFGDV

SEQ ID NO: 9279 - protein, 9 aa, Homo sapiens
  light chain complementarity determining region 3 for antibody 4640
LQHNSYPLT

SEQ ID NO: 9280 - protein, 15 aa, Homo sapiens
  heavy chain complementarity determining region 3 for antibody 4640
ARIWTSSPNCRYMDV

SEQ ID NO: 9281 - protein, 9 aa, Homo sapiens
  light chain complementarity determining region 3 for antibody 4641
LQHNSYPLT

SEQ ID NO: 9282 - protein, 10 aa, Homo sapiens
  heavy chain complementarity determining region 3 for antibody 4641
ARERSGSYDI

SEQ ID NO: 9283 - protein, 9 aa, Homo sapiens
  light chain complementarity determining region 3 for antibody 4642
LQHNSYPLT

SEQ ID NO: 9284 - protein, 12 aa, Homo sapiens
  heavy chain complementarity determining region 3 for antibody 4642
ARDKGGRNGMDV

SEQ ID NO: 9285 - protein, 9 aa, Homo sapiens
  light chain complementarity determining region 3 for antibody 4643
LQHNSYPLI

SEQ ID NO: 9286 - protein, 10 aa, Homo sapiens
  heavy chain complementarity determining region 3 for antibody 4643
CRDRWGFGDV

SEQ ID NO: 9287 - protein, 9 aa, Homo sapiens
  light chain complementarity determining region 3 for antibody 4644
LQHNSYPIT

SEQ ID NO: 9288 - protein, 11 aa, Homo sapiens
  heavy chain complementarity determining region 3 for antibody 4644
VRVSTGWNFDY

SEQ ID NO: 9289 - protein, 9 aa, Homo sapiens
  light chain complementarity determining region 3 for antibody 4645
LQHNSNPLT

SEQ ID NO: 9290 - protein, 11 aa, Homo sapiens
  heavy chain complementarity determining region 3 for antibody 4645
VRVSTGWNFDY

SEQ ID NO: 9291 - protein, 9 aa, Homo sapiens
  light chain complementarity determining region 3 for antibody 4646
LQHNNYPPS

SEQ ID NO: 9292 - protein, 11 aa, Homo sapiens
  heavy chain complementarity determining region 3 for antibody 4646
VRVSTGWYFDY

SEQ ID NO: 9293 - protein, 9 aa, Homo sapiens
  light chain complementarity determining region 3 for antibody 4647
LQHDSYPWT

SEQ ID NO: 9294 - protein, 9 aa, Homo sapiens
  heavy chain complementarity determining region 3 for antibody 4647
ARGHYGPDY

SEQ ID NO: 9295 - protein, 9 aa, Homo sapiens
  light chain complementarity determining region 3 for antibody 4648
LQHDSYPLT

SEQ ID NO: 9296 - protein, 11 aa, Homo sapiens
  heavy chain complementarity determining region 3 for antibody 4648
VRVSTGWNFDY

SEQ ID NO: 9297 - protein, 9 aa, Homo sapiens
  light chain complementarity determining region 3 for antibody 4649
LQHDSSPYT

SEQ ID NO: 9298 - protein, 16 aa, Homo sapiens
  heavy chain complementarity determining region 3 for antibody 4649
TSDVRYGSSIWYWGAV

SEQ ID NO: 9299 - protein, 9 aa, Homo sapiens
  light chain complementarity determining region 3 for antibody 4650
LQGYNHVGT

SEQ ID NO: 9300 - protein, 9 aa, Homo sapiens
  heavy chain complementarity determining region 3 for antibody 4650
GSRRPYFDS

SEQ ID NO: 9301 - protein, 9 aa, Homo sapiens
  light chain complementarity determining region 3 for antibody 4651
LQGLQVPFT

SEQ ID NO: 9302 - protein, 11 aa, Homo sapiens
  heavy chain complementarity determining region 3 for antibody 4651
GRDVDYSPPAF

SEQ ID NO: 9303 - protein, 9 aa, Homo sapiens
  light chain complementarity determining region 3 for antibody 4652
LQGLQAPFP

SEQ ID NO: 9304 - protein, 11 aa, Homo sapiens
  heavy chain complementarity determining region 3 for antibody 4652
GRDVDYSTPGF

SEQ ID NO: 9305 - protein, 9 aa, Homo sapiens
  light chain complementarity determining region 3 for antibody 4653
LQFAHWPRT

SEQ ID NO: 9306 - protein, 9 aa, Homo sapiens
  heavy chain complementarity determining region 3 for antibody 4653
AGWGGLSNY

SEQ ID NO: 9307 - protein, 9 aa, Homo sapiens
  light chain complementarity determining region 3 for antibody 4654
LQFAHWPQT

SEQ ID NO: 9308 - protein, 9 aa, Homo sapiens
  heavy chain complementarity determining region 3 for antibody 4654
AGWGGLSNY

SEQ ID NO: 9309 - protein, 9 aa, Homo sapiens
  light chain complementarity determining region 3 for antibody 4655
LQFAHWPHT

SEQ ID NO: 9310 - protein, 12 aa, Homo sapiens
  heavy chain complementarity determining region 3 for antibody 4655
AIVVPGRWDLDD

SEQ ID NO: 9311 - protein, 9 aa, Homo sapiens
  light chain complementarity determining region 3 for antibody 4656
LQFAHWPHT

SEQ ID NO: 9312 - protein, 9 aa, Homo sapiens
  heavy chain complementarity determining region 3 for antibody 4656
AGWGGLSNH

SEQ ID NO: 9313 - protein, 9 aa, Homo sapiens
  light chain complementarity determining region 3 for antibody 4657
LQFAHWPHT

SEQ ID NO: 9314 - protein, 9 aa, Homo sapiens
  heavy chain complementarity determining region 3 for antibody 4657
AGCGGLSNY

SEQ ID NO: 9315 - protein, 9 aa, Homo sapiens
  light chain complementarity determining region 3 for antibody 4658
LQDYTYPFS

SEQ ID NO: 9316 - protein, 16 aa, Homo sapiens
  heavy chain complementarity determining region 3 for antibody 4658
ATDVGDHSDRCTTLDY

SEQ ID NO: 9317 - protein, 9 aa, Homo sapiens
  light chain complementarity determining region 3 for antibody 4659
LQDYSYPLS

SEQ ID NO: 9318 - protein, 16 aa, Homo sapiens
  heavy chain complementarity determining region 3 for antibody 4659
TAEVGDHRDRYVTLDH

SEQ ID NO: 9319 - protein, 9 aa, Homo sapiens
  light chain complementarity determining region 3 for antibody 4660
LQDYSYPLS

SEQ ID NO: 9320 - protein, 16 aa, Homo sapiens
  heavy chain complementarity determining region 3 for antibody 4660
SEDVGDHRDRYVTLDH

SEQ ID NO: 9321 - protein, 9 aa, Homo sapiens
  light chain complementarity determining region 3 for antibody 4661
LQDYSYPLS

SEQ ID NO: 9322 - protein, 16 aa, Homo sapiens
  heavy chain complementarity determining region 3 for antibody 4661
SAGVGDHRDRYVTLDH

SEQ ID NO: 9323 - protein, 9 aa, Homo sapiens
  light chain complementarity determining region 3 for antibody 4662
LQDYNYPRT

SEQ ID NO: 9324 - protein, 18 aa, Homo sapiens
  heavy chain complementarity determining region 3 for antibody 4662
VRDTSVRDGGVWYDTLDV

SEQ ID NO: 9325 - protein, 9 aa, Homo sapiens
  light chain complementarity determining region 3 for antibody 4663
LQDYNHVGT

SEQ ID NO: 9326 - protein, 11 aa, Homo sapiens
  heavy chain complementarity determining region 3 for antibody 4663
VRVSTGWNFDY

SEQ ID NO: 9327 - protein, 9 aa, Homo sapiens
  light chain complementarity determining region 3 for antibody 4664
LQDYNHVGT

SEQ ID NO: 9328 - protein, 9 aa, Homo sapiens
  heavy chain complementarity determining region 3 for antibody 4664
GSRRPYFGS

SEQ ID NO: 9329 - protein, 9 aa, Homo sapiens
  light chain complementarity determining region 3 for antibody 4665
LQDYNHVGT

SEQ ID NO: 9330 - protein, 17 aa, Homo sapiens
  heavy chain complementarity determining region 3 for antibody 4665
AKRLPDLLGGGHHYIDV

SEQ ID NO: 9331 - protein, 9 aa, Homo sapiens
  light chain complementarity determining region 3 for antibody 4666
LQDYNHVGT

SEQ ID NO: 9332 - protein, 12 aa, Homo sapiens
  heavy chain complementarity determining region 3 for antibody 4666
AIVVPGRWDLDD

SEQ ID NO: 9333 - protein, 9 aa, Homo sapiens
  light chain complementarity determining region 3 for antibody 4667
LQDYNHPGT

SEQ ID NO: 9334 - protein, 9 aa, Homo sapiens
  heavy chain complementarity determining region 3 for antibody 4667
ASRRPYLDY

SEQ ID NO: 9335 - protein, 9 aa, Homo sapiens
  light chain complementarity determining region 3 for antibody 4668
LQDYNHGGT

SEQ ID NO: 9336 - protein, 9 aa, Homo sapiens
  heavy chain complementarity determining region 3 for antibody 4668
GSRRPYFDS

SEQ ID NO: 9337 - protein, 9 aa, Homo sapiens
  light chain complementarity determining region 3 for antibody 4669
LQDYNHDGT

SEQ ID NO: 9338 - protein, 9 aa, Homo sapiens
  heavy chain complementarity determining region 3 for antibody 4669
GSRRPYFDS

SEQ ID NO: 9339 - protein, 9 aa, Homo sapiens
  light chain complementarity determining region 3 for antibody 4670
LQDYIYPFS

SEQ ID NO: 9340 - protein, 16 aa, Homo sapiens
  heavy chain complementarity determining region 3 for antibody 4670
FLNDAAPSDIYTTLDY

SEQ ID NO: 9341 - protein, 9 aa, Homo sapiens
  light chain complementarity determining region 3 for antibody 4671
LQDYIYPFS

SEQ ID NO: 9342 - protein, 11 aa, Homo sapiens
  heavy chain complementarity determining region 3 for antibody 4671
ATFGQQWRLAH

SEQ ID NO: 9343 - protein, 9 aa, Homo sapiens
  light chain complementarity determining region 3 for antibody 4672
LQDNSYPST

SEQ ID NO: 9344 - protein, 15 aa, Homo sapiens
  heavy chain complementarity determining region 3 for antibody 4672
TRDEFTGSHIEAFDI

SEQ ID NO: 9345 - protein, 9 aa, Homo sapiens
  light chain complementarity determining region 3 for antibody 4673
LQDHTYPFT

SEQ ID NO: 9346 - protein, 13 aa, Homo sapiens
  heavy chain complementarity determining region 3 for antibody 4673
AGEGPAPGPDFDY

SEQ ID NO: 9347 - protein, 9 aa, Homo sapiens
  light chain complementarity determining region 3 for antibody 4674
LQDHNYPFS

SEQ ID NO: 9348 - protein, 16 aa, Homo sapiens
  heavy chain complementarity determining region 3 for antibody 4674
AADLDDHTDAYASLDS

SEQ ID NO: 9349 - protein, 9 aa, Homo sapiens
  light chain complementarity determining region 3 for antibody 4675
LQDHNYPFA

SEQ ID NO: 9350 - protein, 16 aa, Homo sapiens
  heavy chain complementarity determining region 3 for antibody 4675
AADVGDRIDVYATLDY

SEQ ID NO: 9351 - protein, 9 aa, Homo sapiens
  light chain complementarity determining region 3 for antibody 4676
LQDHKYPFT

SEQ ID NO: 9352 - protein, 10 aa, Homo sapiens
  heavy chain complementarity determining region 3 for antibody 4676
CRDREGFGDV

SEQ ID NO: 9353 - protein, 9 aa, Homo sapiens
  light chain complementarity determining region 3 for antibody 4677
LQDHKYPFT

SEQ ID NO: 9354 - protein, 16 aa, Homo sapiens
  heavy chain complementarity determining region 3 for antibody 4677
AADLGDHSDGYATLDS

SEQ ID NO: 9355 - protein, 9 aa, Homo sapiens
  light chain complementarity determining region 3 for antibody 4678
LQDHKYPFS

SEQ ID NO: 9356 - protein, 16 aa, Homo sapiens
  heavy chain complementarity determining region 3 for antibody 4678
GADLGDHGDAYASLDS

SEQ ID NO: 9357 - protein, 9 aa, Homo sapiens
  light chain complementarity determining region 3 for antibody 4679
LQDHKYPFS

SEQ ID NO: 9358 - protein, 16 aa, Homo sapiens
  heavy chain complementarity determining region 3 for antibody 4679
GADLGDHGDAYAPLDS

SEQ ID NO: 9359 - protein, 9 aa, Homo sapiens
  light chain complementarity determining region 3 for antibody 4680
LQDHKYPFS

SEQ ID NO: 9360 - protein, 16 aa, Homo sapiens
  heavy chain complementarity determining region 3 for antibody 4680
AADLGNHADAYATLDS

SEQ ID NO: 9361 - protein, 9 aa, Homo sapiens
  light chain complementarity determining region 3 for antibody 4681
LQDHKYPFS

SEQ ID NO: 9362 - protein, 16 aa, Homo sapiens
  heavy chain complementarity determining region 3 for antibody 4681
AADLGDHANAYATLDS

SEQ ID NO: 9363 - protein, 9 aa, Homo sapiens
  light chain complementarity determining region 3 for antibody 4682
LQDHKYPFS

SEQ ID NO: 9364 - protein, 16 aa, Homo sapiens
  heavy chain complementarity determining region 3 for antibody 4682
AADLGDHADAYAALDS

SEQ ID NO: 9365 - protein, 9 aa, Homo sapiens
  light chain complementarity determining region 3 for antibody 4683
LQDHKYPFP

SEQ ID NO: 9366 - protein, 16 aa, Homo sapiens
  heavy chain complementarity determining region 3 for antibody 4683
AADLGDHTDAYATLDN

SEQ ID NO: 9367 - protein, 9 aa, Homo sapiens
  light chain complementarity determining region 3 for antibody 4684
LQDHKYPFA

SEQ ID NO: 9368 - protein, 15 aa, Homo sapiens
  heavy chain complementarity determining region 3 for antibody 4684
TTSRRYGGNSFLCDW

SEQ ID NO: 9369 - protein, 9 aa, Homo sapiens
  light chain complementarity determining region 3 for antibody 4685
LQDHIYPFS

SEQ ID NO: 9370 - protein, 16 aa, Homo sapiens
  heavy chain complementarity determining region 3 for antibody 4685
AADLDDHSDAFASLDD

SEQ ID NO: 9371 - protein, 9 aa, Homo sapiens
  light chain complementarity determining region 3 for antibody 4686
LQDFSYPFS

SEQ ID NO: 9372 - protein, 16 aa, Homo sapiens
  heavy chain complementarity determining region 3 for antibody 4686
VTYVGDHRDTYTTLDY

SEQ ID NO: 9373 - protein, 9 aa, Homo sapiens
  light chain complementarity determining region 3 for antibody 4687
LQDFSYPFS

SEQ ID NO: 9374 - protein, 16 aa, Homo sapiens
  heavy chain complementarity determining region 3 for antibody 4687
VTDLGDHRDTYTTLDY

SEQ ID NO: 9375 - protein, 9 aa, Homo sapiens
  light chain complementarity determining region 3 for antibody 4688
LQATHWPRT

SEQ ID NO: 9376 - protein, 17 aa, Homo sapiens
  heavy chain complementarity determining region 3 for antibody 4688
TTADGHNYNYNYYGVDV

SEQ ID NO: 9377 - protein, 9 aa, Homo sapiens
  light chain complementarity determining region 3 for antibody 4689
LQATHWPRP

SEQ ID NO: 9378 - protein, 12 aa, Homo sapiens
  heavy chain complementarity determining region 3 for antibody 4689
STDVETTFPSVS

SEQ ID NO: 9379 - protein, 9 aa, Homo sapiens
  light chain complementarity determining region 3 for antibody 4690
LPYAHWPHT

SEQ ID NO: 9380 - protein, 15 aa, Homo sapiens
  heavy chain complementarity determining region 3 for antibody 4690
ARVGRPYHNAWYFDN

SEQ ID NO: 9381 - protein, 9 aa, Homo sapiens
  light chain complementarity determining region 3 for antibody 4691
LPYAHWPHT

SEQ ID NO: 9382 - protein, 9 aa, Homo sapiens
  heavy chain complementarity determining region 3 for antibody 4691
AGWGGTSNY

SEQ ID NO: 9383 - protein, 9 aa, Homo sapiens
  light chain complementarity determining region 3 for antibody 4692
LHHNSYPLT

SEQ ID NO: 9384 - protein, 11 aa, Homo sapiens
  heavy chain complementarity determining region 3 for antibody 4692
VRVSTGWNFDY

SEQ ID NO: 9385 - protein, 9 aa, Homo sapiens
  light chain complementarity determining region 3 for antibody 4693
LHDYTYPFS

SEQ ID NO: 9386 - protein, 16 aa, Homo sapiens
  heavy chain complementarity determining region 3 for antibody 4693
TADVGDHRDRYTTLDF

SEQ ID NO: 9387 - protein, 9 aa, Homo sapiens
  light chain complementarity determining region 3 for antibody 4694
KQLNSYPYT

SEQ ID NO: 9388 - protein, 14 aa, Homo sapiens
  heavy chain complementarity determining region 3 for antibody 4694
ARGHFDSTGFRLDY

SEQ ID NO: 9389 - protein, 9 aa, Homo sapiens
  light chain complementarity determining region 3 for antibody 4695
IQHNSYPLT

SEQ ID NO: 9390 - protein, 11 aa, Homo sapiens
  heavy chain complementarity determining region 3 for antibody 4695
VRVSTGWNFDY

SEQ ID NO: 9391 - protein, 9 aa, Homo sapiens
  light chain complementarity determining region 3 for antibody 4696
HQYYTSPPP

SEQ ID NO: 9392 - protein, 10 aa, Homo sapiens
  heavy chain complementarity determining region 3 for antibody 4696
AAGSGWLIEY

SEQ ID NO: 9393 - protein, 9 aa, Homo sapiens
  light chain complementarity determining region 3 for antibody 4697
HQYYTFPLT

SEQ ID NO: 9394 - protein, 10 aa, Homo sapiens
  heavy chain complementarity determining region 3 for antibody 4697
AAGSGWLIEY

SEQ ID NO: 9395 - protein, 9 aa, Homo sapiens
  light chain complementarity determining region 3 for antibody 4698
HQYLYSPRT

SEQ ID NO: 9396 - protein, 16 aa, Homo sapiens
  heavy chain complementarity determining region 3 for antibody 4698
SADVGDHRDRYVTLDH

SEQ ID NO: 9397 - protein, 9 aa, Homo sapiens
  light chain complementarity determining region 3 for antibody 4699
HQYGSLPPT

SEQ ID NO: 9398 - protein, 13 aa, Homo sapiens
  heavy chain complementarity determining region 3 for antibody 4699
AKDRASGWYAWGY

SEQ ID NO: 9399 - protein, 9 aa, Homo sapiens
  light chain complementarity determining region 3 for antibody 4700
HQYGSFPHA

SEQ ID NO: 9400 - protein, 12 aa, Homo sapiens
  heavy chain complementarity determining region 3 for antibody 4700
ARYGRELAPPWT

SEQ ID NO: 9401 - protein, 9 aa, Homo sapiens
  light chain complementarity determining region 3 for antibody 4701
HQYAIPPGT

SEQ ID NO: 9402 - protein, 11 aa, Homo sapiens
  heavy chain complementarity determining region 3 for antibody 4701
ARGRDQSKLGY

SEQ ID NO: 9403 - protein, 9 aa, Homo sapiens
  light chain complementarity determining region 3 for antibody 4702
HQTYSSPWT

SEQ ID NO: 9404 - protein, 15 aa, Homo sapiens
  heavy chain complementarity determining region 3 for antibody 4702
ARIWTSSTNCRYMDV

SEQ ID NO: 9405 - protein, 9 aa, Homo sapiens
  light chain complementarity determining region 3 for antibody 4703
HQSSTLPHT

SEQ ID NO: 9406 - protein, 10 aa, Homo sapiens
  heavy chain complementarity determining region 3 for antibody 4703
TTAPDDDRDY

SEQ ID NO: 9407 - protein, 9 aa, Homo sapiens
  light chain complementarity determining region 3 for antibody 4704
HQSSTLPHT

SEQ ID NO: 9408 - protein, 10 aa, Homo sapiens
  heavy chain complementarity determining region 3 for antibody 4704
ARERSGSYDI

SEQ ID NO: 9409 - protein, 9 aa, Homo sapiens
  light chain complementarity determining region 3 for antibody 4705
HQSSNTPLT

SEQ ID NO: 9410 - protein, 16 aa, Homo sapiens
  heavy chain complementarity determining region 3 for antibody 4705
VRDLAGFTRGGSTFDY

SEQ ID NO: 9411 - protein, 9 aa, Homo sapiens
  light chain complementarity determining region 3 for antibody 4706
HQHGTTPGT

SEQ ID NO: 9412 - protein, 18 aa, Homo sapiens
  heavy chain complementarity determining region 3 for antibody 4706
ASWAGYCGGDCFSVSLDY

SEQ ID NO: 9413 - protein, 9 aa, Homo sapiens
  light chain complementarity determining region 3 for antibody 4707
HQFKSYPWA

SEQ ID NO: 9414 - protein, 6 aa, Homo sapiens
  heavy chain complementarity determining region 3 for antibody 4707
ARFGAI

SEQ ID NO: 9415 - protein, 9 aa, Homo sapiens
  light chain complementarity determining region 3 for antibody 4708
HQCGSSPKT

SEQ ID NO: 9416 - protein, 17 aa, Homo sapiens
  heavy chain complementarity determining region 3 for antibody 4708
ARNTMVGTWQRQGNLDH

SEQ ID NO: 9417 - protein, 9 aa, Homo sapiens
  light chain complementarity determining region 3 for antibody 4709
HPFKSYPWA

SEQ ID NO: 9418 - protein, 13 aa, Homo sapiens
  heavy chain complementarity determining region 3 for antibody 4709
AKATVPTGGHFDH

SEQ ID NO: 9419 - protein, 9 aa, Homo sapiens
  light chain complementarity determining region 3 for antibody 4710
HHFGSATGT

SEQ ID NO: 9420 - protein, 13 aa, Homo sapiens
  heavy chain complementarity determining region 3 for antibody 4710
TKEGSSAGPDFVY

SEQ ID NO: 9421 - protein, 9 aa, Homo sapiens
  light chain complementarity determining region 3 for antibody 4711
HHFGSATGT

SEQ ID NO: 9422 - protein, 13 aa, Homo sapiens
  heavy chain complementarity determining region 3 for antibody 4711
SKEGSSPGPDFEY

SEQ ID NO: 9423 - protein, 9 aa, Homo sapiens
  light chain complementarity determining region 3 for antibody 4712
HHFGSATGT

SEQ ID NO: 9424 - protein, 13 aa, Homo sapiens
  heavy chain complementarity determining region 3 for antibody 4712
AKEGSSPGPDCEY

SEQ ID NO: 9425 - protein, 9 aa, Homo sapiens
  light chain complementarity determining region 3 for antibody 4713
HHFGSATGT

SEQ ID NO: 9426 - protein, 13 aa, Homo sapiens
  heavy chain complementarity determining region 3 for antibody 4713
AKEGSPPGPDFEY

SEQ ID NO: 9427 - protein, 9 aa, Homo sapiens
  light chain complementarity determining region 3 for antibody 4714
HHFGSATGT

SEQ ID NO: 9428 - protein, 13 aa, Homo sapiens
  heavy chain complementarity determining region 3 for antibody 4714
AKDGSSPGPDFEY

SEQ ID NO: 9429 - protein, 9 aa, Homo sapiens
  light chain complementarity determining region 3 for antibody 4715
HHFGSATGA

SEQ ID NO: 9430 - protein, 13 aa, Homo sapiens
  heavy chain complementarity determining region 3 for antibody 4715
AKEGSSPGPDFEY

SEQ ID NO: 9431 - protein, 7 aa, Homo sapiens
  light chain complementarity determining region 3 for antibody 4716
HCRDCWV

SEQ ID NO: 9432 - protein, 20 aa, Homo sapiens
  heavy chain complementarity determining region 3 for antibody 4716
ATYLPGDCSCTGRYYWYFNF

SEQ ID NO: 9433 - protein, 7 aa, Homo sapiens
  light chain complementarity determining region 3 for antibody 4717
HCRDCWA

SEQ ID NO: 9434 - protein, 20 aa, Homo sapiens
  heavy chain complementarity determining region 3 for antibody 4717
ATYLPGDCSCTGCYYWYFNF

SEQ ID NO: 9435 - protein, 11 aa, Homo sapiens
  light chain complementarity determining region 3 for antibody 4718
AQYGSSSGSGT

SEQ ID NO: 9436 - protein, 10 aa, Homo sapiens
  heavy chain complementarity determining region 3 for antibody 4718
ARATYWAYDP

SEQ ID NO: 9437 - protein, 9 aa, Homo sapiens
  light chain complementarity determining region 3 for antibody 4719
AQGSYWPAS

SEQ ID NO: 9438 - protein, 10 aa, Homo sapiens
  heavy chain complementarity determining region 3 for antibody 4719
RRDRRGFGDV

SEQ ID NO: 9439 - protein, 9 aa, Homo sapiens
  light chain complementarity determining region 3 for antibody 4720
AQGSYWPAS

SEQ ID NO: 9440 - protein, 10 aa, Homo sapiens
  heavy chain complementarity determining region 3 for antibody 4720
CRGREGFGDV

SEQ ID NO: 9441 - protein, 9 aa, Homo sapiens
  light chain complementarity determining region 3 for antibody 4721
AQGSYWPAS

SEQ ID NO: 9442 - protein, 10 aa, Homo sapiens
  heavy chain complementarity determining region 3 for antibody 4721
CRERWGFGDV

SEQ ID NO: 9443 - protein, 9 aa, Homo sapiens
  light chain complementarity determining region 3 for antibody 4722
AQGSYWPAS

SEQ ID NO: 9444 - protein, 10 aa, Homo sapiens
  heavy chain complementarity determining region 3 for antibody 4722
CRDRERFGDV

SEQ ID NO: 9445 - protein, 9 aa, Homo sapiens
  light chain complementarity determining region 3 for antibody 4723
AQGSYWPAS

SEQ ID NO: 9446 - protein, 10 aa, Homo sapiens
  heavy chain complementarity determining region 3 for antibody 4723
CRDREGSGDV

SEQ ID NO: 9447 - protein, 9 aa, Homo sapiens
  light chain complementarity determining region 3 for antibody 4724
AQGSYWPAS

SEQ ID NO: 9448 - protein, 10 aa, Homo sapiens
  heavy chain complementarity determining region 3 for antibody 4724
CRDREGFGDI

SEQ ID NO: 9449 - protein, 9 aa, Homo sapiens
  light chain complementarity determining region 3 for antibody 4725
AQGSYWPAS

SEQ ID NO: 9450 - protein, 4 aa, Homo sapiens
  heavy chain complementarity determining region 3 for antibody 4725
CRDR

SEQ ID NO: 9451 - protein, 9 aa, Homo sapiens
  light chain complementarity determining region 3 for antibody 4726
AQGSYWPAS

SEQ ID NO: 9452 - protein, 15 aa, Homo sapiens
  heavy chain complementarity determining region 3 for antibody 4726
ARVGRPYHNAWYFDN

SEQ ID NO: 9453 - protein, 9 aa, Homo sapiens
  light chain complementarity determining region 3 for antibody 4727
AQGSYWPAS

SEQ ID NO: 9454 - protein, 9 aa, Homo sapiens
  heavy chain complementarity determining region 3 for antibody 4727
ARSEYQPTY

SEQ ID NO: 9455 - protein, 9 aa, Homo sapiens
  light chain complementarity determining region 3 for antibody 4728
AQGSYWPAP

SEQ ID NO: 9456 - protein, 10 aa, Homo sapiens
  heavy chain complementarity determining region 3 for antibody 4728
CRDRWGFGDV

SEQ ID NO: 9457 - protein, 9 aa, Homo sapiens
  light chain complementarity determining region 3 for antibody 4729
AQGSYWPAA

SEQ ID NO: 9458 - protein, 10 aa, Homo sapiens
  heavy chain complementarity determining region 3 for antibody 4729
CRDRWGFGDV

SEQ ID NO: 9459 - protein, 9 aa, Homo sapiens
  light chain complementarity determining region 3 for antibody 4730
AQGSYWAAS

SEQ ID NO: 9460 - protein, 10 aa, Homo sapiens
  heavy chain complementarity determining region 3 for antibody 4730
CRDREGFGDV

SEQ ID NO: 9461 - protein, 9 aa, Homo sapiens
  light chain complementarity determining region 3 for antibody 4731
AQGSYRPAS

SEQ ID NO: 9462 - protein, 10 aa, Homo sapiens
  heavy chain complementarity determining region 3 for antibody 4731
CRDREGFGDV

SEQ ID NO: 9463 - protein, 9 aa, Homo sapiens
  light chain complementarity determining region 3 for antibody 4732
AQGPYWPAT

SEQ ID NO: 9464 - protein, 13 aa, Homo sapiens
  heavy chain complementarity determining region 3 for antibody 4732
AKEGSSPGPDFEY

SEQ ID NO: 9465 - protein, 9 aa, Homo sapiens
  light chain complementarity determining region 3 for antibody 4733
YQYYTSPLT

SEQ ID NO: 9466 - protein, 10 aa, Homo sapiens
  heavy chain complementarity determining region 3 for antibody 4733
AAGSGWLIEY

SEQ ID NO: 9467 - protein, 9 aa, Homo sapiens
  light chain complementarity determining region 3 for antibody 4734
WQYAHWPHT

SEQ ID NO: 9468 - protein, 9 aa, Homo sapiens
  heavy chain complementarity determining region 3 for antibody 4734
AGWGGTSNY

SEQ ID NO: 9469 - protein, 9 aa, Homo sapiens
  light chain complementarity determining region 3 for antibody 4735
VQHYNHPRT

SEQ ID NO: 9470 - protein, 16 aa, Homo sapiens
  heavy chain complementarity determining region 3 for antibody 4735
SRDTGGSGWSGYGMDL

SEQ ID NO: 9471 - protein, 9 aa, Homo sapiens
  light chain complementarity determining region 3 for antibody 4736
VQGVHWPGT

SEQ ID NO: 9472 - protein, 13 aa, Homo sapiens
  heavy chain complementarity determining region 3 for antibody 4736
ARLDNTVAGVIDY

SEQ ID NO: 9473 - protein, 9 aa, Homo sapiens
  light chain complementarity determining region 3 for antibody 4737
VQGGHWPWT

SEQ ID NO: 9474 - protein, 13 aa, Homo sapiens
  heavy chain complementarity determining region 3 for antibody 4737
ARLDNTVAGVIDY

SEQ ID NO: 9475 - protein, 9 aa, Homo sapiens
  light chain complementarity determining region 3 for antibody 4738
TQGTHWPWT

SEQ ID NO: 9476 - protein, 12 aa, Homo sapiens
  heavy chain complementarity determining region 3 for antibody 4738
AIVVPGRWDLDD

SEQ ID NO: 9477 - protein, 9 aa, Homo sapiens
  light chain complementarity determining region 3 for antibody 4739
TQFLQTPPT

SEQ ID NO: 9478 - protein, 10 aa, Homo sapiens
  heavy chain complementarity determining region 3 for antibody 4739
ARERSGSYDI

SEQ ID NO: 9479 - protein, 9 aa, Homo sapiens
  light chain complementarity determining region 3 for antibody 4740
SQYAHWPHT

SEQ ID NO: 9480 - protein, 15 aa, Homo sapiens
  heavy chain complementarity determining region 3 for antibody 4740
ARVGRPYHNAWYFDN

SEQ ID NO: 9481 - protein, 7 aa, Homo sapiens
  light chain complementarity determining region 3 for antibody 4741
RQYNTWT

SEQ ID NO: 9482 - protein, 12 aa, Homo sapiens
  heavy chain complementarity determining region 3 for antibody 4741
SRDKGGRNGMDV

SEQ ID NO: 9483 - protein, 9 aa, Homo sapiens
  light chain complementarity determining region 3 for antibody 4742
RQYGNTPFT

SEQ ID NO: 9484 - protein, 12 aa, Homo sapiens
  heavy chain complementarity determining region 3 for antibody 4742
NADHGYVDGFDI

SEQ ID NO: 9485 - protein, 9 aa, Homo sapiens
  light chain complementarity determining region 3 for antibody 4743
RQYGNPVYT

SEQ ID NO: 9486 - protein, 11 aa, Homo sapiens
  heavy chain complementarity determining region 3 for antibody 4743
AAVDSWGTLVY

SEQ ID NO: 9487 - protein, 9 aa, Homo sapiens
  light chain complementarity determining region 3 for antibody 4744
RQYDNLLIT

SEQ ID NO: 9488 - protein, 13 aa, Homo sapiens
  heavy chain complementarity determining region 3 for antibody 4744
AKEGSSPGPDFEY

SEQ ID NO: 9489 - protein, 9 aa, Homo sapiens
  light chain complementarity determining region 3 for antibody 4745
RQLNSYPYT

SEQ ID NO: 9490 - protein, 14 aa, Homo sapiens
  heavy chain complementarity determining region 3 for antibody 4745
ARGHFDSTGFRLDY

SEQ ID NO: 9491 - protein, 9 aa, Homo sapiens
  light chain complementarity determining region 3 for antibody 4746
RQGTHWPHT

SEQ ID NO: 9492 - protein, 11 aa, Homo sapiens
  heavy chain complementarity determining region 3 for antibody 4746
ATFGQQWRLAH

SEQ ID NO: 9493 - protein, 9 aa, Homo sapiens
  light chain complementarity determining region 3 for antibody 4747
RQFSDFPRT

SEQ ID NO: 9494 - protein, 9 aa, Homo sapiens
  heavy chain complementarity determining region 3 for antibody 4747
VRGRNNFRY

SEQ ID NO: 9495 - protein, 9 aa, Homo sapiens
  light chain complementarity determining region 3 for antibody 4748
RQALQTPYT

SEQ ID NO: 9496 - protein, 10 aa, Homo sapiens
  heavy chain complementarity determining region 3 for antibody 4748
AKDLSGGGGY

SEQ ID NO: 9497 - protein, 9 aa, Homo sapiens
  light chain complementarity determining region 3 for antibody 4749
RKYGDSPVP

SEQ ID NO: 9498 - protein, 18 aa, Homo sapiens
  heavy chain complementarity determining region 3 for antibody 4749
ARGDYPEARTAYFLDFDY

SEQ ID NO: 9499 - protein, 8 aa, Homo sapiens
  light chain complementarity determining region 3 for antibody 4750
REYGDSFP

SEQ ID NO: 9500 - protein, 16 aa, Homo sapiens
  heavy chain complementarity determining region 3 for antibody 4750
AIWAAVSSGWSGPFDF

SEQ ID NO: 9501 - protein, 9 aa, Homo sapiens
  light chain complementarity determining region 3 for antibody 4751
QVYKSAPHT

SEQ ID NO: 9502 - protein, 9 aa, Homo sapiens
  heavy chain complementarity determining region 3 for antibody 4751
GSRRPYFDS

SEQ ID NO: 9503 - protein, 9 aa, Homo sapiens
  light chain complementarity determining region 3 for antibody 4752
QVYKSAPHT

SEQ ID NO: 9504 - protein, 14 aa, Homo sapiens
  heavy chain complementarity determining region 3 for antibody 4752
CRGWLDPAAPHYDF

SEQ ID NO: 9505 - protein, 9 aa, Homo sapiens
  light chain complementarity determining region 3 for antibody 4753
QVYKSAPHT

SEQ ID NO: 9506 - protein, 14 aa, Homo sapiens
  heavy chain complementarity determining region 3 for antibody 4753
CRGRLDPATPHYDF

SEQ ID NO: 9507 - protein, 9 aa, Homo sapiens
  light chain complementarity determining region 3 for antibody 4754
QVYKSAPHT

SEQ ID NO: 9508 - protein, 13 aa, Homo sapiens
  heavy chain complementarity determining region 3 for antibody 4754
AKEGSSPGPDFDS

SEQ ID NO: 9509 - protein, 9 aa, Homo sapiens
  light chain complementarity determining region 3 for antibody 4755
QVYGTPRGT

SEQ ID NO: 9510 - protein, 15 aa, Homo sapiens
  heavy chain complementarity determining region 3 for antibody 4755
AKPRSNMFAHDAFDI

SEQ ID NO: 9511 - protein, 9 aa, Homo sapiens
  light chain complementarity determining region 3 for antibody 4756
QVYATSRGT

SEQ ID NO: 9512 - protein, 15 aa, Homo sapiens
  heavy chain complementarity determining region 3 for antibody 4756
AKPRSNMFAHDAFDI

SEQ ID NO: 9513 - protein, 9 aa, Homo sapiens
  light chain complementarity determining region 3 for antibody 4757
QVHKSAPHT

SEQ ID NO: 9514 - protein, 14 aa, Homo sapiens
  heavy chain complementarity determining region 3 for antibody 4757
CRGWLDPATPHYDF

SEQ ID NO: 9515 - protein, 9 aa, Homo sapiens
  light chain complementarity determining region 3 for antibody 4758
QTYDTAPFT

SEQ ID NO: 9516 - protein, 10 aa, Homo sapiens
  heavy chain complementarity determining region 3 for antibody 4758
VREGNWNLDY

SEQ ID NO: 9517 - protein, 9 aa, Homo sapiens
  light chain complementarity determining region 3 for antibody 4759
QRYNSYSYT

SEQ ID NO: 9518 - protein, 10 aa, Homo sapiens
  heavy chain complementarity determining region 3 for antibody 4759
ARTRGSLFDY

SEQ ID NO: 9519 - protein, 9 aa, Homo sapiens
  light chain complementarity determining region 3 for antibody 4760
QRYNSYSYT

SEQ ID NO: 9520 - protein, 14 aa, Homo sapiens
  heavy chain complementarity determining region 3 for antibody 4760
ARGHFDSTGFRLDY

SEQ ID NO: 9521 - protein, 9 aa, Homo sapiens
  light chain complementarity determining region 3 for antibody 4761
QRYNSYSST

SEQ ID NO: 9522 - protein, 10 aa, Homo sapiens
  heavy chain complementarity determining region 3 for antibody 4761
ARTRGFLFDY

SEQ ID NO: 9523 - protein, 9 aa, Homo sapiens
  light chain complementarity determining region 3 for antibody 4762
QRYNSYPWT

SEQ ID NO: 9524 - protein, 15 aa, Homo sapiens
  heavy chain complementarity determining region 3 for antibody 4762
GKEGPGSSGWLTGHY

SEQ ID NO: 9525 - protein, 9 aa, Homo sapiens
  light chain complementarity determining region 3 for antibody 4763
QRYKSAPFT

SEQ ID NO: 9526 - protein, 13 aa, Homo sapiens
  heavy chain complementarity determining region 3 for antibody 4763
AKEGSSPGPDFEY

SEQ ID NO: 9527 - protein, 9 aa, Homo sapiens
  light chain complementarity determining region 3 for antibody 4764
QRYGSSTWT

SEQ ID NO: 9528 - protein, 17 aa, Homo sapiens
  heavy chain complementarity determining region 3 for antibody 4764
AKGRGSVAMALIYYLDL

SEQ ID NO: 9529 - protein, 9 aa, Homo sapiens
  light chain complementarity determining region 3 for antibody 4765
QRYGSSPVP

SEQ ID NO: 9530 - protein, 18 aa, Homo sapiens
  heavy chain complementarity determining region 3 for antibody 4765
ARGDYPEARTGYFLDFDY

SEQ ID NO: 9531 - protein, 9 aa, Homo sapiens
  light chain complementarity determining region 3 for antibody 4766
QRYGGSLLT

SEQ ID NO: 9532 - protein, 10 aa, Homo sapiens
  heavy chain complementarity determining region 3 for antibody 4766
CRDRWGFGDV

SEQ ID NO: 9533 - protein, 9 aa, Homo sapiens
  light chain complementarity determining region 3 for antibody 4767
QRYATSPLT

SEQ ID NO: 9534 - protein, 14 aa, Homo sapiens
  heavy chain complementarity determining region 3 for antibody 4767
ARASGGDTDFLIDF

SEQ ID NO: 9535 - protein, 9 aa, Homo sapiens
  light chain complementarity determining region 3 for antibody 4768
QRSYSTPST

SEQ ID NO: 9536 - protein, 16 aa, Homo sapiens
  heavy chain complementarity determining region 3 for antibody 4768
ARWFSRSSTGVSYMDV

SEQ ID NO: 9537 - protein, 9 aa, Homo sapiens
  light chain complementarity determining region 3 for antibody 4769
QRSYSTPRT

SEQ ID NO: 9538 - protein, 11 aa, Homo sapiens
  heavy chain complementarity determining region 3 for antibody 4769
AREQHGQAPDY

SEQ ID NO: 9539 - protein, 9 aa, Homo sapiens
  light chain complementarity determining region 3 for antibody 4770
QRSYSSPRT

SEQ ID NO: 9540 - protein, 12 aa, Homo sapiens
  heavy chain complementarity determining region 3 for antibody 4770
NADHGYVDGFDI

SEQ ID NO: 9541 - protein, 9 aa, Homo sapiens
  light chain complementarity determining region 3 for antibody 4771
QRSYNTPRT

SEQ ID NO: 9542 - protein, 17 aa, Homo sapiens
  heavy chain complementarity determining region 3 for antibody 4771
ARNTMVHGWQRQGSVDH

SEQ ID NO: 9543 - protein, 7 aa, Homo sapiens
  light chain complementarity determining region 3 for antibody 4772
QRNRNWA

SEQ ID NO: 9544 - protein, 20 aa, Homo sapiens
  heavy chain complementarity determining region 3 for antibody 4772
STYLPGDCTCTGCFYWYSDF

SEQ ID NO: 9545 - protein, 9 aa, Homo sapiens
  light chain complementarity determining region 3 for antibody 4773
QRDYNVPWT

SEQ ID NO: 9546 - protein, 14 aa, Homo sapiens
  heavy chain complementarity determining region 3 for antibody 4773
TRDGINTVVRGGDS

SEQ ID NO: 9547 - protein, 9 aa, Homo sapiens
  light chain complementarity determining region 3 for antibody 4774
QQYYTTPVT

SEQ ID NO: 9548 - protein, 11 aa, Homo sapiens
  heavy chain complementarity determining region 3 for antibody 4774
AREQHGQAPDY

SEQ ID NO: 9549 - protein, 9 aa, Homo sapiens
  light chain complementarity determining region 3 for antibody 4775
QQYYTPPYN

SEQ ID NO: 9550 - protein, 10 aa, Homo sapiens
  heavy chain complementarity determining region 3 for antibody 4775
TRSTDAYNDI

SEQ ID NO: 9551 - protein, 9 aa, Homo sapiens
  light chain complementarity determining region 3 for antibody 4776
QQYYTPPDT

SEQ ID NO: 9552 - protein, 10 aa, Homo sapiens
  heavy chain complementarity determining region 3 for antibody 4776
TRSTDAYNDI

SEQ ID NO: 9553 - protein, 9 aa, Homo sapiens
  light chain complementarity determining region 3 for antibody 4777
QQYYTIPFA

SEQ ID NO: 9554 - protein, 14 aa, Homo sapiens
  heavy chain complementarity determining region 3 for antibody 4777
VKGRIASCYSEADY

SEQ ID NO: 9555 - protein, 9 aa, Homo sapiens
  light chain complementarity determining region 3 for antibody 4778
QQYYSYSRT

SEQ ID NO: 9556 - protein, 16 aa, Homo sapiens
  heavy chain complementarity determining region 3 for antibody 4778
VGPHLTYNSGWRYFDY

SEQ ID NO: 9557 - protein, 9 aa, Homo sapiens
  light chain complementarity determining region 3 for antibody 4779
QQYYSYPRG

SEQ ID NO: 9558 - protein, 23 aa, Homo sapiens
  heavy chain complementarity determining region 3 for antibody 4779
ANDLIYCTSTSCLYDANHDAFHI

SEQ ID NO: 9559 - protein, 9 aa, Homo sapiens
  light chain complementarity determining region 3 for antibody 4780
QQYYSTPWT

SEQ ID NO: 9560 - protein, 18 aa, Homo sapiens
  heavy chain complementarity determining region 3 for antibody 4780
ARGLHQWRLGGYFYGLDV

SEQ ID NO: 9561 - protein, 9 aa, Homo sapiens
  light chain complementarity determining region 3 for antibody 4781
QQYYSTPHT

SEQ ID NO: 9562 - protein, 13 aa, Homo sapiens
  heavy chain complementarity determining region 3 for antibody 4781
ATEPYYGSGRGVY

SEQ ID NO: 9563 - protein, 10 aa, Homo sapiens
  light chain complementarity determining region 3 for antibody 4782
QQYYSSPPWA

SEQ ID NO: 9564 - protein, 16 aa, Homo sapiens
  heavy chain complementarity determining region 3 for antibody 4782
ASVNRGDKEFGVPPAL

SEQ ID NO: 9565 - protein, 10 aa, Homo sapiens
  light chain complementarity determining region 3 for antibody 4783
QQYYSSPPWA

SEQ ID NO: 9566 - protein, 16 aa, Homo sapiens
  heavy chain complementarity determining region 3 for antibody 4783
ASLNWGDKEFGVPPAL

SEQ ID NO: 9567 - protein, 10 aa, Homo sapiens
  light chain complementarity determining region 3 for antibody 4784
QQYYSSPPWA

SEQ ID NO: 9568 - protein, 16 aa, Homo sapiens
  heavy chain complementarity determining region 3 for antibody 4784
ASLNRSDKEFGVPPAL

SEQ ID NO: 9569 - protein, 10 aa, Homo sapiens
  light chain complementarity determining region 3 for antibody 4785
QQYYSSPPWA

SEQ ID NO: 9570 - protein, 16 aa, Homo sapiens
  heavy chain complementarity determining region 3 for antibody 4785
ASLNRGDKEFSVPPAL

SEQ ID NO: 9571 - protein, 10 aa, Homo sapiens
  light chain complementarity determining region 3 for antibody 4786
QQYYSSPPWA

SEQ ID NO: 9572 - protein, 16 aa, Homo sapiens
  heavy chain complementarity determining region 3 for antibody 4786
ASLNRGDKEFGGPPAL

SEQ ID NO: 9573 - protein, 10 aa, Homo sapiens
  light chain complementarity determining region 3 for antibody 4787
QQYYSSPPWA

SEQ ID NO: 9574 - protein, 16 aa, Homo sapiens
  heavy chain complementarity determining region 3 for antibody 4787
ASLNQGDKEFGVPPAL

SEQ ID NO: 9575 - protein, 10 aa, Homo sapiens
  light chain complementarity determining region 3 for antibody 4788
QQYYSSPPWA

SEQ ID NO: 9576 - protein, 13 aa, Homo sapiens
  heavy chain complementarity determining region 3 for antibody 4788
AKEGSSPGPDFDY

SEQ ID NO: 9577 - protein, 9 aa, Homo sapiens
  light chain complementarity determining region 3 for antibody 4789
QQYYSSPPT

SEQ ID NO: 9578 - protein, 12 aa, Homo sapiens
  heavy chain complementarity determining region 3 for antibody 4789
AIVVPGRWDLDD

SEQ ID NO: 9579 - protein, 9 aa, Homo sapiens
  light chain complementarity determining region 3 for antibody 4790
QQYYSNPWT

SEQ ID NO: 9580 - protein, 18 aa, Homo sapiens
  heavy chain complementarity determining region 3 for antibody 4790
ARGLHQLRLGGYFYGLDV

SEQ ID NO: 9581 - protein, 9 aa, Homo sapiens
  light chain complementarity determining region 3 for antibody 4791
QQYYSFPPT

SEQ ID NO: 9582 - protein, 16 aa, Homo sapiens
  heavy chain complementarity determining region 3 for antibody 4791
SRDRWGGDTTRRGLDY

SEQ ID NO: 9583 - protein, 9 aa, Homo sapiens
  light chain complementarity determining region 3 for antibody 4792
QQYYSFPPT

SEQ ID NO: 9584 - protein, 21 aa, Homo sapiens
  heavy chain complementarity determining region 3 for antibody 4792
ARDVILMYSSGWTPASDAFDI

SEQ ID NO: 9585 - protein, 9 aa, Homo sapiens
  light chain complementarity determining region 3 for antibody 4793
QQYYSFPPP

SEQ ID NO: 9586 - protein, 13 aa, Homo sapiens
  heavy chain complementarity determining region 3 for antibody 4793
TTGAPDSGSVFDN

SEQ ID NO: 9587 - protein, 9 aa, Homo sapiens
  light chain complementarity determining region 3 for antibody 4794
QQYYSAPLT

SEQ ID NO: 9588 - protein, 11 aa, Homo sapiens
  heavy chain complementarity determining region 3 for antibody 4794
AGDAWLPDFDY

SEQ ID NO: 9589 - protein, 9 aa, Homo sapiens
  light chain complementarity determining region 3 for antibody 4795
QQYYRAPQT

SEQ ID NO: 9590 - protein, 9 aa, Homo sapiens
  heavy chain complementarity determining region 3 for antibody 4795
ARDVWPEDC

SEQ ID NO: 9591 - protein, 9 aa, Homo sapiens
  light chain complementarity determining region 3 for antibody 4796
QQYYRAPIT

SEQ ID NO: 9592 - protein, 18 aa, Homo sapiens
  heavy chain complementarity determining region 3 for antibody 4796
ARDGDTSSWYLLRGHFDP

SEQ ID NO: 9593 - protein, 9 aa, Homo sapiens
  light chain complementarity determining region 3 for antibody 4797
QQYYNTPET

SEQ ID NO: 9594 - protein, 15 aa, Homo sapiens
  heavy chain complementarity determining region 3 for antibody 4797
SRDLFSGSYAYGDDY

SEQ ID NO: 9595 - protein, 10 aa, Homo sapiens
  light chain complementarity determining region 3 for antibody 4798
QQYYNRPPNT

SEQ ID NO: 9596 - protein, 17 aa, Homo sapiens
  heavy chain complementarity determining region 3 for antibody 4798
ARNTMVGTWQRQGNLDH

SEQ ID NO: 9597 - protein, 9 aa, Homo sapiens
  light chain complementarity determining region 3 for antibody 4799
QQYYNIQFT

SEQ ID NO: 9598 - protein, 14 aa, Homo sapiens
  heavy chain complementarity determining region 3 for antibody 4799
AKGRIASCYDASDI

SEQ ID NO: 9599 - protein, 9 aa, Homo sapiens
  light chain complementarity determining region 3 for antibody 4800
QQYYNIPFT

SEQ ID NO: 9600 - protein, 15 aa, Homo sapiens
  heavy chain complementarity determining region 3 for antibody 4800
ARVGRPYHNAWYFDN

SEQ ID NO: 9601 - protein, 9 aa, Homo sapiens
  light chain complementarity determining region 3 for antibody 4801
QQYYNIPFN

SEQ ID NO: 9602 - protein, 14 aa, Homo sapiens
  heavy chain complementarity determining region 3 for antibody 4801
AKGRIASCYDASDI

SEQ ID NO: 9603 - protein, 9 aa, Homo sapiens
  light chain complementarity determining region 3 for antibody 4802
QQYYNAPLP

SEQ ID NO: 9604 - protein, 14 aa, Homo sapiens
  heavy chain complementarity determining region 3 for antibody 4802
ASGSATPGTFLVDF

SEQ ID NO: 9605 - protein, 9 aa, Homo sapiens
  light chain complementarity determining region 3 for antibody 4803
QQYYITPWT

SEQ ID NO: 9606 - protein, 23 aa, Homo sapiens
  heavy chain complementarity determining region 3 for antibody 4803
ARAEEEDVWTDFTGHYYHYYMDV

SEQ ID NO: 9607 - protein, 9 aa, Homo sapiens
  light chain complementarity determining region 3 for antibody 4804
QQYYGYPWT

SEQ ID NO: 9608 - protein, 9 aa, Homo sapiens
  heavy chain complementarity determining region 3 for antibody 4804
AGWGGLSNY

SEQ ID NO: 9609 - protein, 9 aa, Homo sapiens
  light chain complementarity determining region 3 for antibody 4805
QQYYGVPIT

SEQ ID NO: 9610 - protein, 11 aa, Homo sapiens
  heavy chain complementarity determining region 3 for antibody 4805
ARDFDGAGYDY

SEQ ID NO: 9611 - protein, 9 aa, Homo sapiens
  light chain complementarity determining region 3 for antibody 4806
QQYYGSPLP

SEQ ID NO: 9612 - protein, 14 aa, Homo sapiens
  heavy chain complementarity determining region 3 for antibody 4806
AKPTRGPGSFLIDY

SEQ ID NO: 9613 - protein, 9 aa, Homo sapiens
  light chain complementarity determining region 3 for antibody 4807
QQYYGSPFT

SEQ ID NO: 9614 - protein, 14 aa, Homo sapiens
  heavy chain complementarity determining region 3 for antibody 4807
AASYSSGWLEYFQY

SEQ ID NO: 9615 - protein, 9 aa, Homo sapiens
  light chain complementarity determining region 3 for antibody 4808
QQYYGGPIT

SEQ ID NO: 9616 - protein, 8 aa, Homo sapiens
  heavy chain complementarity determining region 3 for antibody 4808
ARDFSLTA

SEQ ID NO: 9617 - protein, 9 aa, Homo sapiens
  light chain complementarity determining region 3 for antibody 4809
QQYYGAPIT

SEQ ID NO: 9618 - protein, 14 aa, Homo sapiens
  heavy chain complementarity determining region 3 for antibody 4809
ARGESPSCDYILDY

SEQ ID NO: 9619 - protein, 9 aa, Homo sapiens
  light chain complementarity determining region 3 for antibody 4810
QQYYDTPFT

SEQ ID NO: 9620 - protein, 12 aa, Homo sapiens
  heavy chain complementarity determining region 3 for antibody 4810
AIVVPGRWDLDD

SEQ ID NO: 9621 - protein, 9 aa, Homo sapiens
  light chain complementarity determining region 3 for antibody 4811
QQYVSSTWT

SEQ ID NO: 9622 - protein, 17 aa, Homo sapiens
  heavy chain complementarity determining region 3 for antibody 4811
AKGRGSVAMALIYYLDL

SEQ ID NO: 9623 - protein, 9 aa, Homo sapiens
  light chain complementarity determining region 3 for antibody 4812
QQYVSSLWA

SEQ ID NO: 9624 - protein, 14 aa, Homo sapiens
  heavy chain complementarity determining region 3 for antibody 4812
ARENWNDVGGWFDP

SEQ ID NO: 9625 - protein, 9 aa, Homo sapiens
  light chain complementarity determining region 3 for antibody 4813
QQYTSYSRT

SEQ ID NO: 9626 - protein, 16 aa, Homo sapiens
  heavy chain complementarity determining region 3 for antibody 4813
VGPHLTYNSGWRYFDY

SEQ ID NO: 9627 - protein, 9 aa, Homo sapiens
  light chain complementarity determining region 3 for antibody 4814
QQYTGTPPT

SEQ ID NO: 9628 - protein, 10 aa, Homo sapiens
  heavy chain complementarity determining region 3 for antibody 4814
ARGLSLRLVL

SEQ ID NO: 9629 - protein, 9 aa, Homo sapiens
  light chain complementarity determining region 3 for antibody 4815
QQYSVPPIT

SEQ ID NO: 9630 - protein, 8 aa, Homo sapiens
  heavy chain complementarity determining region 3 for antibody 4815
ARRNDFDY

SEQ ID NO: 9631 - protein, 9 aa, Homo sapiens
  light chain complementarity determining region 3 for antibody 4816
QQYSTYPRT

SEQ ID NO: 9632 - protein, 10 aa, Homo sapiens
  heavy chain complementarity determining region 3 for antibody 4816
AHRINRAFDI

SEQ ID NO: 9633 - protein, 9 aa, Homo sapiens
  light chain complementarity determining region 3 for antibody 4817
QQYSSYSHT

SEQ ID NO: 9634 - protein, 14 aa, Homo sapiens
  heavy chain complementarity determining region 3 for antibody 4817
ARDVHTTGWTLGGY

SEQ ID NO: 9635 - protein, 9 aa, Homo sapiens
  light chain complementarity determining region 3 for antibody 4818
QQYSSYPLT

SEQ ID NO: 9636 - protein, 23 aa, Homo sapiens
  heavy chain complementarity determining region 3 for antibody 4818
ATGLGYCRGGRCFPDTVAGSYVF

SEQ ID NO: 9637 - protein, 7 aa, Homo sapiens
  light chain complementarity determining region 3 for antibody 4819
QQYSSWT

SEQ ID NO: 9638 - protein, 11 aa, Homo sapiens
  heavy chain complementarity determining region 3 for antibody 4819
VRVSTGWNFDY

SEQ ID NO: 9639 - protein, 7 aa, Homo sapiens
  light chain complementarity determining region 3 for antibody 4820
QQYSSWT

SEQ ID NO: 9640 - protein, 11 aa, Homo sapiens
  heavy chain complementarity determining region 3 for antibody 4820
ARIVARKPDDY

SEQ ID NO: 9641 - protein, 7 aa, Homo sapiens
  light chain complementarity determining region 3 for antibody 4821
QQYSSWT

SEQ ID NO: 9642 - protein, 12 aa, Homo sapiens
  heavy chain complementarity determining region 3 for antibody 4821
AKDKGGRSGMDV

SEQ ID NO: 9643 - protein, 7 aa, Homo sapiens
  light chain complementarity determining region 3 for antibody 4822
QQYSSWT

SEQ ID NO: 9644 - protein, 12 aa, Homo sapiens
  heavy chain complementarity determining region 3 for antibody 4822
AIVVPGRWDIDD

SEQ ID NO: 9645 - protein, 7 aa, Homo sapiens
  light chain complementarity determining region 3 for antibody 4823
QQYSSWT

SEQ ID NO: 9646 - protein, 12 aa, Homo sapiens
  heavy chain complementarity determining region 3 for antibody 4823
AIVVPGRCDLDD

SEQ ID NO: 9647 - protein, 7 aa, Homo sapiens
  light chain complementarity determining region 3 for antibody 4824
QQYSSWT

SEQ ID NO: 9648 - protein, 12 aa, Homo sapiens
  heavy chain complementarity determining region 3 for antibody 4824
AIIVPGRWDLDD

SEQ ID NO: 9649 - protein, 7 aa, Homo sapiens
  light chain complementarity determining region 3 for antibody 4825
QQYSSWP

SEQ ID NO: 9650 - protein, 12 aa, Homo sapiens
  heavy chain complementarity determining region 3 for antibody 4825
VKDRGGRSGMDL

SEQ ID NO: 9651 - protein, 7 aa, Homo sapiens
  light chain complementarity determining region 3 for antibody 4826
QQYSSWP

SEQ ID NO: 9652 - protein, 12 aa, Homo sapiens
  heavy chain complementarity determining region 3 for antibody 4826
AKDRGGRSGMDV

SEQ ID NO: 9653 - protein, 8 aa, Homo sapiens
  light chain complementarity determining region 3 for antibody 4827
QQYSSDST

SEQ ID NO: 9654 - protein, 22 aa, Homo sapiens
  heavy chain complementarity determining region 3 for antibody 4827
ARGTADSSGWHSYLYKYFGLDV

SEQ ID NO: 9655 - protein, 8 aa, Homo sapiens
  light chain complementarity determining region 3 for antibody 4828
QQYSSCCS

SEQ ID NO: 9656 - protein, 15 aa, Homo sapiens
  heavy chain complementarity determining region 3 for antibody 4828
VRGITGTIHPSHFDY

SEQ ID NO: 9657 - protein, 9 aa, Homo sapiens
  light chain complementarity determining region 3 for antibody 4829
QQYSNWPIT

SEQ ID NO: 9658 - protein, 15 aa, Homo sapiens
  heavy chain complementarity determining region 3 for antibody 4829
AKDVFSSGWYNVFDP

SEQ ID NO: 9659 - protein, 9 aa, Homo sapiens
  light chain complementarity determining region 3 for antibody 4830
QQYRTVPWT

SEQ ID NO: 9660 - protein, 13 aa, Homo sapiens
  heavy chain complementarity determining region 3 for antibody 4830
AKGGSSPGPDFDY

SEQ ID NO: 9661 - protein, 9 aa, Homo sapiens
  light chain complementarity determining region 3 for antibody 4831
QQYRTVPWT

SEQ ID NO: 9662 - protein, 13 aa, Homo sapiens
  heavy chain complementarity determining region 3 for antibody 4831
AKEGSSPGPDFEY

SEQ ID NO: 9663 - protein, 9 aa, Homo sapiens
  light chain complementarity determining region 3 for antibody 4832
QQYRSYPLT

SEQ ID NO: 9664 - protein, 23 aa, Homo sapiens
  heavy chain complementarity determining region 3 for antibody 4832
ATGRGYCRGGRCFPDTVAGSYVF

SEQ ID NO: 9665 - protein, 9 aa, Homo sapiens
  light chain complementarity determining region 3 for antibody 4833
QQYRSYPLT

SEQ ID NO: 9666 - protein, 23 aa, Homo sapiens
  heavy chain complementarity determining region 3 for antibody 4833
ATGLGYCRGGRCCPDTVAGSYVF

SEQ ID NO: 9667 - protein, 9 aa, Homo sapiens
  light chain complementarity determining region 3 for antibody 4834
QQYRSYPLT

SEQ ID NO: 9668 - protein, 23 aa, Homo sapiens
  heavy chain complementarity determining region 3 for antibody 4834
AAGLGYCRGGRCFPDTVAGSYVF

SEQ ID NO: 9669 - protein, 9 aa, Homo sapiens
  light chain complementarity determining region 3 for antibody 4835
QQYRIYPWT

SEQ ID NO: 9670 - protein, 13 aa, Homo sapiens
  heavy chain complementarity determining region 3 for antibody 4835
AKEGSSPGPDFDY

SEQ ID NO: 9671 - protein, 9 aa, Homo sapiens
  light chain complementarity determining region 3 for antibody 4836
QQYPNWPGT

SEQ ID NO: 9672 - protein, 11 aa, Homo sapiens
  heavy chain complementarity determining region 3 for antibody 4836
AKGGFYFLTGD

SEQ ID NO: 9673 - protein, 9 aa, Homo sapiens
  light chain complementarity determining region 3 for antibody 4837
QQYNYYPLP

SEQ ID NO: 9674 - protein, 15 aa, Homo sapiens
  heavy chain complementarity determining region 3 for antibody 4837
SRGDYGDFKGVPFDY

SEQ ID NO: 9675 - protein, 7 aa, Homo sapiens
  light chain complementarity determining region 3 for antibody 4838
QQYNTYP

SEQ ID NO: 9676 - protein, 17 aa, Homo sapiens
  heavy chain complementarity determining region 3 for antibody 4838
AKGTGYFDNTGDDAFDS

SEQ ID NO: 9677 - protein, 7 aa, Homo sapiens
  light chain complementarity determining region 3 for antibody 4839
QQYNTWT

SEQ ID NO: 9678 - protein, 12 aa, Homo sapiens
  heavy chain complementarity determining region 3 for antibody 4839
VRDKGGRNGMDV

SEQ ID NO: 9679 - protein, 7 aa, Homo sapiens
  light chain complementarity determining region 3 for antibody 4840
QQYNTWT

SEQ ID NO: 9680 - protein, 9 aa, Homo sapiens
  heavy chain complementarity determining region 3 for antibody 4840
VKGVISLDY

SEQ ID NO: 9681 - protein, 7 aa, Homo sapiens
  light chain complementarity determining region 3 for antibody 4841
QQYNTWT

SEQ ID NO: 9682 - protein, 18 aa, Homo sapiens
  heavy chain complementarity determining region 3 for antibody 4841
TTVLSQLLAGDWHLYFQH

SEQ ID NO: 9683 - protein, 7 aa, Homo sapiens
  light chain complementarity determining region 3 for antibody 4842
QQYNTWT

SEQ ID NO: 9684 - protein, 12 aa, Homo sapiens
  heavy chain complementarity determining region 3 for antibody 4842
NADHGYVDGFDI

SEQ ID NO: 9685 - protein, 7 aa, Homo sapiens
  light chain complementarity determining region 3 for antibody 4843
QQYNTWT

SEQ ID NO: 9686 - protein, 9 aa, Homo sapiens
  heavy chain complementarity determining region 3 for antibody 4843
GSRRPYFDY

SEQ ID NO: 9687 - protein, 7 aa, Homo sapiens
  light chain complementarity determining region 3 for antibody 4844
QQYNTWT

SEQ ID NO: 9688 - protein, 12 aa, Homo sapiens
  heavy chain complementarity determining region 3 for antibody 4844
ERDKGGRNGMDV

SEQ ID NO: 9689 - protein, 7 aa, Homo sapiens
  light chain complementarity determining region 3 for antibody 4845
QQYNTWT

SEQ ID NO: 9690 - protein, 14 aa, Homo sapiens
  heavy chain complementarity determining region 3 for antibody 4845
CRGWLDPATPHYDF

SEQ ID NO: 9691 - protein, 7 aa, Homo sapiens
  light chain complementarity determining region 3 for antibody 4846
QQYNTWT

SEQ ID NO: 9692 - protein, 12 aa, Homo sapiens
  heavy chain complementarity determining region 3 for antibody 4846
ATDKGGRNGMDV

SEQ ID NO: 9693 - protein, 7 aa, Homo sapiens
  light chain complementarity determining region 3 for antibody 4847
QQYNTWT

SEQ ID NO: 9694 - protein, 9 aa, Homo sapiens
  heavy chain complementarity determining region 3 for antibody 4847
ASRRPYLDY

SEQ ID NO: 9695 - protein, 7 aa, Homo sapiens
  light chain complementarity determining region 3 for antibody 4848
QQYNTWT

SEQ ID NO: 9696 - protein, 10 aa, Homo sapiens
  heavy chain complementarity determining region 3 for antibody 4848
ARTRGFLFDY

SEQ ID NO: 9697 - protein, 7 aa, Homo sapiens
  light chain complementarity determining region 3 for antibody 4849
QQYNTWT

SEQ ID NO: 9698 - protein, 12 aa, Homo sapiens
  heavy chain complementarity determining region 3 for antibody 4849
ARHKGGRNGMDV

SEQ ID NO: 9699 - protein, 7 aa, Homo sapiens
  light chain complementarity determining region 3 for antibody 4850
QQYNTWT

SEQ ID NO: 9700 - protein, 10 aa, Homo sapiens
  heavy chain complementarity determining region 3 for antibody 4850
ARETSGAYDI

SEQ ID NO: 9701 - protein, 7 aa, Homo sapiens
  light chain complementarity determining region 3 for antibody 4851
QQYNTWT

SEQ ID NO: 9702 - protein, 12 aa, Homo sapiens
  heavy chain complementarity determining region 3 for antibody 4851
ARDKSGRNGMDV

SEQ ID NO: 9703 - protein, 7 aa, Homo sapiens
  light chain complementarity determining region 3 for antibody 4852
QQYNTWT

SEQ ID NO: 9704 - protein, 12 aa, Homo sapiens
  heavy chain complementarity determining region 3 for antibody 4852
ARDKGRRNGMDV

SEQ ID NO: 9705 - protein, 7 aa, Homo sapiens
  light chain complementarity determining region 3 for antibody 4853
QQYNTWT

SEQ ID NO: 9706 - protein, 12 aa, Homo sapiens
  heavy chain complementarity determining region 3 for antibody 4853
ARDKGGRTGMDV

SEQ ID NO: 9707 - protein, 7 aa, Homo sapiens
  light chain complementarity determining region 3 for antibody 4854
QQYNTWT

SEQ ID NO: 9708 - protein, 12 aa, Homo sapiens
  heavy chain complementarity determining region 3 for antibody 4854
ARDIGGRNGMDV

SEQ ID NO: 9709 - protein, 7 aa, Homo sapiens
  light chain complementarity determining region 3 for antibody 4855
QQYNTWT

SEQ ID NO: 9710 - protein, 14 aa, Homo sapiens
  heavy chain complementarity determining region 3 for antibody 4855
AKHTHNWYLGVLDC

SEQ ID NO: 9711 - protein, 7 aa, Homo sapiens
  light chain complementarity determining region 3 for antibody 4856
QQYNTWT

SEQ ID NO: 9712 - protein, 17 aa, Homo sapiens
  heavy chain complementarity determining region 3 for antibody 4856
AKGRGSVAMALIYYLDL

SEQ ID NO: 9713 - protein, 7 aa, Homo sapiens
  light chain complementarity determining region 3 for antibody 4857
QQYNTWT

SEQ ID NO: 9714 - protein, 13 aa, Homo sapiens
  heavy chain complementarity determining region 3 for antibody 4857
AKEGSSPGPDFDS

SEQ ID NO: 9715 - protein, 7 aa, Homo sapiens
  light chain complementarity determining region 3 for antibody 4858
QQYNTWT

SEQ ID NO: 9716 - protein, 13 aa, Homo sapiens
  heavy chain complementarity determining region 3 for antibody 4858
AKEGSAPGPDFEY

SEQ ID NO: 9717 - protein, 7 aa, Homo sapiens
  light chain complementarity determining region 3 for antibody 4859
QQYNTWT

SEQ ID NO: 9718 - protein, 12 aa, Homo sapiens
  heavy chain complementarity determining region 3 for antibody 4859
AKDKGGRSGMDV

SEQ ID NO: 9719 - protein, 7 aa, Homo sapiens
  light chain complementarity determining region 3 for antibody 4860
QQYNTWT

SEQ ID NO: 9720 - protein, 8 aa, Homo sapiens
  heavy chain complementarity determining region 3 for antibody 4860
AGWGYGNY

SEQ ID NO: 9721 - protein, 7 aa, Homo sapiens
  light chain complementarity determining region 3 for antibody 4861
QQYNTWT

SEQ ID NO: 9722 - protein, 16 aa, Homo sapiens
  heavy chain complementarity determining region 3 for antibody 4861
AADLGDHADAYATLDS

SEQ ID NO: 9723 - protein, 7 aa, Homo sapiens
  light chain complementarity determining region 3 for antibody 4862
QQYNTWP

SEQ ID NO: 9724 - protein, 10 aa, Homo sapiens
  heavy chain complementarity determining region 3 for antibody 4862
ARGGLAGDIQ

SEQ ID NO: 9725 - protein, 8 aa, Homo sapiens
  light chain complementarity determining region 3 for antibody 4863
QQYNTFYS

SEQ ID NO: 9726 - protein, 10 aa, Homo sapiens
  heavy chain complementarity determining region 3 for antibody 4863
VYDCWSPRHY

SEQ ID NO: 9727 - protein, 9 aa, Homo sapiens
  light chain complementarity determining region 3 for antibody 4864
QQYNSYSWT

SEQ ID NO: 9728 - protein, 18 aa, Homo sapiens
  heavy chain complementarity determining region 3 for antibody 4864
AKECCYFDSTSHPNWFDP

SEQ ID NO: 9729 - protein, 9 aa, Homo sapiens
  light chain complementarity determining region 3 for antibody 4865
QQYNSYSRT

SEQ ID NO: 9730 - protein, 16 aa, Homo sapiens
  heavy chain complementarity determining region 3 for antibody 4865
VRDLAGFTRGGSTFDY

SEQ ID NO: 9731 - protein, 9 aa, Homo sapiens
  light chain complementarity determining region 3 for antibody 4866
QQYNSYSRT

SEQ ID NO: 9732 - protein, 16 aa, Homo sapiens
  heavy chain complementarity determining region 3 for antibody 4866
VGPHLTYNSGWRYFGY

SEQ ID NO: 9733 - protein, 9 aa, Homo sapiens
  light chain complementarity determining region 3 for antibody 4867
QQYNSYSRT

SEQ ID NO: 9734 - protein, 16 aa, Homo sapiens
  heavy chain complementarity determining region 3 for antibody 4867
VGPHLTYNSGWRCFDY

SEQ ID NO: 9735 - protein, 9 aa, Homo sapiens
  light chain complementarity determining region 3 for antibody 4868
QQYNSYSRT

SEQ ID NO: 9736 - protein, 16 aa, Homo sapiens
  heavy chain complementarity determining region 3 for antibody 4868
VGPHLTYNRGWRYFDY

SEQ ID NO: 9737 - protein, 9 aa, Homo sapiens
  light chain complementarity determining region 3 for antibody 4869
QQYNSYSRT

SEQ ID NO: 9738 - protein, 16 aa, Homo sapiens
  heavy chain complementarity determining region 3 for antibody 4869
VGPHLTYNGGWRYFDY

SEQ ID NO: 9739 - protein, 9 aa, Homo sapiens
  light chain complementarity determining region 3 for antibody 4870
QQYNSYSRT

SEQ ID NO: 9740 - protein, 16 aa, Homo sapiens
  heavy chain complementarity determining region 3 for antibody 4870
VGHHLTYNSGWRYFDY

SEQ ID NO: 9741 - protein, 9 aa, Homo sapiens
  light chain complementarity determining region 3 for antibody 4871
QQYNSYSRT

SEQ ID NO: 9742 - protein, 16 aa, Homo sapiens
  heavy chain complementarity determining region 3 for antibody 4871
VGAHLTYNSGWRYFDY

SEQ ID NO: 9743 - protein, 9 aa, Homo sapiens
  light chain complementarity determining region 3 for antibody 4872
QQYNSYSRT

SEQ ID NO: 9744 - protein, 17 aa, Homo sapiens
  heavy chain complementarity determining region 3 for antibody 4872
ARNTMVGTWQRQGNLDH

SEQ ID NO: 9745 - protein, 9 aa, Homo sapiens
  light chain complementarity determining region 3 for antibody 4873
QQYNSYSRT

SEQ ID NO: 9746 - protein, 14 aa, Homo sapiens
  heavy chain complementarity determining region 3 for antibody 4873
ARGHFDSTGFRLDY

SEQ ID NO: 9747 - protein, 10 aa, Homo sapiens
  light chain complementarity determining region 3 for antibody 4874
QQYNSYSPRP

SEQ ID NO: 9748 - protein, 15 aa, Homo sapiens
  heavy chain complementarity determining region 3 for antibody 4874
SRVGRPYHNAWYFDN

SEQ ID NO: 9749 - protein, 10 aa, Homo sapiens
  light chain complementarity determining region 3 for antibody 4875
QQYNSYSPRP

SEQ ID NO: 9750 - protein, 15 aa, Homo sapiens
  heavy chain complementarity determining region 3 for antibody 4875
ARVGRPYRNAWYFDN

SEQ ID NO: 9751 - protein, 10 aa, Homo sapiens
  light chain complementarity determining region 3 for antibody 4876
QQYNSYSPRP

SEQ ID NO: 9752 - protein, 15 aa, Homo sapiens
  heavy chain complementarity determining region 3 for antibody 4876
ARVGRPYHNAWYFDD

SEQ ID NO: 9753 - protein, 10 aa, Homo sapiens
  light chain complementarity determining region 3 for antibody 4877
QQYNSYSPRP

SEQ ID NO: 9754 - protein, 15 aa, Homo sapiens
  heavy chain complementarity determining region 3 for antibody 4877
ARVGRPYHNAGYFDN

SEQ ID NO: 9755 - protein, 10 aa, Homo sapiens
  light chain complementarity determining region 3 for antibody 4878
QQYNSYSPRP

SEQ ID NO: 9756 - protein, 15 aa, Homo sapiens
  heavy chain complementarity determining region 3 for antibody 4878
ARVGRAYHNAWYFDN

SEQ ID NO: 9757 - protein, 10 aa, Homo sapiens
  light chain complementarity determining region 3 for antibody 4879
QQYNSYSPRP

SEQ ID NO: 9758 - protein, 13 aa, Homo sapiens
  heavy chain complementarity determining region 3 for antibody 4879
AKEGSSPGPDFDY

SEQ ID NO: 9759 - protein, 9 aa, Homo sapiens
  light chain complementarity determining region 3 for antibody 4880
QQYNSYSLT

SEQ ID NO: 9760 - protein, 14 aa, Homo sapiens
  heavy chain complementarity determining region 3 for antibody 4880
GRDVHTTGWTLGGY

SEQ ID NO: 9761 - protein, 9 aa, Homo sapiens
  light chain complementarity determining region 3 for antibody 4881
QQYNSYSLT

SEQ ID NO: 9762 - protein, 15 aa, Homo sapiens
  heavy chain complementarity determining region 3 for antibody 4881
ARSRVSGTTDDAFDI

SEQ ID NO: 9763 - protein, 9 aa, Homo sapiens
  light chain complementarity determining region 3 for antibody 4882
QQYNSYSLT

SEQ ID NO: 9764 - protein, 15 aa, Homo sapiens
  heavy chain complementarity determining region 3 for antibody 4882
ARSMVSGTTDYAFDI

SEQ ID NO: 9765 - protein, 9 aa, Homo sapiens
  light chain complementarity determining region 3 for antibody 4883
QQYNSYSLT

SEQ ID NO: 9766 - protein, 15 aa, Homo sapiens
  heavy chain complementarity determining region 3 for antibody 4883
ARSMVSGTTDDAFGI

SEQ ID NO: 9767 - protein, 9 aa, Homo sapiens
  light chain complementarity determining region 3 for antibody 4884
QQYNSYSLT

SEQ ID NO: 9768 - protein, 15 aa, Homo sapiens
  heavy chain complementarity determining region 3 for antibody 4884
ARSMVSGTADDAFDI

SEQ ID NO: 9769 - protein, 9 aa, Homo sapiens
  light chain complementarity determining region 3 for antibody 4885
QQYNSYSLT

SEQ ID NO: 9770 - protein, 15 aa, Homo sapiens
  heavy chain complementarity determining region 3 for antibody 4885
ARSIVSGTTDDAFDI

SEQ ID NO: 9771 - protein, 9 aa, Homo sapiens
  light chain complementarity determining region 3 for antibody 4886
QQYNSYSLT

SEQ ID NO: 9772 - protein, 9 aa, Homo sapiens
  heavy chain complementarity determining region 3 for antibody 4886
ARSEYQPTY

SEQ ID NO: 9773 - protein, 9 aa, Homo sapiens
  light chain complementarity determining region 3 for antibody 4887
QQYNSYSIT

SEQ ID NO: 9774 - protein, 13 aa, Homo sapiens
  heavy chain complementarity determining region 3 for antibody 4887
AKEGSSPGPDFEY

SEQ ID NO: 9775 - protein, 9 aa, Homo sapiens
  light chain complementarity determining region 3 for antibody 4888
QQYNSYSHT

SEQ ID NO: 9776 - protein, 14 aa, Homo sapiens
  heavy chain complementarity determining region 3 for antibody 4888
SRDVHTTGWTLGGY

SEQ ID NO: 9777 - protein, 9 aa, Homo sapiens
  light chain complementarity determining region 3 for antibody 4889
QQYNSYSHT

SEQ ID NO: 9778 - protein, 14 aa, Homo sapiens
  heavy chain complementarity determining region 3 for antibody 4889
GRDVHTTGWALGGY

SEQ ID NO: 9779 - protein, 9 aa, Homo sapiens
  light chain complementarity determining region 3 for antibody 4890
QQYNSYSHT

SEQ ID NO: 9780 - protein, 14 aa, Homo sapiens
  heavy chain complementarity determining region 3 for antibody 4890
GRDVHTPGWTLGGY

SEQ ID NO: 9781 - protein, 9 aa, Homo sapiens
  light chain complementarity determining region 3 for antibody 4891
QQYNSYSHT

SEQ ID NO: 9782 - protein, 14 aa, Homo sapiens
  heavy chain complementarity determining region 3 for antibody 4891
GRDVHTIGWTLGGY

SEQ ID NO: 9783 - protein, 9 aa, Homo sapiens
  light chain complementarity determining region 3 for antibody 4892
QQYNSYSHT

SEQ ID NO: 9784 - protein, 14 aa, Homo sapiens
  heavy chain complementarity determining region 3 for antibody 4892
GRDVHATGWTLGGY

SEQ ID NO: 9785 - protein, 9 aa, Homo sapiens
  light chain complementarity determining region 3 for antibody 4893
QQYNSYSHT

SEQ ID NO: 9786 - protein, 14 aa, Homo sapiens
  heavy chain complementarity determining region 3 for antibody 4893
GRDVHASGWTLGGY

SEQ ID NO: 9787 - protein, 9 aa, Homo sapiens
  light chain complementarity determining region 3 for antibody 4894
QQYNSYSHT

SEQ ID NO: 9788 - protein, 14 aa, Homo sapiens
  heavy chain complementarity determining region 3 for antibody 4894
ARGHFDSTGFRLDY

SEQ ID NO: 9789 - protein, 9 aa, Homo sapiens
  light chain complementarity determining region 3 for antibody 4895
QQYNSYSHT

SEQ ID NO: 9790 - protein, 14 aa, Homo sapiens
  heavy chain complementarity determining region 3 for antibody 4895
AREVHTTGWTLGGY

SEQ ID NO: 9791 - protein, 9 aa, Homo sapiens
  light chain complementarity determining region 3 for antibody 4896
QQYNSYSHT

SEQ ID NO: 9792 - protein, 14 aa, Homo sapiens
  heavy chain complementarity determining region 3 for antibody 4896
ARDVHTTGWTSGGY

SEQ ID NO: 9793 - protein, 9 aa, Homo sapiens
  light chain complementarity determining region 3 for antibody 4897
QQYNSYSHT

SEQ ID NO: 9794 - protein, 14 aa, Homo sapiens
  heavy chain complementarity determining region 3 for antibody 4897
ARDVHTTGWTLRGY

SEQ ID NO: 9795 - protein, 9 aa, Homo sapiens
  light chain complementarity determining region 3 for antibody 4898
QQYNSYSHT

SEQ ID NO: 9796 - protein, 14 aa, Homo sapiens
  heavy chain complementarity determining region 3 for antibody 4898
ARDVHTTGWTLGGS

SEQ ID NO: 9797 - protein, 9 aa, Homo sapiens
  light chain complementarity determining region 3 for antibody 4899
QQYNSYSHT

SEQ ID NO: 9798 - protein, 14 aa, Homo sapiens
  heavy chain complementarity determining region 3 for antibody 4899
ARDVHTTGWSLGGY

SEQ ID NO: 9799 - protein, 9 aa, Homo sapiens
  light chain complementarity determining region 3 for antibody 4900
QQYNSYSHT

SEQ ID NO: 9800 - protein, 14 aa, Homo sapiens
  heavy chain complementarity determining region 3 for antibody 4900
ARDVHTTGCTLGGY

SEQ ID NO: 9801 - protein, 9 aa, Homo sapiens
  light chain complementarity determining region 3 for antibody 4901
QQYNSYSHT

SEQ ID NO: 9802 - protein, 14 aa, Homo sapiens
  heavy chain complementarity determining region 3 for antibody 4901
ARDVHSTGWTLGGY

SEQ ID NO: 9803 - protein, 9 aa, Homo sapiens
  light chain complementarity determining region 3 for antibody 4902
QQYNSYSHT

SEQ ID NO: 9804 - protein, 14 aa, Homo sapiens
  heavy chain complementarity determining region 3 for antibody 4902
ARAVHTTGWTLGGY

SEQ ID NO: 9805 - protein, 10 aa, Homo sapiens
  light chain complementarity determining region 3 for antibody 4903
QQYNSYSGYT

SEQ ID NO: 9806 - protein, 12 aa, Homo sapiens
  heavy chain complementarity determining region 3 for antibody 4903
AIVVPGRWYLDD

SEQ ID NO: 9807 - protein, 10 aa, Homo sapiens
  light chain complementarity determining region 3 for antibody 4904
QQYNSYSGYT

SEQ ID NO: 9808 - protein, 12 aa, Homo sapiens
  heavy chain complementarity determining region 3 for antibody 4904
AIVVPGRWALDD

SEQ ID NO: 9809 - protein, 9 aa, Homo sapiens
  light chain complementarity determining region 3 for antibody 4905
QQYNSYQWT

SEQ ID NO: 9810 - protein, 15 aa, Homo sapiens
  heavy chain complementarity determining region 3 for antibody 4905
GKEGPGSSGWLTGHY

SEQ ID NO: 9811 - protein, 9 aa, Homo sapiens
  light chain complementarity determining region 3 for antibody 4906
QQYNSYPWT

SEQ ID NO: 9812 - protein, 11 aa, Homo sapiens
  heavy chain complementarity determining region 3 for antibody 4906
VRVSTGWNFDY

SEQ ID NO: 9813 - protein, 9 aa, Homo sapiens
  light chain complementarity determining region 3 for antibody 4907
QQYNSYPWT

SEQ ID NO: 9814 - protein, 8 aa, Homo sapiens
  heavy chain complementarity determining region 3 for antibody 4907
TGGRYWDV

SEQ ID NO: 9815 - protein, 9 aa, Homo sapiens
  light chain complementarity determining region 3 for antibody 4908
QQYNSYPWT

SEQ ID NO: 9816 - protein, 15 aa, Homo sapiens
  heavy chain complementarity determining region 3 for antibody 4908
GKEGPVSSGWLTGHY

SEQ ID NO: 9817 - protein, 9 aa, Homo sapiens
  light chain complementarity determining region 3 for antibody 4909
QQYNSYPWT

SEQ ID NO: 9818 - protein, 15 aa, Homo sapiens
  heavy chain complementarity determining region 3 for antibody 4909
GKEGPGSSGWLTGRY

SEQ ID NO: 9819 - protein, 9 aa, Homo sapiens
  light chain complementarity determining region 3 for antibody 4910
QQYNSYPWT

SEQ ID NO: 9820 - protein, 15 aa, Homo sapiens
  heavy chain complementarity determining region 3 for antibody 4910
GKEGPGSSGWLTGDY

SEQ ID NO: 9821 - protein, 9 aa, Homo sapiens
  light chain complementarity determining region 3 for antibody 4911
QQYNSYPWT

SEQ ID NO: 9822 - protein, 15 aa, Homo sapiens
  heavy chain complementarity determining region 3 for antibody 4911
GKEGPGSSGRLTGHY

SEQ ID NO: 9823 - protein, 9 aa, Homo sapiens
  light chain complementarity determining region 3 for antibody 4912
QQYNSYPWT

SEQ ID NO: 9824 - protein, 15 aa, Homo sapiens
  heavy chain complementarity determining region 3 for antibody 4912
GKEGPGRSGWLTGHY

SEQ ID NO: 9825 - protein, 9 aa, Homo sapiens
  light chain complementarity determining region 3 for antibody 4913
QQYNSYPWT

SEQ ID NO: 9826 - protein, 15 aa, Homo sapiens
  heavy chain complementarity determining region 3 for antibody 4913
EKEGPGSSGWLTGHY

SEQ ID NO: 9827 - protein, 9 aa, Homo sapiens
  light chain complementarity determining region 3 for antibody 4914
QQYNSYPWT

SEQ ID NO: 9828 - protein, 11 aa, Homo sapiens
  heavy chain complementarity determining region 3 for antibody 4914
ATFGQQWRLAH

SEQ ID NO: 9829 - protein, 9 aa, Homo sapiens
  light chain complementarity determining region 3 for antibody 4915
QQYNSYPWT

SEQ ID NO: 9830 - protein, 15 aa, Homo sapiens
  heavy chain complementarity determining region 3 for antibody 4915
ARVGRPYHNAWYFDN

SEQ ID NO: 9831 - protein, 9 aa, Homo sapiens
  light chain complementarity determining region 3 for antibody 4916
QQYNSYPWT

SEQ ID NO: 9832 - protein, 11 aa, Homo sapiens
  heavy chain complementarity determining region 3 for antibody 4916
ARIVARNPDDY

SEQ ID NO: 9833 - protein, 9 aa, Homo sapiens
  light chain complementarity determining region 3 for antibody 4917
QQYNSYPWT

SEQ ID NO: 9834 - protein, 17 aa, Homo sapiens
  heavy chain complementarity determining region 3 for antibody 4917
ARGTGIGSGSYYADFDY

SEQ ID NO: 9835 - protein, 9 aa, Homo sapiens
  light chain complementarity determining region 3 for antibody 4918
QQYNSYPWT

SEQ ID NO: 9836 - protein, 9 aa, Homo sapiens
  heavy chain complementarity determining region 3 for antibody 4918
ARGHYGPDY

SEQ ID NO: 9837 - protein, 9 aa, Homo sapiens
  light chain complementarity determining region 3 for antibody 4919
QQYNSYPWT

SEQ ID NO: 9838 - protein, 14 aa, Homo sapiens
  heavy chain complementarity determining region 3 for antibody 4919
ARDVHTTGWTLGGY

SEQ ID NO: 9839 - protein, 9 aa, Homo sapiens
  light chain complementarity determining region 3 for antibody 4920
QQYNSYPWP

SEQ ID NO: 9840 - protein, 14 aa, Homo sapiens
  heavy chain complementarity determining region 3 for antibody 4920
VREEGSGYYRTADY

SEQ ID NO: 9841 - protein, 9 aa, Homo sapiens
  light chain complementarity determining region 3 for antibody 4921
QQYNSYPWP

SEQ ID NO: 9842 - protein, 11 aa, Homo sapiens
  heavy chain complementarity determining region 3 for antibody 4921
ARIVARKPDDY

SEQ ID NO: 9843 - protein, 9 aa, Homo sapiens
  light chain complementarity determining region 3 for antibody 4922
QQYNSYPWK

SEQ ID NO: 9844 - protein, 15 aa, Homo sapiens
  heavy chain complementarity determining region 3 for antibody 4922
GKEGPGSSGWLTGHY

SEQ ID NO: 9845 - protein, 9 aa, Homo sapiens
  light chain complementarity determining region 3 for antibody 4923
QQYNSYPQT

SEQ ID NO: 9846 - protein, 13 aa, Homo sapiens
  heavy chain complementarity determining region 3 for antibody 4923
AKEGSSPGPDFEY

SEQ ID NO: 9847 - protein, 9 aa, Homo sapiens
  light chain complementarity determining region 3 for antibody 4924
QQYNSYPPT

SEQ ID NO: 9848 - protein, 13 aa, Homo sapiens
  heavy chain complementarity determining region 3 for antibody 4924
TKEGSSAGPDFVY

SEQ ID NO: 9849 - protein, 9 aa, Homo sapiens
  light chain complementarity determining region 3 for antibody 4925
QQYNSYPPT

SEQ ID NO: 9850 - protein, 13 aa, Homo sapiens
  heavy chain complementarity determining region 3 for antibody 4925
SKEGSSPGPDFEY

SEQ ID NO: 9851 - protein, 9 aa, Homo sapiens
  light chain complementarity determining region 3 for antibody 4926
QQYNSYPPT

SEQ ID NO: 9852 - protein, 13 aa, Homo sapiens
  heavy chain complementarity determining region 3 for antibody 4926
AKEGSSPGPDSEY

SEQ ID NO: 9853 - protein, 9 aa, Homo sapiens
  light chain complementarity determining region 3 for antibody 4927
QQYNSYPPT

SEQ ID NO: 9854 - protein, 13 aa, Homo sapiens
  heavy chain complementarity determining region 3 for antibody 4927
AKEGSSPGPDCEY

SEQ ID NO: 9855 - protein, 9 aa, Homo sapiens
  light chain complementarity determining region 3 for antibody 4928
QQYNSYPPT

SEQ ID NO: 9856 - protein, 13 aa, Homo sapiens
  heavy chain complementarity determining region 3 for antibody 4928
AEEGSSPGPDFEY

SEQ ID NO: 9857 - protein, 9 aa, Homo sapiens
  light chain complementarity determining region 3 for antibody 4929
QQYNSYPLT

SEQ ID NO: 9858 - protein, 15 aa, Homo sapiens
  heavy chain complementarity determining region 3 for antibody 4929
GKEGPGSSGWLTGHY

SEQ ID NO: 9859 - protein, 9 aa, Homo sapiens
  light chain complementarity determining region 3 for antibody 4930
QQYNSYPLT

SEQ ID NO: 9860 - protein, 15 aa, Homo sapiens
  heavy chain complementarity determining region 3 for antibody 4930
ARSMVSGTTDDAFDI

SEQ ID NO: 9861 - protein, 9 aa, Homo sapiens
  light chain complementarity determining region 3 for antibody 4931
QQYNSYPLS

SEQ ID NO: 9862 - protein, 13 aa, Homo sapiens
  heavy chain complementarity determining region 3 for antibody 4931
ARTTLTTLRPCDY

SEQ ID NO: 9863 - protein, 9 aa, Homo sapiens
  light chain complementarity determining region 3 for antibody 4932
QQYNSYPGT

SEQ ID NO: 9864 - protein, 15 aa, Homo sapiens
  heavy chain complementarity determining region 3 for antibody 4932
GKEGPGSSGWLTGHY

SEQ ID NO: 9865 - protein, 9 aa, Homo sapiens
  light chain complementarity determining region 3 for antibody 4933
QQYNSYPGT

SEQ ID NO: 9866 - protein, 11 aa, Homo sapiens
  heavy chain complementarity determining region 3 for antibody 4933
ARIVARKPDDY

SEQ ID NO: 9867 - protein, 9 aa, Homo sapiens
  light chain complementarity determining region 3 for antibody 4934
QQYNSYLLT

SEQ ID NO: 9868 - protein, 15 aa, Homo sapiens
  heavy chain complementarity determining region 3 for antibody 4934
ARSMVSGTTDDAFDI

SEQ ID NO: 9869 - protein, 7 aa, Homo sapiens
  light chain complementarity determining region 3 for antibody 4935
QQYNSWT

SEQ ID NO: 9870 - protein, 14 aa, Homo sapiens
  heavy chain complementarity determining region 3 for antibody 4935
ARGHFDSTGFRLDY

SEQ ID NO: 9871 - protein, 7 aa, Homo sapiens
  light chain complementarity determining region 3 for antibody 4936
QQYNSWT

SEQ ID NO: 9872 - protein, 12 aa, Homo sapiens
  heavy chain complementarity determining region 3 for antibody 4936
AKNKGGRSGMDV

SEQ ID NO: 9873 - protein, 7 aa, Homo sapiens
  light chain complementarity determining region 3 for antibody 4937
QQYNSWT

SEQ ID NO: 9874 - protein, 12 aa, Homo sapiens
  heavy chain complementarity determining region 3 for antibody 4937
AKDNGGRSGMDV

SEQ ID NO: 9875 - protein, 7 aa, Homo sapiens
  light chain complementarity determining region 3 for antibody 4938
QQYNSWT

SEQ ID NO: 9876 - protein, 12 aa, Homo sapiens
  heavy chain complementarity determining region 3 for antibody 4938
AKDKGGRRGMDV

SEQ ID NO: 9877 - protein, 7 aa, Homo sapiens
  light chain complementarity determining region 3 for antibody 4939
QQYNSWT

SEQ ID NO: 9878 - protein, 12 aa, Homo sapiens
  heavy chain complementarity determining region 3 for antibody 4939
AKDKGGRGGMDV

SEQ ID NO: 9879 - protein, 7 aa, Homo sapiens
  light chain complementarity determining region 3 for antibody 4940
QQYNSWP

SEQ ID NO: 9880 - protein, 12 aa, Homo sapiens
  heavy chain complementarity determining region 3 for antibody 4940
SRDKGGRNGMDV

SEQ ID NO: 9881 - protein, 9 aa, Homo sapiens
  light chain complementarity determining region 3 for antibody 4941
QQYNSSSRT

SEQ ID NO: 9882 - protein, 16 aa, Homo sapiens
  heavy chain complementarity determining region 3 for antibody 4941
VGPHLTYNSGWRYFDY

SEQ ID NO: 9883 - protein, 9 aa, Homo sapiens
  light chain complementarity determining region 3 for antibody 4942
QQYNSSSHT

SEQ ID NO: 9884 - protein, 14 aa, Homo sapiens
  heavy chain complementarity determining region 3 for antibody 4942
GRDVHTTGWTLGGY

SEQ ID NO: 9885 - protein, 9 aa, Homo sapiens
  light chain complementarity determining region 3 for antibody 4943
QQYNNYPWT

SEQ ID NO: 9886 - protein, 15 aa, Homo sapiens
  heavy chain complementarity determining region 3 for antibody 4943
GKEGPGSSGWLTGHY

SEQ ID NO: 9887 - protein, 9 aa, Homo sapiens
  light chain complementarity determining region 3 for antibody 4944
QQYNNYPLT

SEQ ID NO: 9888 - protein, 14 aa, Homo sapiens
  heavy chain complementarity determining region 3 for antibody 4944
AKYRASIGARCFDP

SEQ ID NO: 9889 - protein, 10 aa, Homo sapiens
  light chain complementarity determining region 3 for antibody 4945
QQYNNWRGFP

SEQ ID NO: 9890 - protein, 11 aa, Homo sapiens
  heavy chain complementarity determining region 3 for antibody 4945
ARVAGPQLFDY

SEQ ID NO: 9891 - protein, 9 aa, Homo sapiens
  light chain complementarity determining region 3 for antibody 4946
QQYNNWRFT

SEQ ID NO: 9892 - protein, 10 aa, Homo sapiens
  heavy chain complementarity determining region 3 for antibody 4946
VRSQQPGEDY

SEQ ID NO: 9893 - protein, 10 aa, Homo sapiens
  light chain complementarity determining region 3 for antibody 4947
QQYNNWPPYT

SEQ ID NO: 9894 - protein, 13 aa, Homo sapiens
  heavy chain complementarity determining region 3 for antibody 4947
TKEGSSAGPDFVY

SEQ ID NO: 9895 - protein, 10 aa, Homo sapiens
  light chain complementarity determining region 3 for antibody 4948
QQYNNWPPYP

SEQ ID NO: 9896 - protein, 14 aa, Homo sapiens
  heavy chain complementarity determining region 3 for antibody 4948
ARENCYGTGSCFDY

SEQ ID NO: 9897 - protein, 9 aa, Homo sapiens
  light chain complementarity determining region 3 for antibody 4949
QQYNNWPFT

SEQ ID NO: 9898 - protein, 10 aa, Homo sapiens
  heavy chain complementarity determining region 3 for antibody 4949
VRSDSRGDDS

SEQ ID NO: 9899 - protein, 9 aa, Homo sapiens
  light chain complementarity determining region 3 for antibody 4950
QQYNNWPFT

SEQ ID NO: 9900 - protein, 10 aa, Homo sapiens
  heavy chain complementarity determining region 3 for antibody 4950
VRGDSPGDDS

SEQ ID NO: 9901 - protein, 9 aa, Homo sapiens
  light chain complementarity determining region 3 for antibody 4951
QQYNNWLLT

SEQ ID NO: 9902 - protein, 14 aa, Homo sapiens
  heavy chain complementarity determining region 3 for antibody 4951
ARVNRWLQDKHLDY

SEQ ID NO: 9903 - protein, 9 aa, Homo sapiens
  light chain complementarity determining region 3 for antibody 4952
QQYNIYPWT

SEQ ID NO: 9904 - protein, 12 aa, Homo sapiens
  heavy chain complementarity determining region 3 for antibody 4952
AGSRSGGGSIDY

SEQ ID NO: 9905 - protein, 9 aa, Homo sapiens
  light chain complementarity determining region 3 for antibody 4953
QQYNGYPWT

SEQ ID NO: 9906 - protein, 11 aa, Homo sapiens
  heavy chain complementarity determining region 3 for antibody 4953
ARIVARKPDDY

SEQ ID NO: 9907 - protein, 10 aa, Homo sapiens
  light chain complementarity determining region 3 for antibody 4954
QQYNFYSTLT

SEQ ID NO: 9908 - protein, 16 aa, Homo sapiens
  heavy chain complementarity determining region 3 for antibody 4954
GRRVISATKWPNRLDY

SEQ ID NO: 9909 - protein, 10 aa, Homo sapiens
  light chain complementarity determining region 3 for antibody 4955
QQYNFYSTLT

SEQ ID NO: 9910 - protein, 16 aa, Homo sapiens
  heavy chain complementarity determining region 3 for antibody 4955
GRQVISATKWPHRLDY

SEQ ID NO: 9911 - protein, 10 aa, Homo sapiens
  light chain complementarity determining region 3 for antibody 4956
QQYNFYSTLT

SEQ ID NO: 9912 - protein, 16 aa, Homo sapiens
  heavy chain complementarity determining region 3 for antibody 4956
GRQVISAAKWPNRLDY

SEQ ID NO: 9913 - protein, 10 aa, Homo sapiens
  light chain complementarity determining region 3 for antibody 4957
QQYNFYSTLT

SEQ ID NO: 9914 - protein, 10 aa, Homo sapiens
  heavy chain complementarity determining region 3 for antibody 4957
ARETSGSYDI

SEQ ID NO: 9915 - protein, 10 aa, Homo sapiens
  light chain complementarity determining region 3 for antibody 4958
QQYNFYSTLT

SEQ ID NO: 9916 - protein, 12 aa, Homo sapiens
  heavy chain complementarity determining region 3 for antibody 4958
AIVVPGRWDLDD

SEQ ID NO: 9917 - protein, 10 aa, Homo sapiens
  light chain complementarity determining region 3 for antibody 4959
QQYNFYSTLP

SEQ ID NO: 9918 - protein, 16 aa, Homo sapiens
  heavy chain complementarity determining region 3 for antibody 4959
GRQVISATKWPNRLDY

SEQ ID NO: 9919 - protein, 10 aa, Homo sapiens
  light chain complementarity determining region 3 for antibody 4960
QQYNFSSTLT

SEQ ID NO: 9920 - protein, 16 aa, Homo sapiens
  heavy chain complementarity determining region 3 for antibody 4960
GRQVISATKWPNRLDY

SEQ ID NO: 9921 - protein, 9 aa, Homo sapiens
  light chain complementarity determining region 3 for antibody 4961
QQYNDWPRT

SEQ ID NO: 9922 - protein, 17 aa, Homo sapiens
  heavy chain complementarity determining region 3 for antibody 4961
ARDLPSRCSRTSCALDY

SEQ ID NO: 9923 - protein, 8 aa, Homo sapiens
  light chain complementarity determining region 3 for antibody 4962
QQYLSHFT

SEQ ID NO: 9924 - protein, 11 aa, Homo sapiens
  heavy chain complementarity determining region 3 for antibody 4962
AGDRGGGALDH

SEQ ID NO: 9925 - protein, 9 aa, Homo sapiens
  light chain complementarity determining region 3 for antibody 4963
QQYLNYPFT

SEQ ID NO: 9926 - protein, 11 aa, Homo sapiens
  heavy chain complementarity determining region 3 for antibody 4963
LRGSGMVPFDY

SEQ ID NO: 9927 - protein, 10 aa, Homo sapiens
  light chain complementarity determining region 3 for antibody 4964
QQYLGNPPWT

SEQ ID NO: 9928 - protein, 14 aa, Homo sapiens
  heavy chain complementarity determining region 3 for antibody 4964
ASQSRDTAMVWKGL

SEQ ID NO: 9929 - protein, 9 aa, Homo sapiens
  light chain complementarity determining region 3 for antibody 4965
QQYLGFPPT

SEQ ID NO: 9930 - protein, 13 aa, Homo sapiens
  heavy chain complementarity determining region 3 for antibody 4965
TTGAPQSGSVFDN

SEQ ID NO: 9931 - protein, 9 aa, Homo sapiens
  light chain complementarity determining region 3 for antibody 4966
QQYKTVPWT

SEQ ID NO: 9932 - protein, 20 aa, Homo sapiens
  heavy chain complementarity determining region 3 for antibody 4966
AKDGRGAADYHSAGGGGLDV

SEQ ID NO: 9933 - protein, 8 aa, Homo sapiens
  light chain complementarity determining region 3 for antibody 4967
QQYKTAWT

SEQ ID NO: 9934 - protein, 11 aa, Homo sapiens
  heavy chain complementarity determining region 3 for antibody 4967
IRHLEFQRPDV

SEQ ID NO: 9935 - protein, 9 aa, Homo sapiens
  light chain complementarity determining region 3 for antibody 4968
QQYKTAPWT

SEQ ID NO: 9936 - protein, 20 aa, Homo sapiens
  heavy chain complementarity determining region 3 for antibody 4968
TRDARGSISYAYGGGGGVDV

SEQ ID NO: 9937 - protein, 9 aa, Homo sapiens
  light chain complementarity determining region 3 for antibody 4969
QQYKTAPWT

SEQ ID NO: 9938 - protein, 20 aa, Homo sapiens
  heavy chain complementarity determining region 3 for antibody 4969
TRDARGSISYAYGGGGCLDV

SEQ ID NO: 9939 - protein, 9 aa, Homo sapiens
  light chain complementarity determining region 3 for antibody 4970
QQYKTAPWT

SEQ ID NO: 9940 - protein, 20 aa, Homo sapiens
  heavy chain complementarity determining region 3 for antibody 4970
TRDARGSIAYAYGGGGGLDV

SEQ ID NO: 9941 - protein, 9 aa, Homo sapiens
  light chain complementarity determining region 3 for antibody 4971
QQYKTAPWT

SEQ ID NO: 9942 - protein, 10 aa, Homo sapiens
  heavy chain complementarity determining region 3 for antibody 4971
ARERSGSYDI

SEQ ID NO: 9943 - protein, 9 aa, Homo sapiens
  light chain complementarity determining region 3 for antibody 4972
QQYKTAPWP

SEQ ID NO: 9944 - protein, 20 aa, Homo sapiens
  heavy chain complementarity determining region 3 for antibody 4972
TRDARGSISYAYGGGGGLDV

SEQ ID NO: 9945 - protein, 8 aa, Homo sapiens
  light chain complementarity determining region 3 for antibody 4973
QQYKSYWT

SEQ ID NO: 9946 - protein, 15 aa, Homo sapiens
  heavy chain complementarity determining region 3 for antibody 4973
ARVGRPYHNAWYFDN

SEQ ID NO: 9947 - protein, 8 aa, Homo sapiens
  light chain complementarity determining region 3 for antibody 4974
QQYKSYWT

SEQ ID NO: 9948 - protein, 10 aa, Homo sapiens
  heavy chain complementarity determining region 3 for antibody 4974
ARERSGSYGI

SEQ ID NO: 9949 - protein, 8 aa, Homo sapiens
  light chain complementarity determining region 3 for antibody 4975
QQYKSYWT

SEQ ID NO: 9950 - protein, 10 aa, Homo sapiens
  heavy chain complementarity determining region 3 for antibody 4975
ARERSGSYDT

SEQ ID NO: 9951 - protein, 8 aa, Homo sapiens
  light chain complementarity determining region 3 for antibody 4976
QQYKSYWT

SEQ ID NO: 9952 - protein, 10 aa, Homo sapiens
  heavy chain complementarity determining region 3 for antibody 4976
ARERSGSYDL

SEQ ID NO: 9953 - protein, 8 aa, Homo sapiens
  light chain complementarity determining region 3 for antibody 4977
QQYKSYWT

SEQ ID NO: 9954 - protein, 10 aa, Homo sapiens
  heavy chain complementarity determining region 3 for antibody 4977
ARERSGPYDI

SEQ ID NO: 9955 - protein, 8 aa, Homo sapiens
  light chain complementarity determining region 3 for antibody 4978
QQYKSYWT

SEQ ID NO: 9956 - protein, 10 aa, Homo sapiens
  heavy chain complementarity determining region 3 for antibody 4978
ARERCGSYDI

SEQ ID NO: 9957 - protein, 8 aa, Homo sapiens
  light chain complementarity determining region 3 for antibody 4979
QQYKSYWT

SEQ ID NO: 9958 - protein, 10 aa, Homo sapiens
  heavy chain complementarity determining region 3 for antibody 4979
ARDRSGSYDI

SEQ ID NO: 9959 - protein, 8 aa, Homo sapiens
  light chain complementarity determining region 3 for antibody 4980
QQYKSYWT

SEQ ID NO: 9960 - protein, 13 aa, Homo sapiens
  heavy chain complementarity determining region 3 for antibody 4980
AKEGSSPGPDFDY

SEQ ID NO: 9961 - protein, 8 aa, Homo sapiens
  light chain complementarity determining region 3 for antibody 4981
QQYKSYWR

SEQ ID NO: 9962 - protein, 10 aa, Homo sapiens
  heavy chain complementarity determining region 3 for antibody 4981
ARERSGSYDI

SEQ ID NO: 9963 - protein, 8 aa, Homo sapiens
  light chain complementarity determining region 3 for antibody 4982
QQYKSYWP

SEQ ID NO: 9964 - protein, 10 aa, Homo sapiens
  heavy chain complementarity determining region 3 for antibody 4982
ARERSGSYDI

SEQ ID NO: 9965 - protein, 8 aa, Homo sapiens
  light chain complementarity determining region 3 for antibody 4983
QQYKSSWT

SEQ ID NO: 9966 - protein, 10 aa, Homo sapiens
  heavy chain complementarity determining region 3 for antibody 4983
ARERSGSYDI

SEQ ID NO: 9967 - protein, 8 aa, Homo sapiens
  light chain complementarity determining region 3 for antibody 4984
QQYKRYWT

SEQ ID NO: 9968 - protein, 10 aa, Homo sapiens
  heavy chain complementarity determining region 3 for antibody 4984
ARERSGSYDI

SEQ ID NO: 9969 - protein, 9 aa, Homo sapiens
  light chain complementarity determining region 3 for antibody 4985
QQYKIYPYT

SEQ ID NO: 9970 - protein, 9 aa, Homo sapiens
  heavy chain complementarity determining region 3 for antibody 4985
ARFWTYGRK

SEQ ID NO: 9971 - protein, 9 aa, Homo sapiens
  light chain complementarity determining region 3 for antibody 4986
QQYKIYPWT

SEQ ID NO: 9972 - protein, 10 aa, Homo sapiens
  heavy chain complementarity determining region 3 for antibody 4986
CRDREGFGDV

SEQ ID NO: 9973 - protein, 9 aa, Homo sapiens
  light chain complementarity determining region 3 for antibody 4987
QQYKIYPWT

SEQ ID NO: 9974 - protein, 12 aa, Homo sapiens
  heavy chain complementarity determining region 3 for antibody 4987
ARDKGGRNGMDV

SEQ ID NO: 9975 - protein, 9 aa, Homo sapiens
  light chain complementarity determining region 3 for antibody 4988
QQYKIYPWT

SEQ ID NO: 9976 - protein, 13 aa, Homo sapiens
  heavy chain complementarity determining region 3 for antibody 4988
AKEGSSPGTDFDY

SEQ ID NO: 9977 - protein, 9 aa, Homo sapiens
  light chain complementarity determining region 3 for antibody 4989
QQYKIYPWT

SEQ ID NO: 9978 - protein, 13 aa, Homo sapiens
  heavy chain complementarity determining region 3 for antibody 4989
AKEGSSHGPDFDY

SEQ ID NO: 9979 - protein, 9 aa, Homo sapiens
  light chain complementarity determining region 3 for antibody 4990
QQYKIYPWT

SEQ ID NO: 9980 - protein, 13 aa, Homo sapiens
  heavy chain complementarity determining region 3 for antibody 4990
AKEGSAPGPDFDY

SEQ ID NO: 9981 - protein, 8 aa, Homo sapiens
  light chain complementarity determining region 3 for antibody 4991
QQYKCYWT

SEQ ID NO: 9982 - protein, 10 aa, Homo sapiens
  heavy chain complementarity determining region 3 for antibody 4991
ARERSGSYDI

SEQ ID NO: 9983 - protein, 9 aa, Homo sapiens
  light chain complementarity determining region 3 for antibody 4992
QQYIGYPLT

SEQ ID NO: 9984 - protein, 18 aa, Homo sapiens
  heavy chain complementarity determining region 3 for antibody 4992
VRGAVGVRGVPSFDAFHI

SEQ ID NO: 9985 - protein, 9 aa, Homo sapiens
  light chain complementarity determining region 3 for antibody 4993
QQYHTWPGT

SEQ ID NO: 9986 - protein, 11 aa, Homo sapiens
  heavy chain complementarity determining region 3 for antibody 4993
AKGGFYFLTGD

SEQ ID NO: 9987 - protein, 9 aa, Homo sapiens
  light chain complementarity determining region 3 for antibody 4994
QQYHTTPYT

SEQ ID NO: 9988 - protein, 11 aa, Homo sapiens
  heavy chain complementarity determining region 3 for antibody 4994
GREAPAGGVDH

SEQ ID NO: 9989 - protein, 10 aa, Homo sapiens
  light chain complementarity determining region 3 for antibody 4995
QQYHSYSPRP

SEQ ID NO: 9990 - protein, 15 aa, Homo sapiens
  heavy chain complementarity determining region 3 for antibody 4995
ARVGRPYHNAWYFDN

SEQ ID NO: 9991 - protein, 10 aa, Homo sapiens
  light chain complementarity determining region 3 for antibody 4996
QQYHSYSPLP

SEQ ID NO: 9992 - protein, 16 aa, Homo sapiens
  heavy chain complementarity determining region 3 for antibody 4996
ARWFSRSSTGVSYMDV

SEQ ID NO: 9993 - protein, 7 aa, Homo sapiens
  light chain complementarity determining region 3 for antibody 4997
QQYHSWT

SEQ ID NO: 9994 - protein, 12 aa, Homo sapiens
  heavy chain complementarity determining region 3 for antibody 4997
AKDKGGRSGMDV

SEQ ID NO: 9995 - protein, 9 aa, Homo sapiens
  light chain complementarity determining region 3 for antibody 4998
QQYHSTPRT

SEQ ID NO: 9996 - protein, 11 aa, Homo sapiens
  heavy chain complementarity determining region 3 for antibody 4998
ATGKDNAKTGY

SEQ ID NO: 9997 - protein, 9 aa, Homo sapiens
  light chain complementarity determining region 3 for antibody 4999
QQYHRYSHT

SEQ ID NO: 9998 - protein, 14 aa, Homo sapiens
  heavy chain complementarity determining region 3 for antibody 4999
GRGVHTTGWTLGGY

SEQ ID NO: 9999 - protein, 9 aa, Homo sapiens
  light chain complementarity determining region 3 for antibody 5000
QQYHRYSHT

SEQ ID NO: 10000 - protein, 14 aa, Homo sapiens
  heavy chain complementarity determining region 3 for antibody 5000
GRDVHTTGWALGGY

SEQ ID NO: 10001 - protein, 9 aa, Homo sapiens
  light chain complementarity determining region 3 for antibody 5001
QQYHRYSHT

SEQ ID NO: 10002 - protein, 14 aa, Homo sapiens
  heavy chain complementarity determining region 3 for antibody 5001
GRDVHTSGWTLGGY

SEQ ID NO: 10003 - protein, 9 aa, Homo sapiens
  light chain complementarity determining region 3 for antibody 5002
QQYHRYSHT

SEQ ID NO: 10004 - protein, 14 aa, Homo sapiens
  heavy chain complementarity determining region 3 for antibody 5002
GRDVHTAGWTLGGY

SEQ ID NO: 10005 - protein, 9 aa, Homo sapiens
  light chain complementarity determining region 3 for antibody 5003
QQYHRYSHT

SEQ ID NO: 10006 - protein, 14 aa, Homo sapiens
  heavy chain complementarity determining region 3 for antibody 5003
GRDIHTTGWTLGGY

SEQ ID NO: 10007 - protein, 9 aa, Homo sapiens
  light chain complementarity determining region 3 for antibody 5004
QQYHRYSHT

SEQ ID NO: 10008 - protein, 9 aa, Homo sapiens
  heavy chain complementarity determining region 3 for antibody 5004
ARSEYQPTY

SEQ ID NO: 10009 - protein, 9 aa, Homo sapiens
  light chain complementarity determining region 3 for antibody 5005
QQYHRYSHT

SEQ ID NO: 10010 - protein, 14 aa, Homo sapiens
  heavy chain complementarity determining region 3 for antibody 5005
ARGHFDSTGFRLDY

SEQ ID NO: 10011 - protein, 9 aa, Homo sapiens
  light chain complementarity determining region 3 for antibody 5006
QQYHRHSHT

SEQ ID NO: 10012 - protein, 14 aa, Homo sapiens
  heavy chain complementarity determining region 3 for antibody 5006
GRDVHTTGWTLGGY

SEQ ID NO: 10013 - protein, 9 aa, Homo sapiens
  light chain complementarity determining region 3 for antibody 5007
QQYHNWPGT

SEQ ID NO: 10014 - protein, 15 aa, Homo sapiens
  heavy chain complementarity determining region 3 for antibody 5007
GKEGPGSSGWLTGHY

SEQ ID NO: 10015 - protein, 9 aa, Homo sapiens
  light chain complementarity determining region 3 for antibody 5008
QQYHNWPGT

SEQ ID NO: 10016 - protein, 17 aa, Homo sapiens
  heavy chain complementarity determining region 3 for antibody 5008
ARNTMVGTWQRQGNLDH

SEQ ID NO: 10017 - protein, 9 aa, Homo sapiens
  light chain complementarity determining region 3 for antibody 5009
QQYHNWPGT

SEQ ID NO: 10018 - protein, 12 aa, Homo sapiens
  heavy chain complementarity determining region 3 for antibody 5009
ARDKGGRNGMDV

SEQ ID NO: 10019 - protein, 9 aa, Homo sapiens
  light chain complementarity determining region 3 for antibody 5010
QQYHNWPGT

SEQ ID NO: 10020 - protein, 11 aa, Homo sapiens
  heavy chain complementarity determining region 3 for antibody 5010
AKGGSYFLTGD

SEQ ID NO: 10021 - protein, 9 aa, Homo sapiens
  light chain complementarity determining region 3 for antibody 5011
QQYHNWPGT

SEQ ID NO: 10022 - protein, 11 aa, Homo sapiens
  heavy chain complementarity determining region 3 for antibody 5011
AKGGFYFLTGG

SEQ ID NO: 10023 - protein, 9 aa, Homo sapiens
  light chain complementarity determining region 3 for antibody 5012
QQYHNWPGT

SEQ ID NO: 10024 - protein, 11 aa, Homo sapiens
  heavy chain complementarity determining region 3 for antibody 5012
AKGGFYFLTED

SEQ ID NO: 10025 - protein, 9 aa, Homo sapiens
  light chain complementarity determining region 3 for antibody 5013
QQYHNWPGT

SEQ ID NO: 10026 - protein, 11 aa, Homo sapiens
  heavy chain complementarity determining region 3 for antibody 5013
AKGGFYFLIGD

SEQ ID NO: 10027 - protein, 9 aa, Homo sapiens
  light chain complementarity determining region 3 for antibody 5014
QQYHNWPGT

SEQ ID NO: 10028 - protein, 11 aa, Homo sapiens
  heavy chain complementarity determining region 3 for antibody 5014
AKGGFDFLTGD

SEQ ID NO: 10029 - protein, 9 aa, Homo sapiens
  light chain complementarity determining region 3 for antibody 5015
QQYHNWPGK

SEQ ID NO: 10030 - protein, 11 aa, Homo sapiens
  heavy chain complementarity determining region 3 for antibody 5015
AKGGFYFLTGD

SEQ ID NO: 10031 - protein, 9 aa, Homo sapiens
  light chain complementarity determining region 3 for antibody 5016
QQYHNLPRT

SEQ ID NO: 10032 - protein, 15 aa, Homo sapiens
  heavy chain complementarity determining region 3 for antibody 5016
ARDRGGSYYGGVFDS

SEQ ID NO: 10033 - protein, 9 aa, Homo sapiens
  light chain complementarity determining region 3 for antibody 5017
QQYHGYPWT

SEQ ID NO: 10034 - protein, 11 aa, Homo sapiens
  heavy chain complementarity determining region 3 for antibody 5017
SRIVARKPDDY

SEQ ID NO: 10035 - protein, 9 aa, Homo sapiens
  light chain complementarity determining region 3 for antibody 5018
QQYHGYPWT

SEQ ID NO: 10036 - protein, 11 aa, Homo sapiens
  heavy chain complementarity determining region 3 for antibody 5018
ARSVARKPDDY

SEQ ID NO: 10037 - protein, 9 aa, Homo sapiens
  light chain complementarity determining region 3 for antibody 5019
QQYHGYPWT

SEQ ID NO: 10038 - protein, 11 aa, Homo sapiens
  heavy chain complementarity determining region 3 for antibody 5019
ARIVARKPDGY

SEQ ID NO: 10039 - protein, 9 aa, Homo sapiens
  light chain complementarity determining region 3 for antibody 5020
QQYHGYPWT

SEQ ID NO: 10040 - protein, 9 aa, Homo sapiens
  heavy chain complementarity determining region 3 for antibody 5020
AGWGGLSSY

SEQ ID NO: 10041 - protein, 9 aa, Homo sapiens
  light chain complementarity determining region 3 for antibody 5021
QQYGYSPLT

SEQ ID NO: 10042 - protein, 14 aa, Homo sapiens
  heavy chain complementarity determining region 3 for antibody 5021
ARGHFDSTGFRLDY

SEQ ID NO: 10043 - protein, 9 aa, Homo sapiens
  light chain complementarity determining region 3 for antibody 5022
QQYGYSPLT

SEQ ID NO: 10044 - protein, 18 aa, Homo sapiens
  heavy chain complementarity determining region 3 for antibody 5022
ARGDYPEARSGYYRDFDY

SEQ ID NO: 10045 - protein, 9 aa, Homo sapiens
  light chain complementarity determining region 3 for antibody 5023
QQYGYSPLT

SEQ ID NO: 10046 - protein, 18 aa, Homo sapiens
  heavy chain complementarity determining region 3 for antibody 5023
ARGDYPEARSDYYLDLDY

SEQ ID NO: 10047 - protein, 9 aa, Homo sapiens
  light chain complementarity determining region 3 for antibody 5024
QQYGYSPLT

SEQ ID NO: 10048 - protein, 18 aa, Homo sapiens
  heavy chain complementarity determining region 3 for antibody 5024
ARGDYPEARSDYCLDFDY

SEQ ID NO: 10049 - protein, 9 aa, Homo sapiens
  light chain complementarity determining region 3 for antibody 5025
QQYGYSPLT

SEQ ID NO: 10050 - protein, 18 aa, Homo sapiens
  heavy chain complementarity determining region 3 for antibody 5025
ARGDCPEARSDYYLDFDY

SEQ ID NO: 10051 - protein, 8 aa, Homo sapiens
  light chain complementarity determining region 3 for antibody 5026
QQYGYSHT

SEQ ID NO: 10052 - protein, 15 aa, Homo sapiens
  heavy chain complementarity determining region 3 for antibody 5026
ARGRLAAGGWYYFDY

SEQ ID NO: 10053 - protein, 8 aa, Homo sapiens
  light chain complementarity determining region 3 for antibody 5027
QQYGYSHT

SEQ ID NO: 10054 - protein, 14 aa, Homo sapiens
  heavy chain complementarity determining region 3 for antibody 5027
ARGHFDSTGFRLDY

SEQ ID NO: 10055 - protein, 8 aa, Homo sapiens
  light chain complementarity determining region 3 for antibody 5028
QQYGYSHP

SEQ ID NO: 10056 - protein, 15 aa, Homo sapiens
  heavy chain complementarity determining region 3 for antibody 5028
ARGLLAAGGWYYFDY

SEQ ID NO: 10057 - protein, 8 aa, Homo sapiens
  light chain complementarity determining region 3 for antibody 5029
QQYGYPHT

SEQ ID NO: 10058 - protein, 15 aa, Homo sapiens
  heavy chain complementarity determining region 3 for antibody 5029
ARGLLATGGWYYFDY

SEQ ID NO: 10059 - protein, 9 aa, Homo sapiens
  light chain complementarity determining region 3 for antibody 5030
QQYGTTPPT

SEQ ID NO: 10060 - protein, 6 aa, Homo sapiens
  heavy chain complementarity determining region 3 for antibody 5030
TTGYHA

SEQ ID NO: 10061 - protein, 9 aa, Homo sapiens
  light chain complementarity determining region 3 for antibody 5031
QQYGTTPLT

SEQ ID NO: 10062 - protein, 6 aa, Homo sapiens
  heavy chain complementarity determining region 3 for antibody 5031
TAGYHA

SEQ ID NO: 10063 - protein, 9 aa, Homo sapiens
  light chain complementarity determining region 3 for antibody 5032
QQYGTSPVT

SEQ ID NO: 10064 - protein, 10 aa, Homo sapiens
  heavy chain complementarity determining region 3 for antibody 5032
ARETSGSYDI

SEQ ID NO: 10065 - protein, 9 aa, Homo sapiens
  light chain complementarity determining region 3 for antibody 5033
QQYGTSPVT

SEQ ID NO: 10066 - protein, 13 aa, Homo sapiens
  heavy chain complementarity determining region 3 for antibody 5033
AKDRGSGWFARGY

SEQ ID NO: 10067 - protein, 9 aa, Homo sapiens
  light chain complementarity determining region 3 for antibody 5034
QQYGTSPVT

SEQ ID NO: 10068 - protein, 13 aa, Homo sapiens
  heavy chain complementarity determining region 3 for antibody 5034
AKDRGSDWFAWGY

SEQ ID NO: 10069 - protein, 9 aa, Homo sapiens
  light chain complementarity determining region 3 for antibody 5035
QQYGTSPVT

SEQ ID NO: 10070 - protein, 12 aa, Homo sapiens
  heavy chain complementarity determining region 3 for antibody 5035
AIVVPGRWDLDD

SEQ ID NO: 10071 - protein, 9 aa, Homo sapiens
  light chain complementarity determining region 3 for antibody 5036
QQYGTSPVP

SEQ ID NO: 10072 - protein, 18 aa, Homo sapiens
  heavy chain complementarity determining region 3 for antibody 5036
ARGDYPEARTGYFLDFDY

SEQ ID NO: 10073 - protein, 9 aa, Homo sapiens
  light chain complementarity determining region 3 for antibody 5037
QQYGTSPVP

SEQ ID NO: 10074 - protein, 19 aa, Homo sapiens
  heavy chain complementarity determining region 3 for antibody 5037
AKGDSSGYPIYYYYYGVDV

SEQ ID NO: 10075 - protein, 10 aa, Homo sapiens
  light chain complementarity determining region 3 for antibody 5038
QQYGTSHPLT

SEQ ID NO: 10076 - protein, 12 aa, Homo sapiens
  heavy chain complementarity determining region 3 for antibody 5038
ATSSSWYGYFQD

SEQ ID NO: 10077 - protein, 7 aa, Homo sapiens
  light chain complementarity determining region 3 for antibody 5039
QQYGSYT

SEQ ID NO: 10078 - protein, 10 aa, Homo sapiens
  heavy chain complementarity determining region 3 for antibody 5039
ARRWGRYFDY

SEQ ID NO: 10079 - protein, 7 aa, Homo sapiens
  light chain complementarity determining region 3 for antibody 5040
QQYGSYT

SEQ ID NO: 10080 - protein, 14 aa, Homo sapiens
  heavy chain complementarity determining region 3 for antibody 5040
ARGHFDSTGFRLDY

SEQ ID NO: 10081 - protein, 7 aa, Homo sapiens
  light chain complementarity determining region 3 for antibody 5041
QQYGSYT

SEQ ID NO: 10082 - protein, 12 aa, Homo sapiens
  heavy chain complementarity determining region 3 for antibody 5041
ARDKGGRNGMDV

SEQ ID NO: 10083 - protein, 9 aa, Homo sapiens
  light chain complementarity determining region 3 for antibody 5042
QQYGSTAWT

SEQ ID NO: 10084 - protein, 7 aa, Homo sapiens
  heavy chain complementarity determining region 3 for antibody 5042
TTGDLRN

SEQ ID NO: 10085 - protein, 9 aa, Homo sapiens
  light chain complementarity determining region 3 for antibody 5043
QQYGSSTWT

SEQ ID NO: 10086 - protein, 17 aa, Homo sapiens
  heavy chain complementarity determining region 3 for antibody 5043
SKGRGSVAMALIYYLDL

SEQ ID NO: 10087 - protein, 9 aa, Homo sapiens
  light chain complementarity determining region 3 for antibody 5044
QQYGSSTWT

SEQ ID NO: 10088 - protein, 17 aa, Homo sapiens
  heavy chain complementarity determining region 3 for antibody 5044
AKGRGSVATALIYYLDL

SEQ ID NO: 10089 - protein, 9 aa, Homo sapiens
  light chain complementarity determining region 3 for antibody 5045
QQYGSSTWT

SEQ ID NO: 10090 - protein, 17 aa, Homo sapiens
  heavy chain complementarity determining region 3 for antibody 5045
AKGRGSVAMALVYYLDL

SEQ ID NO: 10091 - protein, 9 aa, Homo sapiens
  light chain complementarity determining region 3 for antibody 5046
QQYGSSTWT

SEQ ID NO: 10092 - protein, 17 aa, Homo sapiens
  heavy chain complementarity determining region 3 for antibody 5046
AEGRGSVAMALIYYLDL

SEQ ID NO: 10093 - protein, 9 aa, Homo sapiens
  light chain complementarity determining region 3 for antibody 5047
QQYGSSTWK

SEQ ID NO: 10094 - protein, 15 aa, Homo sapiens
  heavy chain complementarity determining region 3 for antibody 5047
ARELPQRKYSDGWDH

SEQ ID NO: 10095 - protein, 9 aa, Homo sapiens
  light chain complementarity determining region 3 for antibody 5048
QQYGSSTGT

SEQ ID NO: 10096 - protein, 15 aa, Homo sapiens
  heavy chain complementarity determining region 3 for antibody 5048
ARELPQRKYSDGWDH

SEQ ID NO: 10097 - protein, 9 aa, Homo sapiens
  light chain complementarity determining region 3 for antibody 5049
QQYGSSSWT

SEQ ID NO: 10098 - protein, 17 aa, Homo sapiens
  heavy chain complementarity determining region 3 for antibody 5049
AKGRGSVAMALIYYLDL

SEQ ID NO: 10099 - protein, 9 aa, Homo sapiens
  light chain complementarity determining region 3 for antibody 5050
QQYGSSPWT

SEQ ID NO: 10100 - protein, 13 aa, Homo sapiens
  heavy chain complementarity determining region 3 for antibody 5050
ARYGYGYARPFDF

SEQ ID NO: 10101 - protein, 9 aa, Homo sapiens
  light chain complementarity determining region 3 for antibody 5051
QQYGSSPWT

SEQ ID NO: 10102 - protein, 15 aa, Homo sapiens
  heavy chain complementarity determining region 3 for antibody 5051
ARVGRPYHNAWYFDN

SEQ ID NO: 10103 - protein, 9 aa, Homo sapiens
  light chain complementarity determining region 3 for antibody 5052
QQYGSSPWT

SEQ ID NO: 10104 - protein, 11 aa, Homo sapiens
  heavy chain complementarity determining region 3 for antibody 5052
ARGIPHYYFDL

SEQ ID NO: 10105 - protein, 9 aa, Homo sapiens
  light chain complementarity determining region 3 for antibody 5053
QQYGSSPWT

SEQ ID NO: 10106 - protein, 10 aa, Homo sapiens
  heavy chain complementarity determining region 3 for antibody 5053
ARESSGSYDI

SEQ ID NO: 10107 - protein, 9 aa, Homo sapiens
  light chain complementarity determining region 3 for antibody 5054
QQYGSSPWT

SEQ ID NO: 10108 - protein, 10 aa, Homo sapiens
  heavy chain complementarity determining region 3 for antibody 5054
ARERSGAYDI

SEQ ID NO: 10109 - protein, 9 aa, Homo sapiens
  light chain complementarity determining region 3 for antibody 5055
QQYGSSPWT

SEQ ID NO: 10110 - protein, 15 aa, Homo sapiens
  heavy chain complementarity determining region 3 for antibody 5055
ARELPQRKYSDGWDH

SEQ ID NO: 10111 - protein, 9 aa, Homo sapiens
  light chain complementarity determining region 3 for antibody 5056
QQYGSSPWT

SEQ ID NO: 10112 - protein, 17 aa, Homo sapiens
  heavy chain complementarity determining region 3 for antibody 5056
AKGRGSVAMALIYYLDL

SEQ ID NO: 10113 - protein, 9 aa, Homo sapiens
  light chain complementarity determining region 3 for antibody 5057
QQYGSSPWK

SEQ ID NO: 10114 - protein, 10 aa, Homo sapiens
  heavy chain complementarity determining region 3 for antibody 5057
ARERSGSYDI

SEQ ID NO: 10115 - protein, 8 aa, Homo sapiens
  light chain complementarity determining region 3 for antibody 5058
QQYGSSPT

SEQ ID NO: 10116 - protein, 11 aa, Homo sapiens
  heavy chain complementarity determining region 3 for antibody 5058
ARRSLGGAFDY

SEQ ID NO: 10117 - protein, 9 aa, Homo sapiens
  light chain complementarity determining region 3 for antibody 5059
QQYGSSPRT

SEQ ID NO: 10118 - protein, 10 aa, Homo sapiens
  heavy chain complementarity determining region 3 for antibody 5059
CREREGFGDV

SEQ ID NO: 10119 - protein, 9 aa, Homo sapiens
  light chain complementarity determining region 3 for antibody 5060
QQYGSSPRT

SEQ ID NO: 10120 - protein, 10 aa, Homo sapiens
  heavy chain complementarity determining region 3 for antibody 5060
ARERSGSYDI

SEQ ID NO: 10121 - protein, 10 aa, Homo sapiens
  light chain complementarity determining region 3 for antibody 5061
QQYGSSPPVT

SEQ ID NO: 10122 - protein, 12 aa, Homo sapiens
  heavy chain complementarity determining region 3 for antibody 5061
AIVVPGRWDLDD

SEQ ID NO: 10123 - protein, 10 aa, Homo sapiens
  light chain complementarity determining region 3 for antibody 5062
QQYGSSPPVP

SEQ ID NO: 10124 - protein, 19 aa, Homo sapiens
  heavy chain complementarity determining region 3 for antibody 5062
AREAVRCRDGVCYNATFDI

SEQ ID NO: 10125 - protein, 11 aa, Homo sapiens
  light chain complementarity determining region 3 for antibody 5063
QQYGSSPPVFT

SEQ ID NO: 10126 - protein, 10 aa, Homo sapiens
  heavy chain complementarity determining region 3 for antibody 5063
VVGDYVFFDY

SEQ ID NO: 10127 - protein, 11 aa, Homo sapiens
  light chain complementarity determining region 3 for antibody 5064
QQYGSSPPMYT

SEQ ID NO: 10128 - protein, 13 aa, Homo sapiens
  heavy chain complementarity determining region 3 for antibody 5064
AKEGSAPGPAFEY

SEQ ID NO: 10129 - protein, 11 aa, Homo sapiens
  light chain complementarity determining region 3 for antibody 5065
QQYGSSPPMYP

SEQ ID NO: 10130 - protein, 12 aa, Homo sapiens
  heavy chain complementarity determining region 3 for antibody 5065
ASQETLPYTYGY

SEQ ID NO: 10131 - protein, 10 aa, Homo sapiens
  light chain complementarity determining region 3 for antibody 5066
QQYGSSPPLT

SEQ ID NO: 10132 - protein, 11 aa, Homo sapiens
  heavy chain complementarity determining region 3 for antibody 5066
AREQHGQAPDY

SEQ ID NO: 10133 - protein, 10 aa, Homo sapiens
  light chain complementarity determining region 3 for antibody 5067
QQYGSSPPLT

SEQ ID NO: 10134 - protein, 12 aa, Homo sapiens
  heavy chain complementarity determining region 3 for antibody 5067
ALDEWHPSWYKY

SEQ ID NO: 10135 - protein, 9 aa, Homo sapiens
  light chain complementarity determining region 3 for antibody 5068
QQYGSSPLT

SEQ ID NO: 10136 - protein, 11 aa, Homo sapiens
  heavy chain complementarity determining region 3 for antibody 5068
VSFGQQWGLAY

SEQ ID NO: 10137 - protein, 9 aa, Homo sapiens
  light chain complementarity determining region 3 for antibody 5069
QQYGSPTWT

SEQ ID NO: 10138 - protein, 17 aa, Homo sapiens
  heavy chain complementarity determining region 3 for antibody 5069
AKGRGSVAMALIYYLDL

SEQ ID NO: 10139 - protein, 9 aa, Homo sapiens
  light chain complementarity determining region 3 for antibody 5070
QQYGSPPET

SEQ ID NO: 10140 - protein, 12 aa, Homo sapiens
  heavy chain complementarity determining region 3 for antibody 5070
AIVVPGRWDLDD

SEQ ID NO: 10141 - protein, 10 aa, Homo sapiens
  light chain complementarity determining region 3 for antibody 5071
QQYGRSVPWP

SEQ ID NO: 10142 - protein, 9 aa, Homo sapiens
  heavy chain complementarity determining region 3 for antibody 5071
ARAFGPNFY

SEQ ID NO: 10143 - protein, 10 aa, Homo sapiens
  light chain complementarity determining region 3 for antibody 5072
QQYGRSPPYT

SEQ ID NO: 10144 - protein, 13 aa, Homo sapiens
  heavy chain complementarity determining region 3 for antibody 5072
TTYMAARPEYFRH

SEQ ID NO: 10145 - protein, 10 aa, Homo sapiens
  light chain complementarity determining region 3 for antibody 5073
QQYGRSPLYT

SEQ ID NO: 10146 - protein, 13 aa, Homo sapiens
  heavy chain complementarity determining region 3 for antibody 5073
TTYMAARPEYLRH

SEQ ID NO: 10147 - protein, 10 aa, Homo sapiens
  light chain complementarity determining region 3 for antibody 5074
QQYGRSPLYT

SEQ ID NO: 10148 - protein, 13 aa, Homo sapiens
  heavy chain complementarity determining region 3 for antibody 5074
TAYMAARPEYFRH

SEQ ID NO: 10149 - protein, 10 aa, Homo sapiens
  light chain complementarity determining region 3 for antibody 5075
QQYGRSPLYT

SEQ ID NO: 10150 - protein, 13 aa, Homo sapiens
  heavy chain complementarity determining region 3 for antibody 5075
ATYMAARPEYFRH

SEQ ID NO: 10151 - protein, 10 aa, Homo sapiens
  light chain complementarity determining region 3 for antibody 5076
QQYGRSPLDT

SEQ ID NO: 10152 - protein, 13 aa, Homo sapiens
  heavy chain complementarity determining region 3 for antibody 5076
TTYMAARPEYFRH

SEQ ID NO: 10153 - protein, 10 aa, Homo sapiens
  light chain complementarity determining region 3 for antibody 5077
QQYGRPPLYT

SEQ ID NO: 10154 - protein, 13 aa, Homo sapiens
  heavy chain complementarity determining region 3 for antibody 5077
TTYMAARPEYFRH

SEQ ID NO: 10155 - protein, 9 aa, Homo sapiens
  light chain complementarity determining region 3 for antibody 5078
QQYGNTPFP

SEQ ID NO: 10156 - protein, 12 aa, Homo sapiens
  heavy chain complementarity determining region 3 for antibody 5078
NADHGYVDGFDI

SEQ ID NO: 10157 - protein, 9 aa, Homo sapiens
  light chain complementarity determining region 3 for antibody 5079
QQYGNSRWP

SEQ ID NO: 10158 - protein, 10 aa, Homo sapiens
  heavy chain complementarity determining region 3 for antibody 5079
TTEDWGSGRS

SEQ ID NO: 10159 - protein, 9 aa, Homo sapiens
  light chain complementarity determining region 3 for antibody 5080
QQYGNSPVP

SEQ ID NO: 10160 - protein, 18 aa, Homo sapiens
  heavy chain complementarity determining region 3 for antibody 5080
VRGDYPEARTGYFLDFDY

SEQ ID NO: 10161 - protein, 9 aa, Homo sapiens
  light chain complementarity determining region 3 for antibody 5081
QQYGNSPVP

SEQ ID NO: 10162 - protein, 18 aa, Homo sapiens
  heavy chain complementarity determining region 3 for antibody 5081
ASGDYPEARTGYFLDFDY

SEQ ID NO: 10163 - protein, 9 aa, Homo sapiens
  light chain complementarity determining region 3 for antibody 5082
QQYGNSPVP

SEQ ID NO: 10164 - protein, 17 aa, Homo sapiens
  heavy chain complementarity determining region 3 for antibody 5082
ARGTGIGSGSYYADFDY

SEQ ID NO: 10165 - protein, 9 aa, Homo sapiens
  light chain complementarity determining region 3 for antibody 5083
QQYGNSPVP

SEQ ID NO: 10166 - protein, 18 aa, Homo sapiens
  heavy chain complementarity determining region 3 for antibody 5083
ARGDYTEARTGYFLDFDY

SEQ ID NO: 10167 - protein, 9 aa, Homo sapiens
  light chain complementarity determining region 3 for antibody 5084
QQYGNSPVP

SEQ ID NO: 10168 - protein, 18 aa, Homo sapiens
  heavy chain complementarity determining region 3 for antibody 5084
ARGDYPEARANYVLDFDY

SEQ ID NO: 10169 - protein, 9 aa, Homo sapiens
  light chain complementarity determining region 3 for antibody 5085
QQYGNSPVP

SEQ ID NO: 10170 - protein, 18 aa, Homo sapiens
  heavy chain complementarity determining region 3 for antibody 5085
ARGDYPDARTGYFLDFDY

SEQ ID NO: 10171 - protein, 9 aa, Homo sapiens
  light chain complementarity determining region 3 for antibody 5086
QQYGNSPVP

SEQ ID NO: 10172 - protein, 18 aa, Homo sapiens
  heavy chain complementarity determining region 3 for antibody 5086
ARGDFPEARTGYFLDFDY

SEQ ID NO: 10173 - protein, 10 aa, Homo sapiens
  light chain complementarity determining region 3 for antibody 5087
QQYGNSPRDT

SEQ ID NO: 10174 - protein, 18 aa, Homo sapiens
  heavy chain complementarity determining region 3 for antibody 5087
ARWASLCSSANCYVPFDY

SEQ ID NO: 10175 - protein, 11 aa, Homo sapiens
  light chain complementarity determining region 3 for antibody 5088
QQYGNSPPGYT

SEQ ID NO: 10176 - protein, 13 aa, Homo sapiens
  heavy chain complementarity determining region 3 for antibody 5088
AVVRSISCLSFHY

SEQ ID NO: 10177 - protein, 10 aa, Homo sapiens
  light chain complementarity determining region 3 for antibody 5089
QQYGNSHTWT

SEQ ID NO: 10178 - protein, 19 aa, Homo sapiens
  heavy chain complementarity determining region 3 for antibody 5089
ARHNDGDSFGVSRTNGMDV

SEQ ID NO: 10179 - protein, 9 aa, Homo sapiens
  light chain complementarity determining region 3 for antibody 5090
QQYGNPVYT

SEQ ID NO: 10180 - protein, 11 aa, Homo sapiens
  heavy chain complementarity determining region 3 for antibody 5090
AAVDSWGTLDY

SEQ ID NO: 10181 - protein, 9 aa, Homo sapiens
  light chain complementarity determining region 3 for antibody 5091
QQYGNLPYT

SEQ ID NO: 10182 - protein, 13 aa, Homo sapiens
  heavy chain complementarity determining region 3 for antibody 5091
AKEGSAPGPDFEY

SEQ ID NO: 10183 - protein, 10 aa, Homo sapiens
  light chain complementarity determining region 3 for antibody 5092
QQYGGSPPFT

SEQ ID NO: 10184 - protein, 12 aa, Homo sapiens
  heavy chain complementarity determining region 3 for antibody 5092
ARDLSHRTPGGY

SEQ ID NO: 10185 - protein, 10 aa, Homo sapiens
  light chain complementarity determining region 3 for antibody 5093
QQYGGSPPFP

SEQ ID NO: 10186 - protein, 14 aa, Homo sapiens
  heavy chain complementarity determining region 3 for antibody 5093
AKTTLITTAWGMDV

SEQ ID NO: 10187 - protein, 11 aa, Homo sapiens
  light chain complementarity determining region 3 for antibody 5094
QQYGGSPPEGT

SEQ ID NO: 10188 - protein, 18 aa, Homo sapiens
  heavy chain complementarity determining region 3 for antibody 5094
AKGNRWYCSTTNCYLFDS

SEQ ID NO: 10189 - protein, 11 aa, Homo sapiens
  light chain complementarity determining region 3 for antibody 5095
QQYGGSPPEGT

SEQ ID NO: 10190 - protein, 18 aa, Homo sapiens
  heavy chain complementarity determining region 3 for antibody 5095
AKDNRWYCSTTNCYLFDA

SEQ ID NO: 10191 - protein, 9 aa, Homo sapiens
  light chain complementarity determining region 3 for antibody 5096
QQYGGSLLT

SEQ ID NO: 10192 - protein, 13 aa, Homo sapiens
  heavy chain complementarity determining region 3 for antibody 5096
AKEGSSPGPDFDY

SEQ ID NO: 10193 - protein, 11 aa, Homo sapiens
  light chain complementarity determining region 3 for antibody 5097
QQYGGPPPEGT

SEQ ID NO: 10194 - protein, 18 aa, Homo sapiens
  heavy chain complementarity determining region 3 for antibody 5097
AKDNRWYCSTTNCYLFDS

SEQ ID NO: 10195 - protein, 9 aa, Homo sapiens
  light chain complementarity determining region 3 for antibody 5098
QQYGELALT

SEQ ID NO: 10196 - protein, 13 aa, Homo sapiens
  heavy chain complementarity determining region 3 for antibody 5098
AKGRGSGWYAWGY

SEQ ID NO: 10197 - protein, 9 aa, Homo sapiens
  light chain complementarity determining region 3 for antibody 5099
QQYGDSPVP

SEQ ID NO: 10198 - protein, 18 aa, Homo sapiens
  heavy chain complementarity determining region 3 for antibody 5099
ARGDYTEARTGYFLDFDY

SEQ ID NO: 10199 - protein, 9 aa, Homo sapiens
  light chain complementarity determining region 3 for antibody 5100
QQYGDSPVP

SEQ ID NO: 10200 - protein, 18 aa, Homo sapiens
  heavy chain complementarity determining region 3 for antibody 5100
ARGDYPEARTGYFRDFDY

SEQ ID NO: 10201 - protein, 9 aa, Homo sapiens
  light chain complementarity determining region 3 for antibody 5101
QQYGDSPVP

SEQ ID NO: 10202 - protein, 18 aa, Homo sapiens
  heavy chain complementarity determining region 3 for antibody 5101
ARGDSPEARTGYFLDFDY

SEQ ID NO: 10203 - protein, 8 aa, Homo sapiens
  light chain complementarity determining region 3 for antibody 5102
QQYGDSFP

SEQ ID NO: 10204 - protein, 12 aa, Homo sapiens
  heavy chain complementarity determining region 3 for antibody 5102
ARLDWNYRAFDI

SEQ ID NO: 10205 - protein, 8 aa, Homo sapiens
  light chain complementarity determining region 3 for antibody 5103
QQYGDSFP

SEQ ID NO: 10206 - protein, 17 aa, Homo sapiens
  heavy chain complementarity determining region 3 for antibody 5103
ARGTGIGSGSCYADFDY

SEQ ID NO: 10207 - protein, 8 aa, Homo sapiens
  light chain complementarity determining region 3 for antibody 5104
QQYGDSFP

SEQ ID NO: 10208 - protein, 10 aa, Homo sapiens
  heavy chain complementarity determining region 3 for antibody 5104
ARERSGSYDI

SEQ ID NO: 10209 - protein, 9 aa, Homo sapiens
  light chain complementarity determining region 3 for antibody 5105
QQYFNTPET

SEQ ID NO: 10210 - protein, 15 aa, Homo sapiens
  heavy chain complementarity determining region 3 for antibody 5105
ARDLFSGSYAYGDDY

SEQ ID NO: 10211 - protein, 9 aa, Homo sapiens
  light chain complementarity determining region 3 for antibody 5106
QQYFGAPYS

SEQ ID NO: 10212 - protein, 13 aa, Homo sapiens
  heavy chain complementarity determining region 3 for antibody 5106
VPGSGYHPELFQY

SEQ ID NO: 10213 - protein, 9 aa, Homo sapiens
  light chain complementarity determining region 3 for antibody 5107
QQYENYPLT

SEQ ID NO: 10214 - protein, 12 aa, Homo sapiens
  heavy chain complementarity determining region 3 for antibody 5107
ARDFTANYCPDY

SEQ ID NO: 10215 - protein, 9 aa, Homo sapiens
  light chain complementarity determining region 3 for antibody 5108
QQYEALPPT

SEQ ID NO: 10216 - protein, 17 aa, Homo sapiens
  heavy chain complementarity determining region 3 for antibody 5108
ARNTMVGTWQRQGNLDH

SEQ ID NO: 10217 - protein, 10 aa, Homo sapiens
  light chain complementarity determining region 3 for antibody 5109
QQYDYSPPWT

SEQ ID NO: 10218 - protein, 14 aa, Homo sapiens
  heavy chain complementarity determining region 3 for antibody 5109
SRPTKAARLPIFDY

SEQ ID NO: 10219 - protein, 10 aa, Homo sapiens
  light chain complementarity determining region 3 for antibody 5110
QQYDYSPPWT

SEQ ID NO: 10220 - protein, 14 aa, Homo sapiens
  heavy chain complementarity determining region 3 for antibody 5110
SHPTRAARLPSFDY

SEQ ID NO: 10221 - protein, 10 aa, Homo sapiens
  light chain complementarity determining region 3 for antibody 5111
QQYDYSPPWT

SEQ ID NO: 10222 - protein, 14 aa, Homo sapiens
  heavy chain complementarity determining region 3 for antibody 5111
AHPTRAARLPIFDY

SEQ ID NO: 10223 - protein, 10 aa, Homo sapiens
  light chain complementarity determining region 3 for antibody 5112
QQYDYSPPWA

SEQ ID NO: 10224 - protein, 14 aa, Homo sapiens
  heavy chain complementarity determining region 3 for antibody 5112
SHPTRAARLPIFDY

SEQ ID NO: 10225 - protein, 10 aa, Homo sapiens
  light chain complementarity determining region 3 for antibody 5113
QQYDYSPPRT

SEQ ID NO: 10226 - protein, 14 aa, Homo sapiens
  heavy chain complementarity determining region 3 for antibody 5113
SHPTRAARLPIFDY

SEQ ID NO: 10227 - protein, 10 aa, Homo sapiens
  light chain complementarity determining region 3 for antibody 5114
QQYDYSPPCT

SEQ ID NO: 10228 - protein, 14 aa, Homo sapiens
  heavy chain complementarity determining region 3 for antibody 5114
SHPTKAARLPIFDY

SEQ ID NO: 10229 - protein, 10 aa, Homo sapiens
  light chain complementarity determining region 3 for antibody 5115
QQYDTLPPWT

SEQ ID NO: 10230 - protein, 15 aa, Homo sapiens
  heavy chain complementarity determining region 3 for antibody 5115
TKDEYPGNQIEAFDI

SEQ ID NO: 10231 - protein, 9 aa, Homo sapiens
  light chain complementarity determining region 3 for antibody 5116
QQYDSYSHT

SEQ ID NO: 10232 - protein, 14 aa, Homo sapiens
  heavy chain complementarity determining region 3 for antibody 5116
ARDVHTTGWTLGGY

SEQ ID NO: 10233 - protein, 9 aa, Homo sapiens
  light chain complementarity determining region 3 for antibody 5117
QQYDSLPLT

SEQ ID NO: 10234 - protein, 14 aa, Homo sapiens
  heavy chain complementarity determining region 3 for antibody 5117
ARLHGSGLGRWLDP

SEQ ID NO: 10235 - protein, 9 aa, Homo sapiens
  light chain complementarity determining region 3 for antibody 5118
QQYDRYAHT

SEQ ID NO: 10236 - protein, 14 aa, Homo sapiens
  heavy chain complementarity determining region 3 for antibody 5118
ARGVHTTGWTLGGY

SEQ ID NO: 10237 - protein, 9 aa, Homo sapiens
  light chain complementarity determining region 3 for antibody 5119
QQYDRYAHT

SEQ ID NO: 10238 - protein, 14 aa, Homo sapiens
  heavy chain complementarity determining region 3 for antibody 5119
ARDVHTTGWPLGGY

SEQ ID NO: 10239 - protein, 9 aa, Homo sapiens
  light chain complementarity determining region 3 for antibody 5120
QQYDRYAHT

SEQ ID NO: 10240 - protein, 14 aa, Homo sapiens
  heavy chain complementarity determining region 3 for antibody 5120
ARAVHTTGWTLGGY

SEQ ID NO: 10241 - protein, 9 aa, Homo sapiens
  light chain complementarity determining region 3 for antibody 5121
QQYDNWPWT

SEQ ID NO: 10242 - protein, 17 aa, Homo sapiens
  heavy chain complementarity determining region 3 for antibody 5121
VTHYYHDSGSYHDFFNY

SEQ ID NO: 10243 - protein, 9 aa, Homo sapiens
  light chain complementarity determining region 3 for antibody 5122
QQYDNWPWT

SEQ ID NO: 10244 - protein, 17 aa, Homo sapiens
  heavy chain complementarity determining region 3 for antibody 5122
VTHYYHDSGIYHEFFNY

SEQ ID NO: 10245 - protein, 9 aa, Homo sapiens
  light chain complementarity determining region 3 for antibody 5123
QQYDNWPWT

SEQ ID NO: 10246 - protein, 17 aa, Homo sapiens
  heavy chain complementarity determining region 3 for antibody 5123
VTHYYHDSGIYHDSFNY

SEQ ID NO: 10247 - protein, 9 aa, Homo sapiens
  light chain complementarity determining region 3 for antibody 5124
QQYDNWPWT

SEQ ID NO: 10248 - protein, 17 aa, Homo sapiens
  heavy chain complementarity determining region 3 for antibody 5124
VTHYYHDSGIYHDLFNY

SEQ ID NO: 10249 - protein, 9 aa, Homo sapiens
  light chain complementarity determining region 3 for antibody 5125
QQYDNWPWT

SEQ ID NO: 10250 - protein, 17 aa, Homo sapiens
  heavy chain complementarity determining region 3 for antibody 5125
VTHYYHDSGIYHDFLNY

SEQ ID NO: 10251 - protein, 9 aa, Homo sapiens
  light chain complementarity determining region 3 for antibody 5126
QQYDNWPWT

SEQ ID NO: 10252 - protein, 17 aa, Homo sapiens
  heavy chain complementarity determining region 3 for antibody 5126
VTHYYHDSGICHDFFNY

SEQ ID NO: 10253 - protein, 9 aa, Homo sapiens
  light chain complementarity determining region 3 for antibody 5127
QQYDNWPWK

SEQ ID NO: 10254 - protein, 17 aa, Homo sapiens
  heavy chain complementarity determining region 3 for antibody 5127
VTHYYHDSGIYHDFFNY

SEQ ID NO: 10255 - protein, 10 aa, Homo sapiens
  light chain complementarity determining region 3 for antibody 5128
QQYDNWPPWR

SEQ ID NO: 10256 - protein, 15 aa, Homo sapiens
  heavy chain complementarity determining region 3 for antibody 5128
ARDIRVGASKCYFDY

SEQ ID NO: 10257 - protein, 9 aa, Homo sapiens
  light chain complementarity determining region 3 for antibody 5129
QQYDNWPGT

SEQ ID NO: 10258 - protein, 17 aa, Homo sapiens
  heavy chain complementarity determining region 3 for antibody 5129
VTHYYHDSGIYHDFFNY

SEQ ID NO: 10259 - protein, 9 aa, Homo sapiens
  light chain complementarity determining region 3 for antibody 5130
QQYDNLPYT

SEQ ID NO: 10260 - protein, 16 aa, Homo sapiens
  heavy chain complementarity determining region 3 for antibody 5130
VRDLAGFTRGGSTFDY

SEQ ID NO: 10261 - protein, 9 aa, Homo sapiens
  light chain complementarity determining region 3 for antibody 5131
QQYDNLPYT

SEQ ID NO: 10262 - protein, 14 aa, Homo sapiens
  heavy chain complementarity determining region 3 for antibody 5131
ARGHFDSTGFRLDY

SEQ ID NO: 10263 - protein, 9 aa, Homo sapiens
  light chain complementarity determining region 3 for antibody 5132
QQYDNLPYT

SEQ ID NO: 10264 - protein, 13 aa, Homo sapiens
  heavy chain complementarity determining region 3 for antibody 5132
AKEGSSPGPDFEY

SEQ ID NO: 10265 - protein, 9 aa, Homo sapiens
  light chain complementarity determining region 3 for antibody 5133
QQYDNLPYT

SEQ ID NO: 10266 - protein, 13 aa, Homo sapiens
  heavy chain complementarity determining region 3 for antibody 5133
AKEGSAPGPDVEY

SEQ ID NO: 10267 - protein, 9 aa, Homo sapiens
  light chain complementarity determining region 3 for antibody 5134
QQYDNLPYT

SEQ ID NO: 10268 - protein, 13 aa, Homo sapiens
  heavy chain complementarity determining region 3 for antibody 5134
AKEGSAPGPAFEY

SEQ ID NO: 10269 - protein, 9 aa, Homo sapiens
  light chain complementarity determining region 3 for antibody 5135
QQYDNLPYT

SEQ ID NO: 10270 - protein, 13 aa, Homo sapiens
  heavy chain complementarity determining region 3 for antibody 5135
AEEGSAPGPDFEY

SEQ ID NO: 10271 - protein, 9 aa, Homo sapiens
  light chain complementarity determining region 3 for antibody 5136
QQYDNLPYP

SEQ ID NO: 10272 - protein, 13 aa, Homo sapiens
  heavy chain complementarity determining region 3 for antibody 5136
AKEGSAPGPDFEY

SEQ ID NO: 10273 - protein, 9 aa, Homo sapiens
  light chain complementarity determining region 3 for antibody 5137
QQYDNLPRT

SEQ ID NO: 10274 - protein, 11 aa, Homo sapiens
  heavy chain complementarity determining region 3 for antibody 5137
TRGGYSVGYDY

SEQ ID NO: 10275 - protein, 10 aa, Homo sapiens
  light chain complementarity determining region 3 for antibody 5138
QQYDNLPPLP

SEQ ID NO: 10276 - protein, 10 aa, Homo sapiens
  heavy chain complementarity determining region 3 for antibody 5138
ARGGLAGDIQ

SEQ ID NO: 10277 - protein, 9 aa, Homo sapiens
  light chain complementarity determining region 3 for antibody 5139
QQYDNLPPA

SEQ ID NO: 10278 - protein, 20 aa, Homo sapiens
  heavy chain complementarity determining region 3 for antibody 5139
TRDARGSISYAYGGGGGLDV

SEQ ID NO: 10279 - protein, 9 aa, Homo sapiens
  light chain complementarity determining region 3 for antibody 5140
QQYDNLPPA

SEQ ID NO: 10280 - protein, 13 aa, Homo sapiens
  heavy chain complementarity determining region 3 for antibody 5140
TKEGSSAVPDFVY

SEQ ID NO: 10281 - protein, 9 aa, Homo sapiens
  light chain complementarity determining region 3 for antibody 5141
QQYDNLPPA

SEQ ID NO: 10282 - protein, 13 aa, Homo sapiens
  heavy chain complementarity determining region 3 for antibody 5141
TKEGSSAGPSRQS

SEQ ID NO: 10283 - protein, 9 aa, Homo sapiens
  light chain complementarity determining region 3 for antibody 5142
QQYDNLPPA

SEQ ID NO: 10284 - protein, 13 aa, Homo sapiens
  heavy chain complementarity determining region 3 for antibody 5142
TKEGSSAGPDCVY

SEQ ID NO: 10285 - protein, 9 aa, Homo sapiens
  light chain complementarity determining region 3 for antibody 5143
QQYDNLPPA

SEQ ID NO: 10286 - protein, 13 aa, Homo sapiens
  heavy chain complementarity determining region 3 for antibody 5143
TKEGASAGPDFVY

SEQ ID NO: 10287 - protein, 9 aa, Homo sapiens
  light chain complementarity determining region 3 for antibody 5144
QQYDNLPPA

SEQ ID NO: 10288 - protein, 13 aa, Homo sapiens
  heavy chain complementarity determining region 3 for antibody 5144
TKDGSSAGPDFVY

SEQ ID NO: 10289 - protein, 9 aa, Homo sapiens
  light chain complementarity determining region 3 for antibody 5145
QQYDNLPPA

SEQ ID NO: 10290 - protein, 13 aa, Homo sapiens
  heavy chain complementarity determining region 3 for antibody 5145
AKEGSSAGPDFDY

SEQ ID NO: 10291 - protein, 9 aa, Homo sapiens
  light chain complementarity determining region 3 for antibody 5146
QQYDNLPNT

SEQ ID NO: 10292 - protein, 13 aa, Homo sapiens
  heavy chain complementarity determining region 3 for antibody 5146
AKEGSAPGPDFEY

SEQ ID NO: 10293 - protein, 9 aa, Homo sapiens
  light chain complementarity determining region 3 for antibody 5147
QQYDNLPLT

SEQ ID NO: 10294 - protein, 10 aa, Homo sapiens
  heavy chain complementarity determining region 3 for antibody 5147
ARETAGSYDI

SEQ ID NO: 10295 - protein, 9 aa, Homo sapiens
  light chain complementarity determining region 3 for antibody 5148
QQYDNLPLT

SEQ ID NO: 10296 - protein, 12 aa, Homo sapiens
  heavy chain complementarity determining region 3 for antibody 5148
AMVVPGRWDLDD

SEQ ID NO: 10297 - protein, 9 aa, Homo sapiens
  light chain complementarity determining region 3 for antibody 5149
QQYDNLPLT

SEQ ID NO: 10298 - protein, 17 aa, Homo sapiens
  heavy chain complementarity determining region 3 for antibody 5149
AKGRGSVAMALIYYLDL

SEQ ID NO: 10299 - protein, 9 aa, Homo sapiens
  light chain complementarity determining region 3 for antibody 5150
QQYDNLPLT

SEQ ID NO: 10300 - protein, 12 aa, Homo sapiens
  heavy chain complementarity determining region 3 for antibody 5150
AIVVPGRWGLDD

SEQ ID NO: 10301 - protein, 9 aa, Homo sapiens
  light chain complementarity determining region 3 for antibody 5151
QQYDNLPLT

SEQ ID NO: 10302 - protein, 12 aa, Homo sapiens
  heavy chain complementarity determining region 3 for antibody 5151
AIVVPGRWDIDD

SEQ ID NO: 10303 - protein, 9 aa, Homo sapiens
  light chain complementarity determining region 3 for antibody 5152
QQYDNLPLT

SEQ ID NO: 10304 - protein, 12 aa, Homo sapiens
  heavy chain complementarity determining region 3 for antibody 5152
AIVVPGRWALDD

SEQ ID NO: 10305 - protein, 8 aa, Homo sapiens
  light chain complementarity determining region 3 for antibody 5153
QQYDNLLT

SEQ ID NO: 10306 - protein, 13 aa, Homo sapiens
  heavy chain complementarity determining region 3 for antibody 5153
ARPYGDYGWALNI

SEQ ID NO: 10307 - protein, 8 aa, Homo sapiens
  light chain complementarity determining region 3 for antibody 5154
QQYDNLLP

SEQ ID NO: 10308 - protein, 13 aa, Homo sapiens
  heavy chain complementarity determining region 3 for antibody 5154
ARPYGDYGWAFNI

SEQ ID NO: 10309 - protein, 10 aa, Homo sapiens
  light chain complementarity determining region 3 for antibody 5155
QQYDNLASLT

SEQ ID NO: 10310 - protein, 13 aa, Homo sapiens
  heavy chain complementarity determining region 3 for antibody 5155
SKEGSSPGPDFEY

SEQ ID NO: 10311 - protein, 10 aa, Homo sapiens
  light chain complementarity determining region 3 for antibody 5156
QQYDNLASLT

SEQ ID NO: 10312 - protein, 11 aa, Homo sapiens
  heavy chain complementarity determining region 3 for antibody 5156
AREQHGQAPDY

SEQ ID NO: 10313 - protein, 10 aa, Homo sapiens
  light chain complementarity determining region 3 for antibody 5157
QQYDNLASLT

SEQ ID NO: 10314 - protein, 13 aa, Homo sapiens
  heavy chain complementarity determining region 3 for antibody 5157
AKEGYSPGPDFEY

SEQ ID NO: 10315 - protein, 10 aa, Homo sapiens
  light chain complementarity determining region 3 for antibody 5158
QQYDNLASLT

SEQ ID NO: 10316 - protein, 13 aa, Homo sapiens
  heavy chain complementarity determining region 3 for antibody 5158
AKEGSSTGPDFEY

SEQ ID NO: 10317 - protein, 10 aa, Homo sapiens
  light chain complementarity determining region 3 for antibody 5159
QQYDNLASLT

SEQ ID NO: 10318 - protein, 13 aa, Homo sapiens
  heavy chain complementarity determining region 3 for antibody 5159
AKEGSSPGPNFEY

SEQ ID NO: 10319 - protein, 10 aa, Homo sapiens
  light chain complementarity determining region 3 for antibody 5160
QQYDNLASLT

SEQ ID NO: 10320 - protein, 13 aa, Homo sapiens
  heavy chain complementarity determining region 3 for antibody 5160
AKEGSSPDPDFEY

SEQ ID NO: 10321 - protein, 10 aa, Homo sapiens
  light chain complementarity determining region 3 for antibody 5161
QQYDNLASLT

SEQ ID NO: 10322 - protein, 13 aa, Homo sapiens
  heavy chain complementarity determining region 3 for antibody 5161
AKEGSSAGPDFEY

SEQ ID NO: 10323 - protein, 10 aa, Homo sapiens
  light chain complementarity determining region 3 for antibody 5162
QQYDNLASLT

SEQ ID NO: 10324 - protein, 13 aa, Homo sapiens
  heavy chain complementarity determining region 3 for antibody 5162
AKEESSPGPDFEY

SEQ ID NO: 10325 - protein, 10 aa, Homo sapiens
  light chain complementarity determining region 3 for antibody 5163
QQYDNLASLT

SEQ ID NO: 10326 - protein, 13 aa, Homo sapiens
  heavy chain complementarity determining region 3 for antibody 5163
AKDRGSGWFAWGY

SEQ ID NO: 10327 - protein, 10 aa, Homo sapiens
  light chain complementarity determining region 3 for antibody 5164
QQYDNLASLT

SEQ ID NO: 10328 - protein, 13 aa, Homo sapiens
  heavy chain complementarity determining region 3 for antibody 5164
AKAGSSPGPDFEY

SEQ ID NO: 10329 - protein, 9 aa, Homo sapiens
  light chain complementarity determining region 3 for antibody 5165
QQYDNIPPA

SEQ ID NO: 10330 - protein, 13 aa, Homo sapiens
  heavy chain complementarity determining region 3 for antibody 5165
TKEGSSAGPDFVY

SEQ ID NO: 10331 - protein, 8 aa, Homo sapiens
  light chain complementarity determining region 3 for antibody 5166
QQYDNART

SEQ ID NO: 10332 - protein, 11 aa, Homo sapiens
  heavy chain complementarity determining region 3 for antibody 5166
ATFGQQWRLAH

SEQ ID NO: 10333 - protein, 8 aa, Homo sapiens
  light chain complementarity determining region 3 for antibody 5167
QQYDLSLT

SEQ ID NO: 10334 - protein, 14 aa, Homo sapiens
  heavy chain complementarity determining region 3 for antibody 5167
ARGPIGDYTDYFPY

SEQ ID NO: 10335 - protein, 8 aa, Homo sapiens
  light chain complementarity determining region 3 for antibody 5168
QQYDLSLP

SEQ ID NO: 10336 - protein, 14 aa, Homo sapiens
  heavy chain complementarity determining region 3 for antibody 5168
ARGTIGDYTDYFPY

SEQ ID NO: 10337 - protein, 10 aa, Homo sapiens
  light chain complementarity determining region 3 for antibody 5169
QQYDISPPWT

SEQ ID NO: 10338 - protein, 16 aa, Homo sapiens
  heavy chain complementarity determining region 3 for antibody 5169
ASPNTLGRLVGVASDY

SEQ ID NO: 10339 - protein, 10 aa, Homo sapiens
  light chain complementarity determining region 3 for antibody 5170
QQYDISPPWT

SEQ ID NO: 10340 - protein, 16 aa, Homo sapiens
  heavy chain complementarity determining region 3 for antibody 5170
ASPNTLGRLAGVAFDY

SEQ ID NO: 10341 - protein, 10 aa, Homo sapiens
  light chain complementarity determining region 3 for antibody 5171
QQYDISPPWT

SEQ ID NO: 10342 - protein, 16 aa, Homo sapiens
  heavy chain complementarity determining region 3 for antibody 5171
ASPITLGRLVGVAFDY

SEQ ID NO: 10343 - protein, 9 aa, Homo sapiens
  light chain complementarity determining region 3 for antibody 5172
QQYDHYAHT

SEQ ID NO: 10344 - protein, 14 aa, Homo sapiens
  heavy chain complementarity determining region 3 for antibody 5172
ARDVHTTGWTLGGS

SEQ ID NO: 10345 - protein, 9 aa, Homo sapiens
  light chain complementarity determining region 3 for antibody 5173
QQYDHYAHT

SEQ ID NO: 10346 - protein, 14 aa, Homo sapiens
  heavy chain complementarity determining region 3 for antibody 5173
ARDVHATGWTLGGY

SEQ ID NO: 10347 - protein, 9 aa, Homo sapiens
  light chain complementarity determining region 3 for antibody 5174
QQYDHYAHT

SEQ ID NO: 10348 - protein, 14 aa, Homo sapiens
  heavy chain complementarity determining region 3 for antibody 5174
ARDVDTTGWTLGGY

SEQ ID NO: 10349 - protein, 10 aa, Homo sapiens
  light chain complementarity determining region 3 for antibody 5175
QQYDDLASLT

SEQ ID NO: 10350 - protein, 13 aa, Homo sapiens
  heavy chain complementarity determining region 3 for antibody 5175
AKEGSSPGPDFEY

SEQ ID NO: 10351 - protein, 9 aa, Homo sapiens
  light chain complementarity determining region 3 for antibody 5176
QQYATSPLT

SEQ ID NO: 10352 - protein, 14 aa, Homo sapiens
  heavy chain complementarity determining region 3 for antibody 5176
ARASGGDTGFLIDF

SEQ ID NO: 10353 - protein, 9 aa, Homo sapiens
  light chain complementarity determining region 3 for antibody 5177
QQYATSPLT

SEQ ID NO: 10354 - protein, 14 aa, Homo sapiens
  heavy chain complementarity determining region 3 for antibody 5177
ARASGGDTDCLIDF

SEQ ID NO: 10355 - protein, 9 aa, Homo sapiens
  light chain complementarity determining region 3 for antibody 5178
QQYAREPFT

SEQ ID NO: 10356 - protein, 11 aa, Homo sapiens
  heavy chain complementarity determining region 3 for antibody 5178
ATGYDNVKVGY

SEQ ID NO: 10357 - protein, 10 aa, Homo sapiens
  light chain complementarity determining region 3 for antibody 5179
QQYANLASLT

SEQ ID NO: 10358 - protein, 13 aa, Homo sapiens
  heavy chain complementarity determining region 3 for antibody 5179
AKEGSSPGPDFEY

SEQ ID NO: 10359 - protein, 9 aa, Homo sapiens
  light chain complementarity determining region 3 for antibody 5180
QQYAKAPLP

SEQ ID NO: 10360 - protein, 9 aa, Homo sapiens
  heavy chain complementarity determining region 3 for antibody 5180
VRADWLHDY

SEQ ID NO: 10361 - protein, 9 aa, Homo sapiens
  light chain complementarity determining region 3 for antibody 5181
QQYAASPLP

SEQ ID NO: 10362 - protein, 13 aa, Homo sapiens
  heavy chain complementarity determining region 3 for antibody 5181
VRGTCAGCWQFDY

SEQ ID NO: 10363 - protein, 9 aa, Homo sapiens
  light chain complementarity determining region 3 for antibody 5182
QQYAASPLP

SEQ ID NO: 10364 - protein, 9 aa, Homo sapiens
  heavy chain complementarity determining region 3 for antibody 5182
TRATWLLDY

SEQ ID NO: 10365 - protein, 9 aa, Homo sapiens
  light chain complementarity determining region 3 for antibody 5183
QQVNTYPLT

SEQ ID NO: 10366 - protein, 20 aa, Homo sapiens
  heavy chain complementarity determining region 3 for antibody 5183
ARNLQYCSGGSCYGPFYFDY

SEQ ID NO: 10367 - protein, 9 aa, Homo sapiens
  light chain complementarity determining region 3 for antibody 5184
QQTYTFPLT

SEQ ID NO: 10368 - protein, 18 aa, Homo sapiens
  heavy chain complementarity determining region 3 for antibody 5184
ARDSRVYSGYDNYFYMDV

SEQ ID NO: 10369 - protein, 9 aa, Homo sapiens
  light chain complementarity determining region 3 for antibody 5185
QQTYSSPWT

SEQ ID NO: 10370 - protein, 15 aa, Homo sapiens
  heavy chain complementarity determining region 3 for antibody 5185
TRIWTSSTNCRYMDV

SEQ ID NO: 10371 - protein, 9 aa, Homo sapiens
  light chain complementarity determining region 3 for antibody 5186
QQTYSSPWT

SEQ ID NO: 10372 - protein, 12 aa, Homo sapiens
  heavy chain complementarity determining region 3 for antibody 5186
NADHGYVDGFDI

SEQ ID NO: 10373 - protein, 9 aa, Homo sapiens
  light chain complementarity determining region 3 for antibody 5187
QQTYSSPWT

SEQ ID NO: 10374 - protein, 15 aa, Homo sapiens
  heavy chain complementarity determining region 3 for antibody 5187
GKEGPGSSGWLTGHY

SEQ ID NO: 10375 - protein, 9 aa, Homo sapiens
  light chain complementarity determining region 3 for antibody 5188
QQTYSSPWT

SEQ ID NO: 10376 - protein, 15 aa, Homo sapiens
  heavy chain complementarity determining region 3 for antibody 5188
ERIWTSSTNCRYMDV

SEQ ID NO: 10377 - protein, 9 aa, Homo sapiens
  light chain complementarity determining region 3 for antibody 5189
QQTYSSPWT

SEQ ID NO: 10378 - protein, 10 aa, Homo sapiens
  heavy chain complementarity determining region 3 for antibody 5189
CRDREGFGDV

SEQ ID NO: 10379 - protein, 9 aa, Homo sapiens
  light chain complementarity determining region 3 for antibody 5190
QQTYSSPWT

SEQ ID NO: 10380 - protein, 15 aa, Homo sapiens
  heavy chain complementarity determining region 3 for antibody 5190
ARVGRPYHNAWYFDN

SEQ ID NO: 10381 - protein, 9 aa, Homo sapiens
  light chain complementarity determining region 3 for antibody 5191
QQTYSSPWT

SEQ ID NO: 10382 - protein, 15 aa, Homo sapiens
  heavy chain complementarity determining region 3 for antibody 5191
ARSGTSSTNCRYMDV

SEQ ID NO: 10383 - protein, 9 aa, Homo sapiens
  light chain complementarity determining region 3 for antibody 5192
QQTYSSPWT

SEQ ID NO: 10384 - protein, 15 aa, Homo sapiens
  heavy chain complementarity determining region 3 for antibody 5192
ARNWTSSTNCRYMDV

SEQ ID NO: 10385 - protein, 9 aa, Homo sapiens
  light chain complementarity determining region 3 for antibody 5193
QQTYSSPWT

SEQ ID NO: 10386 - protein, 15 aa, Homo sapiens
  heavy chain complementarity determining region 3 for antibody 5193
ARIWTSSTNGRYMDV

SEQ ID NO: 10387 - protein, 9 aa, Homo sapiens
  light chain complementarity determining region 3 for antibody 5194
QQTYSSPWT

SEQ ID NO: 10388 - protein, 15 aa, Homo sapiens
  heavy chain complementarity determining region 3 for antibody 5194
ARIWTSSTNCRYMEV

SEQ ID NO: 10389 - protein, 9 aa, Homo sapiens
  light chain complementarity determining region 3 for antibody 5195
QQTYSSPWT

SEQ ID NO: 10390 - protein, 15 aa, Homo sapiens
  heavy chain complementarity determining region 3 for antibody 5195
ARIWTSSTNCRDMDV

SEQ ID NO: 10391 - protein, 9 aa, Homo sapiens
  light chain complementarity determining region 3 for antibody 5196
QQTYSSPWT

SEQ ID NO: 10392 - protein, 15 aa, Homo sapiens
  heavy chain complementarity determining region 3 for antibody 5196
ARIWTSGPNCRYMDV

SEQ ID NO: 10393 - protein, 9 aa, Homo sapiens
  light chain complementarity determining region 3 for antibody 5197
QQTYSSPWT

SEQ ID NO: 10394 - protein, 15 aa, Homo sapiens
  heavy chain complementarity determining region 3 for antibody 5197
ARIGTRSTNCRYMDV

SEQ ID NO: 10395 - protein, 9 aa, Homo sapiens
  light chain complementarity determining region 3 for antibody 5198
QQTYSSPWT

SEQ ID NO: 10396 - protein, 12 aa, Homo sapiens
  heavy chain complementarity determining region 3 for antibody 5198
ALDEWHPSWYKY

SEQ ID NO: 10397 - protein, 9 aa, Homo sapiens
  light chain complementarity determining region 3 for antibody 5199
QQTYSSPWT

SEQ ID NO: 10398 - protein, 10 aa, Homo sapiens
  heavy chain complementarity determining region 3 for antibody 5199
AHRINRAFDI

SEQ ID NO: 10399 - protein, 9 aa, Homo sapiens
  light chain complementarity determining region 3 for antibody 5200
QQTYSSPWP

SEQ ID NO: 10400 - protein, 11 aa, Homo sapiens
  heavy chain complementarity determining region 3 for antibody 5200
TRGGYSVGYDY

SEQ ID NO: 10401 - protein, 9 aa, Homo sapiens
  light chain complementarity determining region 3 for antibody 5201
QQTYSSPWP

SEQ ID NO: 10402 - protein, 15 aa, Homo sapiens
  heavy chain complementarity determining region 3 for antibody 5201
ARIWPSSTNCRYMDV

SEQ ID NO: 10403 - protein, 9 aa, Homo sapiens
  light chain complementarity determining region 3 for antibody 5202
QQTYSSPPP

SEQ ID NO: 10404 - protein, 15 aa, Homo sapiens
  heavy chain complementarity determining region 3 for antibody 5202
VRGIVLLRGVWGMDV

SEQ ID NO: 10405 - protein, 9 aa, Homo sapiens
  light chain complementarity determining region 3 for antibody 5203
QQTYRVPYT

SEQ ID NO: 10406 - protein, 14 aa, Homo sapiens
  heavy chain complementarity determining region 3 for antibody 5203
ARLHGSGLGRWLDA

SEQ ID NO: 10407 - protein, 9 aa, Homo sapiens
  light chain complementarity determining region 3 for antibody 5204
QQTYRTPYT

SEQ ID NO: 10408 - protein, 15 aa, Homo sapiens
  heavy chain complementarity determining region 3 for antibody 5204
GKEGPGSSGWLTGHY

SEQ ID NO: 10409 - protein, 9 aa, Homo sapiens
  light chain complementarity determining region 3 for antibody 5205
QQTYRTPYT

SEQ ID NO: 10410 - protein, 16 aa, Homo sapiens
  heavy chain complementarity determining region 3 for antibody 5205
ARWFSRSSTGVSYMDV

SEQ ID NO: 10411 - protein, 9 aa, Homo sapiens
  light chain complementarity determining region 3 for antibody 5206
QQTYRTPYT

SEQ ID NO: 10412 - protein, 17 aa, Homo sapiens
  heavy chain complementarity determining region 3 for antibody 5206
ARNTMVGTWQRQGNLDH

SEQ ID NO: 10413 - protein, 9 aa, Homo sapiens
  light chain complementarity determining region 3 for antibody 5207
QQTYRTPYT

SEQ ID NO: 10414 - protein, 14 aa, Homo sapiens
  heavy chain complementarity determining region 3 for antibody 5207
ARLHGSGLGRWPDP

SEQ ID NO: 10415 - protein, 9 aa, Homo sapiens
  light chain complementarity determining region 3 for antibody 5208
QQTYRTPYT

SEQ ID NO: 10416 - protein, 14 aa, Homo sapiens
  heavy chain complementarity determining region 3 for antibody 5208
ARLHGLGLGRWLDP

SEQ ID NO: 10417 - protein, 9 aa, Homo sapiens
  light chain complementarity determining region 3 for antibody 5209
QQTYRTPYT

SEQ ID NO: 10418 - protein, 13 aa, Homo sapiens
  heavy chain complementarity determining region 3 for antibody 5209
AKEGSSPGPDFDY

SEQ ID NO: 10419 - protein, 9 aa, Homo sapiens
  light chain complementarity determining region 3 for antibody 5210
QQTYRTPYT

SEQ ID NO: 10420 - protein, 13 aa, Homo sapiens
  heavy chain complementarity determining region 3 for antibody 5210
AKEGSAPGPDFEY

SEQ ID NO: 10421 - protein, 9 aa, Homo sapiens
  light chain complementarity determining region 3 for antibody 5211
QQTYRTPYT

SEQ ID NO: 10422 - protein, 12 aa, Homo sapiens
  heavy chain complementarity determining region 3 for antibody 5211
AIVVPGRWDLDD

SEQ ID NO: 10423 - protein, 9 aa, Homo sapiens
  light chain complementarity determining region 3 for antibody 5212
QQTYRTPYT

SEQ ID NO: 10424 - protein, 10 aa, Homo sapiens
  heavy chain complementarity determining region 3 for antibody 5212
AHRSNRAFDI

SEQ ID NO: 10425 - protein, 9 aa, Homo sapiens
  light chain complementarity determining region 3 for antibody 5213
QQTYRTLYT

SEQ ID NO: 10426 - protein, 14 aa, Homo sapiens
  heavy chain complementarity determining region 3 for antibody 5213
ARLHGSGLGRWLDP

SEQ ID NO: 10427 - protein, 9 aa, Homo sapiens
  light chain complementarity determining region 3 for antibody 5214
QQTYRPPYT

SEQ ID NO: 10428 - protein, 14 aa, Homo sapiens
  heavy chain complementarity determining region 3 for antibody 5214
ARLHGSGLGRWLDP

SEQ ID NO: 10429 - protein, 9 aa, Homo sapiens
  light chain complementarity determining region 3 for antibody 5215
QQTYRNPYT

SEQ ID NO: 10430 - protein, 14 aa, Homo sapiens
  heavy chain complementarity determining region 3 for antibody 5215
ARLHGSGLGRWLDP

SEQ ID NO: 10431 - protein, 9 aa, Homo sapiens
  light chain complementarity determining region 3 for antibody 5216
QQTYNSPWT

SEQ ID NO: 10432 - protein, 15 aa, Homo sapiens
  heavy chain complementarity determining region 3 for antibody 5216
ARIWTSSTNCRYMDV

SEQ ID NO: 10433 - protein, 9 aa, Homo sapiens
  light chain complementarity determining region 3 for antibody 5217
QQTYGTPYT

SEQ ID NO: 10434 - protein, 14 aa, Homo sapiens
  heavy chain complementarity determining region 3 for antibody 5217
ARLHGSGLGRWLGP

SEQ ID NO: 10435 - protein, 9 aa, Homo sapiens
  light chain complementarity determining region 3 for antibody 5218
QQTYGTPST

SEQ ID NO: 10436 - protein, 14 aa, Homo sapiens
  heavy chain complementarity determining region 3 for antibody 5218
ARLHGSGLGRWLDP

SEQ ID NO: 10437 - protein, 9 aa, Homo sapiens
  light chain complementarity determining region 3 for antibody 5219
QQTYCTPYT

SEQ ID NO: 10438 - protein, 14 aa, Homo sapiens
  heavy chain complementarity determining region 3 for antibody 5219
ARLHGSGLGRWLDP

SEQ ID NO: 10439 - protein, 9 aa, Homo sapiens
  light chain complementarity determining region 3 for antibody 5220
QQTSSFPPT

SEQ ID NO: 10440 - protein, 15 aa, Homo sapiens
  heavy chain complementarity determining region 3 for antibody 5220
AKDTDLSYWFGWFDV

SEQ ID NO: 10441 - protein, 9 aa, Homo sapiens
  light chain complementarity determining region 3 for antibody 5221
QQTNRTPST

SEQ ID NO: 10442 - protein, 14 aa, Homo sapiens
  heavy chain complementarity determining region 3 for antibody 5221
ARLHGSGLGRWLDP

SEQ ID NO: 10443 - protein, 9 aa, Homo sapiens
  light chain complementarity determining region 3 for antibody 5222
QQTISFPIT

SEQ ID NO: 10444 - protein, 11 aa, Homo sapiens
  heavy chain complementarity determining region 3 for antibody 5222
ARERSSWDFDY

SEQ ID NO: 10445 - protein, 9 aa, Homo sapiens
  light chain complementarity determining region 3 for antibody 5223
QQSYTVPRT

SEQ ID NO: 10446 - protein, 18 aa, Homo sapiens
  heavy chain complementarity determining region 3 for antibody 5223
TTVLSQLLAGDWHLYFQH

SEQ ID NO: 10447 - protein, 9 aa, Homo sapiens
  light chain complementarity determining region 3 for antibody 5224
QQSYTTQYT

SEQ ID NO: 10448 - protein, 13 aa, Homo sapiens
  heavy chain complementarity determining region 3 for antibody 5224
AKEGSAPGPDFEY

SEQ ID NO: 10449 - protein, 9 aa, Homo sapiens
  light chain complementarity determining region 3 for antibody 5225
QQSYTTPYT

SEQ ID NO: 10450 - protein, 13 aa, Homo sapiens
  heavy chain complementarity determining region 3 for antibody 5225
AKGGSAPGPDFEY

SEQ ID NO: 10451 - protein, 9 aa, Homo sapiens
  light chain complementarity determining region 3 for antibody 5226
QQSYTTPYT

SEQ ID NO: 10452 - protein, 13 aa, Homo sapiens
  heavy chain complementarity determining region 3 for antibody 5226
AKEGSAPSPDFEY

SEQ ID NO: 10453 - protein, 9 aa, Homo sapiens
  light chain complementarity determining region 3 for antibody 5227
QQSYTTPYI

SEQ ID NO: 10454 - protein, 13 aa, Homo sapiens
  heavy chain complementarity determining region 3 for antibody 5227
AKEGSAPGPDFEY

SEQ ID NO: 10455 - protein, 8 aa, Homo sapiens
  light chain complementarity determining region 3 for antibody 5228
QQSYTTPT

SEQ ID NO: 10456 - protein, 10 aa, Homo sapiens
  heavy chain complementarity determining region 3 for antibody 5228
ARERSGSYDI

SEQ ID NO: 10457 - protein, 8 aa, Homo sapiens
  light chain complementarity determining region 3 for antibody 5229
QQSYTTPT

SEQ ID NO: 10458 - protein, 26 aa, Homo sapiens
  heavy chain complementarity determining region 3 for antibody 5229
ARDFPKGGSYSSGWYGSIGGKYYMDV

SEQ ID NO: 10459 - protein, 8 aa, Homo sapiens
  light chain complementarity determining region 3 for antibody 5230
QQSYTTPT

SEQ ID NO: 10460 - protein, 12 aa, Homo sapiens
  heavy chain complementarity determining region 3 for antibody 5230
AKWRWQQSEFDY

SEQ ID NO: 10461 - protein, 9 aa, Homo sapiens
  light chain complementarity determining region 3 for antibody 5231
QQSYTTPRT

SEQ ID NO: 10462 - protein, 18 aa, Homo sapiens
  heavy chain complementarity determining region 3 for antibody 5231
TTVLSQLLAGDWHLYFQH

SEQ ID NO: 10463 - protein, 9 aa, Homo sapiens
  light chain complementarity determining region 3 for antibody 5232
QQSYTTPRT

SEQ ID NO: 10464 - protein, 16 aa, Homo sapiens
  heavy chain complementarity determining region 3 for antibody 5232
ARECPYSSTSVWYFDV

SEQ ID NO: 10465 - protein, 8 aa, Homo sapiens
  light chain complementarity determining region 3 for antibody 5233
QQSYTTPP

SEQ ID NO: 10466 - protein, 12 aa, Homo sapiens
  heavy chain complementarity determining region 3 for antibody 5233
ARLDWNYRAFDI

SEQ ID NO: 10467 - protein, 8 aa, Homo sapiens
  light chain complementarity determining region 3 for antibody 5234
QQSYTTPP

SEQ ID NO: 10468 - protein, 26 aa, Homo sapiens
  heavy chain complementarity determining region 3 for antibody 5234
ARDFPKGGSYSSGWYGSVGGNYYMDV

SEQ ID NO: 10469 - protein, 9 aa, Homo sapiens
  light chain complementarity determining region 3 for antibody 5235
QQSYTTPHT

SEQ ID NO: 10470 - protein, 16 aa, Homo sapiens
  heavy chain complementarity determining region 3 for antibody 5235
AKSLNIEVSHSGPFDF

SEQ ID NO: 10471 - protein, 9 aa, Homo sapiens
  light chain complementarity determining region 3 for antibody 5236
QQSYTTPFT

SEQ ID NO: 10472 - protein, 14 aa, Homo sapiens
  heavy chain complementarity determining region 3 for antibody 5236
VRRDDSSDHGRFGY

SEQ ID NO: 10473 - protein, 9 aa, Homo sapiens
  light chain complementarity determining region 3 for antibody 5237
QQSYTMPRT

SEQ ID NO: 10474 - protein, 18 aa, Homo sapiens
  heavy chain complementarity determining region 3 for antibody 5237
TTVVSQLLAGDWHLYFHH

SEQ ID NO: 10475 - protein, 9 aa, Homo sapiens
  light chain complementarity determining region 3 for antibody 5238
QQSYTMPRT

SEQ ID NO: 10476 - protein, 18 aa, Homo sapiens
  heavy chain complementarity determining region 3 for antibody 5238
TTVLSQLWAGDWHLYFQH

SEQ ID NO: 10477 - protein, 9 aa, Homo sapiens
  light chain complementarity determining region 3 for antibody 5239
QQSYTMPRT

SEQ ID NO: 10478 - protein, 18 aa, Homo sapiens
  heavy chain complementarity determining region 3 for antibody 5239
TTVLSQLVAGDWHLYFQH

SEQ ID NO: 10479 - protein, 9 aa, Homo sapiens
  light chain complementarity determining region 3 for antibody 5240
QQSYTMPRT

SEQ ID NO: 10480 - protein, 18 aa, Homo sapiens
  heavy chain complementarity determining region 3 for antibody 5240
TTVLSQLLARDWHLYFQH

SEQ ID NO: 10481 - protein, 9 aa, Homo sapiens
  light chain complementarity determining region 3 for antibody 5241
QQSYTMPRT

SEQ ID NO: 10482 - protein, 18 aa, Homo sapiens
  heavy chain complementarity determining region 3 for antibody 5241
TTVLSQLLAGDWHRYFHH

SEQ ID NO: 10483 - protein, 9 aa, Homo sapiens
  light chain complementarity determining region 3 for antibody 5242
QQSYTMPRT

SEQ ID NO: 10484 - protein, 18 aa, Homo sapiens
  heavy chain complementarity determining region 3 for antibody 5242
TTVLSQLLAGDWHLYSQH

SEQ ID NO: 10485 - protein, 9 aa, Homo sapiens
  light chain complementarity determining region 3 for antibody 5243
QQSYTMPRT

SEQ ID NO: 10486 - protein, 18 aa, Homo sapiens
  heavy chain complementarity determining region 3 for antibody 5243
TTVLSQLLAGDWHLSFQH

SEQ ID NO: 10487 - protein, 9 aa, Homo sapiens
  light chain complementarity determining region 3 for antibody 5244
QQSYTMPRT

SEQ ID NO: 10488 - protein, 18 aa, Homo sapiens
  heavy chain complementarity determining region 3 for antibody 5244
TTVLSQLLAGDWHLDFQH

SEQ ID NO: 10489 - protein, 9 aa, Homo sapiens
  light chain complementarity determining region 3 for antibody 5245
QQSYTMPRT

SEQ ID NO: 10490 - protein, 18 aa, Homo sapiens
  heavy chain complementarity determining region 3 for antibody 5245
TTVLSQLLAGAWHLYFQH

SEQ ID NO: 10491 - protein, 9 aa, Homo sapiens
  light chain complementarity determining region 3 for antibody 5246
QQSYTMPRT

SEQ ID NO: 10492 - protein, 18 aa, Homo sapiens
  heavy chain complementarity determining region 3 for antibody 5246
TTVLSQLLACDWHLYFQH

SEQ ID NO: 10493 - protein, 9 aa, Homo sapiens
  light chain complementarity determining region 3 for antibody 5247
QQSYTMPRT

SEQ ID NO: 10494 - protein, 13 aa, Homo sapiens
  heavy chain complementarity determining region 3 for antibody 5247
TKEGSSAGPDFVY

SEQ ID NO: 10495 - protein, 9 aa, Homo sapiens
  light chain complementarity determining region 3 for antibody 5248
QQSYTMPRT

SEQ ID NO: 10496 - protein, 18 aa, Homo sapiens
  heavy chain complementarity determining region 3 for antibody 5248
TAVLSQLLAGDWHLYFQH

SEQ ID NO: 10497 - protein, 9 aa, Homo sapiens
  light chain complementarity determining region 3 for antibody 5249
QQSYTMPRT

SEQ ID NO: 10498 - protein, 18 aa, Homo sapiens
  heavy chain complementarity determining region 3 for antibody 5249
ATVLSQLLAGDWHLYFQH

SEQ ID NO: 10499 - protein, 9 aa, Homo sapiens
  light chain complementarity determining region 3 for antibody 5250
QQSYTMPRT

SEQ ID NO: 10500 - protein, 11 aa, Homo sapiens
  heavy chain complementarity determining region 3 for antibody 5250
ATFGQQWRLAH

SEQ ID NO: 10501 - protein, 9 aa, Homo sapiens
  light chain complementarity determining region 3 for antibody 5251
QQSYTMPRT

SEQ ID NO: 10502 - protein, 10 aa, Homo sapiens
  heavy chain complementarity determining region 3 for antibody 5251
ARERSGSYDI

SEQ ID NO: 10503 - protein, 9 aa, Homo sapiens
  light chain complementarity determining region 3 for antibody 5252
QQSYTMPRT

SEQ ID NO: 10504 - protein, 13 aa, Homo sapiens
  heavy chain complementarity determining region 3 for antibody 5252
AKEGSSPGPDFEY

SEQ ID NO: 10505 - protein, 8 aa, Homo sapiens
  light chain complementarity determining region 3 for antibody 5253
QQSYTKST

SEQ ID NO: 10506 - protein, 12 aa, Homo sapiens
  heavy chain complementarity determining region 3 for antibody 5253
AIVVPGRWDLDD

SEQ ID NO: 10507 - protein, 8 aa, Homo sapiens
  light chain complementarity determining region 3 for antibody 5254
QQSYTKDT

SEQ ID NO: 10508 - protein, 12 aa, Homo sapiens
  heavy chain complementarity determining region 3 for antibody 5254
AIVVPGRWDLDD

SEQ ID NO: 10509 - protein, 8 aa, Homo sapiens
  light chain complementarity determining region 3 for antibody 5255
QQSYTKAT

SEQ ID NO: 10510 - protein, 15 aa, Homo sapiens
  heavy chain complementarity determining region 3 for antibody 5255
ARDRGDPQLYNWFDP

SEQ ID NO: 10511 - protein, 8 aa, Homo sapiens
  light chain complementarity determining region 3 for antibody 5256
QQSYTKAT

SEQ ID NO: 10512 - protein, 12 aa, Homo sapiens
  heavy chain complementarity determining region 3 for antibody 5256
AIVVPGRGDLDD

SEQ ID NO: 10513 - protein, 9 aa, Homo sapiens
  light chain complementarity determining region 3 for antibody 5257
QQSYTFPRT

SEQ ID NO: 10514 - protein, 18 aa, Homo sapiens
  heavy chain complementarity determining region 3 for antibody 5257
TTVLSQLLAGDWHLYFHH

SEQ ID NO: 10515 - protein, 9 aa, Homo sapiens
  light chain complementarity determining region 3 for antibody 5258
QQSYSTPYT

SEQ ID NO: 10516 - protein, 15 aa, Homo sapiens
  heavy chain complementarity determining region 3 for antibody 5258
ARMFYDYGDSDAFDI

SEQ ID NO: 10517 - protein, 9 aa, Homo sapiens
  light chain complementarity determining region 3 for antibody 5259
QQSYSTPYT

SEQ ID NO: 10518 - protein, 13 aa, Homo sapiens
  heavy chain complementarity determining region 3 for antibody 5259
AKEGSSAGPAFDY

SEQ ID NO: 10519 - protein, 9 aa, Homo sapiens
  light chain complementarity determining region 3 for antibody 5260
QQSYSTPYT

SEQ ID NO: 10520 - protein, 20 aa, Homo sapiens
  heavy chain complementarity determining region 3 for antibody 5260
AKDGRGTAFYHGAGGGGLDV

SEQ ID NO: 10521 - protein, 9 aa, Homo sapiens
  light chain complementarity determining region 3 for antibody 5261
QQSYSTPWT

SEQ ID NO: 10522 - protein, 11 aa, Homo sapiens
  heavy chain complementarity determining region 3 for antibody 5261
ATNSRGQGYDY

SEQ ID NO: 10523 - protein, 9 aa, Homo sapiens
  light chain complementarity determining region 3 for antibody 5262
QQSYSTPWT

SEQ ID NO: 10524 - protein, 9 aa, Homo sapiens
  heavy chain complementarity determining region 3 for antibody 5262
ARSEYQPTY

SEQ ID NO: 10525 - protein, 9 aa, Homo sapiens
  light chain complementarity determining region 3 for antibody 5263
QQSYSTPWT

SEQ ID NO: 10526 - protein, 13 aa, Homo sapiens
  heavy chain complementarity determining region 3 for antibody 5263
AKEGSSPGPDFEY

SEQ ID NO: 10527 - protein, 9 aa, Homo sapiens
  light chain complementarity determining region 3 for antibody 5264
QQSYSTPWM

SEQ ID NO: 10528 - protein, 11 aa, Homo sapiens
  heavy chain complementarity determining region 3 for antibody 5264
ATNSRGQGYEY

SEQ ID NO: 10529 - protein, 8 aa, Homo sapiens
  light chain complementarity determining region 3 for antibody 5265
QQSYSTPT

SEQ ID NO: 10530 - protein, 12 aa, Homo sapiens
  heavy chain complementarity determining region 3 for antibody 5265
AREKGGRNGMDV

SEQ ID NO: 10531 - protein, 9 aa, Homo sapiens
  light chain complementarity determining region 3 for antibody 5266
QQSYSTPST

SEQ ID NO: 10532 - protein, 16 aa, Homo sapiens
  heavy chain complementarity determining region 3 for antibody 5266
VRDLAGFTRGGSTFDY

SEQ ID NO: 10533 - protein, 9 aa, Homo sapiens
  light chain complementarity determining region 3 for antibody 5267
QQSYSTPST

SEQ ID NO: 10534 - protein, 12 aa, Homo sapiens
  heavy chain complementarity determining region 3 for antibody 5267
NADHGYVDGFDI

SEQ ID NO: 10535 - protein, 9 aa, Homo sapiens
  light chain complementarity determining region 3 for antibody 5268
QQSYSTPST

SEQ ID NO: 10536 - protein, 16 aa, Homo sapiens
  heavy chain complementarity determining region 3 for antibody 5268
ARWLSRSSTGVSYMDV

SEQ ID NO: 10537 - protein, 9 aa, Homo sapiens
  light chain complementarity determining region 3 for antibody 5269
QQSYSTPST

SEQ ID NO: 10538 - protein, 16 aa, Homo sapiens
  heavy chain complementarity determining region 3 for antibody 5269
ARWFSRSSTGVSYMDF

SEQ ID NO: 10539 - protein, 9 aa, Homo sapiens
  light chain complementarity determining region 3 for antibody 5270
QQSYSTPST

SEQ ID NO: 10540 - protein, 16 aa, Homo sapiens
  heavy chain complementarity determining region 3 for antibody 5270
ARWFSRSSTGVSHMDV

SEQ ID NO: 10541 - protein, 9 aa, Homo sapiens
  light chain complementarity determining region 3 for antibody 5271
QQSYSTPST

SEQ ID NO: 10542 - protein, 16 aa, Homo sapiens
  heavy chain complementarity determining region 3 for antibody 5271
ARWFSRSSTGFSYMDV

SEQ ID NO: 10543 - protein, 9 aa, Homo sapiens
  light chain complementarity determining region 3 for antibody 5272
QQSYSTPST

SEQ ID NO: 10544 - protein, 12 aa, Homo sapiens
  heavy chain complementarity determining region 3 for antibody 5272
AIVVPGRWDLDD

SEQ ID NO: 10545 - protein, 9 aa, Homo sapiens
  light chain complementarity determining region 3 for antibody 5273
QQSYSTPRT

SEQ ID NO: 10546 - protein, 16 aa, Homo sapiens
  heavy chain complementarity determining region 3 for antibody 5273
VRDLAGFTRGGSSFDY

SEQ ID NO: 10547 - protein, 9 aa, Homo sapiens
  light chain complementarity determining region 3 for antibody 5274
QQSYSTPRT

SEQ ID NO: 10548 - protein, 16 aa, Homo sapiens
  heavy chain complementarity determining region 3 for antibody 5274
VRDLAGFTRGGPTFDY

SEQ ID NO: 10549 - protein, 9 aa, Homo sapiens
  light chain complementarity determining region 3 for antibody 5275
QQSYSTPRT

SEQ ID NO: 10550 - protein, 13 aa, Homo sapiens
  heavy chain complementarity determining region 3 for antibody 5275
TKEGSSAGPDFVY

SEQ ID NO: 10551 - protein, 9 aa, Homo sapiens
  light chain complementarity determining region 3 for antibody 5276
QQSYSTPRT

SEQ ID NO: 10552 - protein, 16 aa, Homo sapiens
  heavy chain complementarity determining region 3 for antibody 5276
ARSYERSNTKVWYFDL

SEQ ID NO: 10553 - protein, 9 aa, Homo sapiens
  light chain complementarity determining region 3 for antibody 5277
QQSYSTPRT

SEQ ID NO: 10554 - protein, 16 aa, Homo sapiens
  heavy chain complementarity determining region 3 for antibody 5277
ARSYDRSNTKVWYSDL

SEQ ID NO: 10555 - protein, 9 aa, Homo sapiens
  light chain complementarity determining region 3 for antibody 5278
QQSYSTPRT

SEQ ID NO: 10556 - protein, 16 aa, Homo sapiens
  heavy chain complementarity determining region 3 for antibody 5278
ARSYDRSNPKVWYFDL

SEQ ID NO: 10557 - protein, 9 aa, Homo sapiens
  light chain complementarity determining region 3 for antibody 5279
QQSYSTPRT

SEQ ID NO: 10558 - protein, 17 aa, Homo sapiens
  heavy chain complementarity determining region 3 for antibody 5279
ARQGRHCDGGSCHPPEY

SEQ ID NO: 10559 - protein, 9 aa, Homo sapiens
  light chain complementarity determining region 3 for antibody 5280
QQSYSTPRT

SEQ ID NO: 10560 - protein, 17 aa, Homo sapiens
  heavy chain complementarity determining region 3 for antibody 5280
ARNTMVHGWQRQGSVDH

SEQ ID NO: 10561 - protein, 9 aa, Homo sapiens
  light chain complementarity determining region 3 for antibody 5281
QQSYSTPRT

SEQ ID NO: 10562 - protein, 12 aa, Homo sapiens
  heavy chain complementarity determining region 3 for antibody 5281
ALDEWHPSWYKY

SEQ ID NO: 10563 - protein, 9 aa, Homo sapiens
  light chain complementarity determining region 3 for antibody 5282
QQSYSTPPT

SEQ ID NO: 10564 - protein, 15 aa, Homo sapiens
  heavy chain complementarity determining region 3 for antibody 5282
ARDLGVGELLYAFDV

SEQ ID NO: 10565 - protein, 11 aa, Homo sapiens
  light chain complementarity determining region 3 for antibody 5283
QQSYSTPPRLT

SEQ ID NO: 10566 - protein, 13 aa, Homo sapiens
  heavy chain complementarity determining region 3 for antibody 5283
TKEGYSAGPDFVY

SEQ ID NO: 10567 - protein, 11 aa, Homo sapiens
  light chain complementarity determining region 3 for antibody 5284
QQSYSTPPRLT

SEQ ID NO: 10568 - protein, 13 aa, Homo sapiens
  heavy chain complementarity determining region 3 for antibody 5284
AKEGSSPGPDFEY

SEQ ID NO: 10569 - protein, 9 aa, Homo sapiens
  light chain complementarity determining region 3 for antibody 5285
QQSYSTPLT

SEQ ID NO: 10570 - protein, 13 aa, Homo sapiens
  heavy chain complementarity determining region 3 for antibody 5285
AKEGSSAGPDCDY

SEQ ID NO: 10571 - protein, 9 aa, Homo sapiens
  light chain complementarity determining region 3 for antibody 5286
QQSYSTPLT

SEQ ID NO: 10572 - protein, 13 aa, Homo sapiens
  heavy chain complementarity determining region 3 for antibody 5286
AKEGSSAGPAFDY

SEQ ID NO: 10573 - protein, 9 aa, Homo sapiens
  light chain complementarity determining region 3 for antibody 5287
QQSYSTPLT

SEQ ID NO: 10574 - protein, 13 aa, Homo sapiens
  heavy chain complementarity determining region 3 for antibody 5287
AKEGASAGPDFDY

SEQ ID NO: 10575 - protein, 10 aa, Homo sapiens
  light chain complementarity determining region 3 for antibody 5288
QQSYSTPLST

SEQ ID NO: 10576 - protein, 23 aa, Homo sapiens
  heavy chain complementarity determining region 3 for antibody 5288
ARHFPMGGSTVTGTQSLLYYMDV

SEQ ID NO: 10577 - protein, 10 aa, Homo sapiens
  light chain complementarity determining region 3 for antibody 5289
QQSYSTPLFT

SEQ ID NO: 10578 - protein, 11 aa, Homo sapiens
  heavy chain complementarity determining region 3 for antibody 5289
ATFGQQWRLAH

SEQ ID NO: 10579 - protein, 10 aa, Homo sapiens
  light chain complementarity determining region 3 for antibody 5290
QQSYSTPLFT

SEQ ID NO: 10580 - protein, 15 aa, Homo sapiens
  heavy chain complementarity determining region 3 for antibody 5290
ARVGRPYHSAWYFDN

SEQ ID NO: 10581 - protein, 10 aa, Homo sapiens
  light chain complementarity determining region 3 for antibody 5291
QQSYSTPLFT

SEQ ID NO: 10582 - protein, 15 aa, Homo sapiens
  heavy chain complementarity determining region 3 for antibody 5291
ARVGRPYHNSWYFDN

SEQ ID NO: 10583 - protein, 10 aa, Homo sapiens
  light chain complementarity determining region 3 for antibody 5292
QQSYSTPLFT

SEQ ID NO: 10584 - protein, 15 aa, Homo sapiens
  heavy chain complementarity determining region 3 for antibody 5292
ARVGRPHHNAWYFDN

SEQ ID NO: 10585 - protein, 10 aa, Homo sapiens
  light chain complementarity determining region 3 for antibody 5293
QQSYSTPLFT

SEQ ID NO: 10586 - protein, 15 aa, Homo sapiens
  heavy chain complementarity determining region 3 for antibody 5293
ARVGRPDRNAWYFDN

SEQ ID NO: 10587 - protein, 10 aa, Homo sapiens
  light chain complementarity determining region 3 for antibody 5294
QQSYSTPLFT

SEQ ID NO: 10588 - protein, 23 aa, Homo sapiens
  heavy chain complementarity determining region 3 for antibody 5294
ARQFPMGGSTVTGTQSLLYYMDV

SEQ ID NO: 10589 - protein, 10 aa, Homo sapiens
  light chain complementarity determining region 3 for antibody 5295
QQSYSTPLFT

SEQ ID NO: 10590 - protein, 23 aa, Homo sapiens
  heavy chain complementarity determining region 3 for antibody 5295
ARPFPMGGSTVTGTQSLLYYMDV

SEQ ID NO: 10591 - protein, 10 aa, Homo sapiens
  light chain complementarity determining region 3 for antibody 5296
QQSYSTPLFT

SEQ ID NO: 10592 - protein, 23 aa, Homo sapiens
  heavy chain complementarity determining region 3 for antibody 5296
ARHFPMGGSTVTGTQSRLYYMDV

SEQ ID NO: 10593 - protein, 10 aa, Homo sapiens
  light chain complementarity determining region 3 for antibody 5297
QQSYSTPLFT

SEQ ID NO: 10594 - protein, 23 aa, Homo sapiens
  heavy chain complementarity determining region 3 for antibody 5297
ARHFPMGGSTVTGTQSLLHYMDV

SEQ ID NO: 10595 - protein, 10 aa, Homo sapiens
  light chain complementarity determining region 3 for antibody 5298
QQSYSTPLFT

SEQ ID NO: 10596 - protein, 23 aa, Homo sapiens
  heavy chain complementarity determining region 3 for antibody 5298
ARHFPKGGPGVTGTQSLLYYMDV

SEQ ID NO: 10597 - protein, 10 aa, Homo sapiens
  light chain complementarity determining region 3 for antibody 5299
QQSYSTPLFT

SEQ ID NO: 10598 - protein, 23 aa, Homo sapiens
  heavy chain complementarity determining region 3 for antibody 5299
ARHCPMGGSTVTGTQSLLYYMDV

SEQ ID NO: 10599 - protein, 10 aa, Homo sapiens
  light chain complementarity determining region 3 for antibody 5300
QQSYSTPLFT

SEQ ID NO: 10600 - protein, 14 aa, Homo sapiens
  heavy chain complementarity determining region 3 for antibody 5300
ARGHFDSTGFRLDY

SEQ ID NO: 10601 - protein, 10 aa, Homo sapiens
  light chain complementarity determining region 3 for antibody 5301
QQSYSTPLFT

SEQ ID NO: 10602 - protein, 15 aa, Homo sapiens
  heavy chain complementarity determining region 3 for antibody 5301
ARGGRPYHNAWYFDN

SEQ ID NO: 10603 - protein, 10 aa, Homo sapiens
  light chain complementarity determining region 3 for antibody 5302
QQSYSTPLFA

SEQ ID NO: 10604 - protein, 23 aa, Homo sapiens
  heavy chain complementarity determining region 3 for antibody 5302
ARHFPMGGSTVTGTQSLLYYMDV

SEQ ID NO: 10605 - protein, 9 aa, Homo sapiens
  light chain complementarity determining region 3 for antibody 5303
QQSYSTPIT

SEQ ID NO: 10606 - protein, 17 aa, Homo sapiens
  heavy chain complementarity determining region 3 for antibody 5303
ARNSMVGTWQRQGNLDH

SEQ ID NO: 10607 - protein, 9 aa, Homo sapiens
  light chain complementarity determining region 3 for antibody 5304
QQSYSTPIA

SEQ ID NO: 10608 - protein, 17 aa, Homo sapiens
  heavy chain complementarity determining region 3 for antibody 5304
ARNTMVGTWQRQGNLDH

SEQ ID NO: 10609 - protein, 10 aa, Homo sapiens
  light chain complementarity determining region 3 for antibody 5305
QQSYSTPFFT

SEQ ID NO: 10610 - protein, 15 aa, Homo sapiens
  heavy chain complementarity determining region 3 for antibody 5305
ARVGRPYHNAWYFDN

SEQ ID NO: 10611 - protein, 10 aa, Homo sapiens
  light chain complementarity determining region 3 for antibody 5306
QQSYSTPFFT

SEQ ID NO: 10612 - protein, 23 aa, Homo sapiens
  heavy chain complementarity determining region 3 for antibody 5306
ARHFPKGGSTVTGTQSLLYYMDV

SEQ ID NO: 10613 - protein, 10 aa, Homo sapiens
  light chain complementarity determining region 3 for antibody 5307
QQSYSTLTWP

SEQ ID NO: 10614 - protein, 11 aa, Homo sapiens
  heavy chain complementarity determining region 3 for antibody 5307
AGSSGYYAIDN

SEQ ID NO: 10615 - protein, 10 aa, Homo sapiens
  light chain complementarity determining region 3 for antibody 5308
QQSYSTLPYT

SEQ ID NO: 10616 - protein, 22 aa, Homo sapiens
  heavy chain complementarity determining region 3 for antibody 5308
AKDKGTPYSYGPYYYDYYGMDV

SEQ ID NO: 10617 - protein, 10 aa, Homo sapiens
  light chain complementarity determining region 3 for antibody 5309
QQSYSTLPNT

SEQ ID NO: 10618 - protein, 18 aa, Homo sapiens
  heavy chain complementarity determining region 3 for antibody 5309
ARGVVVPVATPVPYFFDF

SEQ ID NO: 10619 - protein, 9 aa, Homo sapiens
  light chain complementarity determining region 3 for antibody 5310
QQSYSTHST

SEQ ID NO: 10620 - protein, 16 aa, Homo sapiens
  heavy chain complementarity determining region 3 for antibody 5310
ARWFSRSSTGVSYMDV

SEQ ID NO: 10621 - protein, 9 aa, Homo sapiens
  light chain complementarity determining region 3 for antibody 5311
QQSYSSPWT

SEQ ID NO: 10622 - protein, 15 aa, Homo sapiens
  heavy chain complementarity determining region 3 for antibody 5311
ARIGTSSTNCRYMDV

SEQ ID NO: 10623 - protein, 8 aa, Homo sapiens
  light chain complementarity determining region 3 for antibody 5312
QQSYSSPT

SEQ ID NO: 10624 - protein, 12 aa, Homo sapiens
  heavy chain complementarity determining region 3 for antibody 5312
ARLDWNYRAFDI

SEQ ID NO: 10625 - protein, 8 aa, Homo sapiens
  light chain complementarity determining region 3 for antibody 5313
QQSYSSPT

SEQ ID NO: 10626 - protein, 10 aa, Homo sapiens
  heavy chain complementarity determining region 3 for antibody 5313
ARETSGSYDI

SEQ ID NO: 10627 - protein, 8 aa, Homo sapiens
  light chain complementarity determining region 3 for antibody 5314
QQSYSSPT

SEQ ID NO: 10628 - protein, 17 aa, Homo sapiens
  heavy chain complementarity determining region 3 for antibody 5314
AKVRGSVAMALIYYLDL

SEQ ID NO: 10629 - protein, 8 aa, Homo sapiens
  light chain complementarity determining region 3 for antibody 5315
QQSYSSPT

SEQ ID NO: 10630 - protein, 17 aa, Homo sapiens
  heavy chain complementarity determining region 3 for antibody 5315
AKGRGSVAMAPIYYLDL

SEQ ID NO: 10631 - protein, 8 aa, Homo sapiens
  light chain complementarity determining region 3 for antibody 5316
QQSYSSPT

SEQ ID NO: 10632 - protein, 17 aa, Homo sapiens
  heavy chain complementarity determining region 3 for antibody 5316
AKGRGSVAMALIYYRDL

SEQ ID NO: 10633 - protein, 8 aa, Homo sapiens
  light chain complementarity determining region 3 for antibody 5317
QQSYSSPT

SEQ ID NO: 10634 - protein, 17 aa, Homo sapiens
  heavy chain complementarity determining region 3 for antibody 5317
AKGRGSVAMALIYSLDL

SEQ ID NO: 10635 - protein, 8 aa, Homo sapiens
  light chain complementarity determining region 3 for antibody 5318
QQSYSSPT

SEQ ID NO: 10636 - protein, 17 aa, Homo sapiens
  heavy chain complementarity determining region 3 for antibody 5318
AKGGGSVAMALIYYLDL

SEQ ID NO: 10637 - protein, 9 aa, Homo sapiens
  light chain complementarity determining region 3 for antibody 5319
QQSYSSPRT

SEQ ID NO: 10638 - protein, 17 aa, Homo sapiens
  heavy chain complementarity determining region 3 for antibody 5319
ARNTMVHGWQRQGSVDH

SEQ ID NO: 10639 - protein, 9 aa, Homo sapiens
  light chain complementarity determining region 3 for antibody 5320
QQSYSSPRT

SEQ ID NO: 10640 - protein, 16 aa, Homo sapiens
  heavy chain complementarity determining region 3 for antibody 5320
ARDFAYSSTSVWYFDV

SEQ ID NO: 10641 - protein, 8 aa, Homo sapiens
  light chain complementarity determining region 3 for antibody 5321
QQSYSSPP

SEQ ID NO: 10642 - protein, 17 aa, Homo sapiens
  heavy chain complementarity determining region 3 for antibody 5321
AKGRGSVAMALIYYLDL

SEQ ID NO: 10643 - protein, 9 aa, Homo sapiens
  light chain complementarity determining region 3 for antibody 5322
QQSYSNPST

SEQ ID NO: 10644 - protein, 16 aa, Homo sapiens
  heavy chain complementarity determining region 3 for antibody 5322
ARWFSRSSTGVSYMDV

SEQ ID NO: 10645 - protein, 9 aa, Homo sapiens
  light chain complementarity determining region 3 for antibody 5323
QQSYSMPRT

SEQ ID NO: 10646 - protein, 18 aa, Homo sapiens
  heavy chain complementarity determining region 3 for antibody 5323
VTVLSQLVTGNWYLYFQH

SEQ ID NO: 10647 - protein, 9 aa, Homo sapiens
  light chain complementarity determining region 3 for antibody 5324
QQSYSMPRT

SEQ ID NO: 10648 - protein, 18 aa, Homo sapiens
  heavy chain complementarity determining region 3 for antibody 5324
TTVLSHLLAGGWHLYFNH

SEQ ID NO: 10649 - protein, 9 aa, Homo sapiens
  light chain complementarity determining region 3 for antibody 5325
QQSYSIPYT

SEQ ID NO: 10650 - protein, 17 aa, Homo sapiens
  heavy chain complementarity determining region 3 for antibody 5325
ARASYYDVDLNRFYFDY

SEQ ID NO: 10651 - protein, 9 aa, Homo sapiens
  light chain complementarity determining region 3 for antibody 5326
QQSYSIPLT

SEQ ID NO: 10652 - protein, 9 aa, Homo sapiens
  heavy chain complementarity determining region 3 for antibody 5326
TTVTPPDPA

SEQ ID NO: 10653 - protein, 9 aa, Homo sapiens
  light chain complementarity determining region 3 for antibody 5327
QQSYSIPFT

SEQ ID NO: 10654 - protein, 17 aa, Homo sapiens
  heavy chain complementarity determining region 3 for antibody 5327
ARLGGRHRRGSGSYGDY

SEQ ID NO: 10655 - protein, 9 aa, Homo sapiens
  light chain complementarity determining region 3 for antibody 5328
QQSYSHPLS

SEQ ID NO: 10656 - protein, 9 aa, Homo sapiens
  heavy chain complementarity determining region 3 for antibody 5328
ARSEYHPTY

SEQ ID NO: 10657 - protein, 9 aa, Homo sapiens
  light chain complementarity determining region 3 for antibody 5329
QQSYNTPRT

SEQ ID NO: 10658 - protein, 20 aa, Homo sapiens
  heavy chain complementarity determining region 3 for antibody 5329
ARETSIAAAANGYYYYAMDI

SEQ ID NO: 10659 - protein, 9 aa, Homo sapiens
  light chain complementarity determining region 3 for antibody 5330
QQSYNPPLP

SEQ ID NO: 10660 - protein, 11 aa, Homo sapiens
  heavy chain complementarity determining region 3 for antibody 5330
ARGGTLAWFDP

SEQ ID NO: 10661 - protein, 9 aa, Homo sapiens
  light chain complementarity determining region 3 for antibody 5331
QQSYITPST

SEQ ID NO: 10662 - protein, 16 aa, Homo sapiens
  heavy chain complementarity determining region 3 for antibody 5331
ARWFSRSSTGVSYMDV

SEQ ID NO: 10663 - protein, 9 aa, Homo sapiens
  light chain complementarity determining region 3 for antibody 5332
QQSYGTPST

SEQ ID NO: 10664 - protein, 16 aa, Homo sapiens
  heavy chain complementarity determining region 3 for antibody 5332
ARWFSRSSTGVSYMDV

SEQ ID NO: 10665 - protein, 9 aa, Homo sapiens
  light chain complementarity determining region 3 for antibody 5333
QQSYGGMYT

SEQ ID NO: 10666 - protein, 14 aa, Homo sapiens
  heavy chain complementarity determining region 3 for antibody 5333
ASARGRIAVAAFDS

SEQ ID NO: 10667 - protein, 9 aa, Homo sapiens
  light chain complementarity determining region 3 for antibody 5334
QQSSSTPST

SEQ ID NO: 10668 - protein, 16 aa, Homo sapiens
  heavy chain complementarity determining region 3 for antibody 5334
ARWFSRSSTGVSYMDV

SEQ ID NO: 10669 - protein, 9 aa, Homo sapiens
  light chain complementarity determining region 3 for antibody 5335
QQSSNTPRT

SEQ ID NO: 10670 - protein, 16 aa, Homo sapiens
  heavy chain complementarity determining region 3 for antibody 5335
VRDLAGFTRGGSTFDY

SEQ ID NO: 10671 - protein, 9 aa, Homo sapiens
  light chain complementarity determining region 3 for antibody 5336
QQSSNTPLT

SEQ ID NO: 10672 - protein, 11 aa, Homo sapiens
  heavy chain complementarity determining region 3 for antibody 5336
VRVSTGWNFDY

SEQ ID NO: 10673 - protein, 9 aa, Homo sapiens
  light chain complementarity determining region 3 for antibody 5337
QQSSNTPLT

SEQ ID NO: 10674 - protein, 16 aa, Homo sapiens
  heavy chain complementarity determining region 3 for antibody 5337
VRELAGFTRGGSTFDY

SEQ ID NO: 10675 - protein, 9 aa, Homo sapiens
  light chain complementarity determining region 3 for antibody 5338
QQSSNTPLT

SEQ ID NO: 10676 - protein, 16 aa, Homo sapiens
  heavy chain complementarity determining region 3 for antibody 5338
VRDWAGFTRGGSTFDY

SEQ ID NO: 10677 - protein, 9 aa, Homo sapiens
  light chain complementarity determining region 3 for antibody 5339
QQSSNTPLT

SEQ ID NO: 10678 - protein, 16 aa, Homo sapiens
  heavy chain complementarity determining region 3 for antibody 5339
VRDLAGSTRGGSTFDY

SEQ ID NO: 10679 - protein, 9 aa, Homo sapiens
  light chain complementarity determining region 3 for antibody 5340
QQSSNTPLT

SEQ ID NO: 10680 - protein, 16 aa, Homo sapiens
  heavy chain complementarity determining region 3 for antibody 5340
VRDLAGFTRGGSTSDY

SEQ ID NO: 10681 - protein, 9 aa, Homo sapiens
  light chain complementarity determining region 3 for antibody 5341
QQSSNTPLT

SEQ ID NO: 10682 - protein, 16 aa, Homo sapiens
  heavy chain complementarity determining region 3 for antibody 5341
VRDLAGFTRGGPTFDY

SEQ ID NO: 10683 - protein, 9 aa, Homo sapiens
  light chain complementarity determining region 3 for antibody 5342
QQSSNTPLT

SEQ ID NO: 10684 - protein, 16 aa, Homo sapiens
  heavy chain complementarity determining region 3 for antibody 5342
VRDLAGCTRGGSTFDY

SEQ ID NO: 10685 - protein, 9 aa, Homo sapiens
  light chain complementarity determining region 3 for antibody 5343
QQSSNTPLT

SEQ ID NO: 10686 - protein, 16 aa, Homo sapiens
  heavy chain complementarity determining region 3 for antibody 5343
VGDLAGFTRGGSTFDY

SEQ ID NO: 10687 - protein, 9 aa, Homo sapiens
  light chain complementarity determining region 3 for antibody 5344
QQSSNTPLT

SEQ ID NO: 10688 - protein, 12 aa, Homo sapiens
  heavy chain complementarity determining region 3 for antibody 5344
NADHGYVDGFDI

SEQ ID NO: 10689 - protein, 9 aa, Homo sapiens
  light chain complementarity determining region 3 for antibody 5345
QQSSNTPLT

SEQ ID NO: 10690 - protein, 15 aa, Homo sapiens
  heavy chain complementarity determining region 3 for antibody 5345
ARSMVSGTTDDAFDI

SEQ ID NO: 10691 - protein, 9 aa, Homo sapiens
  light chain complementarity determining region 3 for antibody 5346
QQSSNTPLT

SEQ ID NO: 10692 - protein, 17 aa, Homo sapiens
  heavy chain complementarity determining region 3 for antibody 5346
ARNTMVHGWQRQGSVDH

SEQ ID NO: 10693 - protein, 9 aa, Homo sapiens
  light chain complementarity determining region 3 for antibody 5347
QQSSNTPLT

SEQ ID NO: 10694 - protein, 12 aa, Homo sapiens
  heavy chain complementarity determining region 3 for antibody 5347
AIVVPGRWDLDD

SEQ ID NO: 10695 - protein, 9 aa, Homo sapiens
  light chain complementarity determining region 3 for antibody 5348
QQSSNTPLT

SEQ ID NO: 10696 - protein, 8 aa, Homo sapiens
  heavy chain complementarity determining region 3 for antibody 5348
AGWGYANY

SEQ ID NO: 10697 - protein, 9 aa, Homo sapiens
  light chain complementarity determining region 3 for antibody 5349
QQSSNTPLA

SEQ ID NO: 10698 - protein, 16 aa, Homo sapiens
  heavy chain complementarity determining region 3 for antibody 5349
VRDLAGFTRGGSTFDY

SEQ ID NO: 10699 - protein, 9 aa, Homo sapiens
  light chain complementarity determining region 3 for antibody 5350
QQSSNTPFT

SEQ ID NO: 10700 - protein, 16 aa, Homo sapiens
  heavy chain complementarity determining region 3 for antibody 5350
VRDLAGFTRGGSTFDY

SEQ ID NO: 10701 - protein, 9 aa, Homo sapiens
  light chain complementarity determining region 3 for antibody 5351
QQSRSYPLT

SEQ ID NO: 10702 - protein, 23 aa, Homo sapiens
  heavy chain complementarity determining region 3 for antibody 5351
ATGLGYCRGGRCFPDTVAGSYVF

SEQ ID NO: 10703 - protein, 9 aa, Homo sapiens
  light chain complementarity determining region 3 for antibody 5352
QQSNSYPWT

SEQ ID NO: 10704 - protein, 14 aa, Homo sapiens
  heavy chain complementarity determining region 3 for antibody 5352
VREEGSGYYRTADY

SEQ ID NO: 10705 - protein, 7 aa, Homo sapiens
  light chain complementarity determining region 3 for antibody 5353
QQSNSWT

SEQ ID NO: 10706 - protein, 12 aa, Homo sapiens
  heavy chain complementarity determining region 3 for antibody 5353
AKDKGGRSGMDV

SEQ ID NO: 10707 - protein, 9 aa, Homo sapiens
  light chain complementarity determining region 3 for antibody 5354
QQSINWPRT

SEQ ID NO: 10708 - protein, 14 aa, Homo sapiens
  heavy chain complementarity determining region 3 for antibody 5354
TTSPGYYNSAPWDY

SEQ ID NO: 10709 - protein, 9 aa, Homo sapiens
  light chain complementarity determining region 3 for antibody 5355
QQSINWPRT

SEQ ID NO: 10710 - protein, 15 aa, Homo sapiens
  heavy chain complementarity determining region 3 for antibody 5355
ARRRFNSNYIVGFDS

SEQ ID NO: 10711 - protein, 9 aa, Homo sapiens
  light chain complementarity determining region 3 for antibody 5356
QQSHSTPRT

SEQ ID NO: 10712 - protein, 16 aa, Homo sapiens
  heavy chain complementarity determining region 3 for antibody 5356
ARSYDRSNTKVWYFDL

SEQ ID NO: 10713 - protein, 9 aa, Homo sapiens
  light chain complementarity determining region 3 for antibody 5357
QQSHSTPQT

SEQ ID NO: 10714 - protein, 12 aa, Homo sapiens
  heavy chain complementarity determining region 3 for antibody 5357
AIVVPGRWDLDD

SEQ ID NO: 10715 - protein, 7 aa, Homo sapiens
  light chain complementarity determining region 3 for antibody 5358
QQSGSYT

SEQ ID NO: 10716 - protein, 10 aa, Homo sapiens
  heavy chain complementarity determining region 3 for antibody 5358
ARRWERYFDY

SEQ ID NO: 10717 - protein, 8 aa, Homo sapiens
  light chain complementarity determining region 3 for antibody 5359
QQSDLSLT

SEQ ID NO: 10718 - protein, 14 aa, Homo sapiens
  heavy chain complementarity determining region 3 for antibody 5359
ARGTIGDYTDYFPY

SEQ ID NO: 10719 - protein, 9 aa, Homo sapiens
  light chain complementarity determining region 3 for antibody 5360
QQRYTTPRT

SEQ ID NO: 10720 - protein, 16 aa, Homo sapiens
  heavy chain complementarity determining region 3 for antibody 5360
AREFPYSSTSVWYFDV

SEQ ID NO: 10721 - protein, 9 aa, Homo sapiens
  light chain complementarity determining region 3 for antibody 5361
QQRYSTPRT

SEQ ID NO: 10722 - protein, 16 aa, Homo sapiens
  heavy chain complementarity determining region 3 for antibody 5361
ARSYDRSNTKVWYFDL

SEQ ID NO: 10723 - protein, 10 aa, Homo sapiens
  light chain complementarity determining region 3 for antibody 5362
QQRYSTPLFT

SEQ ID NO: 10724 - protein, 15 aa, Homo sapiens
  heavy chain complementarity determining region 3 for antibody 5362
ARVGRPYHNAWYFDN

SEQ ID NO: 10725 - protein, 10 aa, Homo sapiens
  light chain complementarity determining region 3 for antibody 5363
QQRYSTPLFT

SEQ ID NO: 10726 - protein, 23 aa, Homo sapiens
  heavy chain complementarity determining region 3 for antibody 5363
ARHFPMGGSTVTGTQSLLYYMDV

SEQ ID NO: 10727 - protein, 9 aa, Homo sapiens
  light chain complementarity determining region 3 for antibody 5364
QQRYNWPLP

SEQ ID NO: 10728 - protein, 19 aa, Homo sapiens
  heavy chain complementarity determining region 3 for antibody 5364
AKDKGGHSGSYSWALWFDY

SEQ ID NO: 10729 - protein, 10 aa, Homo sapiens
  light chain complementarity determining region 3 for antibody 5365
QQRTNWPQYT

SEQ ID NO: 10730 - protein, 13 aa, Homo sapiens
  heavy chain complementarity determining region 3 for antibody 5365
AKPIYSGSGSPDY

SEQ ID NO: 10731 - protein, 10 aa, Homo sapiens
  light chain complementarity determining region 3 for antibody 5366
QQRTNWLPYI

SEQ ID NO: 10732 - protein, 8 aa, Homo sapiens
  heavy chain complementarity determining region 3 for antibody 5366
ARDRAGDH

SEQ ID NO: 10733 - protein, 9 aa, Homo sapiens
  light chain complementarity determining region 3 for antibody 5367
QQRSSWPPT

SEQ ID NO: 10734 - protein, 14 aa, Homo sapiens
  heavy chain complementarity determining region 3 for antibody 5367
AKGMTSWYLMVVDY

SEQ ID NO: 10735 - protein, 10 aa, Homo sapiens
  light chain complementarity determining region 3 for antibody 5368
QQRSSWPPIT

SEQ ID NO: 10736 - protein, 14 aa, Homo sapiens
  heavy chain complementarity determining region 3 for antibody 5368
VSQSRSAVNGGGVY

SEQ ID NO: 10737 - protein, 8 aa, Homo sapiens
  light chain complementarity determining region 3 for antibody 5369
QQRSNWPT

SEQ ID NO: 10738 - protein, 13 aa, Homo sapiens
  heavy chain complementarity determining region 3 for antibody 5369
VKDKGNYDRCFDY

SEQ ID NO: 10739 - protein, 9 aa, Homo sapiens
  light chain complementarity determining region 3 for antibody 5370
QQRSNWPTT

SEQ ID NO: 10740 - protein, 12 aa, Homo sapiens
  heavy chain complementarity determining region 3 for antibody 5370
NADHGYVDGFDI

SEQ ID NO: 10741 - protein, 8 aa, Homo sapiens
  light chain complementarity determining region 3 for antibody 5371
QQRSNWPT

SEQ ID NO: 10742 - protein, 15 aa, Homo sapiens
  heavy chain complementarity determining region 3 for antibody 5371
GKGGPGSSGWLTGHY

SEQ ID NO: 10743 - protein, 9 aa, Homo sapiens
  light chain complementarity determining region 3 for antibody 5372
QQRSNWPRT

SEQ ID NO: 10744 - protein, 12 aa, Homo sapiens
  heavy chain complementarity determining region 3 for antibody 5372
TRDTIQAPILGC

SEQ ID NO: 10745 - protein, 9 aa, Homo sapiens
  light chain complementarity determining region 3 for antibody 5373
QQRSNWPRT

SEQ ID NO: 10746 - protein, 13 aa, Homo sapiens
  heavy chain complementarity determining region 3 for antibody 5373
AKEGSSPGPDFEY

SEQ ID NO: 10747 - protein, 10 aa, Homo sapiens
  light chain complementarity determining region 3 for antibody 5374
QQRSNWPRLT

SEQ ID NO: 10748 - protein, 21 aa, Homo sapiens
  heavy chain complementarity determining region 3 for antibody 5374
GRWGAGYYDSNRNYFGRAIDN

SEQ ID NO: 10749 - protein, 9 aa, Homo sapiens
  light chain complementarity determining region 3 for antibody 5375
QQRSNWPRA

SEQ ID NO: 10750 - protein, 12 aa, Homo sapiens
  heavy chain complementarity determining region 3 for antibody 5375
TRDTIQATILGC

SEQ ID NO: 10751 - protein, 10 aa, Homo sapiens
  light chain complementarity determining region 3 for antibody 5376
QQRSNWPPYT

SEQ ID NO: 10752 - protein, 14 aa, Homo sapiens
  heavy chain complementarity determining region 3 for antibody 5376
ANYRASIGANCFDP

SEQ ID NO: 10753 - protein, 10 aa, Homo sapiens
  light chain complementarity determining region 3 for antibody 5377
QQRSNWPPYP

SEQ ID NO: 10754 - protein, 12 aa, Homo sapiens
  heavy chain complementarity determining region 3 for antibody 5377
TREYSSGWYPGY

SEQ ID NO: 10755 - protein, 10 aa, Homo sapiens
  light chain complementarity determining region 3 for antibody 5378
QQRSNWPPLT

SEQ ID NO: 10756 - protein, 18 aa, Homo sapiens
  heavy chain complementarity determining region 3 for antibody 5378
AKECCYFDSTSHPNWFDP

SEQ ID NO: 10757 - protein, 9 aa, Homo sapiens
  light chain complementarity determining region 3 for antibody 5379
QQRSNWPPL

SEQ ID NO: 10758 - protein, 11 aa, Homo sapiens
  heavy chain complementarity determining region 3 for antibody 5379
ARDFRYGFLAD

SEQ ID NO: 10759 - protein, 9 aa, Homo sapiens
  light chain complementarity determining region 3 for antibody 5380
QQRSNWPLT

SEQ ID NO: 10760 - protein, 10 aa, Homo sapiens
  heavy chain complementarity determining region 3 for antibody 5380
ARETSGSYDI

SEQ ID NO: 10761 - protein, 9 aa, Homo sapiens
  light chain complementarity determining region 3 for antibody 5381
QQRSNWPLT

SEQ ID NO: 10762 - protein, 10 aa, Homo sapiens
  heavy chain complementarity determining region 3 for antibody 5381
ARERSGSYDI

SEQ ID NO: 10763 - protein, 9 aa, Homo sapiens
  light chain complementarity determining region 3 for antibody 5382
QQRSNWPLP

SEQ ID NO: 10764 - protein, 12 aa, Homo sapiens
  heavy chain complementarity determining region 3 for antibody 5382
AIVVPGRWDLDD

SEQ ID NO: 10765 - protein, 10 aa, Homo sapiens
  light chain complementarity determining region 3 for antibody 5383
QQRSNWPLCT

SEQ ID NO: 10766 - protein, 15 aa, Homo sapiens
  heavy chain complementarity determining region 3 for antibody 5383
AKASCGTCYALSGDY

SEQ ID NO: 10767 - protein, 9 aa, Homo sapiens
  light chain complementarity determining region 3 for antibody 5384
QQRSNWPIT

SEQ ID NO: 10768 - protein, 12 aa, Homo sapiens
  heavy chain complementarity determining region 3 for antibody 5384
NAGHGYVDGFDI

SEQ ID NO: 10769 - protein, 9 aa, Homo sapiens
  light chain complementarity determining region 3 for antibody 5385
QQRSNWPIN

SEQ ID NO: 10770 - protein, 12 aa, Homo sapiens
  heavy chain complementarity determining region 3 for antibody 5385
NADHGYVDGFDI

SEQ ID NO: 10771 - protein, 9 aa, Homo sapiens
  light chain complementarity determining region 3 for antibody 5386
QQRSNWPHL

SEQ ID NO: 10772 - protein, 11 aa, Homo sapiens
  heavy chain complementarity determining region 3 for antibody 5386
AKDFRYGFHSE

SEQ ID NO: 10773 - protein, 9 aa, Homo sapiens
  light chain complementarity determining region 3 for antibody 5387
QQRSNWPFT

SEQ ID NO: 10774 - protein, 12 aa, Homo sapiens
  heavy chain complementarity determining region 3 for antibody 5387
NADHGYVDGFDI

SEQ ID NO: 10775 - protein, 9 aa, Homo sapiens
  light chain complementarity determining region 3 for antibody 5388
QQRSNRPLT

SEQ ID NO: 10776 - protein, 14 aa, Homo sapiens
  heavy chain complementarity determining region 3 for antibody 5388
ARDQPMQQWAYIDD

SEQ ID NO: 10777 - protein, 9 aa, Homo sapiens
  light chain complementarity determining region 3 for antibody 5389
QQRSNQRFT

SEQ ID NO: 10778 - protein, 7 aa, Homo sapiens
  heavy chain complementarity determining region 3 for antibody 5389
TTEDGRH

SEQ ID NO: 10779 - protein, 9 aa, Homo sapiens
  light chain complementarity determining region 3 for antibody 5390
QQRSNQRFT

SEQ ID NO: 10780 - protein, 7 aa, Homo sapiens
  heavy chain complementarity determining region 3 for antibody 5390
ATEDGRN

SEQ ID NO: 10781 - protein, 9 aa, Homo sapiens
  light chain complementarity determining region 3 for antibody 5391
QQRSNPRFT

SEQ ID NO: 10782 - protein, 7 aa, Homo sapiens
  heavy chain complementarity determining region 3 for antibody 5391
TTEDGRN

SEQ ID NO: 10783 - protein, 9 aa, Homo sapiens
  light chain complementarity determining region 3 for antibody 5392
QQRRNWPLT

SEQ ID NO: 10784 - protein, 13 aa, Homo sapiens
  heavy chain complementarity determining region 3 for antibody 5392
AKEGSSPGPDFDS

SEQ ID NO: 10785 - protein, 10 aa, Homo sapiens
  light chain complementarity determining region 3 for antibody 5393
QQRRKWPLFT

SEQ ID NO: 10786 - protein, 7 aa, Homo sapiens
  heavy chain complementarity determining region 3 for antibody 5393
TTGDLKL

SEQ ID NO: 10787 - protein, 9 aa, Homo sapiens
  light chain complementarity determining region 3 for antibody 5394
QQRGYWPPT

SEQ ID NO: 10788 - protein, 14 aa, Homo sapiens
  heavy chain complementarity determining region 3 for antibody 5394
VKHTHNWYLGVLDC

SEQ ID NO: 10789 - protein, 9 aa, Homo sapiens
  light chain complementarity determining region 3 for antibody 5395
QQRGYWPPT

SEQ ID NO: 10790 - protein, 14 aa, Homo sapiens
  heavy chain complementarity determining region 3 for antibody 5395
AKHAHNWYLGVLDC

SEQ ID NO: 10791 - protein, 9 aa, Homo sapiens
  light chain complementarity determining region 3 for antibody 5396
QQRGYWPPP

SEQ ID NO: 10792 - protein, 14 aa, Homo sapiens
  heavy chain complementarity determining region 3 for antibody 5396
AKHTHNWYLGVLDC

SEQ ID NO: 10793 - protein, 9 aa, Homo sapiens
  light chain complementarity determining region 3 for antibody 5397
QQRGSWPPT

SEQ ID NO: 10794 - protein, 14 aa, Homo sapiens
  heavy chain complementarity determining region 3 for antibody 5397
AKHTRNWYLGVLDC

SEQ ID NO: 10795 - protein, 9 aa, Homo sapiens
  light chain complementarity determining region 3 for antibody 5398
QQRGSWPPT

SEQ ID NO: 10796 - protein, 14 aa, Homo sapiens
  heavy chain complementarity determining region 3 for antibody 5398
AKHTHNWYVGVLDC

SEQ ID NO: 10797 - protein, 9 aa, Homo sapiens
  light chain complementarity determining region 3 for antibody 5399
QQRGSWPPT

SEQ ID NO: 10798 - protein, 14 aa, Homo sapiens
  heavy chain complementarity determining region 3 for antibody 5399
AKGMTTWYVMVVDY

SEQ ID NO: 10799 - protein, 9 aa, Homo sapiens
  light chain complementarity determining region 3 for antibody 5400
QQRGSWPPT

SEQ ID NO: 10800 - protein, 14 aa, Homo sapiens
  heavy chain complementarity determining region 3 for antibody 5400
AKGMTSWYSMVVDY

SEQ ID NO: 10801 - protein, 9 aa, Homo sapiens
  light chain complementarity determining region 3 for antibody 5401
QQRGSWPPT

SEQ ID NO: 10802 - protein, 14 aa, Homo sapiens
  heavy chain complementarity determining region 3 for antibody 5401
AKGMTAWYLMVVDY

SEQ ID NO: 10803 - protein, 9 aa, Homo sapiens
  light chain complementarity determining region 3 for antibody 5402
QQRGSWPPP

SEQ ID NO: 10804 - protein, 14 aa, Homo sapiens
  heavy chain complementarity determining region 3 for antibody 5402
AKGMTSWYLMVVDY

SEQ ID NO: 10805 - protein, 10 aa, Homo sapiens
  light chain complementarity determining region 3 for antibody 5403
QQRANWPQYT

SEQ ID NO: 10806 - protein, 13 aa, Homo sapiens
  heavy chain complementarity determining region 3 for antibody 5403
ANPIYSGSGSPDY

SEQ ID NO: 10807 - protein, 10 aa, Homo sapiens
  light chain complementarity determining region 3 for antibody 5404
QQRANWPPYT

SEQ ID NO: 10808 - protein, 13 aa, Homo sapiens
  heavy chain complementarity determining region 3 for antibody 5404
AKPIYSGSGSPDY

SEQ ID NO: 10809 - protein, 9 aa, Homo sapiens
  light chain complementarity determining region 3 for antibody 5405
QQPYRTPYT

SEQ ID NO: 10810 - protein, 10 aa, Homo sapiens
  heavy chain complementarity determining region 3 for antibody 5405
AHRINRAFDI

SEQ ID NO: 10811 - protein, 9 aa, Homo sapiens
  light chain complementarity determining region 3 for antibody 5406
QQPNSYPYT

SEQ ID NO: 10812 - protein, 14 aa, Homo sapiens
  heavy chain complementarity determining region 3 for antibody 5406
ARGHFDSTGFRLDY

SEQ ID NO: 10813 - protein, 9 aa, Homo sapiens
  light chain complementarity determining region 3 for antibody 5407
QQPNSYPYT

SEQ ID NO: 10814 - protein, 10 aa, Homo sapiens
  heavy chain complementarity determining region 3 for antibody 5407
ARETSGAYDI

SEQ ID NO: 10815 - protein, 9 aa, Homo sapiens
  light chain complementarity determining region 3 for antibody 5408
QQNSTYPWT

SEQ ID NO: 10816 - protein, 10 aa, Homo sapiens
  heavy chain complementarity determining region 3 for antibody 5408
AHRINRAFDI

SEQ ID NO: 10817 - protein, 9 aa, Homo sapiens
  light chain complementarity determining region 3 for antibody 5409
QQNNSYSRT

SEQ ID NO: 10818 - protein, 16 aa, Homo sapiens
  heavy chain complementarity determining region 3 for antibody 5409
VGPHLTYNSGWRYFDY

SEQ ID NO: 10819 - protein, 9 aa, Homo sapiens
  light chain complementarity determining region 3 for antibody 5410
QQNNSYSLT

SEQ ID NO: 10820 - protein, 15 aa, Homo sapiens
  heavy chain complementarity determining region 3 for antibody 5410
ARSMVSGTTDDAFDI

SEQ ID NO: 10821 - protein, 9 aa, Homo sapiens
  light chain complementarity determining region 3 for antibody 5411
QQNNSYPWT

SEQ ID NO: 10822 - protein, 11 aa, Homo sapiens
  heavy chain complementarity determining region 3 for antibody 5411
ARIVARKPDDY

SEQ ID NO: 10823 - protein, 9 aa, Homo sapiens
  light chain complementarity determining region 3 for antibody 5412
QQNHGYPWT

SEQ ID NO: 10824 - protein, 9 aa, Homo sapiens
  heavy chain complementarity determining region 3 for antibody 5412
AGWGGLSNY

SEQ ID NO: 10825 - protein, 9 aa, Homo sapiens
  light chain complementarity determining region 3 for antibody 5413
QQNGGSLLT

SEQ ID NO: 10826 - protein, 10 aa, Homo sapiens
  heavy chain complementarity determining region 3 for antibody 5413
CRDRWGFGDV

SEQ ID NO: 10827 - protein, 9 aa, Homo sapiens
  light chain complementarity determining region 3 for antibody 5414
QQNDNLPYT

SEQ ID NO: 10828 - protein, 13 aa, Homo sapiens
  heavy chain complementarity determining region 3 for antibody 5414
AKEGSAPGPDFEY

SEQ ID NO: 10829 - protein, 9 aa, Homo sapiens
  light chain complementarity determining region 3 for antibody 5415
QQNDNLPLT

SEQ ID NO: 10830 - protein, 12 aa, Homo sapiens
  heavy chain complementarity determining region 3 for antibody 5415
AIVVPGRWDLDD

SEQ ID NO: 10831 - protein, 9 aa, Homo sapiens
  light chain complementarity determining region 3 for antibody 5416
QQLYRYQIT

SEQ ID NO: 10832 - protein, 14 aa, Homo sapiens
  heavy chain complementarity determining region 3 for antibody 5416
GRDTTHDWSDGGIY

SEQ ID NO: 10833 - protein, 9 aa, Homo sapiens
  light chain complementarity determining region 3 for antibody 5417
QQLYRYPIT

SEQ ID NO: 10834 - protein, 14 aa, Homo sapiens
  heavy chain complementarity determining region 3 for antibody 5417
GRDTTRDWSDGGIY

SEQ ID NO: 10835 - protein, 9 aa, Homo sapiens
  light chain complementarity determining region 3 for antibody 5418
QQLYRYPIT

SEQ ID NO: 10836 - protein, 14 aa, Homo sapiens
  heavy chain complementarity determining region 3 for antibody 5418
GGDTTHDWSDGGIY

SEQ ID NO: 10837 - protein, 9 aa, Homo sapiens
  light chain complementarity determining region 3 for antibody 5419
QQLYRYPFT

SEQ ID NO: 10838 - protein, 14 aa, Homo sapiens
  heavy chain complementarity determining region 3 for antibody 5419
GRDTTHDWSDGGIY

SEQ ID NO: 10839 - protein, 9 aa, Homo sapiens
  light chain complementarity determining region 3 for antibody 5420
QQLYRSPIT

SEQ ID NO: 10840 - protein, 14 aa, Homo sapiens
  heavy chain complementarity determining region 3 for antibody 5420
GRDTTHDWSDGGIY

SEQ ID NO: 10841 - protein, 9 aa, Homo sapiens
  light chain complementarity determining region 3 for antibody 5421
QQLYNYPIT

SEQ ID NO: 10842 - protein, 14 aa, Homo sapiens
  heavy chain complementarity determining region 3 for antibody 5421
ARDTTYSWNDGGIS

SEQ ID NO: 10843 - protein, 9 aa, Homo sapiens
  light chain complementarity determining region 3 for antibody 5422
QQLYNYPIT

SEQ ID NO: 10844 - protein, 14 aa, Homo sapiens
  heavy chain complementarity determining region 3 for antibody 5422
ARDTTYNWNGGGIS

SEQ ID NO: 10845 - protein, 9 aa, Homo sapiens
  light chain complementarity determining region 3 for antibody 5423
QQLYNYPIT

SEQ ID NO: 10846 - protein, 14 aa, Homo sapiens
  heavy chain complementarity determining region 3 for antibody 5423
ARDTTYNWNDGGTS

SEQ ID NO: 10847 - protein, 9 aa, Homo sapiens
  light chain complementarity determining region 3 for antibody 5424
QQLYNYPIT

SEQ ID NO: 10848 - protein, 14 aa, Homo sapiens
  heavy chain complementarity determining region 3 for antibody 5424
ARDTTYNWNDGGIA

SEQ ID NO: 10849 - protein, 9 aa, Homo sapiens
  light chain complementarity determining region 3 for antibody 5425
QQLTTYPLT

SEQ ID NO: 10850 - protein, 13 aa, Homo sapiens
  heavy chain complementarity determining region 3 for antibody 5425
TREGDSSGPDFHL

SEQ ID NO: 10851 - protein, 9 aa, Homo sapiens
  light chain complementarity determining region 3 for antibody 5426
QQLSSHPLT

SEQ ID NO: 10852 - protein, 15 aa, Homo sapiens
  heavy chain complementarity determining region 3 for antibody 5426
ARQEDYGGLWGPEIY

SEQ ID NO: 10853 - protein, 9 aa, Homo sapiens
  light chain complementarity determining region 3 for antibody 5427
QQLSNTPLT

SEQ ID NO: 10854 - protein, 17 aa, Homo sapiens
  heavy chain complementarity determining region 3 for antibody 5427
AKRLPDLLGGGHHYIDV

SEQ ID NO: 10855 - protein, 9 aa, Homo sapiens
  light chain complementarity determining region 3 for antibody 5428
QQLSNASLT

SEQ ID NO: 10856 - protein, 17 aa, Homo sapiens
  heavy chain complementarity determining region 3 for antibody 5428
AKRLPDLLGGGHHYIDV

SEQ ID NO: 10857 - protein, 9 aa, Homo sapiens
  light chain complementarity determining region 3 for antibody 5429
QQLSNAPLT

SEQ ID NO: 10858 - protein, 17 aa, Homo sapiens
  heavy chain complementarity determining region 3 for antibody 5429
SRDGRIIWPGSQGSLDS

SEQ ID NO: 10859 - protein, 9 aa, Homo sapiens
  light chain complementarity determining region 3 for antibody 5430
QQLSNAPLT

SEQ ID NO: 10860 - protein, 14 aa, Homo sapiens
  heavy chain complementarity determining region 3 for antibody 5430
GRDVHTTGWTLGGY

SEQ ID NO: 10861 - protein, 9 aa, Homo sapiens
  light chain complementarity determining region 3 for antibody 5431
QQLSNAPLT

SEQ ID NO: 10862 - protein, 10 aa, Homo sapiens
  heavy chain complementarity determining region 3 for antibody 5431
CRDREGFGDV

SEQ ID NO: 10863 - protein, 9 aa, Homo sapiens
  light chain complementarity determining region 3 for antibody 5432
QQLSNAPLT

SEQ ID NO: 10864 - protein, 14 aa, Homo sapiens
  heavy chain complementarity determining region 3 for antibody 5432
ARLHGSGLGRWLDP

SEQ ID NO: 10865 - protein, 9 aa, Homo sapiens
  light chain complementarity determining region 3 for antibody 5433
QQLSNAPLT

SEQ ID NO: 10866 - protein, 12 aa, Homo sapiens
  heavy chain complementarity determining region 3 for antibody 5433
ARLDWNYRAFDI

SEQ ID NO: 10867 - protein, 9 aa, Homo sapiens
  light chain complementarity determining region 3 for antibody 5434
QQLSNAPLT

SEQ ID NO: 10868 - protein, 10 aa, Homo sapiens
  heavy chain complementarity determining region 3 for antibody 5434
ARETSGAYDI

SEQ ID NO: 10869 - protein, 9 aa, Homo sapiens
  light chain complementarity determining region 3 for antibody 5435
QQLSNAPLT

SEQ ID NO: 10870 - protein, 14 aa, Homo sapiens
  heavy chain complementarity determining region 3 for antibody 5435
ARDVHTTGWTLGGY

SEQ ID NO: 10871 - protein, 9 aa, Homo sapiens
  light chain complementarity determining region 3 for antibody 5436
QQLSNAPLT

SEQ ID NO: 10872 - protein, 17 aa, Homo sapiens
  heavy chain complementarity determining region 3 for antibody 5436
AKRSPDLLGGGHHYIDV

SEQ ID NO: 10873 - protein, 9 aa, Homo sapiens
  light chain complementarity determining region 3 for antibody 5437
QQLSNAPLT

SEQ ID NO: 10874 - protein, 17 aa, Homo sapiens
  heavy chain complementarity determining region 3 for antibody 5437
AKRLTDLLGGGHHYIDV

SEQ ID NO: 10875 - protein, 9 aa, Homo sapiens
  light chain complementarity determining region 3 for antibody 5438
QQLSNAPLT

SEQ ID NO: 10876 - protein, 17 aa, Homo sapiens
  heavy chain complementarity determining region 3 for antibody 5438
AKRLPYLLGGGHHYIDV

SEQ ID NO: 10877 - protein, 9 aa, Homo sapiens
  light chain complementarity determining region 3 for antibody 5439
QQLSNAPLT

SEQ ID NO: 10878 - protein, 17 aa, Homo sapiens
  heavy chain complementarity determining region 3 for antibody 5439
AKRLPDLLGGGRHYIDV

SEQ ID NO: 10879 - protein, 9 aa, Homo sapiens
  light chain complementarity determining region 3 for antibody 5440
QQLSNAPLT

SEQ ID NO: 10880 - protein, 17 aa, Homo sapiens
  heavy chain complementarity determining region 3 for antibody 5440
AKRLPDLLGGGHRYIDV

SEQ ID NO: 10881 - protein, 9 aa, Homo sapiens
  light chain complementarity determining region 3 for antibody 5441
QQLSNAPLT

SEQ ID NO: 10882 - protein, 17 aa, Homo sapiens
  heavy chain complementarity determining region 3 for antibody 5441
AKRLPDLLGGGHHYVDV

SEQ ID NO: 10883 - protein, 9 aa, Homo sapiens
  light chain complementarity determining region 3 for antibody 5442
QQLSNAPLT

SEQ ID NO: 10884 - protein, 17 aa, Homo sapiens
  heavy chain complementarity determining region 3 for antibody 5442
AKRLPDLLGGGHHYTDV

SEQ ID NO: 10885 - protein, 9 aa, Homo sapiens
  light chain complementarity determining region 3 for antibody 5443
QQLSNAPLT

SEQ ID NO: 10886 - protein, 17 aa, Homo sapiens
  heavy chain complementarity determining region 3 for antibody 5443
AKRLPDLLGGGHHYIDI

SEQ ID NO: 10887 - protein, 9 aa, Homo sapiens
  light chain complementarity determining region 3 for antibody 5444
QQLSNAPLT

SEQ ID NO: 10888 - protein, 13 aa, Homo sapiens
  heavy chain complementarity determining region 3 for antibody 5444
AKEGSSPGPDFDS

SEQ ID NO: 10889 - protein, 9 aa, Homo sapiens
  light chain complementarity determining region 3 for antibody 5445
QQLSNAPLT

SEQ ID NO: 10890 - protein, 9 aa, Homo sapiens
  heavy chain complementarity determining region 3 for antibody 5445
AGWGGLSNY

SEQ ID NO: 10891 - protein, 9 aa, Homo sapiens
  light chain complementarity determining region 3 for antibody 5446
QQLSNAPIT

SEQ ID NO: 10892 - protein, 17 aa, Homo sapiens
  heavy chain complementarity determining region 3 for antibody 5446
AKRLPDLLGGGHHYIDV

SEQ ID NO: 10893 - protein, 9 aa, Homo sapiens
  light chain complementarity determining region 3 for antibody 5447
QQLSDAPLT

SEQ ID NO: 10894 - protein, 17 aa, Homo sapiens
  heavy chain complementarity determining region 3 for antibody 5447
AKRLPDLLGGGHHYIDV

SEQ ID NO: 10895 - protein, 9 aa, Homo sapiens
  light chain complementarity determining region 3 for antibody 5448
QQLNTYPPT

SEQ ID NO: 10896 - protein, 13 aa, Homo sapiens
  heavy chain complementarity determining region 3 for antibody 5448
TREGDSSGPDFHL

SEQ ID NO: 10897 - protein, 9 aa, Homo sapiens
  light chain complementarity determining region 3 for antibody 5449
QQLNTYPLT

SEQ ID NO: 10898 - protein, 11 aa, Homo sapiens
  heavy chain complementarity determining region 3 for antibody 5449
VKTSRTYYLEF

SEQ ID NO: 10899 - protein, 9 aa, Homo sapiens
  light chain complementarity determining region 3 for antibody 5450
QQLNTYPLT

SEQ ID NO: 10900 - protein, 13 aa, Homo sapiens
  heavy chain complementarity determining region 3 for antibody 5450
AREGDSSGPDFHL

SEQ ID NO: 10901 - protein, 9 aa, Homo sapiens
  light chain complementarity determining region 3 for antibody 5451
QQLNTYPLT

SEQ ID NO: 10902 - protein, 13 aa, Homo sapiens
  heavy chain complementarity determining region 3 for antibody 5451
AKEGSSPGPDFEY

SEQ ID NO: 10903 - protein, 9 aa, Homo sapiens
  light chain complementarity determining region 3 for antibody 5452
QQLNSYPYT

SEQ ID NO: 10904 - protein, 11 aa, Homo sapiens
  heavy chain complementarity determining region 3 for antibody 5452
VRVSTGWNFDY

SEQ ID NO: 10905 - protein, 9 aa, Homo sapiens
  light chain complementarity determining region 3 for antibody 5453
QQLNSYPYT

SEQ ID NO: 10906 - protein, 16 aa, Homo sapiens
  heavy chain complementarity determining region 3 for antibody 5453
VGPHLTYNSGWRYFDY

SEQ ID NO: 10907 - protein, 9 aa, Homo sapiens
  light chain complementarity determining region 3 for antibody 5454
QQLNSYPYT

SEQ ID NO: 10908 - protein, 11 aa, Homo sapiens
  heavy chain complementarity determining region 3 for antibody 5454
TRGGYSVGYDY

SEQ ID NO: 10909 - protein, 9 aa, Homo sapiens
  light chain complementarity determining region 3 for antibody 5455
QQLNSYPYT

SEQ ID NO: 10910 - protein, 13 aa, Homo sapiens
  heavy chain complementarity determining region 3 for antibody 5455
TKEGSSAGPDFVY

SEQ ID NO: 10911 - protein, 9 aa, Homo sapiens
  light chain complementarity determining region 3 for antibody 5456
QQLNSYPYT

SEQ ID NO: 10912 - protein, 11 aa, Homo sapiens
  heavy chain complementarity determining region 3 for antibody 5456
ATFGQQWRLAH

SEQ ID NO: 10913 - protein, 9 aa, Homo sapiens
  light chain complementarity determining region 3 for antibody 5457
QQLNSYPYT

SEQ ID NO: 10914 - protein, 10 aa, Homo sapiens
  heavy chain complementarity determining region 3 for antibody 5457
ASETSGAYDI

SEQ ID NO: 10915 - protein, 9 aa, Homo sapiens
  light chain complementarity determining region 3 for antibody 5458
QQLNSYPYT

SEQ ID NO: 10916 - protein, 15 aa, Homo sapiens
  heavy chain complementarity determining region 3 for antibody 5458
ARVGRPYHNAWYFDN

SEQ ID NO: 10917 - protein, 9 aa, Homo sapiens
  light chain complementarity determining region 3 for antibody 5459
QQLNSYPYT

SEQ ID NO: 10918 - protein, 17 aa, Homo sapiens
  heavy chain complementarity determining region 3 for antibody 5459
ARNTMVHGWQRQGSVDH

SEQ ID NO: 10919 - protein, 9 aa, Homo sapiens
  light chain complementarity determining region 3 for antibody 5460
QQLNSYPYT

SEQ ID NO: 10920 - protein, 14 aa, Homo sapiens
  heavy chain complementarity determining region 3 for antibody 5460
ARLHGSGLGRWLDP

SEQ ID NO: 10921 - protein, 9 aa, Homo sapiens
  light chain complementarity determining region 3 for antibody 5461
QQLNSYPYT

SEQ ID NO: 10922 - protein, 14 aa, Homo sapiens
  heavy chain complementarity determining region 3 for antibody 5461
ARGHSDSTGFRLDY

SEQ ID NO: 10923 - protein, 9 aa, Homo sapiens
  light chain complementarity determining region 3 for antibody 5462
QQLNSYPYT

SEQ ID NO: 10924 - protein, 14 aa, Homo sapiens
  heavy chain complementarity determining region 3 for antibody 5462
ARGHFESTGFRLDY

SEQ ID NO: 10925 - protein, 9 aa, Homo sapiens
  light chain complementarity determining region 3 for antibody 5463
QQLNSYPYT

SEQ ID NO: 10926 - protein, 14 aa, Homo sapiens
  heavy chain complementarity determining region 3 for antibody 5463
ARGHFDSTGFRLDH

SEQ ID NO: 10927 - protein, 9 aa, Homo sapiens
  light chain complementarity determining region 3 for antibody 5464
QQLNSYPYT

SEQ ID NO: 10928 - protein, 10 aa, Homo sapiens
  heavy chain complementarity determining region 3 for antibody 5464
ARETSGSYDI

SEQ ID NO: 10929 - protein, 9 aa, Homo sapiens
  light chain complementarity determining region 3 for antibody 5465
QQLNSYPYT

SEQ ID NO: 10930 - protein, 10 aa, Homo sapiens
  heavy chain complementarity determining region 3 for antibody 5465
ARETSGAYDT

SEQ ID NO: 10931 - protein, 9 aa, Homo sapiens
  light chain complementarity determining region 3 for antibody 5466
QQLNSYPYT

SEQ ID NO: 10932 - protein, 10 aa, Homo sapiens
  heavy chain complementarity determining region 3 for antibody 5466
ARETPGAYDI

SEQ ID NO: 10933 - protein, 9 aa, Homo sapiens
  light chain complementarity determining region 3 for antibody 5467
QQLNSSPYT

SEQ ID NO: 10934 - protein, 10 aa, Homo sapiens
  heavy chain complementarity determining region 3 for antibody 5467
CRDREGFGDV

SEQ ID NO: 10935 - protein, 9 aa, Homo sapiens
  light chain complementarity determining region 3 for antibody 5468
QQLNSSPYT

SEQ ID NO: 10936 - protein, 14 aa, Homo sapiens
  heavy chain complementarity determining region 3 for antibody 5468
ARGHFGSTGFRLDY

SEQ ID NO: 10937 - protein, 9 aa, Homo sapiens
  light chain complementarity determining region 3 for antibody 5469
QQLNSSPYT

SEQ ID NO: 10938 - protein, 14 aa, Homo sapiens
  heavy chain complementarity determining region 3 for antibody 5469
ARGHFDSTVFRLDY

SEQ ID NO: 10939 - protein, 9 aa, Homo sapiens
  light chain complementarity determining region 3 for antibody 5470
QQLNSSPYT

SEQ ID NO: 10940 - protein, 14 aa, Homo sapiens
  heavy chain complementarity determining region 3 for antibody 5470
ARGHFDSTGFRRDY

SEQ ID NO: 10941 - protein, 9 aa, Homo sapiens
  light chain complementarity determining region 3 for antibody 5471
QQLNSSPYT

SEQ ID NO: 10942 - protein, 14 aa, Homo sapiens
  heavy chain complementarity determining region 3 for antibody 5471
ARGHFDSTGFRLDS

SEQ ID NO: 10943 - protein, 9 aa, Homo sapiens
  light chain complementarity determining region 3 for antibody 5472
QQLNSSPYT

SEQ ID NO: 10944 - protein, 14 aa, Homo sapiens
  heavy chain complementarity determining region 3 for antibody 5472
ARGHFDSSGFRLDY

SEQ ID NO: 10945 - protein, 9 aa, Homo sapiens
  light chain complementarity determining region 3 for antibody 5473
QQLNSSPYT

SEQ ID NO: 10946 - protein, 14 aa, Homo sapiens
  heavy chain complementarity determining region 3 for antibody 5473
ARGHCDSTGFRLDY

SEQ ID NO: 10947 - protein, 9 aa, Homo sapiens
  light chain complementarity determining region 3 for antibody 5474
QQLNSSPYT

SEQ ID NO: 10948 - protein, 17 aa, Homo sapiens
  heavy chain complementarity determining region 3 for antibody 5474
AKRLPDLLGGGHHYIDV

SEQ ID NO: 10949 - protein, 8 aa, Homo sapiens
  light chain complementarity determining region 3 for antibody 5475
QQLNSSPL

SEQ ID NO: 10950 - protein, 11 aa, Homo sapiens
  heavy chain complementarity determining region 3 for antibody 5475
AREQHGQAPDY

SEQ ID NO: 10951 - protein, 9 aa, Homo sapiens
  light chain complementarity determining region 3 for antibody 5476
QQLNSPPYT

SEQ ID NO: 10952 - protein, 14 aa, Homo sapiens
  heavy chain complementarity determining region 3 for antibody 5476
ARGHFDSTGFRLDY

SEQ ID NO: 10953 - protein, 9 aa, Homo sapiens
  light chain complementarity determining region 3 for antibody 5477
QQLNSFPYT

SEQ ID NO: 10954 - protein, 21 aa, Homo sapiens
  heavy chain complementarity determining region 3 for antibody 5477
ARGSRTYCRSDDTGCRPMFDS

SEQ ID NO: 10955 - protein, 9 aa, Homo sapiens
  light chain complementarity determining region 3 for antibody 5478
QQLNSDPYT

SEQ ID NO: 10956 - protein, 14 aa, Homo sapiens
  heavy chain complementarity determining region 3 for antibody 5478
ARGHVDSTGFRLDY

SEQ ID NO: 10957 - protein, 9 aa, Homo sapiens
  light chain complementarity determining region 3 for antibody 5479
QQLNSDPYT

SEQ ID NO: 10958 - protein, 14 aa, Homo sapiens
  heavy chain complementarity determining region 3 for antibody 5479
ARGHFDSTGVRLDY

SEQ ID NO: 10959 - protein, 9 aa, Homo sapiens
  light chain complementarity determining region 3 for antibody 5480
QQLNSDPYT

SEQ ID NO: 10960 - protein, 14 aa, Homo sapiens
  heavy chain complementarity determining region 3 for antibody 5480
ARGHFDSTGCRLDY

SEQ ID NO: 10961 - protein, 9 aa, Homo sapiens
  light chain complementarity determining region 3 for antibody 5481
QQLNSDPST

SEQ ID NO: 10962 - protein, 14 aa, Homo sapiens
  heavy chain complementarity determining region 3 for antibody 5481
ARGHFDSTGFRLDY

SEQ ID NO: 10963 - protein, 9 aa, Homo sapiens
  light chain complementarity determining region 3 for antibody 5482
QQLNNAPLT

SEQ ID NO: 10964 - protein, 17 aa, Homo sapiens
  heavy chain complementarity determining region 3 for antibody 5482
AKRLPDLLGGGHHYIDV

SEQ ID NO: 10965 - protein, 10 aa, Homo sapiens
  light chain complementarity determining region 3 for antibody 5483
QQLNGYAPNT

SEQ ID NO: 10966 - protein, 18 aa, Homo sapiens
  heavy chain complementarity determining region 3 for antibody 5483
ATPAARASCYSDGCSFDF

SEQ ID NO: 10967 - protein, 10 aa, Homo sapiens
  light chain complementarity determining region 3 for antibody 5484
QQLNGYAPKT

SEQ ID NO: 10968 - protein, 18 aa, Homo sapiens
  heavy chain complementarity determining region 3 for antibody 5484
ATPAARASCYSDGCYFDF

SEQ ID NO: 10969 - protein, 9 aa, Homo sapiens
  light chain complementarity determining region 3 for antibody 5485
QQLMVYPYT

SEQ ID NO: 10970 - protein, 14 aa, Homo sapiens
  heavy chain complementarity determining region 3 for antibody 5485
TRGPFDSTGFRLDY

SEQ ID NO: 10971 - protein, 9 aa, Homo sapiens
  light chain complementarity determining region 3 for antibody 5486
QQLMVYPYT

SEQ ID NO: 10972 - protein, 14 aa, Homo sapiens
  heavy chain complementarity determining region 3 for antibody 5486
TRGHFDSTGSRLDY

SEQ ID NO: 10973 - protein, 9 aa, Homo sapiens
  light chain complementarity determining region 3 for antibody 5487
QQLMVYPYT

SEQ ID NO: 10974 - protein, 14 aa, Homo sapiens
  heavy chain complementarity determining region 3 for antibody 5487
TRGHFDSTGCRLDY

SEQ ID NO: 10975 - protein, 9 aa, Homo sapiens
  light chain complementarity determining region 3 for antibody 5488
QQLMVYPYT

SEQ ID NO: 10976 - protein, 14 aa, Homo sapiens
  heavy chain complementarity determining region 3 for antibody 5488
TRGHFDSTCFRLDY

SEQ ID NO: 10977 - protein, 9 aa, Homo sapiens
  light chain complementarity determining region 3 for antibody 5489
QQLMSYPYT

SEQ ID NO: 10978 - protein, 17 aa, Homo sapiens
  heavy chain complementarity determining region 3 for antibody 5489
ARNTMAHGWQRQGSVDH

SEQ ID NO: 10979 - protein, 9 aa, Homo sapiens
  light chain complementarity determining region 3 for antibody 5490
QQLMSYPYT

SEQ ID NO: 10980 - protein, 17 aa, Homo sapiens
  heavy chain complementarity determining region 3 for antibody 5490
ARNSMVHGWQRQGSVDH

SEQ ID NO: 10981 - protein, 9 aa, Homo sapiens
  light chain complementarity determining region 3 for antibody 5491
QQLMSYPYT

SEQ ID NO: 10982 - protein, 14 aa, Homo sapiens
  heavy chain complementarity determining region 3 for antibody 5491
ARGRFDSTGFRLDY

SEQ ID NO: 10983 - protein, 9 aa, Homo sapiens
  light chain complementarity determining region 3 for antibody 5492
QQLMSYPYT

SEQ ID NO: 10984 - protein, 14 aa, Homo sapiens
  heavy chain complementarity determining region 3 for antibody 5492
ARGPFDSTGFRLDY

SEQ ID NO: 10985 - protein, 9 aa, Homo sapiens
  light chain complementarity determining region 3 for antibody 5493
QQLMSYPST

SEQ ID NO: 10986 - protein, 14 aa, Homo sapiens
  heavy chain complementarity determining region 3 for antibody 5493
ARGHFDSTGFRLDY

SEQ ID NO: 10987 - protein, 9 aa, Homo sapiens
  light chain complementarity determining region 3 for antibody 5494
QQLMSYPHT

SEQ ID NO: 10988 - protein, 14 aa, Homo sapiens
  heavy chain complementarity determining region 3 for antibody 5494
ARGHFDSTGFRLDY

SEQ ID NO: 10989 - protein, 9 aa, Homo sapiens
  light chain complementarity determining region 3 for antibody 5495
QQLIVYPYT

SEQ ID NO: 10990 - protein, 14 aa, Homo sapiens
  heavy chain complementarity determining region 3 for antibody 5495
TRGHFDSTGFRLDY

SEQ ID NO: 10991 - protein, 9 aa, Homo sapiens
  light chain complementarity determining region 3 for antibody 5496
QQLHSYPYT

SEQ ID NO: 10992 - protein, 14 aa, Homo sapiens
  heavy chain complementarity determining region 3 for antibody 5496
ARGHVDTTGFRLDY

SEQ ID NO: 10993 - protein, 9 aa, Homo sapiens
  light chain complementarity determining region 3 for antibody 5497
QQLHSYPYT

SEQ ID NO: 10994 - protein, 14 aa, Homo sapiens
  heavy chain complementarity determining region 3 for antibody 5497
ARGHVDSTGFRLDY

SEQ ID NO: 10995 - protein, 9 aa, Homo sapiens
  light chain complementarity determining region 3 for antibody 5498
QQLHSYPYT

SEQ ID NO: 10996 - protein, 14 aa, Homo sapiens
  heavy chain complementarity determining region 3 for antibody 5498
ARGHFDSTGCRLDY

SEQ ID NO: 10997 - protein, 9 aa, Homo sapiens
  light chain complementarity determining region 3 for antibody 5499
QQLHSYPST

SEQ ID NO: 10998 - protein, 14 aa, Homo sapiens
  heavy chain complementarity determining region 3 for antibody 5499
ARGHFDSTGFRLDY

SEQ ID NO: 10999 - protein, 9 aa, Homo sapiens
  light chain complementarity determining region 3 for antibody 5500
QQLHSYPHT

SEQ ID NO: 11000 - protein, 14 aa, Homo sapiens
  heavy chain complementarity determining region 3 for antibody 5500
ARGHFDSTGFRLDY

SEQ ID NO: 11001 - protein, 9 aa, Homo sapiens
  light chain complementarity determining region 3 for antibody 5501
QQLHSSPYT

SEQ ID NO: 11002 - protein, 14 aa, Homo sapiens
  heavy chain complementarity determining region 3 for antibody 5501
ARGHVDSTGFRLDY

SEQ ID NO: 11003 - protein, 9 aa, Homo sapiens
  light chain complementarity determining region 3 for antibody 5502
QQLHSSPYT

SEQ ID NO: 11004 - protein, 14 aa, Homo sapiens
  heavy chain complementarity determining region 3 for antibody 5502
ARGHSDSTGFRLDY

SEQ ID NO: 11005 - protein, 9 aa, Homo sapiens
  light chain complementarity determining region 3 for antibody 5503
QQLHSSPYT

SEQ ID NO: 11006 - protein, 14 aa, Homo sapiens
  heavy chain complementarity determining region 3 for antibody 5503
ARGHFDSAGFRLDY

SEQ ID NO: 11007 - protein, 9 aa, Homo sapiens
  light chain complementarity determining region 3 for antibody 5504
QQLHSDPYT

SEQ ID NO: 11008 - protein, 14 aa, Homo sapiens
  heavy chain complementarity determining region 3 for antibody 5504
ARGHFDSTGVRLDY

SEQ ID NO: 11009 - protein, 9 aa, Homo sapiens
  light chain complementarity determining region 3 for antibody 5505
QQLHRYPYT

SEQ ID NO: 11010 - protein, 14 aa, Homo sapiens
  heavy chain complementarity determining region 3 for antibody 5505
ARGHFDSTGFRLDY

SEQ ID NO: 11011 - protein, 9 aa, Homo sapiens
  light chain complementarity determining region 3 for antibody 5506
QQLHISPYT

SEQ ID NO: 11012 - protein, 14 aa, Homo sapiens
  heavy chain complementarity determining region 3 for antibody 5506
ARGHFDSTGCRLDY

SEQ ID NO: 11013 - protein, 9 aa, Homo sapiens
  light chain complementarity determining region 3 for antibody 5507
QQLHGYPIT

SEQ ID NO: 11014 - protein, 10 aa, Homo sapiens
  heavy chain complementarity determining region 3 for antibody 5507
CRDREGSGDV

SEQ ID NO: 11015 - protein, 9 aa, Homo sapiens
  light chain complementarity determining region 3 for antibody 5508
QQLCNAPLT

SEQ ID NO: 11016 - protein, 17 aa, Homo sapiens
  heavy chain complementarity determining region 3 for antibody 5508
AKRLPDLLGGGHHYIDV

SEQ ID NO: 11017 - protein, 9 aa, Homo sapiens
  light chain complementarity determining region 3 for antibody 5509
QQKLQCLGT

SEQ ID NO: 11018 - protein, 10 aa, Homo sapiens
  heavy chain complementarity determining region 3 for antibody 5509
SKSSSGHFDD

SEQ ID NO: 11019 - protein, 9 aa, Homo sapiens
  light chain complementarity determining region 3 for antibody 5510
QQIYRTPYT

SEQ ID NO: 11020 - protein, 14 aa, Homo sapiens
  heavy chain complementarity determining region 3 for antibody 5510
ARLHGSGLGRWLDP

SEQ ID NO: 11021 - protein, 9 aa, Homo sapiens
  light chain complementarity determining region 3 for antibody 5511
QQHYTTPYT

SEQ ID NO: 11022 - protein, 20 aa, Homo sapiens
  heavy chain complementarity determining region 3 for antibody 5511
AKHYCPPSLTYCNTNWYFDL

SEQ ID NO: 11023 - protein, 9 aa, Homo sapiens
  light chain complementarity determining region 3 for antibody 5512
QQHYTAPYT

SEQ ID NO: 11024 - protein, 14 aa, Homo sapiens
  heavy chain complementarity determining region 3 for antibody 5512
ARGHFDSTGFRLDY

SEQ ID NO: 11025 - protein, 9 aa, Homo sapiens
  light chain complementarity determining region 3 for antibody 5513
QQHYTAPYP

SEQ ID NO: 11026 - protein, 10 aa, Homo sapiens
  heavy chain complementarity determining region 3 for antibody 5513
ARDISRHMDV

SEQ ID NO: 11027 - protein, 9 aa, Homo sapiens
  light chain complementarity determining region 3 for antibody 5514
QQHYSIPFP

SEQ ID NO: 11028 - protein, 10 aa, Homo sapiens
  heavy chain complementarity determining region 3 for antibody 5514
TTACGGDCSY

SEQ ID NO: 11029 - protein, 9 aa, Homo sapiens
  light chain complementarity determining region 3 for antibody 5515
QQHYRYPIT

SEQ ID NO: 11030 - protein, 14 aa, Homo sapiens
  heavy chain complementarity determining region 3 for antibody 5515
GRDTTHDWSDGGIY

SEQ ID NO: 11031 - protein, 9 aa, Homo sapiens
  light chain complementarity determining region 3 for antibody 5516
QQHYNLPIP

SEQ ID NO: 11032 - protein, 12 aa, Homo sapiens
  heavy chain complementarity determining region 3 for antibody 5516
CVGGFGGTWFDS

SEQ ID NO: 11033 - protein, 9 aa, Homo sapiens
  light chain complementarity determining region 3 for antibody 5517
QQHYGTPWT

SEQ ID NO: 11034 - protein, 10 aa, Homo sapiens
  heavy chain complementarity determining region 3 for antibody 5517
ATSASGWYVY

SEQ ID NO: 11035 - protein, 9 aa, Homo sapiens
  light chain complementarity determining region 3 for antibody 5518
QQHSSYPRT

SEQ ID NO: 11036 - protein, 21 aa, Homo sapiens
  heavy chain complementarity determining region 3 for antibody 5518
TRGIGAYAWGDFRSSDKDFDF

SEQ ID NO: 11037 - protein, 9 aa, Homo sapiens
  light chain complementarity determining region 3 for antibody 5519
QQHNSYPHT

SEQ ID NO: 11038 - protein, 9 aa, Homo sapiens
  heavy chain complementarity determining region 3 for antibody 5519
ATDRSWFDP

SEQ ID NO: 11039 - protein, 10 aa, Homo sapiens
  light chain complementarity determining region 3 for antibody 5520
QQHNNWPTIT

SEQ ID NO: 11040 - protein, 13 aa, Homo sapiens
  heavy chain complementarity determining region 3 for antibody 5520
AKPQYYGSGSGDY

SEQ ID NO: 11041 - protein, 10 aa, Homo sapiens
  light chain complementarity determining region 3 for antibody 5521
QQHNNWPTIT

SEQ ID NO: 11042 - protein, 13 aa, Homo sapiens
  heavy chain complementarity determining region 3 for antibody 5521
AEPHYYGSGSGDY

SEQ ID NO: 11043 - protein, 9 aa, Homo sapiens
  light chain complementarity determining region 3 for antibody 5522
QQHLTYPLT

SEQ ID NO: 11044 - protein, 18 aa, Homo sapiens
  heavy chain complementarity determining region 3 for antibody 5522
ARGSYCDSSSWCPYGFDI

SEQ ID NO: 11045 - protein, 9 aa, Homo sapiens
  light chain complementarity determining region 3 for antibody 5523
QQHHGYPWT

SEQ ID NO: 11046 - protein, 9 aa, Homo sapiens
  heavy chain complementarity determining region 3 for antibody 5523
AGWGGLSNY

SEQ ID NO: 11047 - protein, 7 aa, Homo sapiens
  light chain complementarity determining region 3 for antibody 5524
QQHGSYT

SEQ ID NO: 11048 - protein, 10 aa, Homo sapiens
  heavy chain complementarity determining region 3 for antibody 5524
ARRWERYFDY

SEQ ID NO: 11049 - protein, 9 aa, Homo sapiens
  light chain complementarity determining region 3 for antibody 5525
QQGYTTPYT

SEQ ID NO: 11050 - protein, 13 aa, Homo sapiens
  heavy chain complementarity determining region 3 for antibody 5525
AKEGSAPGPDFEY

SEQ ID NO: 11051 - protein, 9 aa, Homo sapiens
  light chain complementarity determining region 3 for antibody 5526
QQGYTFPPT

SEQ ID NO: 11052 - protein, 10 aa, Homo sapiens
  heavy chain complementarity determining region 3 for antibody 5526
ARDSSRHMDV

SEQ ID NO: 11053 - protein, 9 aa, Homo sapiens
  light chain complementarity determining region 3 for antibody 5527
QQGYFTPRT

SEQ ID NO: 11054 - protein, 11 aa, Homo sapiens
  heavy chain complementarity determining region 3 for antibody 5527
ARRSLGGAFDY

SEQ ID NO: 11055 - protein, 9 aa, Homo sapiens
  light chain complementarity determining region 3 for antibody 5528
QQFYSNPRT

SEQ ID NO: 11056 - protein, 20 aa, Homo sapiens
  heavy chain complementarity determining region 3 for antibody 5528
TRDNSPNCSGGTCYWWGFDY

SEQ ID NO: 11057 - protein, 9 aa, Homo sapiens
  light chain complementarity determining region 3 for antibody 5529
QQFYEIPLP

SEQ ID NO: 11058 - protein, 16 aa, Homo sapiens
  heavy chain complementarity determining region 3 for antibody 5529
ARDGRGASSQFNLFDP

SEQ ID NO: 11059 - protein, 9 aa, Homo sapiens
  light chain complementarity determining region 3 for antibody 5530
QQFSTLPRT

SEQ ID NO: 11060 - protein, 13 aa, Homo sapiens
  heavy chain complementarity determining region 3 for antibody 5530
AKEGSSPGPDFDS

SEQ ID NO: 11061 - protein, 9 aa, Homo sapiens
  light chain complementarity determining region 3 for antibody 5531
QQFSSYPRT

SEQ ID NO: 11062 - protein, 13 aa, Homo sapiens
  heavy chain complementarity determining region 3 for antibody 5531
AADGPYGSSAFDY

SEQ ID NO: 11063 - protein, 9 aa, Homo sapiens
  light chain complementarity determining region 3 for antibody 5532
QQFSSFPRT

SEQ ID NO: 11064 - protein, 9 aa, Homo sapiens
  heavy chain complementarity determining region 3 for antibody 5532
VRGRNNFRY

SEQ ID NO: 11065 - protein, 9 aa, Homo sapiens
  light chain complementarity determining region 3 for antibody 5533
QQFSSFPRT

SEQ ID NO: 11066 - protein, 9 aa, Homo sapiens
  heavy chain complementarity determining region 3 for antibody 5533
ERGRNNFRY

SEQ ID NO: 11067 - protein, 9 aa, Homo sapiens
  light chain complementarity determining region 3 for antibody 5534
QQFSSFPRT

SEQ ID NO: 11068 - protein, 9 aa, Homo sapiens
  heavy chain complementarity determining region 3 for antibody 5534
ASGRNNFRY

SEQ ID NO: 11069 - protein, 9 aa, Homo sapiens
  light chain complementarity determining region 3 for antibody 5535
QQFSSFPRT

SEQ ID NO: 11070 - protein, 9 aa, Homo sapiens
  heavy chain complementarity determining region 3 for antibody 5535
ARGRNNFQY

SEQ ID NO: 11071 - protein, 9 aa, Homo sapiens
  light chain complementarity determining region 3 for antibody 5536
QQFSSFPRT

SEQ ID NO: 11072 - protein, 10 aa, Homo sapiens
  heavy chain complementarity determining region 3 for antibody 5536
ARERSGSYDI

SEQ ID NO: 11073 - protein, 9 aa, Homo sapiens
  light chain complementarity determining region 3 for antibody 5537
QQFSSFPRT

SEQ ID NO: 11074 - protein, 9 aa, Homo sapiens
  heavy chain complementarity determining region 3 for antibody 5537
ARERNNFRY

SEQ ID NO: 11075 - protein, 9 aa, Homo sapiens
  light chain complementarity determining region 3 for antibody 5538
QQFSSFPRT

SEQ ID NO: 11076 - protein, 9 aa, Homo sapiens
  heavy chain complementarity determining region 3 for antibody 5538
AGGRNNFRY

SEQ ID NO: 11077 - protein, 9 aa, Homo sapiens
  light chain complementarity determining region 3 for antibody 5539
QQFSNLPRT

SEQ ID NO: 11078 - protein, 9 aa, Homo sapiens
  heavy chain complementarity determining region 3 for antibody 5539
VRGRSNFRY

SEQ ID NO: 11079 - protein, 9 aa, Homo sapiens
  light chain complementarity determining region 3 for antibody 5540
QQFSNLPRT

SEQ ID NO: 11080 - protein, 13 aa, Homo sapiens
  heavy chain complementarity determining region 3 for antibody 5540
GKEGSSPGPDFDS

SEQ ID NO: 11081 - protein, 9 aa, Homo sapiens
  light chain complementarity determining region 3 for antibody 5541
QQFSNLPRT

SEQ ID NO: 11082 - protein, 15 aa, Homo sapiens
  heavy chain complementarity determining region 3 for antibody 5541
GKEGPGSSGWLTGHY

SEQ ID NO: 11083 - protein, 9 aa, Homo sapiens
  light chain complementarity determining region 3 for antibody 5542
QQFSNLPRT

SEQ ID NO: 11084 - protein, 13 aa, Homo sapiens
  heavy chain complementarity determining region 3 for antibody 5542
DKEGSSPGPDFDS

SEQ ID NO: 11085 - protein, 9 aa, Homo sapiens
  light chain complementarity determining region 3 for antibody 5543
QQFSNLPRT

SEQ ID NO: 11086 - protein, 13 aa, Homo sapiens
  heavy chain complementarity determining region 3 for antibody 5543
AKEGYSPGPDFDS

SEQ ID NO: 11087 - protein, 9 aa, Homo sapiens
  light chain complementarity determining region 3 for antibody 5544
QQFSNLPRT

SEQ ID NO: 11088 - protein, 13 aa, Homo sapiens
  heavy chain complementarity determining region 3 for antibody 5544
AKEGSSPSPDFDS

SEQ ID NO: 11089 - protein, 9 aa, Homo sapiens
  light chain complementarity determining region 3 for antibody 5545
QQFSNLPRT

SEQ ID NO: 11090 - protein, 13 aa, Homo sapiens
  heavy chain complementarity determining region 3 for antibody 5545
AKEGSSPGSDFDS

SEQ ID NO: 11091 - protein, 9 aa, Homo sapiens
  light chain complementarity determining region 3 for antibody 5546
QQFSNLPRT

SEQ ID NO: 11092 - protein, 13 aa, Homo sapiens
  heavy chain complementarity determining region 3 for antibody 5546
AKEGSSPGPHFDS

SEQ ID NO: 11093 - protein, 9 aa, Homo sapiens
  light chain complementarity determining region 3 for antibody 5547
QQFSNLPRT

SEQ ID NO: 11094 - protein, 13 aa, Homo sapiens
  heavy chain complementarity determining region 3 for antibody 5547
AKEGSSPGPDFEY

SEQ ID NO: 11095 - protein, 9 aa, Homo sapiens
  light chain complementarity determining region 3 for antibody 5548
QQFSNLPRT

SEQ ID NO: 11096 - protein, 13 aa, Homo sapiens
  heavy chain complementarity determining region 3 for antibody 5548
AKEGSSPGPDFDY

SEQ ID NO: 11097 - protein, 9 aa, Homo sapiens
  light chain complementarity determining region 3 for antibody 5549
QQFSNLPRT

SEQ ID NO: 11098 - protein, 13 aa, Homo sapiens
  heavy chain complementarity determining region 3 for antibody 5549
AKEGSSPGPDCDS

SEQ ID NO: 11099 - protein, 9 aa, Homo sapiens
  light chain complementarity determining region 3 for antibody 5550
QQFSNLPRT

SEQ ID NO: 11100 - protein, 13 aa, Homo sapiens
  heavy chain complementarity determining region 3 for antibody 5550
AKEGSSPDPDFDS

SEQ ID NO: 11101 - protein, 9 aa, Homo sapiens
  light chain complementarity determining region 3 for antibody 5551
QQFSNLPRT

SEQ ID NO: 11102 - protein, 13 aa, Homo sapiens
  heavy chain complementarity determining region 3 for antibody 5551
AKEGSSPCPDFDS

SEQ ID NO: 11103 - protein, 9 aa, Homo sapiens
  light chain complementarity determining region 3 for antibody 5552
QQFSNLPRT

SEQ ID NO: 11104 - protein, 13 aa, Homo sapiens
  heavy chain complementarity determining region 3 for antibody 5552
AKEGSLPGPDFDS

SEQ ID NO: 11105 - protein, 9 aa, Homo sapiens
  light chain complementarity determining region 3 for antibody 5553
QQFSNLPRT

SEQ ID NO: 11106 - protein, 13 aa, Homo sapiens
  heavy chain complementarity determining region 3 for antibody 5553
AKEGPSPGPDFDS

SEQ ID NO: 11107 - protein, 9 aa, Homo sapiens
  light chain complementarity determining region 3 for antibody 5554
QQFSNLPRA

SEQ ID NO: 11108 - protein, 13 aa, Homo sapiens
  heavy chain complementarity determining region 3 for antibody 5554
AKEGSSPGPDFDS

SEQ ID NO: 11109 - protein, 9 aa, Homo sapiens
  light chain complementarity determining region 3 for antibody 5555
QQFSNFPRT

SEQ ID NO: 11110 - protein, 11 aa, Homo sapiens
  heavy chain complementarity determining region 3 for antibody 5555
VRVSTGWNFDY

SEQ ID NO: 11111 - protein, 9 aa, Homo sapiens
  light chain complementarity determining region 3 for antibody 5556
QQFSGFPRT

SEQ ID NO: 11112 - protein, 9 aa, Homo sapiens
  heavy chain complementarity determining region 3 for antibody 5556
ARGRNNFRY

SEQ ID NO: 11113 - protein, 9 aa, Homo sapiens
  light chain complementarity determining region 3 for antibody 5557
QQFSDFPRT

SEQ ID NO: 11114 - protein, 13 aa, Homo sapiens
  heavy chain complementarity determining region 3 for antibody 5557
AKEGSSPGPDFDS

SEQ ID NO: 11115 - protein, 9 aa, Homo sapiens
  light chain complementarity determining region 3 for antibody 5558
QQFSAFPRT

SEQ ID NO: 11116 - protein, 9 aa, Homo sapiens
  heavy chain complementarity determining region 3 for antibody 5558
VRGRNNFRY

SEQ ID NO: 11117 - protein, 9 aa, Homo sapiens
  light chain complementarity determining region 3 for antibody 5559
QQFRDLPRT

SEQ ID NO: 11118 - protein, 9 aa, Homo sapiens
  heavy chain complementarity determining region 3 for antibody 5559
ARGRSNFSY

SEQ ID NO: 11119 - protein, 9 aa, Homo sapiens
  light chain complementarity determining region 3 for antibody 5560
QQFRDLPRP

SEQ ID NO: 11120 - protein, 9 aa, Homo sapiens
  heavy chain complementarity determining region 3 for antibody 5560
VRGRSNFRH

SEQ ID NO: 11121 - protein, 9 aa, Homo sapiens
  light chain complementarity determining region 3 for antibody 5561
QQFNTYPLT

SEQ ID NO: 11122 - protein, 13 aa, Homo sapiens
  heavy chain complementarity determining region 3 for antibody 5561
AKEGSAPGPDFEY

SEQ ID NO: 11123 - protein, 9 aa, Homo sapiens
  light chain complementarity determining region 3 for antibody 5562
QQFNTYPLP

SEQ ID NO: 11124 - protein, 20 aa, Homo sapiens
  heavy chain complementarity determining region 3 for antibody 5562
ARNLQYCSGGSCYGPFYFDY

SEQ ID NO: 11125 - protein, 7 aa, Homo sapiens
  light chain complementarity determining region 3 for antibody 5563
QQFNTWT

SEQ ID NO: 11126 - protein, 12 aa, Homo sapiens
  heavy chain complementarity determining region 3 for antibody 5563
ARDKGGRNGMDV

SEQ ID NO: 11127 - protein, 9 aa, Homo sapiens
  light chain complementarity determining region 3 for antibody 5564
QQFNTFPLT

SEQ ID NO: 11128 - protein, 20 aa, Homo sapiens
  heavy chain complementarity determining region 3 for antibody 5564
ARNLQYCSGGSCYGPFYFDY

SEQ ID NO: 11129 - protein, 9 aa, Homo sapiens
  light chain complementarity determining region 3 for antibody 5565
QQFNSYTYT

SEQ ID NO: 11130 - protein, 9 aa, Homo sapiens
  heavy chain complementarity determining region 3 for antibody 5565
ARCWTYGRK

SEQ ID NO: 11131 - protein, 9 aa, Homo sapiens
  light chain complementarity determining region 3 for antibody 5566
QQFNSYPYT

SEQ ID NO: 11132 - protein, 9 aa, Homo sapiens
  heavy chain complementarity determining region 3 for antibody 5566
AGWGGLSNY

SEQ ID NO: 11133 - protein, 9 aa, Homo sapiens
  light chain complementarity determining region 3 for antibody 5567
QQFNSYPWT

SEQ ID NO: 11134 - protein, 14 aa, Homo sapiens
  heavy chain complementarity determining region 3 for antibody 5567
ARDFSNYVHNGFDI

SEQ ID NO: 11135 - protein, 9 aa, Homo sapiens
  light chain complementarity determining region 3 for antibody 5568
QQFNSYPRT

SEQ ID NO: 11136 - protein, 13 aa, Homo sapiens
  heavy chain complementarity determining region 3 for antibody 5568
AADGPYGSSALDY

SEQ ID NO: 11137 - protein, 9 aa, Homo sapiens
  light chain complementarity determining region 3 for antibody 5569
QQFNSYPLT

SEQ ID NO: 11138 - protein, 15 aa, Homo sapiens
  heavy chain complementarity determining region 3 for antibody 5569
ARSREYGNSWPSFDY

SEQ ID NO: 11139 - protein, 9 aa, Homo sapiens
  light chain complementarity determining region 3 for antibody 5570
QQFNSSPRT

SEQ ID NO: 11140 - protein, 13 aa, Homo sapiens
  heavy chain complementarity determining region 3 for antibody 5570
AADGPYGSSAFDY

SEQ ID NO: 11141 - protein, 9 aa, Homo sapiens
  light chain complementarity determining region 3 for antibody 5571
QQFNNYPLT

SEQ ID NO: 11142 - protein, 20 aa, Homo sapiens
  heavy chain complementarity determining region 3 for antibody 5571
ARNLQYCSGGSCYGPFYFDY

SEQ ID NO: 11143 - protein, 9 aa, Homo sapiens
  light chain complementarity determining region 3 for antibody 5572
QQFITTPYT

SEQ ID NO: 11144 - protein, 11 aa, Homo sapiens
  heavy chain complementarity determining region 3 for antibody 5572
ARDFDGAGYDY

SEQ ID NO: 11145 - protein, 10 aa, Homo sapiens
  light chain complementarity determining region 3 for antibody 5573
QQFGGSPMYT

SEQ ID NO: 11146 - protein, 10 aa, Homo sapiens
  heavy chain complementarity determining region 3 for antibody 5573
ARETSGSYDI

SEQ ID NO: 11147 - protein, 10 aa, Homo sapiens
  light chain complementarity determining region 3 for antibody 5574
QQFGGSPMYT

SEQ ID NO: 11148 - protein, 13 aa, Homo sapiens
  heavy chain complementarity determining region 3 for antibody 5574
AKEGSSPGPDFEY

SEQ ID NO: 11149 - protein, 9 aa, Homo sapiens
  light chain complementarity determining region 3 for antibody 5575
QQFANLPRP

SEQ ID NO: 11150 - protein, 9 aa, Homo sapiens
  heavy chain complementarity determining region 3 for antibody 5575
VRGRSNFRY

SEQ ID NO: 11151 - protein, 9 aa, Homo sapiens
  light chain complementarity determining region 3 for antibody 5576
QQDYYTPRT

SEQ ID NO: 11152 - protein, 11 aa, Homo sapiens
  heavy chain complementarity determining region 3 for antibody 5576
ARRSLGVAFDY

SEQ ID NO: 11153 - protein, 9 aa, Homo sapiens
  light chain complementarity determining region 3 for antibody 5577
QQDYYTPRT

SEQ ID NO: 11154 - protein, 11 aa, Homo sapiens
  heavy chain complementarity determining region 3 for antibody 5577
ARRSLGGALDY

SEQ ID NO: 11155 - protein, 9 aa, Homo sapiens
  light chain complementarity determining region 3 for antibody 5578
QQDYYTPRT

SEQ ID NO: 11156 - protein, 11 aa, Homo sapiens
  heavy chain complementarity determining region 3 for antibody 5578
ARRPLGGAFDY

SEQ ID NO: 11157 - protein, 9 aa, Homo sapiens
  light chain complementarity determining region 3 for antibody 5579
QQDYYTPRT

SEQ ID NO: 11158 - protein, 17 aa, Homo sapiens
  heavy chain complementarity determining region 3 for antibody 5579
ARNTMVGTWQRQGNLDH

SEQ ID NO: 11159 - protein, 9 aa, Homo sapiens
  light chain complementarity determining region 3 for antibody 5580
QQDYYTPRT

SEQ ID NO: 11160 - protein, 14 aa, Homo sapiens
  heavy chain complementarity determining region 3 for antibody 5580
ARGHFDSTGFRLDY

SEQ ID NO: 11161 - protein, 9 aa, Homo sapiens
  light chain complementarity determining region 3 for antibody 5581
QQDYYTPRT

SEQ ID NO: 11162 - protein, 13 aa, Homo sapiens
  heavy chain complementarity determining region 3 for antibody 5581
AKEGSSPGPDFEY

SEQ ID NO: 11163 - protein, 9 aa, Homo sapiens
  light chain complementarity determining region 3 for antibody 5582
QQDYYTPRT

SEQ ID NO: 11164 - protein, 13 aa, Homo sapiens
  heavy chain complementarity determining region 3 for antibody 5582
AKEGSSPGPDFDY

SEQ ID NO: 11165 - protein, 9 aa, Homo sapiens
  light chain complementarity determining region 3 for antibody 5583
QQDYYTPRM

SEQ ID NO: 11166 - protein, 11 aa, Homo sapiens
  heavy chain complementarity determining region 3 for antibody 5583
ARRSLGGAFDY

SEQ ID NO: 11167 - protein, 9 aa, Homo sapiens
  light chain complementarity determining region 3 for antibody 5584
QQDYYIPRT

SEQ ID NO: 11168 - protein, 11 aa, Homo sapiens
  heavy chain complementarity determining region 3 for antibody 5584
ARRSLGGAFDY

SEQ ID NO: 11169 - protein, 9 aa, Homo sapiens
  light chain complementarity determining region 3 for antibody 5585
QQDYKWPKT

SEQ ID NO: 11170 - protein, 7 aa, Homo sapiens
  heavy chain complementarity determining region 3 for antibody 5585
VYQLLNN

SEQ ID NO: 11171 - protein, 9 aa, Homo sapiens
  light chain complementarity determining region 3 for antibody 5586
QQDYDFPWT

SEQ ID NO: 11172 - protein, 13 aa, Homo sapiens
  heavy chain complementarity determining region 3 for antibody 5586
AKDVRAYLSLIDL

SEQ ID NO: 11173 - protein, 9 aa, Homo sapiens
  light chain complementarity determining region 3 for antibody 5587
QQDYCTPRT

SEQ ID NO: 11174 - protein, 11 aa, Homo sapiens
  heavy chain complementarity determining region 3 for antibody 5587
ARRSLGGAFDY

SEQ ID NO: 11175 - protein, 9 aa, Homo sapiens
  light chain complementarity determining region 3 for antibody 5588
QQDNSYSRT

SEQ ID NO: 11176 - protein, 16 aa, Homo sapiens
  heavy chain complementarity determining region 3 for antibody 5588
VGPHLTYNSGWRYFDY

SEQ ID NO: 11177 - protein, 9 aa, Homo sapiens
  light chain complementarity determining region 3 for antibody 5589
QQDNSYSHT

SEQ ID NO: 11178 - protein, 14 aa, Homo sapiens
  heavy chain complementarity determining region 3 for antibody 5589
GRDVHTTGWTLGGY

SEQ ID NO: 11179 - protein, 8 aa, Homo sapiens
  light chain complementarity determining region 3 for antibody 5590
QQDGTSFT

SEQ ID NO: 11180 - protein, 16 aa, Homo sapiens
  heavy chain complementarity determining region 3 for antibody 5590
SRWAGVASGWSGPFDN

SEQ ID NO: 11181 - protein, 7 aa, Homo sapiens
  light chain complementarity determining region 3 for antibody 5591
QQDGSYT

SEQ ID NO: 11182 - protein, 10 aa, Homo sapiens
  heavy chain complementarity determining region 3 for antibody 5591
ARRWERYFDY

SEQ ID NO: 11183 - protein, 9 aa, Homo sapiens
  light chain complementarity determining region 3 for antibody 5592
QQDGSSPWT

SEQ ID NO: 11184 - protein, 10 aa, Homo sapiens
  heavy chain complementarity determining region 3 for antibody 5592
ARERSGSYDI

SEQ ID NO: 11185 - protein, 10 aa, Homo sapiens
  light chain complementarity determining region 3 for antibody 5593
QQDGSSPPYT

SEQ ID NO: 11186 - protein, 13 aa, Homo sapiens
  heavy chain complementarity determining region 3 for antibody 5593
AKEGSSPGPDFEY

SEQ ID NO: 11187 - protein, 11 aa, Homo sapiens
  light chain complementarity determining region 3 for antibody 5594
QQDGSSPPMYT

SEQ ID NO: 11188 - protein, 13 aa, Homo sapiens
  heavy chain complementarity determining region 3 for antibody 5594
AKEGSAPGPDFEY

SEQ ID NO: 11189 - protein, 10 aa, Homo sapiens
  light chain complementarity determining region 3 for antibody 5595
QQDGRSPLYT

SEQ ID NO: 11190 - protein, 13 aa, Homo sapiens
  heavy chain complementarity determining region 3 for antibody 5595
TTYMAARPEYFRH

SEQ ID NO: 11191 - protein, 9 aa, Homo sapiens
  light chain complementarity determining region 3 for antibody 5596
QQDDNSLRT

SEQ ID NO: 11192 - protein, 14 aa, Homo sapiens
  heavy chain complementarity determining region 3 for antibody 5596
AREGVLIRQPYRDY

SEQ ID NO: 11193 - protein, 9 aa, Homo sapiens
  light chain complementarity determining region 3 for antibody 5597
QQCSSVPLT

SEQ ID NO: 11194 - protein, 11 aa, Homo sapiens
  heavy chain complementarity determining region 3 for antibody 5597
ARDRGDTIFDF

SEQ ID NO: 11195 - protein, 9 aa, Homo sapiens
  light chain complementarity determining region 3 for antibody 5598
QQCNSYSRT

SEQ ID NO: 11196 - protein, 16 aa, Homo sapiens
  heavy chain complementarity determining region 3 for antibody 5598
VGPHLTYNSGWRYFDY

SEQ ID NO: 11197 - protein, 9 aa, Homo sapiens
  light chain complementarity determining region 3 for antibody 5599
QQCGNSPLA

SEQ ID NO: 11198 - protein, 18 aa, Homo sapiens
  heavy chain complementarity determining region 3 for antibody 5599
AGGDYPEARNGYYLDFDY

SEQ ID NO: 11199 - protein, 8 aa, Homo sapiens
  light chain complementarity determining region 3 for antibody 5600
QQCDGIPT

SEQ ID NO: 11200 - protein, 10 aa, Homo sapiens
  heavy chain complementarity determining region 3 for antibody 5600
ARDISRHMDV

SEQ ID NO: 11201 - protein, 9 aa, Homo sapiens
  light chain complementarity determining region 3 for antibody 5601
QQCAHSPLT

SEQ ID NO: 11202 - protein, 13 aa, Homo sapiens
  heavy chain complementarity determining region 3 for antibody 5601
VGGLDSGTWYGGY

SEQ ID NO: 11203 - protein, 9 aa, Homo sapiens
  light chain complementarity determining region 3 for antibody 5602
QQAQTYPLT

SEQ ID NO: 11204 - protein, 14 aa, Homo sapiens
  heavy chain complementarity determining region 3 for antibody 5602
ARDPCGDPSSDFDY

SEQ ID NO: 11205 - protein, 9 aa, Homo sapiens
  light chain complementarity determining region 3 for antibody 5603
QQANSLPLT

SEQ ID NO: 11206 - protein, 17 aa, Homo sapiens
  heavy chain complementarity determining region 3 for antibody 5603
ARGTGSGSGSYYADFDY

SEQ ID NO: 11207 - protein, 9 aa, Homo sapiens
  light chain complementarity determining region 3 for antibody 5604
QQANSLPLP

SEQ ID NO: 11208 - protein, 17 aa, Homo sapiens
  heavy chain complementarity determining region 3 for antibody 5604
ARGTGIGSGSYYADFDY

SEQ ID NO: 11209 - protein, 9 aa, Homo sapiens
  light chain complementarity determining region 3 for antibody 5605
QQANSHPKT

SEQ ID NO: 11210 - protein, 12 aa, Homo sapiens
  heavy chain complementarity determining region 3 for antibody 5605
TTGHRSGSYYDN

SEQ ID NO: 11211 - protein, 9 aa, Homo sapiens
  light chain complementarity determining region 3 for antibody 5606
QQANSFPLT

SEQ ID NO: 11212 - protein, 14 aa, Homo sapiens
  heavy chain complementarity determining region 3 for antibody 5606
ARDVWGSRYYGMDV

SEQ ID NO: 11213 - protein, 9 aa, Homo sapiens
  light chain complementarity determining region 3 for antibody 5607
QQANSFPLR

SEQ ID NO: 11214 - protein, 15 aa, Homo sapiens
  heavy chain complementarity determining region 3 for antibody 5607
ASFGLGVGDSNWFGT

SEQ ID NO: 11215 - protein, 9 aa, Homo sapiens
  light chain complementarity determining region 3 for antibody 5608
QQANNLPLT

SEQ ID NO: 11216 - protein, 17 aa, Homo sapiens
  heavy chain complementarity determining region 3 for antibody 5608
ARGTGIGSGSYYADFDY

SEQ ID NO: 11217 - protein, 9 aa, Homo sapiens
  light chain complementarity determining region 3 for antibody 5609
QPYYSSPFT

SEQ ID NO: 11218 - protein, 14 aa, Homo sapiens
  heavy chain complementarity determining region 3 for antibody 5609
AASYSSGWLEYFQY

SEQ ID NO: 11219 - protein, 8 aa, Homo sapiens
  light chain complementarity determining region 3 for antibody 5610
QPYYATPT

SEQ ID NO: 11220 - protein, 16 aa, Homo sapiens
  heavy chain complementarity determining region 3 for antibody 5610
VRAADTSSWSFLISDY

SEQ ID NO: 11221 - protein, 9 aa, Homo sapiens
  light chain complementarity determining region 3 for antibody 5611
QPYNSYSRT

SEQ ID NO: 11222 - protein, 16 aa, Homo sapiens
  heavy chain complementarity determining region 3 for antibody 5611
VGPHLTYNSGWRYFDY

SEQ ID NO: 11223 - protein, 9 aa, Homo sapiens
  light chain complementarity determining region 3 for antibody 5612
QPYNSYPPT

SEQ ID NO: 11224 - protein, 13 aa, Homo sapiens
  heavy chain complementarity determining region 3 for antibody 5612
AKEGSSPGPDFEY

SEQ ID NO: 11225 - protein, 9 aa, Homo sapiens
  light chain complementarity determining region 3 for antibody 5613
QPYNNWPFT

SEQ ID NO: 11226 - protein, 10 aa, Homo sapiens
  heavy chain complementarity determining region 3 for antibody 5613
VRSDSPGDDS

SEQ ID NO: 11227 - protein, 8 aa, Homo sapiens
  light chain complementarity determining region 3 for antibody 5614
QPYGYSHT

SEQ ID NO: 11228 - protein, 15 aa, Homo sapiens
  heavy chain complementarity determining region 3 for antibody 5614
ARGLLATGGWYYFDY

SEQ ID NO: 11229 - protein, 10 aa, Homo sapiens
  light chain complementarity determining region 3 for antibody 5615
QPYGSSPPLT

SEQ ID NO: 11230 - protein, 20 aa, Homo sapiens
  heavy chain complementarity determining region 3 for antibody 5615
GRDSSRSYSNSWAYYYGTDV

SEQ ID NO: 11231 - protein, 10 aa, Homo sapiens
  light chain complementarity determining region 3 for antibody 5616
QPYDNLASLT

SEQ ID NO: 11232 - protein, 13 aa, Homo sapiens
  heavy chain complementarity determining region 3 for antibody 5616
AKEGSSPGPDFEY

SEQ ID NO: 11233 - protein, 10 aa, Homo sapiens
  light chain complementarity determining region 3 for antibody 5617
QPYDISPPWT

SEQ ID NO: 11234 - protein, 16 aa, Homo sapiens
  heavy chain complementarity determining region 3 for antibody 5617
ASPNTLGRLVGVAFDY

SEQ ID NO: 11235 - protein, 10 aa, Homo sapiens
  light chain complementarity determining region 3 for antibody 5618
QPSYSTPLFT

SEQ ID NO: 11236 - protein, 23 aa, Homo sapiens
  heavy chain complementarity determining region 3 for antibody 5618
ARHFPMGGSTVTGTQSLLYYMDV

SEQ ID NO: 11237 - protein, 9 aa, Homo sapiens
  light chain complementarity determining region 3 for antibody 5619
QPSYSTPIT

SEQ ID NO: 11238 - protein, 17 aa, Homo sapiens
  heavy chain complementarity determining region 3 for antibody 5619
ARNTMVGTWQRQGNLDH

SEQ ID NO: 11239 - protein, 9 aa, Homo sapiens
  light chain complementarity determining region 3 for antibody 5620
QPSGSSLLT

SEQ ID NO: 11240 - protein, 12 aa, Homo sapiens
  heavy chain complementarity determining region 3 for antibody 5620
ALDEWHPSWYKY

SEQ ID NO: 11241 - protein, 9 aa, Homo sapiens
  light chain complementarity determining region 3 for antibody 5621
QPFSSFPRT

SEQ ID NO: 11242 - protein, 9 aa, Homo sapiens
  heavy chain complementarity determining region 3 for antibody 5621
ARGRNNFRY

SEQ ID NO: 11243 - protein, 9 aa, Homo sapiens
  light chain complementarity determining region 3 for antibody 5622
QNYNSVPLT

SEQ ID NO: 11244 - protein, 10 aa, Homo sapiens
  heavy chain complementarity determining region 3 for antibody 5622
CREREGFGDV

SEQ ID NO: 11245 - protein, 9 aa, Homo sapiens
  light chain complementarity determining region 3 for antibody 5623
QMSGSSLLT

SEQ ID NO: 11246 - protein, 12 aa, Homo sapiens
  heavy chain complementarity determining region 3 for antibody 5623
ALDEWHPSWYKY

SEQ ID NO: 11247 - protein, 9 aa, Homo sapiens
  light chain complementarity determining region 3 for antibody 5624
QLSGSSLLT

SEQ ID NO: 11248 - protein, 18 aa, Homo sapiens
  heavy chain complementarity determining region 3 for antibody 5624
ARGDYPEARTGYFLDFDY

SEQ ID NO: 11249 - protein, 9 aa, Homo sapiens
  light chain complementarity determining region 3 for antibody 5625
QLSGSSLLT

SEQ ID NO: 11250 - protein, 12 aa, Homo sapiens
  heavy chain complementarity determining region 3 for antibody 5625
ALDEWHPSWYKH

SEQ ID NO: 11251 - protein, 9 aa, Homo sapiens
  light chain complementarity determining region 3 for antibody 5626
QLSGSSLLT

SEQ ID NO: 11252 - protein, 12 aa, Homo sapiens
  heavy chain complementarity determining region 3 for antibody 5626
ALDEWHPSRYKY

SEQ ID NO: 11253 - protein, 9 aa, Homo sapiens
  light chain complementarity determining region 3 for antibody 5627
QLSGSSLLT

SEQ ID NO: 11254 - protein, 12 aa, Homo sapiens
  heavy chain complementarity determining region 3 for antibody 5627
ALDEWHPIWYKY

SEQ ID NO: 11255 - protein, 9 aa, Homo sapiens
  light chain complementarity determining region 3 for antibody 5628
QLSGSSLLT

SEQ ID NO: 11256 - protein, 13 aa, Homo sapiens
  heavy chain complementarity determining region 3 for antibody 5628
AKEGSSPGPDFDS

SEQ ID NO: 11257 - protein, 9 aa, Homo sapiens
  light chain complementarity determining region 3 for antibody 5629
QLSGSSLLT

SEQ ID NO: 11258 - protein, 12 aa, Homo sapiens
  heavy chain complementarity determining region 3 for antibody 5629
AIDEWHPSWYKY

SEQ ID NO: 11259 - protein, 9 aa, Homo sapiens
  light chain complementarity determining region 3 for antibody 5630
QLSGSSLLN

SEQ ID NO: 11260 - protein, 12 aa, Homo sapiens
  heavy chain complementarity determining region 3 for antibody 5630
ALDEWHPSWYKY

SEQ ID NO: 11261 - protein, 9 aa, Homo sapiens
  light chain complementarity determining region 3 for antibody 5631
QLSGSSLIT

SEQ ID NO: 11262 - protein, 12 aa, Homo sapiens
  heavy chain complementarity determining region 3 for antibody 5631
ALDEWHPSWYKY

SEQ ID NO: 11263 - protein, 9 aa, Homo sapiens
  light chain complementarity determining region 3 for antibody 5632
QLAGSSLLT

SEQ ID NO: 11264 - protein, 12 aa, Homo sapiens
  heavy chain complementarity determining region 3 for antibody 5632
ALDEWHPSWYKY

SEQ ID NO: 11265 - protein, 9 aa, Homo sapiens
  light chain complementarity determining region 3 for antibody 5633
QKYYTVPLT

SEQ ID NO: 11266 - protein, 10 aa, Homo sapiens
  heavy chain complementarity determining region 3 for antibody 5633
VGGGGWLTDF

SEQ ID NO: 11267 - protein, 9 aa, Homo sapiens
  light chain complementarity determining region 3 for antibody 5634
QKYYTAPLT

SEQ ID NO: 11268 - protein, 10 aa, Homo sapiens
  heavy chain complementarity determining region 3 for antibody 5634
VGGEGWLTDF

SEQ ID NO: 11269 - protein, 9 aa, Homo sapiens
  light chain complementarity determining region 3 for antibody 5635
QKYYNAPWT

SEQ ID NO: 11270 - protein, 16 aa, Homo sapiens
  heavy chain complementarity determining region 3 for antibody 5635
SRDRWGGDVTRRGLDY

SEQ ID NO: 11271 - protein, 9 aa, Homo sapiens
  light chain complementarity determining region 3 for antibody 5636
QKYNSVPWT

SEQ ID NO: 11272 - protein, 17 aa, Homo sapiens
  heavy chain complementarity determining region 3 for antibody 5636
TRDRADSTWTAANRRDS

SEQ ID NO: 11273 - protein, 9 aa, Homo sapiens
  light chain complementarity determining region 3 for antibody 5637
QKYNSVPWT

SEQ ID NO: 11274 - protein, 17 aa, Homo sapiens
  heavy chain complementarity determining region 3 for antibody 5637
TRDRADSAWTSANRRDS

SEQ ID NO: 11275 - protein, 9 aa, Homo sapiens
  light chain complementarity determining region 3 for antibody 5638
QKYNSFPWT

SEQ ID NO: 11276 - protein, 17 aa, Homo sapiens
  heavy chain complementarity determining region 3 for antibody 5638
TRDRADSTWTSANRRDS

SEQ ID NO: 11277 - protein, 11 aa, Homo sapiens
  light chain complementarity determining region 3 for antibody 5639
QKYNSAPPGFT

SEQ ID NO: 11278 - protein, 15 aa, Homo sapiens
  heavy chain complementarity determining region 3 for antibody 5639
SRDASADSFPDAFDV

SEQ ID NO: 11279 - protein, 9 aa, Homo sapiens
  light chain complementarity determining region 3 for antibody 5640
QKYNNVPWT

SEQ ID NO: 11280 - protein, 10 aa, Homo sapiens
  heavy chain complementarity determining region 3 for antibody 5640
ARERAGSYDI

SEQ ID NO: 11281 - protein, 9 aa, Homo sapiens
  light chain complementarity determining region 3 for antibody 5641
QKYKSSPFT

SEQ ID NO: 11282 - protein, 13 aa, Homo sapiens
  heavy chain complementarity determining region 3 for antibody 5641
AKEGSSPGPDFEY

SEQ ID NO: 11283 - protein, 9 aa, Homo sapiens
  light chain complementarity determining region 3 for antibody 5642
QKYKSAPFT

SEQ ID NO: 11284 - protein, 13 aa, Homo sapiens
  heavy chain complementarity determining region 3 for antibody 5642
TREGDSSGPDFHL

SEQ ID NO: 11285 - protein, 9 aa, Homo sapiens
  light chain complementarity determining region 3 for antibody 5643
QKYKSAPFT

SEQ ID NO: 11286 - protein, 9 aa, Homo sapiens
  heavy chain complementarity determining region 3 for antibody 5643
GSRRPYFDS

SEQ ID NO: 11287 - protein, 9 aa, Homo sapiens
  light chain complementarity determining region 3 for antibody 5644
QKYKSAPFT

SEQ ID NO: 11288 - protein, 9 aa, Homo sapiens
  heavy chain complementarity determining region 3 for antibody 5644
ARSEYQPTY

SEQ ID NO: 11289 - protein, 9 aa, Homo sapiens
  light chain complementarity determining region 3 for antibody 5645
QKYKSAPFT

SEQ ID NO: 11290 - protein, 13 aa, Homo sapiens
  heavy chain complementarity determining region 3 for antibody 5645
AREGSSPGPDFEY

SEQ ID NO: 11291 - protein, 9 aa, Homo sapiens
  light chain complementarity determining region 3 for antibody 5646
QKYKSAPFT

SEQ ID NO: 11292 - protein, 13 aa, Homo sapiens
  heavy chain complementarity determining region 3 for antibody 5646
AKKGSSPGPDFEY

SEQ ID NO: 11293 - protein, 9 aa, Homo sapiens
  light chain complementarity determining region 3 for antibody 5647
QKYKSAPFT

SEQ ID NO: 11294 - protein, 13 aa, Homo sapiens
  heavy chain complementarity determining region 3 for antibody 5647
AKEGSSPGPGFEY

SEQ ID NO: 11295 - protein, 9 aa, Homo sapiens
  light chain complementarity determining region 3 for antibody 5648
QKYKSAPFT

SEQ ID NO: 11296 - protein, 13 aa, Homo sapiens
  heavy chain complementarity determining region 3 for antibody 5648
AKEGSSPCPDFEY

SEQ ID NO: 11297 - protein, 9 aa, Homo sapiens
  light chain complementarity determining region 3 for antibody 5649
QKYKSAPFT

SEQ ID NO: 11298 - protein, 13 aa, Homo sapiens
  heavy chain complementarity determining region 3 for antibody 5649
AKEGSLPGPDFEY

SEQ ID NO: 11299 - protein, 9 aa, Homo sapiens
  light chain complementarity determining region 3 for antibody 5650
QKYKSAPFT

SEQ ID NO: 11300 - protein, 13 aa, Homo sapiens
  heavy chain complementarity determining region 3 for antibody 5650
AKEGPSPGPDFEY

SEQ ID NO: 11301 - protein, 9 aa, Homo sapiens
  light chain complementarity determining region 3 for antibody 5651
QKYKHVPWT

SEQ ID NO: 11302 - protein, 10 aa, Homo sapiens
  heavy chain complementarity determining region 3 for antibody 5651
ARERSGPYDI

SEQ ID NO: 11303 - protein, 9 aa, Homo sapiens
  light chain complementarity determining region 3 for antibody 5652
QKYKHVPWT

SEQ ID NO: 11304 - protein, 10 aa, Homo sapiens
  heavy chain complementarity determining region 3 for antibody 5652
AMERSGSYDI

SEQ ID NO: 11305 - protein, 9 aa, Homo sapiens
  light chain complementarity determining region 3 for antibody 5653
QKYKHVPWT

SEQ ID NO: 11306 - protein, 10 aa, Homo sapiens
  heavy chain complementarity determining region 3 for antibody 5653
AGERSGSYDI

SEQ ID NO: 11307 - protein, 9 aa, Homo sapiens
  light chain complementarity determining region 3 for antibody 5654
QKYKHVPWP

SEQ ID NO: 11308 - protein, 10 aa, Homo sapiens
  heavy chain complementarity determining region 3 for antibody 5654
ARERSGSYDI

SEQ ID NO: 11309 - protein, 9 aa, Homo sapiens
  light chain complementarity determining region 3 for antibody 5655
QKYKHVPRT

SEQ ID NO: 11310 - protein, 10 aa, Homo sapiens
  heavy chain complementarity determining region 3 for antibody 5655
ARERSGSYDI

SEQ ID NO: 11311 - protein, 9 aa, Homo sapiens
  light chain complementarity determining region 3 for antibody 5656
QKYKGAPFT

SEQ ID NO: 11312 - protein, 13 aa, Homo sapiens
  heavy chain complementarity determining region 3 for antibody 5656
AKEGSSPGPDFEY

SEQ ID NO: 11313 - protein, 9 aa, Homo sapiens
  light chain complementarity determining region 3 for antibody 5657
QKYGSSPVP

SEQ ID NO: 11314 - protein, 18 aa, Homo sapiens
  heavy chain complementarity determining region 3 for antibody 5657
ARVDYPEARTGYFLDFDY

SEQ ID NO: 11315 - protein, 9 aa, Homo sapiens
  light chain complementarity determining region 3 for antibody 5658
QKYGSSPVP

SEQ ID NO: 11316 - protein, 18 aa, Homo sapiens
  heavy chain complementarity determining region 3 for antibody 5658
ARGDYPEDRTGYFLDFDY

SEQ ID NO: 11317 - protein, 9 aa, Homo sapiens
  light chain complementarity determining region 3 for antibody 5659
QKYGSSPVP

SEQ ID NO: 11318 - protein, 18 aa, Homo sapiens
  heavy chain complementarity determining region 3 for antibody 5659
ARGDYPEARTGYFLDCDY

SEQ ID NO: 11319 - protein, 9 aa, Homo sapiens
  light chain complementarity determining region 3 for antibody 5660
QKYGSSPVP

SEQ ID NO: 11320 - protein, 18 aa, Homo sapiens
  heavy chain complementarity determining region 3 for antibody 5660
ARGDYPEARTGYFLAFDY

SEQ ID NO: 11321 - protein, 9 aa, Homo sapiens
  light chain complementarity determining region 3 for antibody 5661
QKYGSSPVP

SEQ ID NO: 11322 - protein, 18 aa, Homo sapiens
  heavy chain complementarity determining region 3 for antibody 5661
ARGDYPEARTGYFIDFDY

SEQ ID NO: 11323 - protein, 9 aa, Homo sapiens
  light chain complementarity determining region 3 for antibody 5662
QKYGSSPVP

SEQ ID NO: 11324 - protein, 18 aa, Homo sapiens
  heavy chain complementarity determining region 3 for antibody 5662
ARGDYPEARTGDFLDFDY

SEQ ID NO: 11325 - protein, 9 aa, Homo sapiens
  light chain complementarity determining region 3 for antibody 5663
QKYGSSPVP

SEQ ID NO: 11326 - protein, 12 aa, Homo sapiens
  heavy chain complementarity determining region 3 for antibody 5663
ARDKGGRNGMDV

SEQ ID NO: 11327 - protein, 9 aa, Homo sapiens
  light chain complementarity determining region 3 for antibody 5664
QKYGSSPVP

SEQ ID NO: 11328 - protein, 18 aa, Homo sapiens
  heavy chain complementarity determining region 3 for antibody 5664
AGGDYPEARTGYFLDFDY

SEQ ID NO: 11329 - protein, 9 aa, Homo sapiens
  light chain complementarity determining region 3 for antibody 5665
QKYGSSPGP

SEQ ID NO: 11330 - protein, 11 aa, Homo sapiens
  heavy chain complementarity determining region 3 for antibody 5665
TRGGYSVGYDY

SEQ ID NO: 11331 - protein, 9 aa, Homo sapiens
  light chain complementarity determining region 3 for antibody 5666
QKYGSLPVP

SEQ ID NO: 11332 - protein, 18 aa, Homo sapiens
  heavy chain complementarity determining region 3 for antibody 5666
ARGDYPEARTGYFLDFDY

SEQ ID NO: 11333 - protein, 8 aa, Homo sapiens
  light chain complementarity determining region 3 for antibody 5667
QKYGNSFP

SEQ ID NO: 11334 - protein, 16 aa, Homo sapiens
  heavy chain complementarity determining region 3 for antibody 5667
AIWAAVSSGWSGPFDF

SEQ ID NO: 11335 - protein, 9 aa, Homo sapiens
  light chain complementarity determining region 3 for antibody 5668
QKYGGSPVP

SEQ ID NO: 11336 - protein, 18 aa, Homo sapiens
  heavy chain complementarity determining region 3 for antibody 5668
ARGDYPEARTGYFLDFDY

SEQ ID NO: 11337 - protein, 9 aa, Homo sapiens
  light chain complementarity determining region 3 for antibody 5669
QKYGDSPVP

SEQ ID NO: 11338 - protein, 18 aa, Homo sapiens
  heavy chain complementarity determining region 3 for antibody 5669
ARGDYPEGRTGYFLDFGY

SEQ ID NO: 11339 - protein, 10 aa, Homo sapiens
  light chain complementarity determining region 3 for antibody 5670
QKYDISPPWT

SEQ ID NO: 11340 - protein, 16 aa, Homo sapiens
  heavy chain complementarity determining region 3 for antibody 5670
ASPNTLGRLVGVAFDY

SEQ ID NO: 11341 - protein, 9 aa, Homo sapiens
  light chain complementarity determining region 3 for antibody 5671
QKTYRTPYT

SEQ ID NO: 11342 - protein, 14 aa, Homo sapiens
  heavy chain complementarity determining region 3 for antibody 5671
ARLHGSGLGRWLDP

SEQ ID NO: 11343 - protein, 9 aa, Homo sapiens
  light chain complementarity determining region 3 for antibody 5672
QKSYSTPRT

SEQ ID NO: 11344 - protein, 16 aa, Homo sapiens
  heavy chain complementarity determining region 3 for antibody 5672
ARSYDRSNTKVWYFDL

SEQ ID NO: 11345 - protein, 10 aa, Homo sapiens
  light chain complementarity determining region 3 for antibody 5673
QKSYSTPLFT

SEQ ID NO: 11346 - protein, 23 aa, Homo sapiens
  heavy chain complementarity determining region 3 for antibody 5673
ARHFPMGGSTVTGTQSLLYYMDV

SEQ ID NO: 11347 - protein, 10 aa, Homo sapiens
  light chain complementarity determining region 3 for antibody 5674
QKSYGAPPYT

SEQ ID NO: 11348 - protein, 13 aa, Homo sapiens
  heavy chain complementarity determining region 3 for antibody 5674
ARVAGDAYNEFDF

SEQ ID NO: 11349 - protein, 9 aa, Homo sapiens
  light chain complementarity determining region 3 for antibody 5675
QKDYYTPRT

SEQ ID NO: 11350 - protein, 11 aa, Homo sapiens
  heavy chain complementarity determining region 3 for antibody 5675
ARRSLGGAFDY

SEQ ID NO: 11351 - protein, 9 aa, Homo sapiens
  light chain complementarity determining region 3 for antibody 5676
QKDKHVPWT

SEQ ID NO: 11352 - protein, 10 aa, Homo sapiens
  heavy chain complementarity determining region 3 for antibody 5676
ARERSGSYDI

SEQ ID NO: 11353 - protein, 9 aa, Homo sapiens
  light chain complementarity determining region 3 for antibody 5677
QKDGDSPVP

SEQ ID NO: 11354 - protein, 18 aa, Homo sapiens
  heavy chain complementarity determining region 3 for antibody 5677
ARGDYPEARTAYFLDFDY

SEQ ID NO: 11355 - protein, 9 aa, Homo sapiens
  light chain complementarity determining region 3 for antibody 5678
QHYYTPPYT

SEQ ID NO: 11356 - protein, 10 aa, Homo sapiens
  heavy chain complementarity determining region 3 for antibody 5678
TRSTDAYNDI

SEQ ID NO: 11357 - protein, 9 aa, Homo sapiens
  light chain complementarity determining region 3 for antibody 5679
QHYYSAPQT

SEQ ID NO: 11358 - protein, 9 aa, Homo sapiens
  heavy chain complementarity determining region 3 for antibody 5679
ARDVWPEDC

SEQ ID NO: 11359 - protein, 9 aa, Homo sapiens
  light chain complementarity determining region 3 for antibody 5680
QHYYSAPPT

SEQ ID NO: 11360 - protein, 14 aa, Homo sapiens
  heavy chain complementarity determining region 3 for antibody 5680
ARPTSGPGSFLIDS

SEQ ID NO: 11361 - protein, 9 aa, Homo sapiens
  light chain complementarity determining region 3 for antibody 5681
QHYYSAPLP

SEQ ID NO: 11362 - protein, 14 aa, Homo sapiens
  heavy chain complementarity determining region 3 for antibody 5681
ARPTSGPGSFLIDS

SEQ ID NO: 11363 - protein, 9 aa, Homo sapiens
  light chain complementarity determining region 3 for antibody 5682
QHYYRAPLT

SEQ ID NO: 11364 - protein, 14 aa, Homo sapiens
  heavy chain complementarity determining region 3 for antibody 5682
ARPTSGPGSFLIDS

SEQ ID NO: 11365 - protein, 9 aa, Homo sapiens
  light chain complementarity determining region 3 for antibody 5683
QHYYNYPLT

SEQ ID NO: 11366 - protein, 9 aa, Homo sapiens
  heavy chain complementarity determining region 3 for antibody 5683
ARSEYQPTY

SEQ ID NO: 11367 - protein, 9 aa, Homo sapiens
  light chain complementarity determining region 3 for antibody 5684
QHYYNIPFA

SEQ ID NO: 11368 - protein, 14 aa, Homo sapiens
  heavy chain complementarity determining region 3 for antibody 5684
VKGRIASCYSEADY

SEQ ID NO: 11369 - protein, 8 aa, Homo sapiens
  light chain complementarity determining region 3 for antibody 5685
QHYSGFPA

SEQ ID NO: 11370 - protein, 15 aa, Homo sapiens
  heavy chain complementarity determining region 3 for antibody 5685
GRHVFSGSYPDYCGY

SEQ ID NO: 11371 - protein, 8 aa, Homo sapiens
  light chain complementarity determining region 3 for antibody 5686
QHYSGFPA

SEQ ID NO: 11372 - protein, 15 aa, Homo sapiens
  heavy chain complementarity determining region 3 for antibody 5686
GRHVFSGSYPDCCDY

SEQ ID NO: 11373 - protein, 8 aa, Homo sapiens
  light chain complementarity determining region 3 for antibody 5687
QHYSGFPA

SEQ ID NO: 11374 - protein, 15 aa, Homo sapiens
  heavy chain complementarity determining region 3 for antibody 5687
GRHVFSGSDPDYCDY

SEQ ID NO: 11375 - protein, 8 aa, Homo sapiens
  light chain complementarity determining region 3 for antibody 5688
QHYSGFPA

SEQ ID NO: 11376 - protein, 12 aa, Homo sapiens
  heavy chain complementarity determining region 3 for antibody 5688
AIVVPGRWDLDD

SEQ ID NO: 11377 - protein, 9 aa, Homo sapiens
  light chain complementarity determining region 3 for antibody 5689
QHYNTAPFA

SEQ ID NO: 11378 - protein, 10 aa, Homo sapiens
  heavy chain complementarity determining region 3 for antibody 5689
VREGYWSLDH

SEQ ID NO: 11379 - protein, 9 aa, Homo sapiens
  light chain complementarity determining region 3 for antibody 5690
QHYNSVPLT

SEQ ID NO: 11380 - protein, 10 aa, Homo sapiens
  heavy chain complementarity determining region 3 for antibody 5690
AREGYYALDY

SEQ ID NO: 11381 - protein, 9 aa, Homo sapiens
  light chain complementarity determining region 3 for antibody 5691
QHYNNWWGT

SEQ ID NO: 11382 - protein, 10 aa, Homo sapiens
  heavy chain complementarity determining region 3 for antibody 5691
AQSSSGHFDN

SEQ ID NO: 11383 - protein, 11 aa, Homo sapiens
  light chain complementarity determining region 3 for antibody 5692
QHYNNWPPSST

SEQ ID NO: 11384 - protein, 18 aa, Homo sapiens
  heavy chain complementarity determining region 3 for antibody 5692
AIWGGRDQRTTVYPLFDY

SEQ ID NO: 11385 - protein, 9 aa, Homo sapiens
  light chain complementarity determining region 3 for antibody 5693
QHYKSYPLT

SEQ ID NO: 11386 - protein, 10 aa, Homo sapiens
  heavy chain complementarity determining region 3 for antibody 5693
ARGGLAGGVS

SEQ ID NO: 11387 - protein, 9 aa, Homo sapiens
  light chain complementarity determining region 3 for antibody 5694
QHYKSYPHT

SEQ ID NO: 11388 - protein, 8 aa, Homo sapiens
  heavy chain complementarity determining region 3 for antibody 5694
TGGRYWDV

SEQ ID NO: 11389 - protein, 8 aa, Homo sapiens
  light chain complementarity determining region 3 for antibody 5695
QHYKGFPA

SEQ ID NO: 11390 - protein, 15 aa, Homo sapiens
  heavy chain complementarity determining region 3 for antibody 5695
GRHVLSGSHPDYADY

SEQ ID NO: 11391 - protein, 8 aa, Homo sapiens
  light chain complementarity determining region 3 for antibody 5696
QHYKGFPA

SEQ ID NO: 11392 - protein, 12 aa, Homo sapiens
  heavy chain complementarity determining region 3 for antibody 5696
CVGGFGGTWFDA

SEQ ID NO: 11393 - protein, 9 aa, Homo sapiens
  light chain complementarity determining region 3 for antibody 5697
QHYKAYPHT

SEQ ID NO: 11394 - protein, 18 aa, Homo sapiens
  heavy chain complementarity determining region 3 for antibody 5697
ARAAGCINGNCYQSYFDL

SEQ ID NO: 11395 - protein, 10 aa, Homo sapiens
  light chain complementarity determining region 3 for antibody 5698
QHYGTPYPNT

SEQ ID NO: 11396 - protein, 14 aa, Homo sapiens
  heavy chain complementarity determining region 3 for antibody 5698
ATHKFDTPRGAFDI

SEQ ID NO: 11397 - protein, 10 aa, Homo sapiens
  light chain complementarity determining region 3 for antibody 5699
QHYGSSRGIT

SEQ ID NO: 11398 - protein, 17 aa, Homo sapiens
  heavy chain complementarity determining region 3 for antibody 5699
ARGTGIGSGSYYADFDY

SEQ ID NO: 11399 - protein, 10 aa, Homo sapiens
  light chain complementarity determining region 3 for antibody 5700
QHYGSSQGIT

SEQ ID NO: 11400 - protein, 17 aa, Homo sapiens
  heavy chain complementarity determining region 3 for antibody 5700
ARGTGIGSGSYYGDFDY

SEQ ID NO: 11401 - protein, 10 aa, Homo sapiens
  light chain complementarity determining region 3 for antibody 5701
QHYGSSQGIT

SEQ ID NO: 11402 - protein, 17 aa, Homo sapiens
  heavy chain complementarity determining region 3 for antibody 5701
ARGTGIGSGSYYAGFDY

SEQ ID NO: 11403 - protein, 10 aa, Homo sapiens
  light chain complementarity determining region 3 for antibody 5702
QHYGSSQGIT

SEQ ID NO: 11404 - protein, 17 aa, Homo sapiens
  heavy chain complementarity determining region 3 for antibody 5702
ARGTGIGSGSYYADLDY

SEQ ID NO: 11405 - protein, 10 aa, Homo sapiens
  light chain complementarity determining region 3 for antibody 5703
QHYGSSQGIT

SEQ ID NO: 11406 - protein, 10 aa, Homo sapiens
  heavy chain complementarity determining region 3 for antibody 5703
AKYLRRAFDV

SEQ ID NO: 11407 - protein, 10 aa, Homo sapiens
  light chain complementarity determining region 3 for antibody 5704
QHYGSSQGIT

SEQ ID NO: 11408 - protein, 12 aa, Homo sapiens
  heavy chain complementarity determining region 3 for antibody 5704
AIVVPGRWDLDD

SEQ ID NO: 11409 - protein, 9 aa, Homo sapiens
  light chain complementarity determining region 3 for antibody 5705
QHYGQSLFI

SEQ ID NO: 11410 - protein, 10 aa, Homo sapiens
  heavy chain complementarity determining region 3 for antibody 5705
TSESWGKFDY

SEQ ID NO: 11411 - protein, 10 aa, Homo sapiens
  light chain complementarity determining region 3 for antibody 5706
QHYGGSVPIT

SEQ ID NO: 11412 - protein, 14 aa, Homo sapiens
  heavy chain complementarity determining region 3 for antibody 5706
AREVIIRGTHHFDY

SEQ ID NO: 11413 - protein, 8 aa, Homo sapiens
  light chain complementarity determining region 3 for antibody 5707
QHYGGSPT

SEQ ID NO: 11414 - protein, 23 aa, Homo sapiens
  heavy chain complementarity determining region 3 for antibody 5707
ARHFPKGGSGVTGTQSRLYYMDV

SEQ ID NO: 11415 - protein, 8 aa, Homo sapiens
  light chain complementarity determining region 3 for antibody 5708
QHYGGSPT

SEQ ID NO: 11416 - protein, 23 aa, Homo sapiens
  heavy chain complementarity determining region 3 for antibody 5708
ARHFPKGGSGVTGTQSLLHYMDV

SEQ ID NO: 11417 - protein, 8 aa, Homo sapiens
  light chain complementarity determining region 3 for antibody 5709
QHYGGSPT

SEQ ID NO: 11418 - protein, 23 aa, Homo sapiens
  heavy chain complementarity determining region 3 for antibody 5709
ARHFPKGGSGVTGAQSLLYYMDV

SEQ ID NO: 11419 - protein, 8 aa, Homo sapiens
  light chain complementarity determining region 3 for antibody 5710
QHYGGSPT

SEQ ID NO: 11420 - protein, 23 aa, Homo sapiens
  heavy chain complementarity determining region 3 for antibody 5710
ARHFPEGGSGVTGTQSLLYYMDV

SEQ ID NO: 11421 - protein, 10 aa, Homo sapiens
  light chain complementarity determining region 3 for antibody 5711
QHYGGPPRVT

SEQ ID NO: 11422 - protein, 14 aa, Homo sapiens
  heavy chain complementarity determining region 3 for antibody 5711
AREIIVRGTQQFDS

SEQ ID NO: 11423 - protein, 12 aa, Homo sapiens
  light chain complementarity determining region 3 for antibody 5712
QHYGEGGSPPLT

SEQ ID NO: 11424 - protein, 17 aa, Homo sapiens
  heavy chain complementarity determining region 3 for antibody 5712
ARNTMVHGWQRQGSVDH

SEQ ID NO: 11425 - protein, 12 aa, Homo sapiens
  light chain complementarity determining region 3 for antibody 5713
QHYGEGGSPPIT

SEQ ID NO: 11426 - protein, 17 aa, Homo sapiens
  heavy chain complementarity determining region 3 for antibody 5713
ARNTMAHGWQRQGSVDH

SEQ ID NO: 11427 - protein, 8 aa, Homo sapiens
  light chain complementarity determining region 3 for antibody 5714
QHYGASPT

SEQ ID NO: 11428 - protein, 14 aa, Homo sapiens
  heavy chain complementarity determining region 3 for antibody 5714
SHPTRAARLPIFDY

SEQ ID NO: 11429 - protein, 9 aa, Homo sapiens
  light chain complementarity determining region 3 for antibody 5715
QHYDDLPLT

SEQ ID NO: 11430 - protein, 21 aa, Homo sapiens
  heavy chain complementarity determining region 3 for antibody 5715
ARVRRPVVVSAATIFFDAFDI

SEQ ID NO: 11431 - protein, 9 aa, Homo sapiens
  light chain complementarity determining region 3 for antibody 5716
QHSYNTPRT

SEQ ID NO: 11432 - protein, 17 aa, Homo sapiens
  heavy chain complementarity determining region 3 for antibody 5716
ARNTMVHGWQRQGSVNH

SEQ ID NO: 11433 - protein, 8 aa, Homo sapiens
  light chain complementarity determining region 3 for antibody 5717
QHHKGFPA

SEQ ID NO: 11434 - protein, 15 aa, Homo sapiens
  heavy chain complementarity determining region 3 for antibody 5717
GRHVFSGSYPDYVDF

SEQ ID NO: 11435 - protein, 9 aa, Homo sapiens
  light chain complementarity determining region 3 for antibody 5718
QHFYNYLGT

SEQ ID NO: 11436 - protein, 25 aa, Homo sapiens
  heavy chain complementarity determining region 3 for antibody 5718
AREICHTAACYEILWFGQTPYYFDS

SEQ ID NO: 11437 - protein, 9 aa, Homo sapiens
  light chain complementarity determining region 3 for antibody 5719
QHFNNYFVT

SEQ ID NO: 11438 - protein, 25 aa, Homo sapiens
  heavy chain complementarity determining region 3 for antibody 5719
AREICHTAACYEILWFGQTPYYFDS

SEQ ID NO: 11439 - protein, 12 aa, Homo sapiens
  light chain complementarity determining region 3 for antibody 5720
QHFDSTPPGGYP

SEQ ID NO: 11440 - protein, 21 aa, Homo sapiens
  heavy chain complementarity determining region 3 for antibody 5720
ARVRRRGVGYGSYERYYAMDV

SEQ ID NO: 11441 - protein, 9 aa, Homo sapiens
  light chain complementarity determining region 3 for antibody 5721
QGYKSAPHT

SEQ ID NO: 11442 - protein, 14 aa, Homo sapiens
  heavy chain complementarity determining region 3 for antibody 5721
CRGWLDPATPHYDF

SEQ ID NO: 11443 - protein, 8 aa, Homo sapiens
  light chain complementarity determining region 3 for antibody 5722
QEYVDSFP

SEQ ID NO: 11444 - protein, 16 aa, Homo sapiens
  heavy chain complementarity determining region 3 for antibody 5722
AIWAAVSSGWSGPFDF

SEQ ID NO: 11445 - protein, 9 aa, Homo sapiens
  light chain complementarity determining region 3 for antibody 5723
QEYSTYSWT

SEQ ID NO: 11446 - protein, 15 aa, Homo sapiens
  heavy chain complementarity determining region 3 for antibody 5723
ARDCISTNCYLIFDN

SEQ ID NO: 11447 - protein, 9 aa, Homo sapiens
  light chain complementarity determining region 3 for antibody 5724
QEYSTYSRT

SEQ ID NO: 11448 - protein, 15 aa, Homo sapiens
  heavy chain complementarity determining region 3 for antibody 5724
ARDCISTDCYLIFDN

SEQ ID NO: 11449 - protein, 9 aa, Homo sapiens
  light chain complementarity determining region 3 for antibody 5725
QEYSTYSRA

SEQ ID NO: 11450 - protein, 15 aa, Homo sapiens
  heavy chain complementarity determining region 3 for antibody 5725
ARDCISTNCYLIFDN

SEQ ID NO: 11451 - protein, 9 aa, Homo sapiens
  light chain complementarity determining region 3 for antibody 5726
QEYSTYSLT

SEQ ID NO: 11452 - protein, 15 aa, Homo sapiens
  heavy chain complementarity determining region 3 for antibody 5726
ARDCISTNCYLIFDN

SEQ ID NO: 11453 - protein, 9 aa, Homo sapiens
  light chain complementarity determining region 3 for antibody 5727
QEYSTYPRT

SEQ ID NO: 11454 - protein, 15 aa, Homo sapiens
  heavy chain complementarity determining region 3 for antibody 5727
ARDCISTNCYLIFDN

SEQ ID NO: 11455 - protein, 9 aa, Homo sapiens
  light chain complementarity determining region 3 for antibody 5728
QEYRTPPRT

SEQ ID NO: 11456 - protein, 20 aa, Homo sapiens
  heavy chain complementarity determining region 3 for antibody 5728
ARDGRGIVEYDYAGGGGLDV

SEQ ID NO: 11457 - protein, 9 aa, Homo sapiens
  light chain complementarity determining region 3 for antibody 5729
QEYRTPPGT

SEQ ID NO: 11458 - protein, 20 aa, Homo sapiens
  heavy chain complementarity determining region 3 for antibody 5729
ARDGRGIVEYDYAGGGGLDV

SEQ ID NO: 11459 - protein, 9 aa, Homo sapiens
  light chain complementarity determining region 3 for antibody 5730
QEYKTVPWT

SEQ ID NO: 11460 - protein, 10 aa, Homo sapiens
  heavy chain complementarity determining region 3 for antibody 5730
ARERSGSYDI

SEQ ID NO: 11461 - protein, 9 aa, Homo sapiens
  light chain complementarity determining region 3 for antibody 5731
QEYKTVPWT

SEQ ID NO: 11462 - protein, 12 aa, Homo sapiens
  heavy chain complementarity determining region 3 for antibody 5731
ARDKGGRNGMDV

SEQ ID NO: 11463 - protein, 9 aa, Homo sapiens
  light chain complementarity determining region 3 for antibody 5732
QEYKTVPWT

SEQ ID NO: 11464 - protein, 20 aa, Homo sapiens
  heavy chain complementarity determining region 3 for antibody 5732
AKDGRGTASYHSAGGGGLDV

SEQ ID NO: 11465 - protein, 9 aa, Homo sapiens
  light chain complementarity determining region 3 for antibody 5733
QEYKTVPWT

SEQ ID NO: 11466 - protein, 20 aa, Homo sapiens
  heavy chain complementarity determining region 3 for antibody 5733
AKDGRGTANYHSAGGVGLDV

SEQ ID NO: 11467 - protein, 9 aa, Homo sapiens
  light chain complementarity determining region 3 for antibody 5734
QEYKTVPWT

SEQ ID NO: 11468 - protein, 20 aa, Homo sapiens
  heavy chain complementarity determining region 3 for antibody 5734
AKDGRGTANYHSAGGGCLDV

SEQ ID NO: 11469 - protein, 9 aa, Homo sapiens
  light chain complementarity determining region 3 for antibody 5735
QEYKTVPWT

SEQ ID NO: 11470 - protein, 20 aa, Homo sapiens
  heavy chain complementarity determining region 3 for antibody 5735
AKDGRGTANDHSAGGGGLDV

SEQ ID NO: 11471 - protein, 9 aa, Homo sapiens
  light chain complementarity determining region 3 for antibody 5736
QEYKTVPWP

SEQ ID NO: 11472 - protein, 20 aa, Homo sapiens
  heavy chain complementarity determining region 3 for antibody 5736
AKDGRGTANYHSAGGGGLDV

SEQ ID NO: 11473 - protein, 9 aa, Homo sapiens
  light chain complementarity determining region 3 for antibody 5737
QEYKTVPWK

SEQ ID NO: 11474 - protein, 20 aa, Homo sapiens
  heavy chain complementarity determining region 3 for antibody 5737
AKDGRGTAFYHGAGGGGLDV

SEQ ID NO: 11475 - protein, 9 aa, Homo sapiens
  light chain complementarity determining region 3 for antibody 5738
QEYGTSRGT

SEQ ID NO: 11476 - protein, 15 aa, Homo sapiens
  heavy chain complementarity determining region 3 for antibody 5738
AKPRSNMFAHDAFDI

SEQ ID NO: 11477 - protein, 9 aa, Homo sapiens
  light chain complementarity determining region 3 for antibody 5739
QERSTWPGS

SEQ ID NO: 11478 - protein, 13 aa, Homo sapiens
  heavy chain complementarity determining region 3 for antibody 5739
ATGAWGSSWWGDD

SEQ ID NO: 11479 - protein, 9 aa, Homo sapiens
  light chain complementarity determining region 3 for antibody 5740
QERSTWPGS

SEQ ID NO: 11480 - protein, 13 aa, Homo sapiens
  heavy chain complementarity determining region 3 for antibody 5740
ATGAWGSSWRGDY

SEQ ID NO: 11481 - protein, 9 aa, Homo sapiens
  light chain complementarity determining region 3 for antibody 5741
QERSTWPGS

SEQ ID NO: 11482 - protein, 13 aa, Homo sapiens
  heavy chain complementarity determining region 3 for antibody 5741
ATGAWGSRWWGDY

SEQ ID NO: 11483 - protein, 9 aa, Homo sapiens
  light chain complementarity determining region 3 for antibody 5742
QERSTWPGS

SEQ ID NO: 11484 - protein, 13 aa, Homo sapiens
  heavy chain complementarity determining region 3 for antibody 5742
ATGAWGRSWWGDY

SEQ ID NO: 11485 - protein, 9 aa, Homo sapiens
  light chain complementarity determining region 3 for antibody 5743
QERSTWPGS

SEQ ID NO: 11486 - protein, 13 aa, Homo sapiens
  heavy chain complementarity determining region 3 for antibody 5743
ATGAWGGSWWGDY

SEQ ID NO: 11487 - protein, 9 aa, Homo sapiens
  light chain complementarity determining region 3 for antibody 5744
QERSTWPGS

SEQ ID NO: 11488 - protein, 13 aa, Homo sapiens
  heavy chain complementarity determining region 3 for antibody 5744
ATGARGSSWWGDY

SEQ ID NO: 11489 - protein, 9 aa, Homo sapiens
  light chain complementarity determining region 3 for antibody 5745
QERSTWPGS

SEQ ID NO: 11490 - protein, 13 aa, Homo sapiens
  heavy chain complementarity determining region 3 for antibody 5745
AAGAWDSSWWGDY

SEQ ID NO: 11491 - protein, 9 aa, Homo sapiens
  light chain complementarity determining region 3 for antibody 5746
QERGTWPGS

SEQ ID NO: 11492 - protein, 13 aa, Homo sapiens
  heavy chain complementarity determining region 3 for antibody 5746
ATGAWGSSWWGDY

SEQ ID NO: 11493 - protein, 7 aa, Homo sapiens
  light chain complementarity determining region 3 for antibody 5747
QCNRTWA

SEQ ID NO: 11494 - protein, 20 aa, Homo sapiens
  heavy chain complementarity determining region 3 for antibody 5747
STYLPGDCTCTGCFYWYSDF

SEQ ID NO: 11495 - protein, 7 aa, Homo sapiens
  light chain complementarity determining region 3 for antibody 5748
QCNRNWA

SEQ ID NO: 11496 - protein, 20 aa, Homo sapiens
  heavy chain complementarity determining region 3 for antibody 5748
STYLPGDCTCTSCFYWYSDF

SEQ ID NO: 11497 - protein, 7 aa, Homo sapiens
  light chain complementarity determining region 3 for antibody 5749
QCNRNWA

SEQ ID NO: 11498 - protein, 20 aa, Homo sapiens
  heavy chain complementarity determining region 3 for antibody 5749
STYLPGDCTCTGCFYWYSDV

SEQ ID NO: 11499 - protein, 7 aa, Homo sapiens
  light chain complementarity determining region 3 for antibody 5750
QCNRNWA

SEQ ID NO: 11500 - protein, 20 aa, Homo sapiens
  heavy chain complementarity determining region 3 for antibody 5750
STYLPGDCTCTGCFYWYADF

SEQ ID NO: 11501 - protein, 7 aa, Homo sapiens
  light chain complementarity determining region 3 for antibody 5751
QCNRNWA

SEQ ID NO: 11502 - protein, 16 aa, Homo sapiens
  heavy chain complementarity determining region 3 for antibody 5751
ARWFSRSSTGVSYMDV

SEQ ID NO: 11503 - protein, 7 aa, Homo sapiens
  light chain complementarity determining region 3 for antibody 5752
QCNRNWA

SEQ ID NO: 11504 - protein, 10 aa, Homo sapiens
  heavy chain complementarity determining region 3 for antibody 5752
ARERSGSYDI

SEQ ID NO: 11505 - protein, 7 aa, Homo sapiens
  light chain complementarity determining region 3 for antibody 5753
QCFGASS

SEQ ID NO: 11506 - protein, 11 aa, Homo sapiens
  heavy chain complementarity determining region 3 for antibody 5753
VRDVAYWRSDP

SEQ ID NO: 11507 - protein, 8 aa, Homo sapiens
  light chain complementarity determining region 3 for antibody 5754
QAYGDSFP

SEQ ID NO: 11508 - protein, 16 aa, Homo sapiens
  heavy chain complementarity determining region 3 for antibody 5754
AIWAAVSSGWSGPFDF

SEQ ID NO: 11509 - protein, 10 aa, Homo sapiens
  light chain complementarity determining region 3 for antibody 5755
PQYYSSPPWA

SEQ ID NO: 11510 - protein, 16 aa, Homo sapiens
  heavy chain complementarity determining region 3 for antibody 5755
ASLNRGDKEFGVPPAL

SEQ ID NO: 11511 - protein, 9 aa, Homo sapiens
  light chain complementarity determining region 3 for antibody 5756
PQDYNHVGT

SEQ ID NO: 11512 - protein, 9 aa, Homo sapiens
  heavy chain complementarity determining region 3 for antibody 5756
GSRRPYFDS

SEQ ID NO: 11513 - protein, 8 aa, Homo sapiens
  light chain complementarity determining region 3 for antibody 5757
PEYGDSFP

SEQ ID NO: 11514 - protein, 16 aa, Homo sapiens
  heavy chain complementarity determining region 3 for antibody 5757
AIWAAVSSGWSGPFDF

SEQ ID NO: 11515 - protein, 9 aa, Homo sapiens
  light chain complementarity determining region 3 for antibody 5758
NHFGSATGT

SEQ ID NO: 11516 - protein, 13 aa, Homo sapiens
  heavy chain complementarity determining region 3 for antibody 5758
AKEGSSPGPDFEY

SEQ ID NO: 11517 - protein, 9 aa, Homo sapiens
  light chain complementarity determining region 3 for antibody 5759
MRGTHWPHT

SEQ ID NO: 11518 - protein, 11 aa, Homo sapiens
  heavy chain complementarity determining region 3 for antibody 5759
ATFGQQWRLAH

SEQ ID NO: 11519 - protein, 9 aa, Homo sapiens
  light chain complementarity determining region 3 for antibody 5760
MQYTNRPHT

SEQ ID NO: 11520 - protein, 8 aa, Homo sapiens
  heavy chain complementarity determining region 3 for antibody 5760
AGWGYANY

SEQ ID NO: 11521 - protein, 9 aa, Homo sapiens
  light chain complementarity determining region 3 for antibody 5761
MQYTHWPHT

SEQ ID NO: 11522 - protein, 8 aa, Homo sapiens
  heavy chain complementarity determining region 3 for antibody 5761
AGWNDVNY

SEQ ID NO: 11523 - protein, 9 aa, Homo sapiens
  light chain complementarity determining region 3 for antibody 5762
MQYTHWPHT

SEQ ID NO: 11524 - protein, 8 aa, Homo sapiens
  heavy chain complementarity determining region 3 for antibody 5762
AGWNDASY

SEQ ID NO: 11525 - protein, 9 aa, Homo sapiens
  light chain complementarity determining region 3 for antibody 5763
MQYTHRPHT

SEQ ID NO: 11526 - protein, 9 aa, Homo sapiens
  heavy chain complementarity determining region 3 for antibody 5763
AGWGGLSNY

SEQ ID NO: 11527 - protein, 9 aa, Homo sapiens
  light chain complementarity determining region 3 for antibody 5764
MQYKHRPHT

SEQ ID NO: 11528 - protein, 8 aa, Homo sapiens
  heavy chain complementarity determining region 3 for antibody 5764
AGWGYANY

SEQ ID NO: 11529 - protein, 9 aa, Homo sapiens
  light chain complementarity determining region 3 for antibody 5765
MQYAPWPHT

SEQ ID NO: 11530 - protein, 8 aa, Homo sapiens
  heavy chain complementarity determining region 3 for antibody 5765
AGWSDANY

SEQ ID NO: 11531 - protein, 9 aa, Homo sapiens
  light chain complementarity determining region 3 for antibody 5766
MQYAHWPPT

SEQ ID NO: 11532 - protein, 8 aa, Homo sapiens
  heavy chain complementarity determining region 3 for antibody 5766
AGWSDANY

SEQ ID NO: 11533 - protein, 9 aa, Homo sapiens
  light chain complementarity determining region 3 for antibody 5767
MQYAHGPHT

SEQ ID NO: 11534 - protein, 13 aa, Homo sapiens
  heavy chain complementarity determining region 3 for antibody 5767
AKEGSSPGPDFEY

SEQ ID NO: 11535 - protein, 9 aa, Homo sapiens
  light chain complementarity determining region 3 for antibody 5768
MQYAHGPHT

SEQ ID NO: 11536 - protein, 8 aa, Homo sapiens
  heavy chain complementarity determining region 3 for antibody 5768
AGWGYGND

SEQ ID NO: 11537 - protein, 9 aa, Homo sapiens
  light chain complementarity determining region 3 for antibody 5769
MQYAHGPHT

SEQ ID NO: 11538 - protein, 8 aa, Homo sapiens
  heavy chain complementarity determining region 3 for antibody 5769
AGWCYGNY

SEQ ID NO: 11539 - protein, 9 aa, Homo sapiens
  light chain complementarity determining region 3 for antibody 5770
MQVTQSPYT

SEQ ID NO: 11540 - protein, 6 aa, Homo sapiens
  heavy chain complementarity determining region 3 for antibody 5770
MNGADQ

SEQ ID NO: 11541 - protein, 9 aa, Homo sapiens
  light chain complementarity determining region 3 for antibody 5771
MQVTHWPRT

SEQ ID NO: 11542 - protein, 16 aa, Homo sapiens
  heavy chain complementarity determining region 3 for antibody 5771
TEDVGDHRDRYVTLDH

SEQ ID NO: 11543 - protein, 9 aa, Homo sapiens
  light chain complementarity determining region 3 for antibody 5772
MQVLHLPLT

SEQ ID NO: 11544 - protein, 15 aa, Homo sapiens
  heavy chain complementarity determining region 3 for antibody 5772
VRDPGGLAYFYNMEV

SEQ ID NO: 11545 - protein, 9 aa, Homo sapiens
  light chain complementarity determining region 3 for antibody 5773
MQTVQTPWT

SEQ ID NO: 11546 - protein, 12 aa, Homo sapiens
  heavy chain complementarity determining region 3 for antibody 5773
ARLDWTYRAFDI

SEQ ID NO: 11547 - protein, 9 aa, Homo sapiens
  light chain complementarity determining region 3 for antibody 5774
MQTVQTPWT

SEQ ID NO: 11548 - protein, 12 aa, Homo sapiens
  heavy chain complementarity determining region 3 for antibody 5774
ARLDWNYRAFGI

SEQ ID NO: 11549 - protein, 9 aa, Homo sapiens
  light chain complementarity determining region 3 for antibody 5775
MQTVQTPWT

SEQ ID NO: 11550 - protein, 12 aa, Homo sapiens
  heavy chain complementarity determining region 3 for antibody 5775
ARLDWNYRAFDV

SEQ ID NO: 11551 - protein, 9 aa, Homo sapiens
  light chain complementarity determining region 3 for antibody 5776
MQTVQTPWT

SEQ ID NO: 11552 - protein, 12 aa, Homo sapiens
  heavy chain complementarity determining region 3 for antibody 5776
ARLDWNCRAFDI

SEQ ID NO: 11553 - protein, 9 aa, Homo sapiens
  light chain complementarity determining region 3 for antibody 5777
MQTVQTPWR

SEQ ID NO: 11554 - protein, 12 aa, Homo sapiens
  heavy chain complementarity determining region 3 for antibody 5777
ARLDWNYRAFDI

SEQ ID NO: 11555 - protein, 9 aa, Homo sapiens
  light chain complementarity determining region 3 for antibody 5778
MQTVQPPWT

SEQ ID NO: 11556 - protein, 12 aa, Homo sapiens
  heavy chain complementarity determining region 3 for antibody 5778
ARLDWNYRAFDI

SEQ ID NO: 11557 - protein, 9 aa, Homo sapiens
  light chain complementarity determining region 3 for antibody 5779
MQTVQNPWT

SEQ ID NO: 11558 - protein, 12 aa, Homo sapiens
  heavy chain complementarity determining region 3 for antibody 5779
ARLDWNYRAFDI

SEQ ID NO: 11559 - protein, 9 aa, Homo sapiens
  light chain complementarity determining region 3 for antibody 5780
MQTRQTPGT

SEQ ID NO: 11560 - protein, 12 aa, Homo sapiens
  heavy chain complementarity determining region 3 for antibody 5780
ARLDWNYRAFDI

SEQ ID NO: 11561 - protein, 9 aa, Homo sapiens
  light chain complementarity determining region 3 for antibody 5781
MQTLQTPWT

SEQ ID NO: 11562 - protein, 12 aa, Homo sapiens
  heavy chain complementarity determining region 3 for antibody 5781
ARLYWNYRAFDI

SEQ ID NO: 11563 - protein, 9 aa, Homo sapiens
  light chain complementarity determining region 3 for antibody 5782
MQTLQTPWT

SEQ ID NO: 11564 - protein, 12 aa, Homo sapiens
  heavy chain complementarity determining region 3 for antibody 5782
ARLDWYYRAFDI

SEQ ID NO: 11565 - protein, 9 aa, Homo sapiens
  light chain complementarity determining region 3 for antibody 5783
MQTLQTPWT

SEQ ID NO: 11566 - protein, 12 aa, Homo sapiens
  heavy chain complementarity determining region 3 for antibody 5783
ARLDWNYRAFNI

SEQ ID NO: 11567 - protein, 9 aa, Homo sapiens
  light chain complementarity determining region 3 for antibody 5784
MQTLQTPWT

SEQ ID NO: 11568 - protein, 12 aa, Homo sapiens
  heavy chain complementarity determining region 3 for antibody 5784
ARLDWNYRAFEI

SEQ ID NO: 11569 - protein, 9 aa, Homo sapiens
  light chain complementarity determining region 3 for antibody 5785
MQTLQTPWT

SEQ ID NO: 11570 - protein, 12 aa, Homo sapiens
  heavy chain complementarity determining region 3 for antibody 5785
ARLDWNYRAFDN

SEQ ID NO: 11571 - protein, 9 aa, Homo sapiens
  light chain complementarity determining region 3 for antibody 5786
MQTLQTPWT

SEQ ID NO: 11572 - protein, 12 aa, Homo sapiens
  heavy chain complementarity determining region 3 for antibody 5786
ARLDWNSRAFDI

SEQ ID NO: 11573 - protein, 9 aa, Homo sapiens
  light chain complementarity determining region 3 for antibody 5787
MQTLQTPWT

SEQ ID NO: 11574 - protein, 12 aa, Homo sapiens
  heavy chain complementarity determining region 3 for antibody 5787
ARLDWHYRAFDI

SEQ ID NO: 11575 - protein, 9 aa, Homo sapiens
  light chain complementarity determining region 3 for antibody 5788
MQTLQTPWT

SEQ ID NO: 11576 - protein, 11 aa, Homo sapiens
  heavy chain complementarity determining region 3 for antibody 5788
AREQHGQAPDY

SEQ ID NO: 11577 - protein, 9 aa, Homo sapiens
  light chain complementarity determining region 3 for antibody 5789
MQTLQTPWT

SEQ ID NO: 11578 - protein, 13 aa, Homo sapiens
  heavy chain complementarity determining region 3 for antibody 5789
AKEGSSPGPDFDY

SEQ ID NO: 11579 - protein, 9 aa, Homo sapiens
  light chain complementarity determining region 3 for antibody 5790
MQTLQTPWR

SEQ ID NO: 11580 - protein, 13 aa, Homo sapiens
  heavy chain complementarity determining region 3 for antibody 5790
AKRYSTNWGHFDY

SEQ ID NO: 11581 - protein, 9 aa, Homo sapiens
  light chain complementarity determining region 3 for antibody 5791
MQTLQTPVT

SEQ ID NO: 11582 - protein, 16 aa, Homo sapiens
  heavy chain complementarity determining region 3 for antibody 5791
ATDSFSLTSTVGHTDH

SEQ ID NO: 11583 - protein, 9 aa, Homo sapiens
  light chain complementarity determining region 3 for antibody 5792
MQTLQTPVT

SEQ ID NO: 11584 - protein, 17 aa, Homo sapiens
  heavy chain complementarity determining region 3 for antibody 5792
ARNTMVGAWQRQGYLDH

SEQ ID NO: 11585 - protein, 9 aa, Homo sapiens
  light chain complementarity determining region 3 for antibody 5793
MQTLQTPLT

SEQ ID NO: 11586 - protein, 12 aa, Homo sapiens
  heavy chain complementarity determining region 3 for antibody 5793
ARLDWNYRAFDI

SEQ ID NO: 11587 - protein, 9 aa, Homo sapiens
  light chain complementarity determining region 3 for antibody 5794
MQTLQTPGT

SEQ ID NO: 11588 - protein, 12 aa, Homo sapiens
  heavy chain complementarity determining region 3 for antibody 5794
ARWDWNYRAFDI

SEQ ID NO: 11589 - protein, 9 aa, Homo sapiens
  light chain complementarity determining region 3 for antibody 5795
MQTLQTPGT

SEQ ID NO: 11590 - protein, 12 aa, Homo sapiens
  heavy chain complementarity determining region 3 for antibody 5795
ARLDWNYRAFDL

SEQ ID NO: 11591 - protein, 9 aa, Homo sapiens
  light chain complementarity determining region 3 for antibody 5796
MQTLQTPGT

SEQ ID NO: 11592 - protein, 10 aa, Homo sapiens
  heavy chain complementarity determining region 3 for antibody 5796
AHRINRAFDI

SEQ ID NO: 11593 - protein, 9 aa, Homo sapiens
  light chain complementarity determining region 3 for antibody 5797
MQTLPTPGT

SEQ ID NO: 11594 - protein, 12 aa, Homo sapiens
  heavy chain complementarity determining region 3 for antibody 5797
ARLDWNYRAFDI

SEQ ID NO: 11595 - protein, 9 aa, Homo sapiens
  light chain complementarity determining region 3 for antibody 5798
MQTLNTPWT

SEQ ID NO: 11596 - protein, 12 aa, Homo sapiens
  heavy chain complementarity determining region 3 for antibody 5798
ARLLWQLRGLDV

SEQ ID NO: 11597 - protein, 9 aa, Homo sapiens
  light chain complementarity determining region 3 for antibody 5799
MQTLHTPWP

SEQ ID NO: 11598 - protein, 12 aa, Homo sapiens
  heavy chain complementarity determining region 3 for antibody 5799
ARLLWQLRGLDV

SEQ ID NO: 11599 - protein, 9 aa, Homo sapiens
  light chain complementarity determining region 3 for antibody 5800
MQTLHTPRT

SEQ ID NO: 11600 - protein, 12 aa, Homo sapiens
  heavy chain complementarity determining region 3 for antibody 5800
ARLLWQLRGLDV

SEQ ID NO: 11601 - protein, 6 aa, Homo sapiens
  light chain complementarity determining region 3 for antibody 5801
MQSTNW

SEQ ID NO: 11602 - protein, 16 aa, Homo sapiens
  heavy chain complementarity determining region 3 for antibody 5801
VRDLAGFTRGGSTFDY

SEQ ID NO: 11603 - protein, 6 aa, Homo sapiens
  light chain complementarity determining region 3 for antibody 5802
MQSTNW

SEQ ID NO: 11604 - protein, 15 aa, Homo sapiens
  heavy chain complementarity determining region 3 for antibody 5802
GKEGPGSSGWLTGHY

SEQ ID NO: 11605 - protein, 6 aa, Homo sapiens
  light chain complementarity determining region 3 for antibody 5803
MQSTNW

SEQ ID NO: 11606 - protein, 19 aa, Homo sapiens
  heavy chain complementarity determining region 3 for antibody 5803
ARERVRRRSGICYDATFDI

SEQ ID NO: 11607 - protein, 6 aa, Homo sapiens
  light chain complementarity determining region 3 for antibody 5804
MQSTNW

SEQ ID NO: 11608 - protein, 19 aa, Homo sapiens
  heavy chain complementarity determining region 3 for antibody 5804
ARERVRCRSGICYDATFGI

SEQ ID NO: 11609 - protein, 6 aa, Homo sapiens
  light chain complementarity determining region 3 for antibody 5805
MQSTNW

SEQ ID NO: 11610 - protein, 19 aa, Homo sapiens
  heavy chain complementarity determining region 3 for antibody 5805
ARERVRCRSGICCDATFDI

SEQ ID NO: 11611 - protein, 9 aa, Homo sapiens
  light chain complementarity determining region 3 for antibody 5806
MQSTHWPHT

SEQ ID NO: 11612 - protein, 11 aa, Homo sapiens
  heavy chain complementarity determining region 3 for antibody 5806
ATFGQQWRLAH

SEQ ID NO: 11613 - protein, 9 aa, Homo sapiens
  light chain complementarity determining region 3 for antibody 5807
MQPLQTTGT

SEQ ID NO: 11614 - protein, 10 aa, Homo sapiens
  heavy chain complementarity determining region 3 for antibody 5807
VGYNWGNDHF

SEQ ID NO: 11615 - protein, 9 aa, Homo sapiens
  light chain complementarity determining region 3 for antibody 5808
MQNTPWPWT

SEQ ID NO: 11616 - protein, 16 aa, Homo sapiens
  heavy chain complementarity determining region 3 for antibody 5808
ARGHTFPGERRGGSDF

SEQ ID NO: 11617 - protein, 9 aa, Homo sapiens
  light chain complementarity determining region 3 for antibody 5809
MQNTNWPWT

SEQ ID NO: 11618 - protein, 16 aa, Homo sapiens
  heavy chain complementarity determining region 3 for antibody 5809
ARGHTFPGERRGGSDF

SEQ ID NO: 11619 - protein, 9 aa, Homo sapiens
  light chain complementarity determining region 3 for antibody 5810
MQNTNWPPT

SEQ ID NO: 11620 - protein, 10 aa, Homo sapiens
  heavy chain complementarity determining region 3 for antibody 5810
ARDHWFSLDL

SEQ ID NO: 11621 - protein, 9 aa, Homo sapiens
  light chain complementarity determining region 3 for antibody 5811
MQNTHWPWT

SEQ ID NO: 11622 - protein, 16 aa, Homo sapiens
  heavy chain complementarity determining region 3 for antibody 5811
ARGHTVPGERRGGSDF

SEQ ID NO: 11623 - protein, 9 aa, Homo sapiens
  light chain complementarity determining region 3 for antibody 5812
MQNTHWPWT

SEQ ID NO: 11624 - protein, 16 aa, Homo sapiens
  heavy chain complementarity determining region 3 for antibody 5812
ARGHTFPGERRGCSDF

SEQ ID NO: 11625 - protein, 9 aa, Homo sapiens
  light chain complementarity determining region 3 for antibody 5813
MQNTHWPWK

SEQ ID NO: 11626 - protein, 16 aa, Homo sapiens
  heavy chain complementarity determining region 3 for antibody 5813
ARGHTFPGERRGGSDF

SEQ ID NO: 11627 - protein, 9 aa, Homo sapiens
  light chain complementarity determining region 3 for antibody 5814
MQGTYWPYT

SEQ ID NO: 11628 - protein, 11 aa, Homo sapiens
  heavy chain complementarity determining region 3 for antibody 5814
AGEGWGSLLDY

SEQ ID NO: 11629 - protein, 9 aa, Homo sapiens
  light chain complementarity determining region 3 for antibody 5815
MQGTYWPST

SEQ ID NO: 11630 - protein, 11 aa, Homo sapiens
  heavy chain complementarity determining region 3 for antibody 5815
AREGWGSLLDY

SEQ ID NO: 11631 - protein, 10 aa, Homo sapiens
  light chain complementarity determining region 3 for antibody 5816
MQGTYWPPTT

SEQ ID NO: 11632 - protein, 11 aa, Homo sapiens
  heavy chain complementarity determining region 3 for antibody 5816
AGGGAGIKIDS

SEQ ID NO: 11633 - protein, 9 aa, Homo sapiens
  light chain complementarity determining region 3 for antibody 5817
MQGTYWPPT

SEQ ID NO: 11634 - protein, 11 aa, Homo sapiens
  heavy chain complementarity determining region 3 for antibody 5817
ARDPGWGACDY

SEQ ID NO: 11635 - protein, 9 aa, Homo sapiens
  light chain complementarity determining region 3 for antibody 5818
MQGTYWPHT

SEQ ID NO: 11636 - protein, 11 aa, Homo sapiens
  heavy chain complementarity determining region 3 for antibody 5818
VSVGQQWGLAY

SEQ ID NO: 11637 - protein, 9 aa, Homo sapiens
  light chain complementarity determining region 3 for antibody 5819
MQGTYRPYT

SEQ ID NO: 11638 - protein, 11 aa, Homo sapiens
  heavy chain complementarity determining region 3 for antibody 5819
AREGWGSLLDY

SEQ ID NO: 11639 - protein, 10 aa, Homo sapiens
  light chain complementarity determining region 3 for antibody 5820
MQGTPWPPIT

SEQ ID NO: 11640 - protein, 16 aa, Homo sapiens
  heavy chain complementarity determining region 3 for antibody 5820
ARHGVLPAAIHDAFDI

SEQ ID NO: 11641 - protein, 10 aa, Homo sapiens
  light chain complementarity determining region 3 for antibody 5821
MQGTPWPAWT

SEQ ID NO: 11642 - protein, 12 aa, Homo sapiens
  heavy chain complementarity determining region 3 for antibody 5821
TTWIKTSVWLDY

SEQ ID NO: 11643 - protein, 10 aa, Homo sapiens
  light chain complementarity determining region 3 for antibody 5822
MQGTPWPAGT

SEQ ID NO: 11644 - protein, 12 aa, Homo sapiens
  heavy chain complementarity determining region 3 for antibody 5822
TTWIKTSVWLDY

SEQ ID NO: 11645 - protein, 10 aa, Homo sapiens
  light chain complementarity determining region 3 for antibody 5823
MQGTNWPAWT

SEQ ID NO: 11646 - protein, 12 aa, Homo sapiens
  heavy chain complementarity determining region 3 for antibody 5823
TTWIKTSVWLDY

SEQ ID NO: 11647 - protein, 9 aa, Homo sapiens
  light chain complementarity determining region 3 for antibody 5824
MQGTHWPYT

SEQ ID NO: 11648 - protein, 26 aa, Homo sapiens
  heavy chain complementarity determining region 3 for antibody 5824
ARDFPKGGSYISGWYENTGGSYYMDV

SEQ ID NO: 11649 - protein, 9 aa, Homo sapiens
  light chain complementarity determining region 3 for antibody 5825
MQGTHWPWT

SEQ ID NO: 11650 - protein, 10 aa, Homo sapiens
  heavy chain complementarity determining region 3 for antibody 5825
VRETSGSYDI

SEQ ID NO: 11651 - protein, 9 aa, Homo sapiens
  light chain complementarity determining region 3 for antibody 5826
MQGTHWPWT

SEQ ID NO: 11652 - protein, 16 aa, Homo sapiens
  heavy chain complementarity determining region 3 for antibody 5826
ASGHTNPGERRGGSDF

SEQ ID NO: 11653 - protein, 9 aa, Homo sapiens
  light chain complementarity determining region 3 for antibody 5827
MQGTHWPWT

SEQ ID NO: 11654 - protein, 6 aa, Homo sapiens
  heavy chain complementarity determining region 3 for antibody 5827
ARISAY

SEQ ID NO: 11655 - protein, 9 aa, Homo sapiens
  light chain complementarity determining region 3 for antibody 5828
MQGTHWPWT

SEQ ID NO: 11656 - protein, 16 aa, Homo sapiens
  heavy chain complementarity determining region 3 for antibody 5828
ARGHTNRGERRGGSDF

SEQ ID NO: 11657 - protein, 9 aa, Homo sapiens
  light chain complementarity determining region 3 for antibody 5829
MQGTHWPWT

SEQ ID NO: 11658 - protein, 16 aa, Homo sapiens
  heavy chain complementarity determining region 3 for antibody 5829
ARGHTNPGERRGGSGF

SEQ ID NO: 11659 - protein, 9 aa, Homo sapiens
  light chain complementarity determining region 3 for antibody 5830
MQGTHWPWT

SEQ ID NO: 11660 - protein, 16 aa, Homo sapiens
  heavy chain complementarity determining region 3 for antibody 5830
ARGHTNPGERRGGLDF

SEQ ID NO: 11661 - protein, 9 aa, Homo sapiens
  light chain complementarity determining region 3 for antibody 5831
MQGTHWPWT

SEQ ID NO: 11662 - protein, 16 aa, Homo sapiens
  heavy chain complementarity determining region 3 for antibody 5831
ARGHTNPGERRCGSDF

SEQ ID NO: 11663 - protein, 9 aa, Homo sapiens
  light chain complementarity determining region 3 for antibody 5832
MQGTHWPWT

SEQ ID NO: 11664 - protein, 16 aa, Homo sapiens
  heavy chain complementarity determining region 3 for antibody 5832
ARGHTNPGERLGGSDF

SEQ ID NO: 11665 - protein, 9 aa, Homo sapiens
  light chain complementarity determining region 3 for antibody 5833
MQGTHWPWT

SEQ ID NO: 11666 - protein, 16 aa, Homo sapiens
  heavy chain complementarity determining region 3 for antibody 5833
ARGHSNPGERRGGSDF

SEQ ID NO: 11667 - protein, 9 aa, Homo sapiens
  light chain complementarity determining region 3 for antibody 5834
MQGTHWPWT

SEQ ID NO: 11668 - protein, 12 aa, Homo sapiens
  heavy chain complementarity determining region 3 for antibody 5834
ARDKGGRNGMDV

SEQ ID NO: 11669 - protein, 9 aa, Homo sapiens
  light chain complementarity determining region 3 for antibody 5835
MQGTHWPWT

SEQ ID NO: 11670 - protein, 13 aa, Homo sapiens
  heavy chain complementarity determining region 3 for antibody 5835
AKEGSAPGPDFEY

SEQ ID NO: 11671 - protein, 9 aa, Homo sapiens
  light chain complementarity determining region 3 for antibody 5836
MQGTHWPWT

SEQ ID NO: 11672 - protein, 12 aa, Homo sapiens
  heavy chain complementarity determining region 3 for antibody 5836
AIVVPRRWDLDD

SEQ ID NO: 11673 - protein, 9 aa, Homo sapiens
  light chain complementarity determining region 3 for antibody 5837
MQGTHWPWT

SEQ ID NO: 11674 - protein, 12 aa, Homo sapiens
  heavy chain complementarity determining region 3 for antibody 5837
AIVVPGRWDLDE

SEQ ID NO: 11675 - protein, 9 aa, Homo sapiens
  light chain complementarity determining region 3 for antibody 5838
MQGTHWPWT

SEQ ID NO: 11676 - protein, 12 aa, Homo sapiens
  heavy chain complementarity determining region 3 for antibody 5838
AIVVPGRWALDD

SEQ ID NO: 11677 - protein, 9 aa, Homo sapiens
  light chain complementarity determining region 3 for antibody 5839
MQGTHWPWT

SEQ ID NO: 11678 - protein, 12 aa, Homo sapiens
  heavy chain complementarity determining region 3 for antibody 5839
AIVVPERWDLDD

SEQ ID NO: 11679 - protein, 9 aa, Homo sapiens
  light chain complementarity determining region 3 for antibody 5840
MQGTHWPWT

SEQ ID NO: 11680 - protein, 12 aa, Homo sapiens
  heavy chain complementarity determining region 3 for antibody 5840
AIVGPGRWDLDD

SEQ ID NO: 11681 - protein, 9 aa, Homo sapiens
  light chain complementarity determining region 3 for antibody 5841
MQGTHWPWT

SEQ ID NO: 11682 - protein, 9 aa, Homo sapiens
  heavy chain complementarity determining region 3 for antibody 5841
AGWGGTSNY

SEQ ID NO: 11683 - protein, 9 aa, Homo sapiens
  light chain complementarity determining region 3 for antibody 5842
MQGTHWPWT

SEQ ID NO: 11684 - protein, 16 aa, Homo sapiens
  heavy chain complementarity determining region 3 for antibody 5842
AGGHTNPGERRGGSDF

SEQ ID NO: 11685 - protein, 9 aa, Homo sapiens
  light chain complementarity determining region 3 for antibody 5843
MQGTHWPWR

SEQ ID NO: 11686 - protein, 12 aa, Homo sapiens
  heavy chain complementarity determining region 3 for antibody 5843
AIVVPGRWDLDD

SEQ ID NO: 11687 - protein, 9 aa, Homo sapiens
  light chain complementarity determining region 3 for antibody 5844
MQGTHWPRT

SEQ ID NO: 11688 - protein, 10 aa, Homo sapiens
  heavy chain complementarity determining region 3 for antibody 5844
VRDYWDSIDY

SEQ ID NO: 11689 - protein, 9 aa, Homo sapiens
  light chain complementarity determining region 3 for antibody 5845
MQGTHWPRT

SEQ ID NO: 11690 - protein, 15 aa, Homo sapiens
  heavy chain complementarity determining region 3 for antibody 5845
ATVTCTNGWYNAFDI

SEQ ID NO: 11691 - protein, 9 aa, Homo sapiens
  light chain complementarity determining region 3 for antibody 5846
MQGTHWPQT

SEQ ID NO: 11692 - protein, 11 aa, Homo sapiens
  heavy chain complementarity determining region 3 for antibody 5846
ATFGISWYFSG

SEQ ID NO: 11693 - protein, 10 aa, Homo sapiens
  light chain complementarity determining region 3 for antibody 5847
MQGTHWPPYT

SEQ ID NO: 11694 - protein, 20 aa, Homo sapiens
  heavy chain complementarity determining region 3 for antibody 5847
ARERSLAVAGNGYYYYGMDV

SEQ ID NO: 11695 - protein, 10 aa, Homo sapiens
  light chain complementarity determining region 3 for antibody 5848
MQGTHWPPTT

SEQ ID NO: 11696 - protein, 11 aa, Homo sapiens
  heavy chain complementarity determining region 3 for antibody 5848
TGGGAGTKIDS

SEQ ID NO: 11697 - protein, 9 aa, Homo sapiens
  light chain complementarity determining region 3 for antibody 5849
MQGTHWPPT

SEQ ID NO: 11698 - protein, 11 aa, Homo sapiens
  heavy chain complementarity determining region 3 for antibody 5849
ATFGISWYFSG

SEQ ID NO: 11699 - protein, 9 aa, Homo sapiens
  light chain complementarity determining region 3 for antibody 5850
MQGTHWPPT

SEQ ID NO: 11700 - protein, 11 aa, Homo sapiens
  heavy chain complementarity determining region 3 for antibody 5850
ATCGQQWRLAH

SEQ ID NO: 11701 - protein, 9 aa, Homo sapiens
  light chain complementarity determining region 3 for antibody 5851
MQGTHWPPT

SEQ ID NO: 11702 - protein, 10 aa, Homo sapiens
  heavy chain complementarity determining region 3 for antibody 5851
ARERSGSYDI

SEQ ID NO: 11703 - protein, 9 aa, Homo sapiens
  light chain complementarity determining region 3 for antibody 5852
MQGTHWPPS

SEQ ID NO: 11704 - protein, 11 aa, Homo sapiens
  heavy chain complementarity determining region 3 for antibody 5852
ARGPQLHYFDS

SEQ ID NO: 11705 - protein, 9 aa, Homo sapiens
  light chain complementarity determining region 3 for antibody 5853
MQGTHWPPS

SEQ ID NO: 11706 - protein, 13 aa, Homo sapiens
  heavy chain complementarity determining region 3 for antibody 5853
ARDTVTNRMGSDY

SEQ ID NO: 11707 - protein, 9 aa, Homo sapiens
  light chain complementarity determining region 3 for antibody 5854
MQGTHWPPS

SEQ ID NO: 11708 - protein, 13 aa, Homo sapiens
  heavy chain complementarity determining region 3 for antibody 5854
ARDTVTNKRGSDY

SEQ ID NO: 11709 - protein, 9 aa, Homo sapiens
  light chain complementarity determining region 3 for antibody 5855
MQGTHWPPS

SEQ ID NO: 11710 - protein, 13 aa, Homo sapiens
  heavy chain complementarity determining region 3 for antibody 5855
ARDTVPNKMGSDY

SEQ ID NO: 11711 - protein, 9 aa, Homo sapiens
  light chain complementarity determining region 3 for antibody 5856
MQGTHWPPS

SEQ ID NO: 11712 - protein, 13 aa, Homo sapiens
  heavy chain complementarity determining region 3 for antibody 5856
ARDAVTNKMGSDY

SEQ ID NO: 11713 - protein, 10 aa, Homo sapiens
  light chain complementarity determining region 3 for antibody 5857
MQGTHWPPNT

SEQ ID NO: 11714 - protein, 16 aa, Homo sapiens
  heavy chain complementarity determining region 3 for antibody 5857
ARHGVLPAAIHDAFDI

SEQ ID NO: 11715 - protein, 10 aa, Homo sapiens
  light chain complementarity determining region 3 for antibody 5858
MQGTHWPPIT

SEQ ID NO: 11716 - protein, 12 aa, Homo sapiens
  heavy chain complementarity determining region 3 for antibody 5858
ARLDWNYRAFDI

SEQ ID NO: 11717 - protein, 10 aa, Homo sapiens
  light chain complementarity determining region 3 for antibody 5859
MQGTHWPPIP

SEQ ID NO: 11718 - protein, 11 aa, Homo sapiens
  heavy chain complementarity determining region 3 for antibody 5859
AGGGAGTKVDS

SEQ ID NO: 11719 - protein, 10 aa, Homo sapiens
  light chain complementarity determining region 3 for antibody 5860
MQGTHWPPGT

SEQ ID NO: 11720 - protein, 10 aa, Homo sapiens
  heavy chain complementarity determining region 3 for antibody 5860
AKGGLAGEND

SEQ ID NO: 11721 - protein, 9 aa, Homo sapiens
  light chain complementarity determining region 3 for antibody 5861
MQGTHWPLT

SEQ ID NO: 11722 - protein, 11 aa, Homo sapiens
  heavy chain complementarity determining region 3 for antibody 5861
ATFGQQWRLAH

SEQ ID NO: 11723 - protein, 9 aa, Homo sapiens
  light chain complementarity determining region 3 for antibody 5862
MQGTHWPLT

SEQ ID NO: 11724 - protein, 11 aa, Homo sapiens
  heavy chain complementarity determining region 3 for antibody 5862
ARGWAKSGFDI

SEQ ID NO: 11725 - protein, 9 aa, Homo sapiens
  light chain complementarity determining region 3 for antibody 5863
MQGTHWPIT

SEQ ID NO: 11726 - protein, 10 aa, Homo sapiens
  heavy chain complementarity determining region 3 for antibody 5863
CRDREGFGDV

SEQ ID NO: 11727 - protein, 9 aa, Homo sapiens
  light chain complementarity determining region 3 for antibody 5864
MQGTHWPIT

SEQ ID NO: 11728 - protein, 17 aa, Homo sapiens
  heavy chain complementarity determining region 3 for antibody 5864
ARNTMVGTWQRQGSLDH

SEQ ID NO: 11729 - protein, 9 aa, Homo sapiens
  light chain complementarity determining region 3 for antibody 5865
MQGTHWPIP

SEQ ID NO: 11730 - protein, 17 aa, Homo sapiens
  heavy chain complementarity determining region 3 for antibody 5865
ARNTMVGTWQRQGNLDH

SEQ ID NO: 11731 - protein, 9 aa, Homo sapiens
  light chain complementarity determining region 3 for antibody 5866
MQGTHWPIN

SEQ ID NO: 11732 - protein, 13 aa, Homo sapiens
  heavy chain complementarity determining region 3 for antibody 5866
AKGGSSAGPDFDY

SEQ ID NO: 11733 - protein, 9 aa, Homo sapiens
  light chain complementarity determining region 3 for antibody 5867
MQGTHWPIN

SEQ ID NO: 11734 - protein, 13 aa, Homo sapiens
  heavy chain complementarity determining region 3 for antibody 5867
AKEGSSAVPDFDY

SEQ ID NO: 11735 - protein, 9 aa, Homo sapiens
  light chain complementarity determining region 3 for antibody 5868
MQGTHWPIK

SEQ ID NO: 11736 - protein, 13 aa, Homo sapiens
  heavy chain complementarity determining region 3 for antibody 5868
AKEGSSAGPDFDY

SEQ ID NO: 11737 - protein, 9 aa, Homo sapiens
  light chain complementarity determining region 3 for antibody 5869
MQGTHWPHT

SEQ ID NO: 11738 - protein, 11 aa, Homo sapiens
  heavy chain complementarity determining region 3 for antibody 5869
VRVSTGWNFDY

SEQ ID NO: 11739 - protein, 9 aa, Homo sapiens
  light chain complementarity determining region 3 for antibody 5870
MQGTHWPHT

SEQ ID NO: 11740 - protein, 15 aa, Homo sapiens
  heavy chain complementarity determining region 3 for antibody 5870
GKEGPGSSGWLTGHY

SEQ ID NO: 11741 - protein, 9 aa, Homo sapiens
  light chain complementarity determining region 3 for antibody 5871
MQGTHWPHT

SEQ ID NO: 11742 - protein, 11 aa, Homo sapiens
  heavy chain complementarity determining region 3 for antibody 5871
ATIGQQWRLAH

SEQ ID NO: 11743 - protein, 9 aa, Homo sapiens
  light chain complementarity determining region 3 for antibody 5872
MQGTHWPHT

SEQ ID NO: 11744 - protein, 11 aa, Homo sapiens
  heavy chain complementarity determining region 3 for antibody 5872
ATFGQQWRLAY

SEQ ID NO: 11745 - protein, 9 aa, Homo sapiens
  light chain complementarity determining region 3 for antibody 5873
MQGTHWPHT

SEQ ID NO: 11746 - protein, 11 aa, Homo sapiens
  heavy chain complementarity determining region 3 for antibody 5873
ATFGQQWRLAN

SEQ ID NO: 11747 - protein, 9 aa, Homo sapiens
  light chain complementarity determining region 3 for antibody 5874
MQGTHWPHT

SEQ ID NO: 11748 - protein, 11 aa, Homo sapiens
  heavy chain complementarity determining region 3 for antibody 5874
ATFGQQWMLAH

SEQ ID NO: 11749 - protein, 9 aa, Homo sapiens
  light chain complementarity determining region 3 for antibody 5875
MQGTHWPHT

SEQ ID NO: 11750 - protein, 11 aa, Homo sapiens
  heavy chain complementarity determining region 3 for antibody 5875
ATFGQQWKLAH

SEQ ID NO: 11751 - protein, 9 aa, Homo sapiens
  light chain complementarity determining region 3 for antibody 5876
MQGTHWPHT

SEQ ID NO: 11752 - protein, 11 aa, Homo sapiens
  heavy chain complementarity determining region 3 for antibody 5876
ATFGQQLRLAH

SEQ ID NO: 11753 - protein, 9 aa, Homo sapiens
  light chain complementarity determining region 3 for antibody 5877
MQGTHWPHT

SEQ ID NO: 11754 - protein, 11 aa, Homo sapiens
  heavy chain complementarity determining region 3 for antibody 5877
ATFGISWYFSV

SEQ ID NO: 11755 - protein, 9 aa, Homo sapiens
  light chain complementarity determining region 3 for antibody 5878
MQGTHWPHT

SEQ ID NO: 11756 - protein, 11 aa, Homo sapiens
  heavy chain complementarity determining region 3 for antibody 5878
ATFGISWYFAG

SEQ ID NO: 11757 - protein, 9 aa, Homo sapiens
  light chain complementarity determining region 3 for antibody 5879
MQGTHWPHT

SEQ ID NO: 11758 - protein, 11 aa, Homo sapiens
  heavy chain complementarity determining region 3 for antibody 5879
ATFGHQWRLAH

SEQ ID NO: 11759 - protein, 9 aa, Homo sapiens
  light chain complementarity determining region 3 for antibody 5880
MQGTHWPHT

SEQ ID NO: 11760 - protein, 14 aa, Homo sapiens
  heavy chain complementarity determining region 3 for antibody 5880
ARGTTYNWNDGGIS

SEQ ID NO: 11761 - protein, 9 aa, Homo sapiens
  light chain complementarity determining region 3 for antibody 5881
MQGTHWPHT

SEQ ID NO: 11762 - protein, 13 aa, Homo sapiens
  heavy chain complementarity determining region 3 for antibody 5881
AKEGSSPGPDFDY

SEQ ID NO: 11763 - protein, 9 aa, Homo sapiens
  light chain complementarity determining region 3 for antibody 5882
MQGTHWPHT

SEQ ID NO: 11764 - protein, 11 aa, Homo sapiens
  heavy chain complementarity determining region 3 for antibody 5882
AAFGQQWRLPH

SEQ ID NO: 11765 - protein, 9 aa, Homo sapiens
  light chain complementarity determining region 3 for antibody 5883
MQGTHWPHT

SEQ ID NO: 11766 - protein, 11 aa, Homo sapiens
  heavy chain complementarity determining region 3 for antibody 5883
AAFGISWYFSG

SEQ ID NO: 11767 - protein, 9 aa, Homo sapiens
  light chain complementarity determining region 3 for antibody 5884
MQGTHWPHI

SEQ ID NO: 11768 - protein, 11 aa, Homo sapiens
  heavy chain complementarity determining region 3 for antibody 5884
ATFGQQWRLAH

SEQ ID NO: 11769 - protein, 9 aa, Homo sapiens
  light chain complementarity determining region 3 for antibody 5885
MQGTHWPGT

SEQ ID NO: 11770 - protein, 13 aa, Homo sapiens
  heavy chain complementarity determining region 3 for antibody 5885
TGGPNCFAGGCLA

SEQ ID NO: 11771 - protein, 9 aa, Homo sapiens
  light chain complementarity determining region 3 for antibody 5886
MQGTHWPGT

SEQ ID NO: 11772 - protein, 12 aa, Homo sapiens
  heavy chain complementarity determining region 3 for antibody 5886
ASGPLREVTGML

SEQ ID NO: 11773 - protein, 9 aa, Homo sapiens
  light chain complementarity determining region 3 for antibody 5887
MQGTHWPGT

SEQ ID NO: 11774 - protein, 17 aa, Homo sapiens
  heavy chain complementarity determining region 3 for antibody 5887
ARNTMVGAWQRQGNLDH

SEQ ID NO: 11775 - protein, 9 aa, Homo sapiens
  light chain complementarity determining region 3 for antibody 5888
MQGTHWPGT

SEQ ID NO: 11776 - protein, 11 aa, Homo sapiens
  heavy chain complementarity determining region 3 for antibody 5888
ARGGGVGTADY

SEQ ID NO: 11777 - protein, 9 aa, Homo sapiens
  light chain complementarity determining region 3 for antibody 5889
MQGTHWPGT

SEQ ID NO: 11778 - protein, 12 aa, Homo sapiens
  heavy chain complementarity determining region 3 for antibody 5889
AIVVPGRWDLDD

SEQ ID NO: 11779 - protein, 10 aa, Homo sapiens
  light chain complementarity determining region 3 for antibody 5890
MQGTHWPGGT

SEQ ID NO: 11780 - protein, 12 aa, Homo sapiens
  heavy chain complementarity determining region 3 for antibody 5890
TTWIKTSVWLDY

SEQ ID NO: 11781 - protein, 10 aa, Homo sapiens
  light chain complementarity determining region 3 for antibody 5891
MQGTHWPAWT

SEQ ID NO: 11782 - protein, 12 aa, Homo sapiens
  heavy chain complementarity determining region 3 for antibody 5891
TTWIRTSVWLDY

SEQ ID NO: 11783 - protein, 10 aa, Homo sapiens
  light chain complementarity determining region 3 for antibody 5892
MQGTHWPAWT

SEQ ID NO: 11784 - protein, 12 aa, Homo sapiens
  heavy chain complementarity determining region 3 for antibody 5892
TTWIKTSVWLNY

SEQ ID NO: 11785 - protein, 10 aa, Homo sapiens
  light chain complementarity determining region 3 for antibody 5893
MQGTHWPAWT

SEQ ID NO: 11786 - protein, 12 aa, Homo sapiens
  heavy chain complementarity determining region 3 for antibody 5893
TTWIKTSGWLDY

SEQ ID NO: 11787 - protein, 10 aa, Homo sapiens
  light chain complementarity determining region 3 for antibody 5894
MQGTHWPAWT

SEQ ID NO: 11788 - protein, 12 aa, Homo sapiens
  heavy chain complementarity determining region 3 for antibody 5894
TTWIKASVWLDY

SEQ ID NO: 11789 - protein, 10 aa, Homo sapiens
  light chain complementarity determining region 3 for antibody 5895
MQGTHWPAWT

SEQ ID NO: 11790 - protein, 13 aa, Homo sapiens
  heavy chain complementarity determining region 3 for antibody 5895
TKEGSSAGPDFVY

SEQ ID NO: 11791 - protein, 8 aa, Homo sapiens
  light chain complementarity determining region 3 for antibody 5896
MQGTHWPA

SEQ ID NO: 11792 - protein, 10 aa, Homo sapiens
  heavy chain complementarity determining region 3 for antibody 5896
VRETSGSYDI

SEQ ID NO: 11793 - protein, 10 aa, Homo sapiens
  light chain complementarity determining region 3 for antibody 5897
MQGTHWPAGT

SEQ ID NO: 11794 - protein, 12 aa, Homo sapiens
  heavy chain complementarity determining region 3 for antibody 5897
VTWIKTSVWLDY

SEQ ID NO: 11795 - protein, 8 aa, Homo sapiens
  light chain complementarity determining region 3 for antibody 5898
MQGTHWPA

SEQ ID NO: 11796 - protein, 12 aa, Homo sapiens
  heavy chain complementarity determining region 3 for antibody 5898
EIVVPGRWDLDD

SEQ ID NO: 11797 - protein, 8 aa, Homo sapiens
  light chain complementarity determining region 3 for antibody 5899
MQGTHWPA

SEQ ID NO: 11798 - protein, 12 aa, Homo sapiens
  heavy chain complementarity determining region 3 for antibody 5899
AIVGPGRWDLDD

SEQ ID NO: 11799 - protein, 8 aa, Homo sapiens
  light chain complementarity determining region 3 for antibody 5900
MQGTHSHQ

SEQ ID NO: 11800 - protein, 18 aa, Homo sapiens
  heavy chain complementarity determining region 3 for antibody 5900
VRGPSGAPGAMAYYYLDV

SEQ ID NO: 11801 - protein, 9 aa, Homo sapiens
  light chain complementarity determining region 3 for antibody 5901
MQGTHGRGT

SEQ ID NO: 11802 - protein, 16 aa, Homo sapiens
  heavy chain complementarity determining region 3 for antibody 5901
VRDLAGFTRGGSTFDY

SEQ ID NO: 11803 - protein, 9 aa, Homo sapiens
  light chain complementarity determining region 3 for antibody 5902
MQGTHGPGT

SEQ ID NO: 11804 - protein, 16 aa, Homo sapiens
  heavy chain complementarity determining region 3 for antibody 5902
ARGHTNPGERRGGSDF

SEQ ID NO: 11805 - protein, 10 aa, Homo sapiens
  light chain complementarity determining region 3 for antibody 5903
MQGTHGPAWT

SEQ ID NO: 11806 - protein, 12 aa, Homo sapiens
  heavy chain complementarity determining region 3 for antibody 5903
TTWIKTSVWLDY

SEQ ID NO: 11807 - protein, 9 aa, Homo sapiens
  light chain complementarity determining region 3 for antibody 5904
MQGTHCPHT

SEQ ID NO: 11808 - protein, 11 aa, Homo sapiens
  heavy chain complementarity determining region 3 for antibody 5904
ATFGQQWRLAH

SEQ ID NO: 11809 - protein, 9 aa, Homo sapiens
  light chain complementarity determining region 3 for antibody 5905
MQGSHWPYT

SEQ ID NO: 11810 - protein, 10 aa, Homo sapiens
  heavy chain complementarity determining region 3 for antibody 5905
ARERSGSYDI

SEQ ID NO: 11811 - protein, 10 aa, Homo sapiens
  light chain complementarity determining region 3 for antibody 5906
MQGSHWPPYT

SEQ ID NO: 11812 - protein, 17 aa, Homo sapiens
  heavy chain complementarity determining region 3 for antibody 5906
ARGALGYFDRSGSSFDY

SEQ ID NO: 11813 - protein, 10 aa, Homo sapiens
  light chain complementarity determining region 3 for antibody 5907
MQGPHWPAWT

SEQ ID NO: 11814 - protein, 12 aa, Homo sapiens
  heavy chain complementarity determining region 3 for antibody 5907
TTWIKTSVWLDY

SEQ ID NO: 11815 - protein, 9 aa, Homo sapiens
  light chain complementarity determining region 3 for antibody 5908
MQGKHWPWT

SEQ ID NO: 11816 - protein, 16 aa, Homo sapiens
  heavy chain complementarity determining region 3 for antibody 5908
ARGHTNPGERRGGSDF

SEQ ID NO: 11817 - protein, 9 aa, Homo sapiens
  light chain complementarity determining region 3 for antibody 5909
MQGKHWPHT

SEQ ID NO: 11818 - protein, 11 aa, Homo sapiens
  heavy chain complementarity determining region 3 for antibody 5909
ATFGISWYFSG

SEQ ID NO: 11819 - protein, 9 aa, Homo sapiens
  light chain complementarity determining region 3 for antibody 5910
MQFLQTSLT

SEQ ID NO: 11820 - protein, 10 aa, Homo sapiens
  heavy chain complementarity determining region 3 for antibody 5910
ARERSGSYDI

SEQ ID NO: 11821 - protein, 9 aa, Homo sapiens
  light chain complementarity determining region 3 for antibody 5911
MQFLQTPPT

SEQ ID NO: 11822 - protein, 10 aa, Homo sapiens
  heavy chain complementarity determining region 3 for antibody 5911
ARESSGSYDI

SEQ ID NO: 11823 - protein, 9 aa, Homo sapiens
  light chain complementarity determining region 3 for antibody 5912
MQFLQTPPT

SEQ ID NO: 11824 - protein, 10 aa, Homo sapiens
  heavy chain complementarity determining region 3 for antibody 5912
ARERSSSYDI

SEQ ID NO: 11825 - protein, 9 aa, Homo sapiens
  light chain complementarity determining region 3 for antibody 5913
MQFLQTPLT

SEQ ID NO: 11826 - protein, 18 aa, Homo sapiens
  heavy chain complementarity determining region 3 for antibody 5913
TTVLSQLLAGDWHLYFQH

SEQ ID NO: 11827 - protein, 9 aa, Homo sapiens
  light chain complementarity determining region 3 for antibody 5914
MQFLQTPLT

SEQ ID NO: 11828 - protein, 10 aa, Homo sapiens
  heavy chain complementarity determining region 3 for antibody 5914
GRERSGSYDI

SEQ ID NO: 11829 - protein, 9 aa, Homo sapiens
  light chain complementarity determining region 3 for antibody 5915
MQFLQTPLT

SEQ ID NO: 11830 - protein, 10 aa, Homo sapiens
  heavy chain complementarity determining region 3 for antibody 5915
ERERSGSYDI

SEQ ID NO: 11831 - protein, 9 aa, Homo sapiens
  light chain complementarity determining region 3 for antibody 5916
MQFLQTPLT

SEQ ID NO: 11832 - protein, 10 aa, Homo sapiens
  heavy chain complementarity determining region 3 for antibody 5916
CRDREGFGDV

SEQ ID NO: 11833 - protein, 9 aa, Homo sapiens
  light chain complementarity determining region 3 for antibody 5917
MQFLQTPLT

SEQ ID NO: 11834 - protein, 11 aa, Homo sapiens
  heavy chain complementarity determining region 3 for antibody 5917
ATFGQQWRLAH

SEQ ID NO: 11835 - protein, 9 aa, Homo sapiens
  light chain complementarity determining region 3 for antibody 5918
MQFLQTPLT

SEQ ID NO: 11836 - protein, 17 aa, Homo sapiens
  heavy chain complementarity determining region 3 for antibody 5918
ARNTMVGTWQRQGNLDH

SEQ ID NO: 11837 - protein, 9 aa, Homo sapiens
  light chain complementarity determining region 3 for antibody 5919
MQFLQTPLT

SEQ ID NO: 11838 - protein, 14 aa, Homo sapiens
  heavy chain complementarity determining region 3 for antibody 5919
ARGHFDSTGFRLDY

SEQ ID NO: 11839 - protein, 9 aa, Homo sapiens
  light chain complementarity determining region 3 for antibody 5920
MQFLQTPLT

SEQ ID NO: 11840 - protein, 18 aa, Homo sapiens
  heavy chain complementarity determining region 3 for antibody 5920
ARGDYPEARTGYFLDFDY

SEQ ID NO: 11841 - protein, 9 aa, Homo sapiens
  light chain complementarity determining region 3 for antibody 5921
MQFLQTPLT

SEQ ID NO: 11842 - protein, 10 aa, Homo sapiens
  heavy chain complementarity determining region 3 for antibody 5921
ARERSGYYDI

SEQ ID NO: 11843 - protein, 9 aa, Homo sapiens
  light chain complementarity determining region 3 for antibody 5922
MQFLQTPLT

SEQ ID NO: 11844 - protein, 10 aa, Homo sapiens
  heavy chain complementarity determining region 3 for antibody 5922
ARERSGSYNI

SEQ ID NO: 11845 - protein, 9 aa, Homo sapiens
  light chain complementarity determining region 3 for antibody 5923
MQFLQTPLT

SEQ ID NO: 11846 - protein, 10 aa, Homo sapiens
  heavy chain complementarity determining region 3 for antibody 5923
ARERSGSYDN

SEQ ID NO: 11847 - protein, 9 aa, Homo sapiens
  light chain complementarity determining region 3 for antibody 5924
MQFLQTPLT

SEQ ID NO: 11848 - protein, 10 aa, Homo sapiens
  heavy chain complementarity determining region 3 for antibody 5924
ARERSGSYDF

SEQ ID NO: 11849 - protein, 9 aa, Homo sapiens
  light chain complementarity determining region 3 for antibody 5925
MQFLQTPLT

SEQ ID NO: 11850 - protein, 10 aa, Homo sapiens
  heavy chain complementarity determining region 3 for antibody 5925
ARERSGFYDI

SEQ ID NO: 11851 - protein, 9 aa, Homo sapiens
  light chain complementarity determining region 3 for antibody 5926
MQFLQTPLT

SEQ ID NO: 11852 - protein, 10 aa, Homo sapiens
  heavy chain complementarity determining region 3 for antibody 5926
ARERSCSYDI

SEQ ID NO: 11853 - protein, 9 aa, Homo sapiens
  light chain complementarity determining region 3 for antibody 5927
MQFLQTPLT

SEQ ID NO: 11854 - protein, 10 aa, Homo sapiens
  heavy chain complementarity determining region 3 for antibody 5927
ARERCGSYDI

SEQ ID NO: 11855 - protein, 9 aa, Homo sapiens
  light chain complementarity determining region 3 for antibody 5928
MQFLQTPLT

SEQ ID NO: 11856 - protein, 11 aa, Homo sapiens
  heavy chain complementarity determining region 3 for antibody 5928
AREQHGQAPDY

SEQ ID NO: 11857 - protein, 9 aa, Homo sapiens
  light chain complementarity determining region 3 for antibody 5929
MQFLQTPLT

SEQ ID NO: 11858 - protein, 13 aa, Homo sapiens
  heavy chain complementarity determining region 3 for antibody 5929
AKDRGSGWYAWGY

SEQ ID NO: 11859 - protein, 9 aa, Homo sapiens
  light chain complementarity determining region 3 for antibody 5930
MQFLQTPLA

SEQ ID NO: 11860 - protein, 10 aa, Homo sapiens
  heavy chain complementarity determining region 3 for antibody 5930
ARERSGSYDI

SEQ ID NO: 11861 - protein, 9 aa, Homo sapiens
  light chain complementarity determining region 3 for antibody 5931
MQFLQTPHT

SEQ ID NO: 11862 - protein, 10 aa, Homo sapiens
  heavy chain complementarity determining region 3 for antibody 5931
ARERSGSYDI

SEQ ID NO: 11863 - protein, 9 aa, Homo sapiens
  light chain complementarity determining region 3 for antibody 5932
MQFLQSPLT

SEQ ID NO: 11864 - protein, 10 aa, Homo sapiens
  heavy chain complementarity determining region 3 for antibody 5932
ARERSGSYDI

SEQ ID NO: 11865 - protein, 9 aa, Homo sapiens
  light chain complementarity determining region 3 for antibody 5933
MQFLQIPLT

SEQ ID NO: 11866 - protein, 10 aa, Homo sapiens
  heavy chain complementarity determining region 3 for antibody 5933
ARERSGSYDI

SEQ ID NO: 11867 - protein, 9 aa, Homo sapiens
  light chain complementarity determining region 3 for antibody 5934
MQDTHWPHT

SEQ ID NO: 11868 - protein, 11 aa, Homo sapiens
  heavy chain complementarity determining region 3 for antibody 5934
ATFGQQWRLAH

SEQ ID NO: 11869 - protein, 9 aa, Homo sapiens
  light chain complementarity determining region 3 for antibody 5935
MQAVQTPWT

SEQ ID NO: 11870 - protein, 12 aa, Homo sapiens
  heavy chain complementarity determining region 3 for antibody 5935
ARLDWNYRAFDI

SEQ ID NO: 11871 - protein, 9 aa, Homo sapiens
  light chain complementarity determining region 3 for antibody 5936
MQATNWPWT

SEQ ID NO: 11872 - protein, 14 aa, Homo sapiens
  heavy chain complementarity determining region 3 for antibody 5936
VRDYCSGGTCYSGS

SEQ ID NO: 11873 - protein, 9 aa, Homo sapiens
  light chain complementarity determining region 3 for antibody 5937
MQATHWPWT

SEQ ID NO: 11874 - protein, 10 aa, Homo sapiens
  heavy chain complementarity determining region 3 for antibody 5937
CRDREGFGDV

SEQ ID NO: 11875 - protein, 9 aa, Homo sapiens
  light chain complementarity determining region 3 for antibody 5938
MQATHWPWT

SEQ ID NO: 11876 - protein, 12 aa, Homo sapiens
  heavy chain complementarity determining region 3 for antibody 5938
ARGPLRMSAGTS

SEQ ID NO: 11877 - protein, 9 aa, Homo sapiens
  light chain complementarity determining region 3 for antibody 5939
MQATHWPWT

SEQ ID NO: 11878 - protein, 12 aa, Homo sapiens
  heavy chain complementarity determining region 3 for antibody 5939
ARGPLRMAAGSS

SEQ ID NO: 11879 - protein, 9 aa, Homo sapiens
  light chain complementarity determining region 3 for antibody 5940
MQATHWPRT

SEQ ID NO: 11880 - protein, 15 aa, Homo sapiens
  heavy chain complementarity determining region 3 for antibody 5940
ARVGRPYHNAWYFDN

SEQ ID NO: 11881 - protein, 9 aa, Homo sapiens
  light chain complementarity determining region 3 for antibody 5941
MQATHWPRK

SEQ ID NO: 11882 - protein, 12 aa, Homo sapiens
  heavy chain complementarity determining region 3 for antibody 5941
STDVETTFPSVS

SEQ ID NO: 11883 - protein, 9 aa, Homo sapiens
  light chain complementarity determining region 3 for antibody 5942
MQATHGPRT

SEQ ID NO: 11884 - protein, 12 aa, Homo sapiens
  heavy chain complementarity determining region 3 for antibody 5942
STDVETTFPSVS

SEQ ID NO: 11885 - protein, 9 aa, Homo sapiens
  light chain complementarity determining region 3 for antibody 5943
MQALQTPYT

SEQ ID NO: 11886 - protein, 9 aa, Homo sapiens
  heavy chain complementarity determining region 3 for antibody 5943
ARSEYQPTY

SEQ ID NO: 11887 - protein, 9 aa, Homo sapiens
  light chain complementarity determining region 3 for antibody 5944
MQALQTPYT

SEQ ID NO: 11888 - protein, 17 aa, Homo sapiens
  heavy chain complementarity determining region 3 for antibody 5944
ARNTMVHGWQRQGSVDH

SEQ ID NO: 11889 - protein, 9 aa, Homo sapiens
  light chain complementarity determining region 3 for antibody 5945
MQALQTPYT

SEQ ID NO: 11890 - protein, 14 aa, Homo sapiens
  heavy chain complementarity determining region 3 for antibody 5945
ARDTTYNWNDGGIS

SEQ ID NO: 11891 - protein, 9 aa, Homo sapiens
  light chain complementarity determining region 3 for antibody 5946
MQALQTPYT

SEQ ID NO: 11892 - protein, 10 aa, Homo sapiens
  heavy chain complementarity determining region 3 for antibody 5946
AKDPSGGGGY

SEQ ID NO: 11893 - protein, 9 aa, Homo sapiens
  light chain complementarity determining region 3 for antibody 5947
MQALQTPYT

SEQ ID NO: 11894 - protein, 10 aa, Homo sapiens
  heavy chain complementarity determining region 3 for antibody 5947
AKDHSGGGGY

SEQ ID NO: 11895 - protein, 9 aa, Homo sapiens
  light chain complementarity determining region 3 for antibody 5948
MQALQTPYT

SEQ ID NO: 11896 - protein, 10 aa, Homo sapiens
  heavy chain complementarity determining region 3 for antibody 5948
AEDLSGGGGY

SEQ ID NO: 11897 - protein, 9 aa, Homo sapiens
  light chain complementarity determining region 3 for antibody 5949
MQALQTPWT

SEQ ID NO: 11898 - protein, 15 aa, Homo sapiens
  heavy chain complementarity determining region 3 for antibody 5949
ARDLSYENSGHAFHI

SEQ ID NO: 11899 - protein, 9 aa, Homo sapiens
  light chain complementarity determining region 3 for antibody 5950
MQALQTPVT

SEQ ID NO: 11900 - protein, 25 aa, Homo sapiens
  heavy chain complementarity determining region 3 for antibody 5950
ARDPGITIFGVVPPSPEPRLGYMDV

SEQ ID NO: 11901 - protein, 8 aa, Homo sapiens
  light chain complementarity determining region 3 for antibody 5951
MQALQTPT

SEQ ID NO: 11902 - protein, 17 aa, Homo sapiens
  heavy chain complementarity determining region 3 for antibody 5951
AKDVVNIAARPWSPFDY

SEQ ID NO: 11903 - protein, 9 aa, Homo sapiens
  light chain complementarity determining region 3 for antibody 5952
MQALQTPLT

SEQ ID NO: 11904 - protein, 21 aa, Homo sapiens
  heavy chain complementarity determining region 3 for antibody 5952
AKLNGRYCDTSGSTCGLWFDP

SEQ ID NO: 11905 - protein, 9 aa, Homo sapiens
  light chain complementarity determining region 3 for antibody 5953
MQALQTPLT

SEQ ID NO: 11906 - protein, 14 aa, Homo sapiens
  heavy chain complementarity determining region 3 for antibody 5953
AKGESTPCDYIFDF

SEQ ID NO: 11907 - protein, 10 aa, Homo sapiens
  light chain complementarity determining region 3 for antibody 5954
MQALQTPLLT

SEQ ID NO: 11908 - protein, 16 aa, Homo sapiens
  heavy chain complementarity determining region 3 for antibody 5954
AKERGQSSAWYGELDS

SEQ ID NO: 11909 - protein, 9 aa, Homo sapiens
  light chain complementarity determining region 3 for antibody 5955
MQALQTPKT

SEQ ID NO: 11910 - protein, 18 aa, Homo sapiens
  heavy chain complementarity determining region 3 for antibody 5955
TRDRRVGESSTYYNGMNV

SEQ ID NO: 11911 - protein, 9 aa, Homo sapiens
  light chain complementarity determining region 3 for antibody 5956
MQALQTPHT

SEQ ID NO: 11912 - protein, 15 aa, Homo sapiens
  heavy chain complementarity determining region 3 for antibody 5956
ARERRMFGELRGFDV

SEQ ID NO: 11913 - protein, 8 aa, Homo sapiens
  light chain complementarity determining region 3 for antibody 5957
MQALQTLP

SEQ ID NO: 11914 - protein, 12 aa, Homo sapiens
  heavy chain complementarity determining region 3 for antibody 5957
ARVTTVTAGRAY

SEQ ID NO: 11915 - protein, 9 aa, Homo sapiens
  light chain complementarity determining region 3 for antibody 5958
MQALQIPPT

SEQ ID NO: 11916 - protein, 11 aa, Homo sapiens
  heavy chain complementarity determining region 3 for antibody 5958
ARTLKYSYGLD

SEQ ID NO: 11917 - protein, 9 aa, Homo sapiens
  light chain complementarity determining region 3 for antibody 5959
MQALQAPPT

SEQ ID NO: 11918 - protein, 10 aa, Homo sapiens
  heavy chain complementarity determining region 3 for antibody 5959
TRHYDWHFDH

SEQ ID NO: 11919 - protein, 9 aa, Homo sapiens
  light chain complementarity determining region 3 for antibody 5960
MQALQAPPP

SEQ ID NO: 11920 - protein, 10 aa, Homo sapiens
  heavy chain complementarity determining region 3 for antibody 5960
TRHYNWHFDY

SEQ ID NO: 11921 - protein, 8 aa, Homo sapiens
  light chain complementarity determining region 3 for antibody 5961
MQALPRLT

SEQ ID NO: 11922 - protein, 8 aa, Homo sapiens
  heavy chain complementarity determining region 3 for antibody 5961
VSQTGQNY

SEQ ID NO: 11923 - protein, 8 aa, Homo sapiens
  light chain complementarity determining region 3 for antibody 5962
MQALNRLT

SEQ ID NO: 11924 - protein, 8 aa, Homo sapiens
  heavy chain complementarity determining region 3 for antibody 5962
VSQTGQNY

SEQ ID NO: 11925 - protein, 9 aa, Homo sapiens
  light chain complementarity determining region 3 for antibody 5963
MQALHTPYT

SEQ ID NO: 11926 - protein, 10 aa, Homo sapiens
  heavy chain complementarity determining region 3 for antibody 5963
AKDLSGGGGY

SEQ ID NO: 11927 - protein, 8 aa, Homo sapiens
  light chain complementarity determining region 3 for antibody 5964
MQALHRLT

SEQ ID NO: 11928 - protein, 8 aa, Homo sapiens
  heavy chain complementarity determining region 3 for antibody 5964
VGQTGQNY

SEQ ID NO: 11929 - protein, 9 aa, Homo sapiens
  light chain complementarity determining region 3 for antibody 5965
MQALHLPLP

SEQ ID NO: 11930 - protein, 15 aa, Homo sapiens
  heavy chain complementarity determining region 3 for antibody 5965
VRDPAGLAYFYNMEV

SEQ ID NO: 11931 - protein, 9 aa, Homo sapiens
  light chain complementarity determining region 3 for antibody 5966
MQAKHWPWT

SEQ ID NO: 11932 - protein, 12 aa, Homo sapiens
  heavy chain complementarity determining region 3 for antibody 5966
ARGPLKMAGGSS

SEQ ID NO: 11933 - protein, 9 aa, Homo sapiens
  light chain complementarity determining region 3 for antibody 5967
MQAKHWPRT

SEQ ID NO: 11934 - protein, 12 aa, Homo sapiens
  heavy chain complementarity determining region 3 for antibody 5967
AGSRSVGGSVDF

SEQ ID NO: 11935 - protein, 9 aa, Homo sapiens
  light chain complementarity determining region 3 for antibody 5968
MQAIQTPYT

SEQ ID NO: 11936 - protein, 10 aa, Homo sapiens
  heavy chain complementarity determining region 3 for antibody 5968
AKDLSGGGGY

SEQ ID NO: 11937 - protein, 6 aa, Homo sapiens
  light chain complementarity determining region 3 for antibody 5969
MPSTNW

SEQ ID NO: 11938 - protein, 19 aa, Homo sapiens
  heavy chain complementarity determining region 3 for antibody 5969
ARERVRCRSGICYDATFDI

SEQ ID NO: 11939 - protein, 9 aa, Homo sapiens
  light chain complementarity determining region 3 for antibody 5970
MPGTYWPYT

SEQ ID NO: 11940 - protein, 11 aa, Homo sapiens
  heavy chain complementarity determining region 3 for antibody 5970
AREGWGSLLDY

SEQ ID NO: 11941 - protein, 9 aa, Homo sapiens
  light chain complementarity determining region 3 for antibody 5971
MPGTHWPWT

SEQ ID NO: 11942 - protein, 16 aa, Homo sapiens
  heavy chain complementarity determining region 3 for antibody 5971
ARGHTNPGERRGGSDF

SEQ ID NO: 11943 - protein, 9 aa, Homo sapiens
  light chain complementarity determining region 3 for antibody 5972
MPGTHWPPS

SEQ ID NO: 11944 - protein, 13 aa, Homo sapiens
  heavy chain complementarity determining region 3 for antibody 5972
ARDTVTNKMGSDY

SEQ ID NO: 11945 - protein, 9 aa, Homo sapiens
  light chain complementarity determining region 3 for antibody 5973
MPALQTPYT

SEQ ID NO: 11946 - protein, 10 aa, Homo sapiens
  heavy chain complementarity determining region 3 for antibody 5973
AKDLSGGGGY

SEQ ID NO: 11947 - protein, 9 aa, Homo sapiens
  light chain complementarity determining region 3 for antibody 5974
MKTLQTPWT

SEQ ID NO: 11948 - protein, 12 aa, Homo sapiens
  heavy chain complementarity determining region 3 for antibody 5974
ARLDWNYRAFDI

SEQ ID NO: 11949 - protein, 9 aa, Homo sapiens
  light chain complementarity determining region 3 for antibody 5975
MHYTHRPHT

SEQ ID NO: 11950 - protein, 8 aa, Homo sapiens
  heavy chain complementarity determining region 3 for antibody 5975
AGWGYANY

SEQ ID NO: 11951 - protein, 9 aa, Homo sapiens
  light chain complementarity determining region 3 for antibody 5976
LQYYTAPWT

SEQ ID NO: 11952 - protein, 17 aa, Homo sapiens
  heavy chain complementarity determining region 3 for antibody 5976
SRDGRITWPGSQGSLDS

SEQ ID NO: 11953 - protein, 9 aa, Homo sapiens
  light chain complementarity determining region 3 for antibody 5977
LQYYTAPWT

SEQ ID NO: 11954 - protein, 14 aa, Homo sapiens
  heavy chain complementarity determining region 3 for antibody 5977
ARGHFDSTGFRLDY

SEQ ID NO: 11955 - protein, 9 aa, Homo sapiens
  light chain complementarity determining region 3 for antibody 5978
LQYNSYPLT

SEQ ID NO: 11956 - protein, 11 aa, Homo sapiens
  heavy chain complementarity determining region 3 for antibody 5978
VRVSTGWNFDY

SEQ ID NO: 11957 - protein, 9 aa, Homo sapiens
  light chain complementarity determining region 3 for antibody 5979
LQYNSYPHT

SEQ ID NO: 11958 - protein, 10 aa, Homo sapiens
  heavy chain complementarity determining region 3 for antibody 5979
ARDSLWAFDI

SEQ ID NO: 11959 - protein, 9 aa, Homo sapiens
  light chain complementarity determining region 3 for antibody 5980
LQYDTYPWT

SEQ ID NO: 11960 - protein, 9 aa, Homo sapiens
  heavy chain complementarity determining region 3 for antibody 5980
GRGHYGPDY

SEQ ID NO: 11961 - protein, 9 aa, Homo sapiens
  light chain complementarity determining region 3 for antibody 5981
LQYDSYPWT

SEQ ID NO: 11962 - protein, 10 aa, Homo sapiens
  heavy chain complementarity determining region 3 for antibody 5981
CRDRWGFGDV

SEQ ID NO: 11963 - protein, 9 aa, Homo sapiens
  light chain complementarity determining region 3 for antibody 5982
LQYDSYPWT

SEQ ID NO: 11964 - protein, 11 aa, Homo sapiens
  heavy chain complementarity determining region 3 for antibody 5982
ATFGQQWRLAH

SEQ ID NO: 11965 - protein, 9 aa, Homo sapiens
  light chain complementarity determining region 3 for antibody 5983
LQYDSYPWT

SEQ ID NO: 11966 - protein, 9 aa, Homo sapiens
  heavy chain complementarity determining region 3 for antibody 5983
ARGYYGPDY

SEQ ID NO: 11967 - protein, 9 aa, Homo sapiens
  light chain complementarity determining region 3 for antibody 5984
LQYDSYPWT

SEQ ID NO: 11968 - protein, 9 aa, Homo sapiens
  heavy chain complementarity determining region 3 for antibody 5984
ARGRYGPDY

SEQ ID NO: 11969 - protein, 9 aa, Homo sapiens
  light chain complementarity determining region 3 for antibody 5985
LQYDSYPWT

SEQ ID NO: 11970 - protein, 9 aa, Homo sapiens
  heavy chain complementarity determining region 3 for antibody 5985
ARGPYGPDY

SEQ ID NO: 11971 - protein, 9 aa, Homo sapiens
  light chain complementarity determining region 3 for antibody 5986
LQYDSYPWT

SEQ ID NO: 11972 - protein, 9 aa, Homo sapiens
  heavy chain complementarity determining region 3 for antibody 5986
ARGHYGHDY

SEQ ID NO: 11973 - protein, 9 aa, Homo sapiens
  light chain complementarity determining region 3 for antibody 5987
LQYAQWPHT

SEQ ID NO: 11974 - protein, 9 aa, Homo sapiens
  heavy chain complementarity determining region 3 for antibody 5987
AGWGGTSNY

SEQ ID NO: 11975 - protein, 9 aa, Homo sapiens
  light chain complementarity determining region 3 for antibody 5988
LQYAHWPRT

SEQ ID NO: 11976 - protein, 15 aa, Homo sapiens
  heavy chain complementarity determining region 3 for antibody 5988
ARVGRPYHNAWYFDN

SEQ ID NO: 11977 - protein, 9 aa, Homo sapiens
  light chain complementarity determining region 3 for antibody 5989
LQYAHWPNT

SEQ ID NO: 11978 - protein, 15 aa, Homo sapiens
  heavy chain complementarity determining region 3 for antibody 5989
ARVGRPYHNAWYFDN

SEQ ID NO: 11979 - protein, 9 aa, Homo sapiens
  light chain complementarity determining region 3 for antibody 5990
LQYAHWPNT

SEQ ID NO: 11980 - protein, 9 aa, Homo sapiens
  heavy chain complementarity determining region 3 for antibody 5990
AGWGGTSNY

SEQ ID NO: 11981 - protein, 9 aa, Homo sapiens
  light chain complementarity determining region 3 for antibody 5991
LQYAHWPHT

SEQ ID NO: 11982 - protein, 13 aa, Homo sapiens
  heavy chain complementarity determining region 3 for antibody 5991
TKEGSSAGPDFVY

SEQ ID NO: 11983 - protein, 9 aa, Homo sapiens
  light chain complementarity determining region 3 for antibody 5992
LQYAHWPHT

SEQ ID NO: 11984 - protein, 10 aa, Homo sapiens
  heavy chain complementarity determining region 3 for antibody 5992
CRDRWGFGDV

SEQ ID NO: 11985 - protein, 9 aa, Homo sapiens
  light chain complementarity determining region 3 for antibody 5993
LQYAHWPHT

SEQ ID NO: 11986 - protein, 15 aa, Homo sapiens
  heavy chain complementarity determining region 3 for antibody 5993
ARVGRPYHNAWYVDN

SEQ ID NO: 11987 - protein, 9 aa, Homo sapiens
  light chain complementarity determining region 3 for antibody 5994
LQYAHWPHT

SEQ ID NO: 11988 - protein, 15 aa, Homo sapiens
  heavy chain complementarity determining region 3 for antibody 5994
ARVGRPYHNAWYSDN

SEQ ID NO: 11989 - protein, 9 aa, Homo sapiens
  light chain complementarity determining region 3 for antibody 5995
LQYAHWPHT

SEQ ID NO: 11990 - protein, 15 aa, Homo sapiens
  heavy chain complementarity determining region 3 for antibody 5995
ARVGRPYHNALYFDN

SEQ ID NO: 11991 - protein, 9 aa, Homo sapiens
  light chain complementarity determining region 3 for antibody 5996
LQYAHWPHT

SEQ ID NO: 11992 - protein, 15 aa, Homo sapiens
  heavy chain complementarity determining region 3 for antibody 5996
ARVGRPDHNAWYFDN

SEQ ID NO: 11993 - protein, 9 aa, Homo sapiens
  light chain complementarity determining region 3 for antibody 5997
LQYAHWPHT

SEQ ID NO: 11994 - protein, 15 aa, Homo sapiens
  heavy chain complementarity determining region 3 for antibody 5997
ARVGGPYHNAWYFDN

SEQ ID NO: 11995 - protein, 9 aa, Homo sapiens
  light chain complementarity determining region 3 for antibody 5998
LQYAHWPHT

SEQ ID NO: 11996 - protein, 10 aa, Homo sapiens
  heavy chain complementarity determining region 3 for antibody 5998
ARERSGSYDI

SEQ ID NO: 11997 - protein, 9 aa, Homo sapiens
  light chain complementarity determining region 3 for antibody 5999
LQYAHWPHT

SEQ ID NO: 11998 - protein, 13 aa, Homo sapiens
  heavy chain complementarity determining region 3 for antibody 5999
AKDRGSGWFAWGY

SEQ ID NO: 11999 - protein, 9 aa, Homo sapiens
  light chain complementarity determining region 3 for antibody 6000
LQYAHWPHT

SEQ ID NO: 12000 - protein, 9 aa, Homo sapiens
  heavy chain complementarity determining region 3 for antibody 6000
AGWGGTSSY

SEQ ID NO: 12001 - protein, 9 aa, Homo sapiens
  light chain complementarity determining region 3 for antibody 6001
LQYAHWPHT

SEQ ID NO: 12002 - protein, 9 aa, Homo sapiens
  heavy chain complementarity determining region 3 for antibody 6001
AGWGGTSNP

SEQ ID NO: 12003 - protein, 9 aa, Homo sapiens
  light chain complementarity determining region 3 for antibody 6002
LQYAHWPHT

SEQ ID NO: 12004 - protein, 9 aa, Homo sapiens
  heavy chain complementarity determining region 3 for antibody 6002
AAWGGPSNY

SEQ ID NO: 12005 - protein, 9 aa, Homo sapiens
  light chain complementarity determining region 3 for antibody 6003
LQYAHWPHN

SEQ ID NO: 12006 - protein, 15 aa, Homo sapiens
  heavy chain complementarity determining region 3 for antibody 6003
ARVGRPYHNAWYFDN

SEQ ID NO: 12007 - protein, 9 aa, Homo sapiens
  light chain complementarity determining region 3 for antibody 6004
LQYAHLPHT

SEQ ID NO: 12008 - protein, 15 aa, Homo sapiens
  heavy chain complementarity determining region 3 for antibody 6004
ARVGRPYHNAWYFDN

SEQ ID NO: 12009 - protein, 9 aa, Homo sapiens
  light chain complementarity determining region 3 for antibody 6005
LQTLHWPGT

SEQ ID NO: 12010 - protein, 10 aa, Homo sapiens
  heavy chain complementarity determining region 3 for antibody 6005
VRLPSRACDF

SEQ ID NO: 12011 - protein, 9 aa, Homo sapiens
  light chain complementarity determining region 3 for antibody 6006
LQTIHWPRT

SEQ ID NO: 12012 - protein, 10 aa, Homo sapiens
  heavy chain complementarity determining region 3 for antibody 6006
TRLPSRASDF

SEQ ID NO: 12013 - protein, 9 aa, Homo sapiens
  light chain complementarity determining region 3 for antibody 6007
LQTATPPRT

SEQ ID NO: 12014 - protein, 13 aa, Homo sapiens
  heavy chain complementarity determining region 3 for antibody 6007
ARGSTATSWNIDY

SEQ ID NO: 12015 - protein, 9 aa, Homo sapiens
  light chain complementarity determining region 3 for antibody 6008
LQSAHWPHT

SEQ ID NO: 12016 - protein, 15 aa, Homo sapiens
  heavy chain complementarity determining region 3 for antibody 6008
ARVGRPYHNAWYFDN

SEQ ID NO: 12017 - protein, 11 aa, Homo sapiens
  light chain complementarity determining region 3 for antibody 6009
LQPNSYPPMYT

SEQ ID NO: 12018 - protein, 13 aa, Homo sapiens
  heavy chain complementarity determining region 3 for antibody 6009
AKEGSSPGPDFEY

SEQ ID NO: 12019 - protein, 9 aa, Homo sapiens
  light chain complementarity determining region 3 for antibody 6010
LQNDSSPYT

SEQ ID NO: 12020 - protein, 16 aa, Homo sapiens
  heavy chain complementarity determining region 3 for antibody 6010
TSDFRYGSSIWYWGAV

SEQ ID NO: 12021 - protein, 9 aa, Homo sapiens
  light chain complementarity determining region 3 for antibody 6011
LQHYTAPLT

SEQ ID NO: 12022 - protein, 17 aa, Homo sapiens
  heavy chain complementarity determining region 3 for antibody 6011
SRDGRIIWPGSQGSLDS

SEQ ID NO: 12023 - protein, 9 aa, Homo sapiens
  light chain complementarity determining region 3 for antibody 6012
LQHYSYPLT

SEQ ID NO: 12024 - protein, 11 aa, Homo sapiens
  heavy chain complementarity determining region 3 for antibody 6012
VRVSTGWNFDY

SEQ ID NO: 12025 - protein, 9 aa, Homo sapiens
  light chain complementarity determining region 3 for antibody 6013
LQHTTYPWT

SEQ ID NO: 12026 - protein, 13 aa, Homo sapiens
  heavy chain complementarity determining region 3 for antibody 6013
ARGTTATSWNIDY

SEQ ID NO: 12027 - protein, 9 aa, Homo sapiens
  light chain complementarity determining region 3 for antibody 6014
LQHTTYPWT

SEQ ID NO: 12028 - protein, 12 aa, Homo sapiens
  heavy chain complementarity determining region 3 for antibody 6014
ARDLAGAPYFDS

SEQ ID NO: 12029 - protein, 9 aa, Homo sapiens
  light chain complementarity determining region 3 for antibody 6015
LQHRSYPWT

SEQ ID NO: 12030 - protein, 18 aa, Homo sapiens
  heavy chain complementarity determining region 3 for antibody 6015
VRGPSGAPGAMAYCYLDV

SEQ ID NO: 12031 - protein, 9 aa, Homo sapiens
  light chain complementarity determining region 3 for antibody 6016
LQHNTYPVT

SEQ ID NO: 12032 - protein, 10 aa, Homo sapiens
  heavy chain complementarity determining region 3 for antibody 6016
ATVAGITNDY

SEQ ID NO: 12033 - protein, 9 aa, Homo sapiens
  light chain complementarity determining region 3 for antibody 6017
LQHNSYSLT

SEQ ID NO: 12034 - protein, 10 aa, Homo sapiens
  heavy chain complementarity determining region 3 for antibody 6017
CRDRWGFGDV

SEQ ID NO: 12035 - protein, 9 aa, Homo sapiens
  light chain complementarity determining region 3 for antibody 6018
LQHNSYPWT

SEQ ID NO: 12036 - protein, 12 aa, Homo sapiens
  heavy chain complementarity determining region 3 for antibody 6018
NADHGYVDGFDI

SEQ ID NO: 12037 - protein, 9 aa, Homo sapiens
  light chain complementarity determining region 3 for antibody 6019
LQHNSYPWT

SEQ ID NO: 12038 - protein, 9 aa, Homo sapiens
  heavy chain complementarity determining region 3 for antibody 6019
ARSEYQPTY

SEQ ID NO: 12039 - protein, 9 aa, Homo sapiens
  light chain complementarity determining region 3 for antibody 6020
LQHNSYPWT

SEQ ID NO: 12040 - protein, 17 aa, Homo sapiens
  heavy chain complementarity determining region 3 for antibody 6020
ARNSMVGTWQRQGNLDH

SEQ ID NO: 12041 - protein, 9 aa, Homo sapiens
  light chain complementarity determining region 3 for antibody 6021
LQHNSYPWT

SEQ ID NO: 12042 - protein, 14 aa, Homo sapiens
  heavy chain complementarity determining region 3 for antibody 6021
AKYRASIGARCFDP

SEQ ID NO: 12043 - protein, 11 aa, Homo sapiens
  light chain complementarity determining region 3 for antibody 6022
LQHNSYPPMYT

SEQ ID NO: 12044 - protein, 13 aa, Homo sapiens
  heavy chain complementarity determining region 3 for antibody 6022
AKEGSSPGPDFDY

SEQ ID NO: 12045 - protein, 11 aa, Homo sapiens
  light chain complementarity determining region 3 for antibody 6023
LQHNSYPPMYT

SEQ ID NO: 12046 - protein, 13 aa, Homo sapiens
  heavy chain complementarity determining region 3 for antibody 6023
AEEGSSPGPDFEY

SEQ ID NO: 12047 - protein, 10 aa, Homo sapiens
  light chain complementarity determining region 3 for antibody 6024
LQHNSYPMYT

SEQ ID NO: 12048 - protein, 12 aa, Homo sapiens
  heavy chain complementarity determining region 3 for antibody 6024
AREGMTTKEFVY

SEQ ID NO: 12049 - protein, 9 aa, Homo sapiens
  light chain complementarity determining region 3 for antibody 6025
LQHNSYPLT

SEQ ID NO: 12050 - protein, 11 aa, Homo sapiens
  heavy chain complementarity determining region 3 for antibody 6025
VRVSTGWYFDY

SEQ ID NO: 12051 - protein, 9 aa, Homo sapiens
  light chain complementarity determining region 3 for antibody 6026
LQHNSYPLT

SEQ ID NO: 12052 - protein, 11 aa, Homo sapiens
  heavy chain complementarity determining region 3 for antibody 6026
VRVSTGWNFAY

SEQ ID NO: 12053 - protein, 9 aa, Homo sapiens
  light chain complementarity determining region 3 for antibody 6027
LQHNSYPLT

SEQ ID NO: 12054 - protein, 11 aa, Homo sapiens
  heavy chain complementarity determining region 3 for antibody 6027
VRVSIGWNFDY

SEQ ID NO: 12055 - protein, 9 aa, Homo sapiens
  light chain complementarity determining region 3 for antibody 6028
LQHNSYPLT

SEQ ID NO: 12056 - protein, 11 aa, Homo sapiens
  heavy chain complementarity determining region 3 for antibody 6028
VRVCTGWNFDY

SEQ ID NO: 12057 - protein, 9 aa, Homo sapiens
  light chain complementarity determining region 3 for antibody 6029
LQHNSYPLT

SEQ ID NO: 12058 - protein, 11 aa, Homo sapiens
  heavy chain complementarity determining region 3 for antibody 6029
VRASTGWNFDY

SEQ ID NO: 12059 - protein, 9 aa, Homo sapiens
  light chain complementarity determining region 3 for antibody 6030
LQHNSYPLT

SEQ ID NO: 12060 - protein, 13 aa, Homo sapiens
  heavy chain complementarity determining region 3 for antibody 6030
TREGDSSGPDFHL

SEQ ID NO: 12061 - protein, 9 aa, Homo sapiens
  light chain complementarity determining region 3 for antibody 6031
LQHNSYPLT

SEQ ID NO: 12062 - protein, 11 aa, Homo sapiens
  heavy chain complementarity determining region 3 for antibody 6031
MRVSTGWNFDY

SEQ ID NO: 12063 - protein, 9 aa, Homo sapiens
  light chain complementarity determining region 3 for antibody 6032
LQHNSYPLT

SEQ ID NO: 12064 - protein, 11 aa, Homo sapiens
  heavy chain complementarity determining region 3 for antibody 6032
LRVSTGWNFDY

SEQ ID NO: 12065 - protein, 9 aa, Homo sapiens
  light chain complementarity determining region 3 for antibody 6033
LQHNSYPLT

SEQ ID NO: 12066 - protein, 10 aa, Homo sapiens
  heavy chain complementarity determining region 3 for antibody 6033
CRDSWGFGDV

SEQ ID NO: 12067 - protein, 9 aa, Homo sapiens
  light chain complementarity determining region 3 for antibody 6034
LQHNSYPLT

SEQ ID NO: 12068 - protein, 10 aa, Homo sapiens
  heavy chain complementarity determining region 3 for antibody 6034
CRDRWVFGDV

SEQ ID NO: 12069 - protein, 9 aa, Homo sapiens
  light chain complementarity determining region 3 for antibody 6035
LQHNSYPLT

SEQ ID NO: 12070 - protein, 10 aa, Homo sapiens
  heavy chain complementarity determining region 3 for antibody 6035
CRDRWGLGDV

SEQ ID NO: 12071 - protein, 9 aa, Homo sapiens
  light chain complementarity determining region 3 for antibody 6036
LQHNSYPLT

SEQ ID NO: 12072 - protein, 10 aa, Homo sapiens
  heavy chain complementarity determining region 3 for antibody 6036
CRDRRGFGDV

SEQ ID NO: 12073 - protein, 9 aa, Homo sapiens
  light chain complementarity determining region 3 for antibody 6037
LQHNSYPLT

SEQ ID NO: 12074 - protein, 10 aa, Homo sapiens
  heavy chain complementarity determining region 3 for antibody 6037
CRDRCGFGDV

SEQ ID NO: 12075 - protein, 9 aa, Homo sapiens
  light chain complementarity determining region 3 for antibody 6038
LQHNSYPLT

SEQ ID NO: 12076 - protein, 10 aa, Homo sapiens
  heavy chain complementarity determining region 3 for antibody 6038
CGDRWGFGDV

SEQ ID NO: 12077 - protein, 9 aa, Homo sapiens
  light chain complementarity determining region 3 for antibody 6039
LQHNSYPLT

SEQ ID NO: 12078 - protein, 11 aa, Homo sapiens
  heavy chain complementarity determining region 3 for antibody 6039
ATFGQQWRLAH

SEQ ID NO: 12079 - protein, 9 aa, Homo sapiens
  light chain complementarity determining region 3 for antibody 6040
LQHNSYPLT

SEQ ID NO: 12080 - protein, 11 aa, Homo sapiens
  heavy chain complementarity determining region 3 for antibody 6040
ARRSLGGAFDY

SEQ ID NO: 12081 - protein, 9 aa, Homo sapiens
  light chain complementarity determining region 3 for antibody 6041
LQHNSYPLT

SEQ ID NO: 12082 - protein, 15 aa, Homo sapiens
  heavy chain complementarity determining region 3 for antibody 6041
ARIGTSSTNCRYMDV

SEQ ID NO: 12083 - protein, 9 aa, Homo sapiens
  light chain complementarity determining region 3 for antibody 6042
LQHNSYPLT

SEQ ID NO: 12084 - protein, 19 aa, Homo sapiens
  heavy chain complementarity determining region 3 for antibody 6042
ARERVRCRSGICYDATFDI

SEQ ID NO: 12085 - protein, 9 aa, Homo sapiens
  light chain complementarity determining region 3 for antibody 6043
LQHNSYPLT

SEQ ID NO: 12086 - protein, 20 aa, Homo sapiens
  heavy chain complementarity determining region 3 for antibody 6043
AKDGRGIDTYHSAGGGGLDV

SEQ ID NO: 12087 - protein, 9 aa, Homo sapiens
  light chain complementarity determining region 3 for antibody 6044
LQHNSYHLT

SEQ ID NO: 12088 - protein, 10 aa, Homo sapiens
  heavy chain complementarity determining region 3 for antibody 6044
CRDRWGFGDV

SEQ ID NO: 12089 - protein, 9 aa, Homo sapiens
  light chain complementarity determining region 3 for antibody 6045
LQHNSFPLT

SEQ ID NO: 12090 - protein, 11 aa, Homo sapiens
  heavy chain complementarity determining region 3 for antibody 6045
VRVSTGWNFDY

SEQ ID NO: 12091 - protein, 9 aa, Homo sapiens
  light chain complementarity determining region 3 for antibody 6046
LQHNNYPLS

SEQ ID NO: 12092 - protein, 11 aa, Homo sapiens
  heavy chain complementarity determining region 3 for antibody 6046
VRVSTGWYLDY

SEQ ID NO: 12093 - protein, 9 aa, Homo sapiens
  light chain complementarity determining region 3 for antibody 6047
LQHNIYPWT

SEQ ID NO: 12094 - protein, 12 aa, Homo sapiens
  heavy chain complementarity determining region 3 for antibody 6047
AKKGATTGDFDS

SEQ ID NO: 12095 - protein, 9 aa, Homo sapiens
  light chain complementarity determining region 3 for antibody 6048
LQHNDYPLS

SEQ ID NO: 12096 - protein, 11 aa, Homo sapiens
  heavy chain complementarity determining region 3 for antibody 6048
VRVSTGWYFDY

SEQ ID NO: 12097 - protein, 9 aa, Homo sapiens
  light chain complementarity determining region 3 for antibody 6049
LQHHSYPLT

SEQ ID NO: 12098 - protein, 11 aa, Homo sapiens
  heavy chain complementarity determining region 3 for antibody 6049
VRVSTGWNFDY

SEQ ID NO: 12099 - protein, 9 aa, Homo sapiens
  light chain complementarity determining region 3 for antibody 6050
LQHDYFPWT

SEQ ID NO: 12100 - protein, 19 aa, Homo sapiens
  heavy chain complementarity determining region 3 for antibody 6050
ASWAGYCPSANCHTTPFDY

SEQ ID NO: 12101 - protein, 9 aa, Homo sapiens
  light chain complementarity determining region 3 for antibody 6051
LQHDSYPRT

SEQ ID NO: 12102 - protein, 16 aa, Homo sapiens
  heavy chain complementarity determining region 3 for antibody 6051
SRDGGGGSWHGTGVDY

SEQ ID NO: 12103 - protein, 9 aa, Homo sapiens
  light chain complementarity determining region 3 for antibody 6052
LQHDSSPYT

SEQ ID NO: 12104 - protein, 16 aa, Homo sapiens
  heavy chain complementarity determining region 3 for antibody 6052
TSDFRHGSSIWYWGAV

SEQ ID NO: 12105 - protein, 9 aa, Homo sapiens
  light chain complementarity determining region 3 for antibody 6053
LQHDSSPYA

SEQ ID NO: 12106 - protein, 16 aa, Homo sapiens
  heavy chain complementarity determining region 3 for antibody 6053
TSDFRYGSSIWYWGAV

SEQ ID NO: 12107 - protein, 9 aa, Homo sapiens
  light chain complementarity determining region 3 for antibody 6054
LQHAHWPHT

SEQ ID NO: 12108 - protein, 9 aa, Homo sapiens
  heavy chain complementarity determining region 3 for antibody 6054
AGWGGTSNY

SEQ ID NO: 12109 - protein, 9 aa, Homo sapiens
  light chain complementarity determining region 3 for antibody 6055
LQGTYGPKT

SEQ ID NO: 12110 - protein, 10 aa, Homo sapiens
  heavy chain complementarity determining region 3 for antibody 6055
ARDFREGEVY

SEQ ID NO: 12111 - protein, 9 aa, Homo sapiens
  light chain complementarity determining region 3 for antibody 6056
LQGTHWPWT

SEQ ID NO: 12112 - protein, 16 aa, Homo sapiens
  heavy chain complementarity determining region 3 for antibody 6056
ARGHTNPGERRGGSDF

SEQ ID NO: 12113 - protein, 9 aa, Homo sapiens
  light chain complementarity determining region 3 for antibody 6057
LQGTHWPPS

SEQ ID NO: 12114 - protein, 13 aa, Homo sapiens
  heavy chain complementarity determining region 3 for antibody 6057
ARDTVTNKMGSDY

SEQ ID NO: 12115 - protein, 9 aa, Homo sapiens
  light chain complementarity determining region 3 for antibody 6058
LQGLQVPFT

SEQ ID NO: 12116 - protein, 12 aa, Homo sapiens
  heavy chain complementarity determining region 3 for antibody 6058
STDVETTFPSVS

SEQ ID NO: 12117 - protein, 9 aa, Homo sapiens
  light chain complementarity determining region 3 for antibody 6059
LQGLQVPFP

SEQ ID NO: 12118 - protein, 11 aa, Homo sapiens
  heavy chain complementarity determining region 3 for antibody 6059
GRDVDYSTPGF

SEQ ID NO: 12119 - protein, 9 aa, Homo sapiens
  light chain complementarity determining region 3 for antibody 6060
LQGLQAPFT

SEQ ID NO: 12120 - protein, 11 aa, Homo sapiens
  heavy chain complementarity determining region 3 for antibody 6060
GRDVDYSPPGF

SEQ ID NO: 12121 - protein, 9 aa, Homo sapiens
  light chain complementarity determining region 3 for antibody 6061
LQGLQAPFT

SEQ ID NO: 12122 - protein, 11 aa, Homo sapiens
  heavy chain complementarity determining region 3 for antibody 6061
GRDVDYSAPGF

SEQ ID NO: 12123 - protein, 9 aa, Homo sapiens
  light chain complementarity determining region 3 for antibody 6062
LQGLQAPFT

SEQ ID NO: 12124 - protein, 11 aa, Homo sapiens
  heavy chain complementarity determining region 3 for antibody 6062
GRDGDYSTPGF

SEQ ID NO: 12125 - protein, 9 aa, Homo sapiens
  light chain complementarity determining region 3 for antibody 6063
LQFYTAPWT

SEQ ID NO: 12126 - protein, 17 aa, Homo sapiens
  heavy chain complementarity determining region 3 for antibody 6063
SRDGRIEWPGSHGSLDS

SEQ ID NO: 12127 - protein, 9 aa, Homo sapiens
  light chain complementarity determining region 3 for antibody 6064
LQFVHWPHT

SEQ ID NO: 12128 - protein, 9 aa, Homo sapiens
  heavy chain complementarity determining region 3 for antibody 6064
AGWGGLSNY

SEQ ID NO: 12129 - protein, 9 aa, Homo sapiens
  light chain complementarity determining region 3 for antibody 6065
LQFSHWPHT

SEQ ID NO: 12130 - protein, 9 aa, Homo sapiens
  heavy chain complementarity determining region 3 for antibody 6065
AGWGGLSNY

SEQ ID NO: 12131 - protein, 9 aa, Homo sapiens
  light chain complementarity determining region 3 for antibody 6066
LQFLQTPPT

SEQ ID NO: 12132 - protein, 10 aa, Homo sapiens
  heavy chain complementarity determining region 3 for antibody 6066
ARERSGSYDI

SEQ ID NO: 12133 - protein, 9 aa, Homo sapiens
  light chain complementarity determining region 3 for antibody 6067
LQFEHWPHT

SEQ ID NO: 12134 - protein, 9 aa, Homo sapiens
  heavy chain complementarity determining region 3 for antibody 6067
AGWGGLSNY

SEQ ID NO: 12135 - protein, 9 aa, Homo sapiens
  light chain complementarity determining region 3 for antibody 6068
LQFAYWPHT

SEQ ID NO: 12136 - protein, 9 aa, Homo sapiens
  heavy chain complementarity determining region 3 for antibody 6068
AGWGGLSNY

SEQ ID NO: 12137 - protein, 9 aa, Homo sapiens
  light chain complementarity determining region 3 for antibody 6069
LQFATWPHT

SEQ ID NO: 12138 - protein, 9 aa, Homo sapiens
  heavy chain complementarity determining region 3 for antibody 6069
AGWGGLSNY

SEQ ID NO: 12139 - protein, 9 aa, Homo sapiens
  light chain complementarity determining region 3 for antibody 6070
LQFANFPRT

SEQ ID NO: 12140 - protein, 9 aa, Homo sapiens
  heavy chain complementarity determining region 3 for antibody 6070
ARGRSNFRY

SEQ ID NO: 12141 - protein, 9 aa, Homo sapiens
  light chain complementarity determining region 3 for antibody 6071
LQFAHWPHT

SEQ ID NO: 12142 - protein, 11 aa, Homo sapiens
  heavy chain complementarity determining region 3 for antibody 6071
VRVSTGWNFDY

SEQ ID NO: 12143 - protein, 9 aa, Homo sapiens
  light chain complementarity determining region 3 for antibody 6072
LQFAHWPHT

SEQ ID NO: 12144 - protein, 16 aa, Homo sapiens
  heavy chain complementarity determining region 3 for antibody 6072
VRDLAGFTRGGSTFDY

SEQ ID NO: 12145 - protein, 9 aa, Homo sapiens
  light chain complementarity determining region 3 for antibody 6073
LQFAHWPHT

SEQ ID NO: 12146 - protein, 17 aa, Homo sapiens
  heavy chain complementarity determining region 3 for antibody 6073
ARNTMVGTWQRQGNLDH

SEQ ID NO: 12147 - protein, 9 aa, Homo sapiens
  light chain complementarity determining region 3 for antibody 6074
LQFAHWPHT

SEQ ID NO: 12148 - protein, 13 aa, Homo sapiens
  heavy chain complementarity determining region 3 for antibody 6074
AKEGSSPGPDFEY

SEQ ID NO: 12149 - protein, 9 aa, Homo sapiens
  light chain complementarity determining region 3 for antibody 6075
LQFAHWPHT

SEQ ID NO: 12150 - protein, 9 aa, Homo sapiens
  heavy chain complementarity determining region 3 for antibody 6075
AGWGGSSNY

SEQ ID NO: 12151 - protein, 9 aa, Homo sapiens
  light chain complementarity determining region 3 for antibody 6076
LQFAHWPHT

SEQ ID NO: 12152 - protein, 9 aa, Homo sapiens
  heavy chain complementarity determining region 3 for antibody 6076
AGWGGLLNY

SEQ ID NO: 12153 - protein, 9 aa, Homo sapiens
  light chain complementarity determining region 3 for antibody 6077
LQFAHWHHT

SEQ ID NO: 12154 - protein, 9 aa, Homo sapiens
  heavy chain complementarity determining region 3 for antibody 6077
AGWGGLSNY

SEQ ID NO: 12155 - protein, 9 aa, Homo sapiens
  light chain complementarity determining region 3 for antibody 6078
LQDYTYPFS

SEQ ID NO: 12156 - protein, 16 aa, Homo sapiens
  heavy chain complementarity determining region 3 for antibody 6078
ATDVGDRSDRFTTLDY

SEQ ID NO: 12157 - protein, 9 aa, Homo sapiens
  light chain complementarity determining region 3 for antibody 6079
LQDYTYPFS

SEQ ID NO: 12158 - protein, 16 aa, Homo sapiens
  heavy chain complementarity determining region 3 for antibody 6079
ATDVGDHRDRFTTLDY

SEQ ID NO: 12159 - protein, 9 aa, Homo sapiens
  light chain complementarity determining region 3 for antibody 6080
LQDYTYPFS

SEQ ID NO: 12160 - protein, 16 aa, Homo sapiens
  heavy chain complementarity determining region 3 for antibody 6080
AADVGDHSDRFTTLDY

SEQ ID NO: 12161 - protein, 9 aa, Homo sapiens
  light chain complementarity determining region 3 for antibody 6081
LQDYTYPFS

SEQ ID NO: 12162 - protein, 16 aa, Homo sapiens
  heavy chain complementarity determining region 3 for antibody 6081
AADLGDHADAYATLDS

SEQ ID NO: 12163 - protein, 9 aa, Homo sapiens
  light chain complementarity determining region 3 for antibody 6082
LQDYSYPPS

SEQ ID NO: 12164 - protein, 16 aa, Homo sapiens
  heavy chain complementarity determining region 3 for antibody 6082
TADVGDHRDRYVTLDH

SEQ ID NO: 12165 - protein, 9 aa, Homo sapiens
  light chain complementarity determining region 3 for antibody 6083
LQDYSYPLS

SEQ ID NO: 12166 - protein, 16 aa, Homo sapiens
  heavy chain complementarity determining region 3 for antibody 6083
VTEVGDHRDRYTTLDY

SEQ ID NO: 12167 - protein, 9 aa, Homo sapiens
  light chain complementarity determining region 3 for antibody 6084
LQDYSYPLS

SEQ ID NO: 12168 - protein, 16 aa, Homo sapiens
  heavy chain complementarity determining region 3 for antibody 6084
VSDVGDHRDMYTTLDY

SEQ ID NO: 12169 - protein, 9 aa, Homo sapiens
  light chain complementarity determining region 3 for antibody 6085
LQDYSYPLS

SEQ ID NO: 12170 - protein, 16 aa, Homo sapiens
  heavy chain complementarity determining region 3 for antibody 6085
TEEVGDHRDRYVTLDH

SEQ ID NO: 12171 - protein, 9 aa, Homo sapiens
  light chain complementarity determining region 3 for antibody 6086
LQDYSYPLS

SEQ ID NO: 12172 - protein, 16 aa, Homo sapiens
  heavy chain complementarity determining region 3 for antibody 6086
TADLGDHRDRYVTLDH

SEQ ID NO: 12173 - protein, 9 aa, Homo sapiens
  light chain complementarity determining region 3 for antibody 6087
LQDYSYPFS

SEQ ID NO: 12174 - protein, 16 aa, Homo sapiens
  heavy chain complementarity determining region 3 for antibody 6087
STDVGDHRDRFTTLDY

SEQ ID NO: 12175 - protein, 9 aa, Homo sapiens
  light chain complementarity determining region 3 for antibody 6088
LQDYNYVGT

SEQ ID NO: 12176 - protein, 9 aa, Homo sapiens
  heavy chain complementarity determining region 3 for antibody 6088
GSRRPYFDS

SEQ ID NO: 12177 - protein, 9 aa, Homo sapiens
  light chain complementarity determining region 3 for antibody 6089
LQDYNYPFS

SEQ ID NO: 12178 - protein, 16 aa, Homo sapiens
  heavy chain complementarity determining region 3 for antibody 6089
AADLDDHTDAYATLDS

SEQ ID NO: 12179 - protein, 9 aa, Homo sapiens
  light chain complementarity determining region 3 for antibody 6090
LQDYNPVGT

SEQ ID NO: 12180 - protein, 9 aa, Homo sapiens
  heavy chain complementarity determining region 3 for antibody 6090
GSRRPYFDY

SEQ ID NO: 12181 - protein, 9 aa, Homo sapiens
  light chain complementarity determining region 3 for antibody 6091
LQDYNHVRT

SEQ ID NO: 12182 - protein, 9 aa, Homo sapiens
  heavy chain complementarity determining region 3 for antibody 6091
GSRRPYFDS

SEQ ID NO: 12183 - protein, 9 aa, Homo sapiens
  light chain complementarity determining region 3 for antibody 6092
LQDYNHVGT

SEQ ID NO: 12184 - protein, 16 aa, Homo sapiens
  heavy chain complementarity determining region 3 for antibody 6092
VRDLAGFTRGGSTFDY

SEQ ID NO: 12185 - protein, 9 aa, Homo sapiens
  light chain complementarity determining region 3 for antibody 6093
LQDYNHVGT

SEQ ID NO: 12186 - protein, 9 aa, Homo sapiens
  heavy chain complementarity determining region 3 for antibody 6093
RSRRPYFDS

SEQ ID NO: 12187 - protein, 9 aa, Homo sapiens
  light chain complementarity determining region 3 for antibody 6094
LQDYNHVGT

SEQ ID NO: 12188 - protein, 9 aa, Homo sapiens
  heavy chain complementarity determining region 3 for antibody 6094
GSRRPYVDS

SEQ ID NO: 12189 - protein, 9 aa, Homo sapiens
  light chain complementarity determining region 3 for antibody 6095
LQDYNHVGT

SEQ ID NO: 12190 - protein, 9 aa, Homo sapiens
  heavy chain complementarity determining region 3 for antibody 6095
GSRRPYFDF

SEQ ID NO: 12191 - protein, 9 aa, Homo sapiens
  light chain complementarity determining region 3 for antibody 6096
LQDYNHVGT

SEQ ID NO: 12192 - protein, 9 aa, Homo sapiens
  heavy chain complementarity determining region 3 for antibody 6096
GSRRPYFDC

SEQ ID NO: 12193 - protein, 9 aa, Homo sapiens
  light chain complementarity determining region 3 for antibody 6097
LQDYNHVGT

SEQ ID NO: 12194 - protein, 9 aa, Homo sapiens
  heavy chain complementarity determining region 3 for antibody 6097
GSRRPCFDS

SEQ ID NO: 12195 - protein, 9 aa, Homo sapiens
  light chain complementarity determining region 3 for antibody 6098
LQDYNHVGT

SEQ ID NO: 12196 - protein, 11 aa, Homo sapiens
  heavy chain complementarity determining region 3 for antibody 6098
ATFGQQWRLAH

SEQ ID NO: 12197 - protein, 9 aa, Homo sapiens
  light chain complementarity determining region 3 for antibody 6099
LQDYNHVGT

SEQ ID NO: 12198 - protein, 17 aa, Homo sapiens
  heavy chain complementarity determining region 3 for antibody 6099
ARNTMVGTWQRQGNLDH

SEQ ID NO: 12199 - protein, 9 aa, Homo sapiens
  light chain complementarity determining region 3 for antibody 6100
LQDYNHIGT

SEQ ID NO: 12200 - protein, 9 aa, Homo sapiens
  heavy chain complementarity determining region 3 for antibody 6100
GSRRPYFDS

SEQ ID NO: 12201 - protein, 9 aa, Homo sapiens
  light chain complementarity determining region 3 for antibody 6101
LQDYKYPFT

SEQ ID NO: 12202 - protein, 16 aa, Homo sapiens
  heavy chain complementarity determining region 3 for antibody 6101
AADLGDHTDAYATLDN

SEQ ID NO: 12203 - protein, 9 aa, Homo sapiens
  light chain complementarity determining region 3 for antibody 6102
LQDYKYPFS

SEQ ID NO: 12204 - protein, 16 aa, Homo sapiens
  heavy chain complementarity determining region 3 for antibody 6102
AADLGDRADAYATLDS

SEQ ID NO: 12205 - protein, 9 aa, Homo sapiens
  light chain complementarity determining region 3 for antibody 6103
LQDYKYPFS

SEQ ID NO: 12206 - protein, 16 aa, Homo sapiens
  heavy chain complementarity determining region 3 for antibody 6103
AADLGDHAGAYATLDS

SEQ ID NO: 12207 - protein, 9 aa, Homo sapiens
  light chain complementarity determining region 3 for antibody 6104
LQDYKYPFS

SEQ ID NO: 12208 - protein, 16 aa, Homo sapiens
  heavy chain complementarity determining region 3 for antibody 6104
AADLGDHADAYASLDS

SEQ ID NO: 12209 - protein, 9 aa, Homo sapiens
  light chain complementarity determining region 3 for antibody 6105
LQDYIYPFS

SEQ ID NO: 12210 - protein, 16 aa, Homo sapiens
  heavy chain complementarity determining region 3 for antibody 6105
VTDVGDHRDIYTTLDY

SEQ ID NO: 12211 - protein, 9 aa, Homo sapiens
  light chain complementarity determining region 3 for antibody 6106
LQDYIYPFS

SEQ ID NO: 12212 - protein, 16 aa, Homo sapiens
  heavy chain complementarity determining region 3 for antibody 6106
FSNDAAPRDIYTTLDY

SEQ ID NO: 12213 - protein, 9 aa, Homo sapiens
  light chain complementarity determining region 3 for antibody 6107
LQDYIYPFS

SEQ ID NO: 12214 - protein, 16 aa, Homo sapiens
  heavy chain complementarity determining region 3 for antibody 6107
FSDVGAPRDIYTTLDY

SEQ ID NO: 12215 - protein, 9 aa, Homo sapiens
  light chain complementarity determining region 3 for antibody 6108
LQDYIYPFS

SEQ ID NO: 12216 - protein, 16 aa, Homo sapiens
  heavy chain complementarity determining region 3 for antibody 6108
FLNDAAPPDIYTTLDY

SEQ ID NO: 12217 - protein, 9 aa, Homo sapiens
  light chain complementarity determining region 3 for antibody 6109
LQDYIYPFS

SEQ ID NO: 12218 - protein, 16 aa, Homo sapiens
  heavy chain complementarity determining region 3 for antibody 6109
FFNDAAPTDIYTTLDY

SEQ ID NO: 12219 - protein, 9 aa, Homo sapiens
  light chain complementarity determining region 3 for antibody 6110
LQDLQAPFT

SEQ ID NO: 12220 - protein, 11 aa, Homo sapiens
  heavy chain complementarity determining region 3 for antibody 6110
GRDVDYSTPGF

SEQ ID NO: 12221 - protein, 9 aa, Homo sapiens
  light chain complementarity determining region 3 for antibody 6111
LQDHTYPFT

SEQ ID NO: 12222 - protein, 16 aa, Homo sapiens
  heavy chain complementarity determining region 3 for antibody 6111
AADLGDHTDAYATLDN

SEQ ID NO: 12223 - protein, 9 aa, Homo sapiens
  light chain complementarity determining region 3 for antibody 6112
LQDHTYPFS

SEQ ID NO: 12224 - protein, 16 aa, Homo sapiens
  heavy chain complementarity determining region 3 for antibody 6112
AADLGGHSDTYATLDY

SEQ ID NO: 12225 - protein, 9 aa, Homo sapiens
  light chain complementarity determining region 3 for antibody 6113
LQDHNYPFT

SEQ ID NO: 12226 - protein, 16 aa, Homo sapiens
  heavy chain complementarity determining region 3 for antibody 6113
AADLGDHADAYATLDN

SEQ ID NO: 12227 - protein, 9 aa, Homo sapiens
  light chain complementarity determining region 3 for antibody 6114
LQDHNYPFS

SEQ ID NO: 12228 - protein, 16 aa, Homo sapiens
  heavy chain complementarity determining region 3 for antibody 6114
GADLGDHGDAYATLDS

SEQ ID NO: 12229 - protein, 9 aa, Homo sapiens
  light chain complementarity determining region 3 for antibody 6115
LQDHKYPST

SEQ ID NO: 12230 - protein, 16 aa, Homo sapiens
  heavy chain complementarity determining region 3 for antibody 6115
AADLGDHTDAYATLDN

SEQ ID NO: 12231 - protein, 9 aa, Homo sapiens
  light chain complementarity determining region 3 for antibody 6116
LQDHKYPFT

SEQ ID NO: 12232 - protein, 12 aa, Homo sapiens
  heavy chain complementarity determining region 3 for antibody 6116
ARLDWNYRAFDI

SEQ ID NO: 12233 - protein, 9 aa, Homo sapiens
  light chain complementarity determining region 3 for antibody 6117
LQDHKYPFT

SEQ ID NO: 12234 - protein, 10 aa, Homo sapiens
  heavy chain complementarity determining region 3 for antibody 6117
ARERSGSYDI

SEQ ID NO: 12235 - protein, 9 aa, Homo sapiens
  light chain complementarity determining region 3 for antibody 6118
LQDHKYPFT

SEQ ID NO: 12236 - protein, 16 aa, Homo sapiens
  heavy chain complementarity determining region 3 for antibody 6118
AADVGDHTDAYATLDN

SEQ ID NO: 12237 - protein, 9 aa, Homo sapiens
  light chain complementarity determining region 3 for antibody 6119
LQDHKYPFT

SEQ ID NO: 12238 - protein, 16 aa, Homo sapiens
  heavy chain complementarity determining region 3 for antibody 6119
AADLGDRTDAYATLDN

SEQ ID NO: 12239 - protein, 9 aa, Homo sapiens
  light chain complementarity determining region 3 for antibody 6120
LQDHIYPFS

SEQ ID NO: 12240 - protein, 12 aa, Homo sapiens
  heavy chain complementarity determining region 3 for antibody 6120
ARDKGGRNGMDV

SEQ ID NO: 12241 - protein, 9 aa, Homo sapiens
  light chain complementarity determining region 3 for antibody 6121
LQDHIYPFS

SEQ ID NO: 12242 - protein, 16 aa, Homo sapiens
  heavy chain complementarity determining region 3 for antibody 6121
AADLDDHSDAFAALDD

SEQ ID NO: 12243 - protein, 9 aa, Homo sapiens
  light chain complementarity determining region 3 for antibody 6122
LQDFSYPFS

SEQ ID NO: 12244 - protein, 16 aa, Homo sapiens
  heavy chain complementarity determining region 3 for antibody 6122
VTDDGDHRDTYTTLDY

SEQ ID NO: 12245 - protein, 9 aa, Homo sapiens
  light chain complementarity determining region 3 for antibody 6123
LQDFSYPFS

SEQ ID NO: 12246 - protein, 16 aa, Homo sapiens
  heavy chain complementarity determining region 3 for antibody 6123
VKEVGDHRDTYTTLDY

SEQ ID NO: 12247 - protein, 9 aa, Homo sapiens
  light chain complementarity determining region 3 for antibody 6124
LQAYNHVGT

SEQ ID NO: 12248 - protein, 9 aa, Homo sapiens
  heavy chain complementarity determining region 3 for antibody 6124
GSRRPYFDS

SEQ ID NO: 12249 - protein, 9 aa, Homo sapiens
  light chain complementarity determining region 3 for antibody 6125
LQATHWPRT

SEQ ID NO: 12250 - protein, 12 aa, Homo sapiens
  heavy chain complementarity determining region 3 for antibody 6125
STDVETTLPSVS

SEQ ID NO: 12251 - protein, 9 aa, Homo sapiens
  light chain complementarity determining region 3 for antibody 6126
LQATHWPRT

SEQ ID NO: 12252 - protein, 12 aa, Homo sapiens
  heavy chain complementarity determining region 3 for antibody 6126
SADVETTFPSVS

SEQ ID NO: 12253 - protein, 9 aa, Homo sapiens
  light chain complementarity determining region 3 for antibody 6127
LKHNSYPLT

SEQ ID NO: 12254 - protein, 11 aa, Homo sapiens
  heavy chain complementarity determining region 3 for antibody 6127
VRVSTGWNFDY

SEQ ID NO: 12255 - protein, 9 aa, Homo sapiens
  light chain complementarity determining region 3 for antibody 6128
LHYDTYSRV

SEQ ID NO: 12256 - protein, 11 aa, Homo sapiens
  heavy chain complementarity determining region 3 for antibody 6128
ATDSFSGGPGF

SEQ ID NO: 12257 - protein, 10 aa, Homo sapiens
  light chain complementarity determining region 3 for antibody 6129
LHYAGSPWIT

SEQ ID NO: 12258 - protein, 6 aa, Homo sapiens
  heavy chain complementarity determining region 3 for antibody 6129
ARFFDF

SEQ ID NO: 12259 - protein, 9 aa, Homo sapiens
  light chain complementarity determining region 3 for antibody 6130
LHHNSYPLT

SEQ ID NO: 12260 - protein, 10 aa, Homo sapiens
  heavy chain complementarity determining region 3 for antibody 6130
CRDRWGFGDV

SEQ ID NO: 12261 - protein, 9 aa, Homo sapiens
  light chain complementarity determining region 3 for antibody 6131
LHGLQAPFT

SEQ ID NO: 12262 - protein, 11 aa, Homo sapiens
  heavy chain complementarity determining region 3 for antibody 6131
GRDVDYSTPGF

SEQ ID NO: 12263 - protein, 9 aa, Homo sapiens
  light chain complementarity determining region 3 for antibody 6132
LHDYIYPFS

SEQ ID NO: 12264 - protein, 16 aa, Homo sapiens
  heavy chain complementarity determining region 3 for antibody 6132
AEDVGDHRDSYTTLDH

SEQ ID NO: 12265 - protein, 9 aa, Homo sapiens
  light chain complementarity determining region 3 for antibody 6133
LHDHNYPFS

SEQ ID NO: 12266 - protein, 16 aa, Homo sapiens
  heavy chain complementarity determining region 3 for antibody 6133
AADLDDHTDAYATLDS

SEQ ID NO: 12267 - protein, 9 aa, Homo sapiens
  light chain complementarity determining region 3 for antibody 6134
LEYKTVPWT

SEQ ID NO: 12268 - protein, 20 aa, Homo sapiens
  heavy chain complementarity determining region 3 for antibody 6134
AKDGRGTAFYHGAGGGGLDV

SEQ ID NO: 12269 - protein, 7 aa, Homo sapiens
  light chain complementarity determining region 3 for antibody 6135
KQYNTWT

SEQ ID NO: 12270 - protein, 12 aa, Homo sapiens
  heavy chain complementarity determining region 3 for antibody 6135
ARDKGGRNGMDV

SEQ ID NO: 12271 - protein, 9 aa, Homo sapiens
  light chain complementarity determining region 3 for antibody 6136
KQSYSTPST

SEQ ID NO: 12272 - protein, 16 aa, Homo sapiens
  heavy chain complementarity determining region 3 for antibody 6136
ARWFSRSSTGVSYMDV

SEQ ID NO: 12273 - protein, 10 aa, Homo sapiens
  light chain complementarity determining region 3 for antibody 6137
KQSYSTPLFT

SEQ ID NO: 12274 - protein, 23 aa, Homo sapiens
  heavy chain complementarity determining region 3 for antibody 6137
ARHFPMGGSTVTGTQSLLYYMDV

SEQ ID NO: 12275 - protein, 9 aa, Homo sapiens
  light chain complementarity determining region 3 for antibody 6138
KQDYYTPRT

SEQ ID NO: 12276 - protein, 11 aa, Homo sapiens
  heavy chain complementarity determining region 3 for antibody 6138
ARRSLGGAFDY

SEQ ID NO: 12277 - protein, 9 aa, Homo sapiens
  light chain complementarity determining region 3 for antibody 6139
IQYDTYPWT

SEQ ID NO: 12278 - protein, 9 aa, Homo sapiens
  heavy chain complementarity determining region 3 for antibody 6139
GRGQYGPDY

SEQ ID NO: 12279 - protein, 9 aa, Homo sapiens
  light chain complementarity determining region 3 for antibody 6140
IQGLQIPRT

SEQ ID NO: 12280 - protein, 13 aa, Homo sapiens
  heavy chain complementarity determining region 3 for antibody 6140
ARDHTYSVPRGGY

SEQ ID NO: 12281 - protein, 9 aa, Homo sapiens
  light chain complementarity determining region 3 for antibody 6141
IQFLQTPLT

SEQ ID NO: 12282 - protein, 10 aa, Homo sapiens
  heavy chain complementarity determining region 3 for antibody 6141
ARERSGSYDI

SEQ ID NO: 12283 - protein, 9 aa, Homo sapiens
  light chain complementarity determining region 3 for antibody 6142
IQATHGPLT

SEQ ID NO: 12284 - protein, 10 aa, Homo sapiens
  heavy chain complementarity determining region 3 for antibody 6142
VYDFWSPRHY

SEQ ID NO: 12285 - protein, 9 aa, Homo sapiens
  light chain complementarity determining region 3 for antibody 6143
HVYKSAPHT

SEQ ID NO: 12286 - protein, 14 aa, Homo sapiens
  heavy chain complementarity determining region 3 for antibody 6143
CRGWLDPATPHYDF

SEQ ID NO: 12287 - protein, 9 aa, Homo sapiens
  light chain complementarity determining region 3 for antibody 6144
HQYSSIPFT

SEQ ID NO: 12288 - protein, 12 aa, Homo sapiens
  heavy chain complementarity determining region 3 for antibody 6144
ARGVTEGAAFDV

SEQ ID NO: 12289 - protein, 9 aa, Homo sapiens
  light chain complementarity determining region 3 for antibody 6145
HQYSSIPFT

SEQ ID NO: 12290 - protein, 12 aa, Homo sapiens
  heavy chain complementarity determining region 3 for antibody 6145
ARGLTEGAAFNV

SEQ ID NO: 12291 - protein, 9 aa, Homo sapiens
  light chain complementarity determining region 3 for antibody 6146
HQYNSYSLT

SEQ ID NO: 12292 - protein, 15 aa, Homo sapiens
  heavy chain complementarity determining region 3 for antibody 6146
ARSMVSGTTDDAFDI

SEQ ID NO: 12293 - protein, 9 aa, Homo sapiens
  light chain complementarity determining region 3 for antibody 6147
HQYNSYSHT

SEQ ID NO: 12294 - protein, 14 aa, Homo sapiens
  heavy chain complementarity determining region 3 for antibody 6147
ARDVHTTGWTLGGY

SEQ ID NO: 12295 - protein, 9 aa, Homo sapiens
  light chain complementarity determining region 3 for antibody 6148
HQYLYSPRT

SEQ ID NO: 12296 - protein, 16 aa, Homo sapiens
  heavy chain complementarity determining region 3 for antibody 6148
TADVSDHRDRYVTLDH

SEQ ID NO: 12297 - protein, 8 aa, Homo sapiens
  light chain complementarity determining region 3 for antibody 6149
HQYKSYWT

SEQ ID NO: 12298 - protein, 10 aa, Homo sapiens
  heavy chain complementarity determining region 3 for antibody 6149
ARERSGSYDI

SEQ ID NO: 12299 - protein, 9 aa, Homo sapiens
  light chain complementarity determining region 3 for antibody 6150
HQYGSLPPT

SEQ ID NO: 12300 - protein, 13 aa, Homo sapiens
  heavy chain complementarity determining region 3 for antibody 6150
AKDRSSGWYAWGY

SEQ ID NO: 12301 - protein, 9 aa, Homo sapiens
  light chain complementarity determining region 3 for antibody 6151
HQYGSLPLT

SEQ ID NO: 12302 - protein, 10 aa, Homo sapiens
  heavy chain complementarity determining region 3 for antibody 6151
CRDREGFGDV

SEQ ID NO: 12303 - protein, 8 aa, Homo sapiens
  light chain complementarity determining region 3 for antibody 6152
HQYGSLMT

SEQ ID NO: 12304 - protein, 18 aa, Homo sapiens
  heavy chain complementarity determining region 3 for antibody 6152
AKGTLASCSGVTCYPFDY

SEQ ID NO: 12305 - protein, 10 aa, Homo sapiens
  light chain complementarity determining region 3 for antibody 6153
HQYDNLASLT

SEQ ID NO: 12306 - protein, 13 aa, Homo sapiens
  heavy chain complementarity determining region 3 for antibody 6153
AKEGSSPGPDFEY

SEQ ID NO: 12307 - protein, 9 aa, Homo sapiens
  light chain complementarity determining region 3 for antibody 6154
HQYASTPGT

SEQ ID NO: 12308 - protein, 11 aa, Homo sapiens
  heavy chain complementarity determining region 3 for antibody 6154
ARGRDQSKLGY

SEQ ID NO: 12309 - protein, 10 aa, Homo sapiens
  light chain complementarity determining region 3 for antibody 6155
HQSYSTPLFT

SEQ ID NO: 12310 - protein, 15 aa, Homo sapiens
  heavy chain complementarity determining region 3 for antibody 6155
ARVGRPYHNAWYFDN

SEQ ID NO: 12311 - protein, 9 aa, Homo sapiens
  light chain complementarity determining region 3 for antibody 6156
HQSSTLPRT

SEQ ID NO: 12312 - protein, 10 aa, Homo sapiens
  heavy chain complementarity determining region 3 for antibody 6156
ARETSGAYDI

SEQ ID NO: 12313 - protein, 9 aa, Homo sapiens
  light chain complementarity determining region 3 for antibody 6157
HQSSTLPHT

SEQ ID NO: 12314 - protein, 10 aa, Homo sapiens
  heavy chain complementarity determining region 3 for antibody 6157
AREASGAYDI

SEQ ID NO: 12315 - protein, 9 aa, Homo sapiens
  light chain complementarity determining region 3 for antibody 6158
HQSANSPRT

SEQ ID NO: 12316 - protein, 13 aa, Homo sapiens
  heavy chain complementarity determining region 3 for antibody 6158
ARGATSTSWNIDY

SEQ ID NO: 12317 - protein, 9 aa, Homo sapiens
  light chain complementarity determining region 3 for antibody 6159
HQSANSPRT

SEQ ID NO: 12318 - protein, 13 aa, Homo sapiens
  heavy chain complementarity determining region 3 for antibody 6159
ARGATATSWSIDY

SEQ ID NO: 12319 - protein, 9 aa, Homo sapiens
  light chain complementarity determining region 3 for antibody 6160
HQSANSPRT

SEQ ID NO: 12320 - protein, 13 aa, Homo sapiens
  heavy chain complementarity determining region 3 for antibody 6160
ARGATATSGNIDY

SEQ ID NO: 12321 - protein, 9 aa, Homo sapiens
  light chain complementarity determining region 3 for antibody 6161
HQSANSPRP

SEQ ID NO: 12322 - protein, 13 aa, Homo sapiens
  heavy chain complementarity determining region 3 for antibody 6161
ARGATATSWNIDY

SEQ ID NO: 12323 - protein, 9 aa, Homo sapiens
  light chain complementarity determining region 3 for antibody 6162
HQLSNAPLT

SEQ ID NO: 12324 - protein, 17 aa, Homo sapiens
  heavy chain complementarity determining region 3 for antibody 6162
AKRLPDLLGGGHHYIDV

SEQ ID NO: 12325 - protein, 9 aa, Homo sapiens
  light chain complementarity determining region 3 for antibody 6163
HQHGTTPGT

SEQ ID NO: 12326 - protein, 18 aa, Homo sapiens
  heavy chain complementarity determining region 3 for antibody 6163
ASWAGYCGGGCSSVSLDY

SEQ ID NO: 12327 - protein, 9 aa, Homo sapiens
  light chain complementarity determining region 3 for antibody 6164
HQHGTTPGT

SEQ ID NO: 12328 - protein, 18 aa, Homo sapiens
  heavy chain complementarity determining region 3 for antibody 6164
ASWAGYCGGDRSSVSLDY

SEQ ID NO: 12329 - protein, 9 aa, Homo sapiens
  light chain complementarity determining region 3 for antibody 6165
HQHGTTPGT

SEQ ID NO: 12330 - protein, 18 aa, Homo sapiens
  heavy chain complementarity determining region 3 for antibody 6165
ASWAGYCGGDCSSVSLGY

SEQ ID NO: 12331 - protein, 9 aa, Homo sapiens
  light chain complementarity determining region 3 for antibody 6166
HQHGTTPGK

SEQ ID NO: 12332 - protein, 18 aa, Homo sapiens
  heavy chain complementarity determining region 3 for antibody 6166
ASWAGYCGGDCSSVSLDY

SEQ ID NO: 12333 - protein, 9 aa, Homo sapiens
  light chain complementarity determining region 3 for antibody 6167
HKHGTTPGT

SEQ ID NO: 12334 - protein, 18 aa, Homo sapiens
  heavy chain complementarity determining region 3 for antibody 6167
ASWAGYCGGDCSSVSLDY

SEQ ID NO: 12335 - protein, 9 aa, Homo sapiens
  light chain complementarity determining region 3 for antibody 6168
HHYGGSPRT

SEQ ID NO: 12336 - protein, 16 aa, Homo sapiens
  heavy chain complementarity determining region 3 for antibody 6168
AQDLGSEWTHFNWFDP

SEQ ID NO: 12337 - protein, 9 aa, Homo sapiens
  light chain complementarity determining region 3 for antibody 6169
HHYGGSPRT

SEQ ID NO: 12338 - protein, 16 aa, Homo sapiens
  heavy chain complementarity determining region 3 for antibody 6169
AQDLGSEWNHFNWFNP

SEQ ID NO: 12339 - protein, 9 aa, Homo sapiens
  light chain complementarity determining region 3 for antibody 6170
HHYDNLPGS

SEQ ID NO: 12340 - protein, 13 aa, Homo sapiens
  heavy chain complementarity determining region 3 for antibody 6170
ARGRVGAYDAFDI

SEQ ID NO: 12341 - protein, 9 aa, Homo sapiens
  light chain complementarity determining region 3 for antibody 6171
HHSGSATGT

SEQ ID NO: 12342 - protein, 13 aa, Homo sapiens
  heavy chain complementarity determining region 3 for antibody 6171
AKEGSSPGPDFEY

SEQ ID NO: 12343 - protein, 9 aa, Homo sapiens
  light chain complementarity determining region 3 for antibody 6172
HHFGSSTGT

SEQ ID NO: 12344 - protein, 13 aa, Homo sapiens
  heavy chain complementarity determining region 3 for antibody 6172
AKEGSSPGPDFEY

SEQ ID NO: 12345 - protein, 9 aa, Homo sapiens
  light chain complementarity determining region 3 for antibody 6173
HHFGSATWT

SEQ ID NO: 12346 - protein, 13 aa, Homo sapiens
  heavy chain complementarity determining region 3 for antibody 6173
AKEGSSPGPDFEY

SEQ ID NO: 12347 - protein, 9 aa, Homo sapiens
  light chain complementarity determining region 3 for antibody 6174
HHFGSATGT

SEQ ID NO: 12348 - protein, 9 aa, Homo sapiens
  heavy chain complementarity determining region 3 for antibody 6174
ARSEYQPTY

SEQ ID NO: 12349 - protein, 9 aa, Homo sapiens
  light chain complementarity determining region 3 for antibody 6175
HHFGSATGT

SEQ ID NO: 12350 - protein, 17 aa, Homo sapiens
  heavy chain complementarity determining region 3 for antibody 6175
AKGRGSVAMALIYYLDL

SEQ ID NO: 12351 - protein, 9 aa, Homo sapiens
  light chain complementarity determining region 3 for antibody 6176
HHFGSATGT

SEQ ID NO: 12352 - protein, 13 aa, Homo sapiens
  heavy chain complementarity determining region 3 for antibody 6176
AKEGSSPGPSTQS

SEQ ID NO: 12353 - protein, 9 aa, Homo sapiens
  light chain complementarity determining region 3 for antibody 6177
HHFGSATGT

SEQ ID NO: 12354 - protein, 13 aa, Homo sapiens
  heavy chain complementarity determining region 3 for antibody 6177
AKEGSSPGPDSEY

SEQ ID NO: 12355 - protein, 9 aa, Homo sapiens
  light chain complementarity determining region 3 for antibody 6178
HHFGSATGT

SEQ ID NO: 12356 - protein, 12 aa, Homo sapiens
  heavy chain complementarity determining region 3 for antibody 6178
AIVVPGRWDLDD

SEQ ID NO: 12357 - protein, 7 aa, Homo sapiens
  light chain complementarity determining region 3 for antibody 6179
HCRDYWV

SEQ ID NO: 12358 - protein, 20 aa, Homo sapiens
  heavy chain complementarity determining region 3 for antibody 6179
ATYLPGDCSCTGCYYWYFNF

SEQ ID NO: 12359 - protein, 7 aa, Homo sapiens
  light chain complementarity determining region 3 for antibody 6180
HCRDCWG

SEQ ID NO: 12360 - protein, 20 aa, Homo sapiens
  heavy chain complementarity determining region 3 for antibody 6180
ATYLPGDCSCTGCYYWYFNF

SEQ ID NO: 12361 - protein, 9 aa, Homo sapiens
  light chain complementarity determining region 3 for antibody 6181
GQGSYWPAS

SEQ ID NO: 12362 - protein, 10 aa, Homo sapiens
  heavy chain complementarity determining region 3 for antibody 6181
CRDRWGFGDV

SEQ ID NO: 12363 - protein, 9 aa, Homo sapiens
  light chain complementarity determining region 3 for antibody 6182
GQGSYWPAS

SEQ ID NO: 12364 - protein, 10 aa, Homo sapiens
  heavy chain complementarity determining region 3 for antibody 6182
CRDHEGFGDV

SEQ ID NO: 12365 - protein, 9 aa, Homo sapiens
  light chain complementarity determining region 3 for antibody 6183
FQYKYGPPT

SEQ ID NO: 12366 - protein, 8 aa, Homo sapiens
  heavy chain complementarity determining region 3 for antibody 6183
AGWGYGNY

SEQ ID NO: 12367 - protein, 9 aa, Homo sapiens
  light chain complementarity determining region 3 for antibody 6184
FQGTNWPRT

SEQ ID NO: 12368 - protein, 8 aa, Homo sapiens
  heavy chain complementarity determining region 3 for antibody 6184
GRDRWWSG

SEQ ID NO: 12369 - protein, 9 aa, Homo sapiens
  light chain complementarity determining region 3 for antibody 6185
FQGTHWPRP

SEQ ID NO: 12370 - protein, 8 aa, Homo sapiens
  heavy chain complementarity determining region 3 for antibody 6185
GRDRWWSG

SEQ ID NO: 12371 - protein, 9 aa, Homo sapiens
  light chain complementarity determining region 3 for antibody 6186
FQGTHWPGT

SEQ ID NO: 12372 - protein, 8 aa, Homo sapiens
  heavy chain complementarity determining region 3 for antibody 6186
GRDRWWSG

SEQ ID NO: 12373 - protein, 9 aa, Homo sapiens
  light chain complementarity determining region 3 for antibody 6187
EQYGSSPRT

SEQ ID NO: 12374 - protein, 9 aa, Homo sapiens
  heavy chain complementarity determining region 3 for antibody 6187
AREWSGFDF

SEQ ID NO: 12375 - protein, 9 aa, Homo sapiens
  light chain complementarity determining region 3 for antibody 6188
EQYGRSPRT

SEQ ID NO: 12376 - protein, 9 aa, Homo sapiens
  heavy chain complementarity determining region 3 for antibody 6188
AREWSGFDF

SEQ ID NO: 12377 - protein, 11 aa, Homo sapiens
  light chain complementarity determining region 3 for antibody 6189
AQYGSSSGSGT

SEQ ID NO: 12378 - protein, 10 aa, Homo sapiens
  heavy chain complementarity determining region 3 for antibody 6189
ARATYWAYDA

SEQ ID NO: 12379 - protein, 9 aa, Homo sapiens
  light chain complementarity determining region 3 for antibody 6190
AQGSYWPVS

SEQ ID NO: 12380 - protein, 10 aa, Homo sapiens
  heavy chain complementarity determining region 3 for antibody 6190
CRDREGFGDV

SEQ ID NO: 12381 - protein, 9 aa, Homo sapiens
  light chain complementarity determining region 3 for antibody 6191
AQGSYWPAS

SEQ ID NO: 12382 - protein, 12 aa, Homo sapiens
  heavy chain complementarity determining region 3 for antibody 6191
STDVETTFPSVS

SEQ ID NO: 12383 - protein, 9 aa, Homo sapiens
  light chain complementarity determining region 3 for antibody 6192
AQGSYWPAS

SEQ ID NO: 12384 - protein, 17 aa, Homo sapiens
  heavy chain complementarity determining region 3 for antibody 6192
SRDGRIIWPGSQGSLDS

SEQ ID NO: 12385 - protein, 9 aa, Homo sapiens
  light chain complementarity determining region 3 for antibody 6193
AQGSYWPAS

SEQ ID NO: 12386 - protein, 10 aa, Homo sapiens
  heavy chain complementarity determining region 3 for antibody 6193
GRDREGFGDV

SEQ ID NO: 12387 - protein, 9 aa, Homo sapiens
  light chain complementarity determining region 3 for antibody 6194
AQGSYWPAS

SEQ ID NO: 12388 - protein, 10 aa, Homo sapiens
  heavy chain complementarity determining region 3 for antibody 6194
CRGRWGFGDV

SEQ ID NO: 12389 - protein, 9 aa, Homo sapiens
  light chain complementarity determining region 3 for antibody 6195
AQGSYWPAS

SEQ ID NO: 12390 - protein, 10 aa, Homo sapiens
  heavy chain complementarity determining region 3 for antibody 6195
CREHEGFGDV

SEQ ID NO: 12391 - protein, 9 aa, Homo sapiens
  light chain complementarity determining region 3 for antibody 6196
AQGSYWPAS

SEQ ID NO: 12392 - protein, 10 aa, Homo sapiens
  heavy chain complementarity determining region 3 for antibody 6196
CRDRWGFVDV

SEQ ID NO: 12393 - protein, 9 aa, Homo sapiens
  light chain complementarity determining region 3 for antibody 6197
AQGSYWPAS

SEQ ID NO: 12394 - protein, 10 aa, Homo sapiens
  heavy chain complementarity determining region 3 for antibody 6197
CRDREGYGDV

SEQ ID NO: 12395 - protein, 9 aa, Homo sapiens
  light chain complementarity determining region 3 for antibody 6198
AQGSYWPAS

SEQ ID NO: 12396 - protein, 10 aa, Homo sapiens
  heavy chain complementarity determining region 3 for antibody 6198
CRDREGVGDV

SEQ ID NO: 12397 - protein, 9 aa, Homo sapiens
  light chain complementarity determining region 3 for antibody 6199
AQGSYWPAS

SEQ ID NO: 12398 - protein, 10 aa, Homo sapiens
  heavy chain complementarity determining region 3 for antibody 6199
CRDLEGFGDV

SEQ ID NO: 12399 - protein, 9 aa, Homo sapiens
  light chain complementarity determining region 3 for antibody 6200
AQGSYWPAS

SEQ ID NO: 12400 - protein, 10 aa, Homo sapiens
  heavy chain complementarity determining region 3 for antibody 6200
CGDRWGFGDV

SEQ ID NO: 12401 - protein, 9 aa, Homo sapiens
  light chain complementarity determining region 3 for antibody 6201
AQGSYWPAS

SEQ ID NO: 12402 - protein, 11 aa, Homo sapiens
  heavy chain complementarity determining region 3 for antibody 6201
ARRSLGGAFDY

SEQ ID NO: 12403 - protein, 9 aa, Homo sapiens
  light chain complementarity determining region 3 for antibody 6202
AQGSYWPAS

SEQ ID NO: 12404 - protein, 17 aa, Homo sapiens
  heavy chain complementarity determining region 3 for antibody 6202
ARNTMVGTWQRQGNLDH

SEQ ID NO: 12405 - protein, 9 aa, Homo sapiens
  light chain complementarity determining region 3 for antibody 6203
AQGSYWPAS

SEQ ID NO: 12406 - protein, 10 aa, Homo sapiens
  heavy chain complementarity determining region 3 for antibody 6203
ARETSGAYDI

SEQ ID NO: 12407 - protein, 9 aa, Homo sapiens
  light chain complementarity determining region 3 for antibody 6204
AQGSYWPAS

SEQ ID NO: 12408 - protein, 17 aa, Homo sapiens
  heavy chain complementarity determining region 3 for antibody 6204
AKRLPDLLGGGHHYIDV

SEQ ID NO: 12409 - protein, 9 aa, Homo sapiens
  light chain complementarity determining region 3 for antibody 6205
AQGSYWPAS

SEQ ID NO: 12410 - protein, 13 aa, Homo sapiens
  heavy chain complementarity determining region 3 for antibody 6205
AKEGSSPGPDFDY

SEQ ID NO: 12411 - protein, 9 aa, Homo sapiens
  light chain complementarity determining region 3 for antibody 6206
AQGSYWPAS

SEQ ID NO: 12412 - protein, 13 aa, Homo sapiens
  heavy chain complementarity determining region 3 for antibody 6206
AKEGSSPGPDFDS

SEQ ID NO: 12413 - protein, 9 aa, Homo sapiens
  light chain complementarity determining region 3 for antibody 6207
AQGSYWPAS

SEQ ID NO: 12414 - protein, 13 aa, Homo sapiens
  heavy chain complementarity determining region 3 for antibody 6207
AKEGSSAGPDFDY

SEQ ID NO: 12415 - protein, 9 aa, Homo sapiens
  light chain complementarity determining region 3 for antibody 6208
AQGSYWPAS

SEQ ID NO: 12416 - protein, 16 aa, Homo sapiens
  heavy chain complementarity determining region 3 for antibody 6208
AIWAAVSSGWSGPFDF

SEQ ID NO: 12417 - protein, 9 aa, Homo sapiens
  light chain complementarity determining region 3 for antibody 6209
AQGSYLPAS

SEQ ID NO: 12418 - protein, 10 aa, Homo sapiens
  heavy chain complementarity determining region 3 for antibody 6209
CRDRWGFGDV

SEQ ID NO: 12419 - protein, 9 aa, Homo sapiens
  light chain complementarity determining region 3 for antibody 6210
AQGSSWPAS

SEQ ID NO: 12420 - protein, 10 aa, Homo sapiens
  heavy chain complementarity determining region 3 for antibody 6210
CRDREGFGDV

SEQ ID NO: 12421 - protein, 9 aa, Homo sapiens
  light chain complementarity determining region 3 for antibody 6211
AQGSFWPVS

SEQ ID NO: 12422 - protein, 10 aa, Homo sapiens
  heavy chain complementarity determining region 3 for antibody 6211
CRDREGFGDV

SEQ ID NO: 12423 - protein, 9 aa, Homo sapiens
  light chain complementarity determining region 3 for antibody 6212
AQGSFWPGS

SEQ ID NO: 12424 - protein, 10 aa, Homo sapiens
  heavy chain complementarity determining region 3 for antibody 6212
CRDREGFGDV

SEQ ID NO: 12425 - protein, 9 aa, Homo sapiens
  light chain complementarity determining region 3 for antibody 6213
AQGSFWPAS

SEQ ID NO: 12426 - protein, 10 aa, Homo sapiens
  heavy chain complementarity determining region 3 for antibody 6213
CRDREGFGDA

SEQ ID NO: 12427 - protein, 9 aa, Homo sapiens
  light chain complementarity determining region 3 for antibody 6214
AQGSFWPAS

SEQ ID NO: 12428 - protein, 12 aa, Homo sapiens
  heavy chain complementarity determining region 3 for antibody 6214
AIVVPGRWDLDD

SEQ ID NO: 12429 - protein, 9 aa, Homo sapiens
  light chain complementarity determining region 3 for antibody 6215
AQGLYWPAS

SEQ ID NO: 12430 - protein, 10 aa, Homo sapiens
  heavy chain complementarity determining region 3 for antibody 6215
CRDREGFGDV

SEQ ID NO: 12431 - protein, 9 aa, Homo sapiens
  light chain complementarity determining region 3 for antibody 6216
APGSYGPAS

SEQ ID NO: 12432 - protein, 10 aa, Homo sapiens
  heavy chain complementarity determining region 3 for antibody 6216
CRDREGFGDV

SEQ ID NO: 12433 - protein, 9 aa, Homo sapiens
  light chain complementarity determining region 3 for antibody 6217
AKGSYWPAS

SEQ ID NO: 12434 - protein, 10 aa, Homo sapiens
  heavy chain complementarity determining region 3 for antibody 6217
CRDREGFGDV

SEQ ID NO: 12435 - protein, 9 aa, Homo sapiens
  light chain complementarity determining region 3 for antibody 6218
WQYAHWPHT

SEQ ID NO: 12436 - protein, 15 aa, Homo sapiens
  heavy chain complementarity determining region 3 for antibody 6218
ARVGRPYHNAWYFDN

SEQ ID NO: 12437 - protein, 9 aa, Homo sapiens
  light chain complementarity determining region 3 for antibody 6219
WQGTYWPKT

SEQ ID NO: 12438 - protein, 10 aa, Homo sapiens
  heavy chain complementarity determining region 3 for antibody 6219
ARDFREGEVY

SEQ ID NO: 12439 - protein, 9 aa, Homo sapiens
  light chain complementarity determining region 3 for antibody 6220
WQFAHWPHT

SEQ ID NO: 12440 - protein, 9 aa, Homo sapiens
  heavy chain complementarity determining region 3 for antibody 6220
AGWGGLSNY

SEQ ID NO: 12441 - protein, 10 aa, Homo sapiens
  light chain complementarity determining region 3 for antibody 6221
VRNTHWPPET

SEQ ID NO: 12442 - protein, 12 aa, Homo sapiens
  heavy chain complementarity determining region 3 for antibody 6221
ARDDGSRCPFEY

SEQ ID NO: 12443 - protein, 9 aa, Homo sapiens
  light chain complementarity determining region 3 for antibody 6222
VQYTNYPRT

SEQ ID NO: 12444 - protein, 12 aa, Homo sapiens
  heavy chain complementarity determining region 3 for antibody 6222
TRSPASPDNYDY

SEQ ID NO: 12445 - protein, 9 aa, Homo sapiens
  light chain complementarity determining region 3 for antibody 6223
VQYTNYPRT

SEQ ID NO: 12446 - protein, 12 aa, Homo sapiens
  heavy chain complementarity determining region 3 for antibody 6223
ARSPASPDKYDY

SEQ ID NO: 12447 - protein, 9 aa, Homo sapiens
  light chain complementarity determining region 3 for antibody 6224
VQTVQTPWT

SEQ ID NO: 12448 - protein, 12 aa, Homo sapiens
  heavy chain complementarity determining region 3 for antibody 6224
ARLDWNYRAFDI

SEQ ID NO: 12449 - protein, 9 aa, Homo sapiens
  light chain complementarity determining region 3 for antibody 6225
VQNTNYPRT

SEQ ID NO: 12450 - protein, 12 aa, Homo sapiens
  heavy chain complementarity determining region 3 for antibody 6225
TRSPASPDKYDY

SEQ ID NO: 12451 - protein, 9 aa, Homo sapiens
  light chain complementarity determining region 3 for antibody 6226
VQHNSYPLT

SEQ ID NO: 12452 - protein, 11 aa, Homo sapiens
  heavy chain complementarity determining region 3 for antibody 6226
VRVSTGWNFDY

SEQ ID NO: 12453 - protein, 9 aa, Homo sapiens
  light chain complementarity determining region 3 for antibody 6227
VQGVHWPWT

SEQ ID NO: 12454 - protein, 17 aa, Homo sapiens
  heavy chain complementarity determining region 3 for antibody 6227
ARNPMVGTWQRQGNLDH

SEQ ID NO: 12455 - protein, 9 aa, Homo sapiens
  light chain complementarity determining region 3 for antibody 6228
VQGVHWPWP

SEQ ID NO: 12456 - protein, 13 aa, Homo sapiens
  heavy chain complementarity determining region 3 for antibody 6228
ARLDNTVAGVIDY

SEQ ID NO: 12457 - protein, 9 aa, Homo sapiens
  light chain complementarity determining region 3 for antibody 6229
VQGVHWPGT

SEQ ID NO: 12458 - protein, 17 aa, Homo sapiens
  heavy chain complementarity determining region 3 for antibody 6229
ARNTMVGTWQRQGNLDH

SEQ ID NO: 12459 - protein, 9 aa, Homo sapiens
  light chain complementarity determining region 3 for antibody 6230
VQGVHGPWT

SEQ ID NO: 12460 - protein, 13 aa, Homo sapiens
  heavy chain complementarity determining region 3 for antibody 6230
ARLDNTVAGVIDY

SEQ ID NO: 12461 - protein, 9 aa, Homo sapiens
  light chain complementarity determining region 3 for antibody 6231
VQGTHWPWT

SEQ ID NO: 12462 - protein, 16 aa, Homo sapiens
  heavy chain complementarity determining region 3 for antibody 6231
ARGHTNPGERRGGSDF

SEQ ID NO: 12463 - protein, 9 aa, Homo sapiens
  light chain complementarity determining region 3 for antibody 6232
VQGTHWPWT

SEQ ID NO: 12464 - protein, 12 aa, Homo sapiens
  heavy chain complementarity determining region 3 for antibody 6232
AIVVPGRWDLDD

SEQ ID NO: 12465 - protein, 9 aa, Homo sapiens
  light chain complementarity determining region 3 for antibody 6233
VQGTHWPWA

SEQ ID NO: 12466 - protein, 12 aa, Homo sapiens
  heavy chain complementarity determining region 3 for antibody 6233
AIVVPGRWDLDD

SEQ ID NO: 12467 - protein, 9 aa, Homo sapiens
  light chain complementarity determining region 3 for antibody 6234
VQGTHWPHT

SEQ ID NO: 12468 - protein, 11 aa, Homo sapiens
  heavy chain complementarity determining region 3 for antibody 6234
ATFGQQWRLAH

SEQ ID NO: 12469 - protein, 9 aa, Homo sapiens
  light chain complementarity determining region 3 for antibody 6235
VQGSFWPAS

SEQ ID NO: 12470 - protein, 10 aa, Homo sapiens
  heavy chain complementarity determining region 3 for antibody 6235
CRDREGFGDV

SEQ ID NO: 12471 - protein, 9 aa, Homo sapiens
  light chain complementarity determining region 3 for antibody 6236
VQGGHWPWT

SEQ ID NO: 12472 - protein, 17 aa, Homo sapiens
  heavy chain complementarity determining region 3 for antibody 6236
ARNTMVGTWQRQGNLDH

SEQ ID NO: 12473 - protein, 9 aa, Homo sapiens
  light chain complementarity determining region 3 for antibody 6237
VQFAHWPHT

SEQ ID NO: 12474 - protein, 9 aa, Homo sapiens
  heavy chain complementarity determining region 3 for antibody 6237
AGWGGLSNY

SEQ ID NO: 12475 - protein, 9 aa, Homo sapiens
  light chain complementarity determining region 3 for antibody 6238
VLYTNYPRT

SEQ ID NO: 12476 - protein, 12 aa, Homo sapiens
  heavy chain complementarity determining region 3 for antibody 6238
TRSPASPDKYDY

SEQ ID NO: 12477 - protein, 9 aa, Homo sapiens
  light chain complementarity determining region 3 for antibody 6239
TQTTHWPWT

SEQ ID NO: 12478 - protein, 11 aa, Homo sapiens
  heavy chain complementarity determining region 3 for antibody 6239
TRELRGSAGAY

SEQ ID NO: 12479 - protein, 9 aa, Homo sapiens
  light chain complementarity determining region 3 for antibody 6240
TQTTHWPWT

SEQ ID NO: 12480 - protein, 9 aa, Homo sapiens
  heavy chain complementarity determining region 3 for antibody 6240
GSRRPYFDS

SEQ ID NO: 12481 - protein, 9 aa, Homo sapiens
  light chain complementarity determining region 3 for antibody 6241
TQTTHWPWP

SEQ ID NO: 12482 - protein, 11 aa, Homo sapiens
  heavy chain complementarity determining region 3 for antibody 6241
TRDLRGSAAAY

SEQ ID NO: 12483 - protein, 9 aa, Homo sapiens
  light chain complementarity determining region 3 for antibody 6242
TQTTHWPGT

SEQ ID NO: 12484 - protein, 11 aa, Homo sapiens
  heavy chain complementarity determining region 3 for antibody 6242
TRDLSGSAGAY

SEQ ID NO: 12485 - protein, 9 aa, Homo sapiens
  light chain complementarity determining region 3 for antibody 6243
TQTTHRPWT

SEQ ID NO: 12486 - protein, 11 aa, Homo sapiens
  heavy chain complementarity determining region 3 for antibody 6243
TRDLRGSAAAY

SEQ ID NO: 12487 - protein, 9 aa, Homo sapiens
  light chain complementarity determining region 3 for antibody 6244
TQTLQTPGT

SEQ ID NO: 12488 - protein, 12 aa, Homo sapiens
  heavy chain complementarity determining region 3 for antibody 6244
ARLDWNYRAFDI

SEQ ID NO: 12489 - protein, 9 aa, Homo sapiens
  light chain complementarity determining region 3 for antibody 6245
TQGTHWPWT

SEQ ID NO: 12490 - protein, 16 aa, Homo sapiens
  heavy chain complementarity determining region 3 for antibody 6245
ARGHTNPGERRGGSDF

SEQ ID NO: 12491 - protein, 9 aa, Homo sapiens
  light chain complementarity determining region 3 for antibody 6246
TQGTHWPWA

SEQ ID NO: 12492 - protein, 12 aa, Homo sapiens
  heavy chain complementarity determining region 3 for antibody 6246
AIVVPGRWDLDD

SEQ ID NO: 12493 - protein, 9 aa, Homo sapiens
  light chain complementarity determining region 3 for antibody 6247
TQGTHWPHT

SEQ ID NO: 12494 - protein, 11 aa, Homo sapiens
  heavy chain complementarity determining region 3 for antibody 6247
ATFGISWYFSG

SEQ ID NO: 12495 - protein, 9 aa, Homo sapiens
  light chain complementarity determining region 3 for antibody 6248
SQYAHWPHT

SEQ ID NO: 12496 - protein, 9 aa, Homo sapiens
  heavy chain complementarity determining region 3 for antibody 6248
AGWGGTSNY

SEQ ID NO: 12497 - protein, 9 aa, Homo sapiens
  light chain complementarity determining region 3 for antibody 6249
SQGSYWPAS

SEQ ID NO: 12498 - protein, 10 aa, Homo sapiens
  heavy chain complementarity determining region 3 for antibody 6249
CRDRWGFGDV

SEQ ID NO: 12499 - protein, 9 aa, Homo sapiens
  light chain complementarity determining region 3 for antibody 6250
SQGSYWPAS

SEQ ID NO: 12500 - protein, 10 aa, Homo sapiens
  heavy chain complementarity determining region 3 for antibody 6250
CRDREGFGDV

SEQ ID NO: 12501 - protein, 9 aa, Homo sapiens
  light chain complementarity determining region 3 for antibody 6251
SQGLQAPFT

SEQ ID NO: 12502 - protein, 11 aa, Homo sapiens
  heavy chain complementarity determining region 3 for antibody 6251
GRDVDYSTPGF

SEQ ID NO: 12503 - protein, 10 aa, Homo sapiens
  light chain complementarity determining region 3 for antibody 6252
RQYYNRPPNT

SEQ ID NO: 12504 - protein, 17 aa, Homo sapiens
  heavy chain complementarity determining region 3 for antibody 6252
ATTERYYDRSGYHPFEN

SEQ ID NO: 12505 - protein, 7 aa, Homo sapiens
  light chain complementarity determining region 3 for antibody 6253
RQYSSWT

SEQ ID NO: 12506 - protein, 12 aa, Homo sapiens
  heavy chain complementarity determining region 3 for antibody 6253
AIVVPGRWDLDD

SEQ ID NO: 12507 - protein, 7 aa, Homo sapiens
  light chain complementarity determining region 3 for antibody 6254
RQYNTWT

SEQ ID NO: 12508 - protein, 10 aa, Homo sapiens
  heavy chain complementarity determining region 3 for antibody 6254
ARGGLAGDIQ

SEQ ID NO: 12509 - protein, 8 aa, Homo sapiens
  light chain complementarity determining region 3 for antibody 6255
RQYNSYST

SEQ ID NO: 12510 - protein, 23 aa, Homo sapiens
  heavy chain complementarity determining region 3 for antibody 6255
ARLRVWGSYRYMVDPYYYYGMDV

SEQ ID NO: 12511 - protein, 10 aa, Homo sapiens
  light chain complementarity determining region 3 for antibody 6256
RQYNSYSPRP

SEQ ID NO: 12512 - protein, 15 aa, Homo sapiens
  heavy chain complementarity determining region 3 for antibody 6256
ARVGRPYHNAWYFDN

SEQ ID NO: 12513 - protein, 9 aa, Homo sapiens
  light chain complementarity determining region 3 for antibody 6257
RQYNSYPWT

SEQ ID NO: 12514 - protein, 15 aa, Homo sapiens
  heavy chain complementarity determining region 3 for antibody 6257
GKEGPGSSGWLTGHY

SEQ ID NO: 12515 - protein, 9 aa, Homo sapiens
  light chain complementarity determining region 3 for antibody 6258
RQYNSYPPT

SEQ ID NO: 12516 - protein, 13 aa, Homo sapiens
  heavy chain complementarity determining region 3 for antibody 6258
AKEGSSPGPDFEY

SEQ ID NO: 12517 - protein, 9 aa, Homo sapiens
  light chain complementarity determining region 3 for antibody 6259
RQYNNWPQT

SEQ ID NO: 12518 - protein, 16 aa, Homo sapiens
  heavy chain complementarity determining region 3 for antibody 6259
ARDLWVAAWYPGALDV

SEQ ID NO: 12519 - protein, 9 aa, Homo sapiens
  light chain complementarity determining region 3 for antibody 6260
RQYKTVPWT

SEQ ID NO: 12520 - protein, 20 aa, Homo sapiens
  heavy chain complementarity determining region 3 for antibody 6260
AKDGRGTADYHSAGGGGLDV

SEQ ID NO: 12521 - protein, 8 aa, Homo sapiens
  light chain complementarity determining region 3 for antibody 6261
RQYGYSHT

SEQ ID NO: 12522 - protein, 15 aa, Homo sapiens
  heavy chain complementarity determining region 3 for antibody 6261
ARGLLATGGWYYFDY

SEQ ID NO: 12523 - protein, 9 aa, Homo sapiens
  light chain complementarity determining region 3 for antibody 6262
RQYGTSPVT

SEQ ID NO: 12524 - protein, 13 aa, Homo sapiens
  heavy chain complementarity determining region 3 for antibody 6262
AKDRGSGWFAWGY

SEQ ID NO: 12525 - protein, 9 aa, Homo sapiens
  light chain complementarity determining region 3 for antibody 6263
RQYGTSPKT

SEQ ID NO: 12526 - protein, 15 aa, Homo sapiens
  heavy chain complementarity determining region 3 for antibody 6263
TTEDITGVQGEPLDY

SEQ ID NO: 12527 - protein, 9 aa, Homo sapiens
  light chain complementarity determining region 3 for antibody 6264
RQYGSSTWT

SEQ ID NO: 12528 - protein, 17 aa, Homo sapiens
  heavy chain complementarity determining region 3 for antibody 6264
AKGRGSVAMALIYYLDL

SEQ ID NO: 12529 - protein, 9 aa, Homo sapiens
  light chain complementarity determining region 3 for antibody 6265
RQYGSSPWT

SEQ ID NO: 12530 - protein, 10 aa, Homo sapiens
  heavy chain complementarity determining region 3 for antibody 6265
ARERSGSYDI

SEQ ID NO: 12531 - protein, 9 aa, Homo sapiens
  light chain complementarity determining region 3 for antibody 6266
RQYGNSPLT

SEQ ID NO: 12532 - protein, 6 aa, Homo sapiens
  heavy chain complementarity determining region 3 for antibody 6266
VRSVDY

SEQ ID NO: 12533 - protein, 10 aa, Homo sapiens
  light chain complementarity determining region 3 for antibody 6267
RQYGNLASLT

SEQ ID NO: 12534 - protein, 13 aa, Homo sapiens
  heavy chain complementarity determining region 3 for antibody 6267
AKEGSSPGPDFEY

SEQ ID NO: 12535 - protein, 9 aa, Homo sapiens
  light chain complementarity determining region 3 for antibody 6268
RQYGGSLLT

SEQ ID NO: 12536 - protein, 10 aa, Homo sapiens
  heavy chain complementarity determining region 3 for antibody 6268
CRDRWGFGDV

SEQ ID NO: 12537 - protein, 9 aa, Homo sapiens
  light chain complementarity determining region 3 for antibody 6269
RQYDNLPLT

SEQ ID NO: 12538 - protein, 13 aa, Homo sapiens
  heavy chain complementarity determining region 3 for antibody 6269
AKEGSSPGPDFEY

SEQ ID NO: 12539 - protein, 9 aa, Homo sapiens
  light chain complementarity determining region 3 for antibody 6270
RQYDNLPLT

SEQ ID NO: 12540 - protein, 12 aa, Homo sapiens
  heavy chain complementarity determining region 3 for antibody 6270
AIVVPGRWDFDD

SEQ ID NO: 12541 - protein, 9 aa, Homo sapiens
  light chain complementarity determining region 3 for antibody 6271
RQYDNLPLT

SEQ ID NO: 12542 - protein, 12 aa, Homo sapiens
  heavy chain complementarity determining region 3 for antibody 6271
AIVVPGRWALDD

SEQ ID NO: 12543 - protein, 8 aa, Homo sapiens
  light chain complementarity determining region 3 for antibody 6272
RQYDNLLT

SEQ ID NO: 12544 - protein, 13 aa, Homo sapiens
  heavy chain complementarity determining region 3 for antibody 6272
ARPYGDYGWAFNI

SEQ ID NO: 12545 - protein, 8 aa, Homo sapiens
  light chain complementarity determining region 3 for antibody 6273
RQYDNART

SEQ ID NO: 12546 - protein, 18 aa, Homo sapiens
  heavy chain complementarity determining region 3 for antibody 6273
AKGKLPFCSGTRCYPDDL

SEQ ID NO: 12547 - protein, 9 aa, Homo sapiens
  light chain complementarity determining region 3 for antibody 6274
RQYDHYAHT

SEQ ID NO: 12548 - protein, 14 aa, Homo sapiens
  heavy chain complementarity determining region 3 for antibody 6274
ARDVHTTGWTLGGY

SEQ ID NO: 12549 - protein, 9 aa, Homo sapiens
  light chain complementarity determining region 3 for antibody 6275
RQTYRTPYT

SEQ ID NO: 12550 - protein, 14 aa, Homo sapiens
  heavy chain complementarity determining region 3 for antibody 6275
ARLHGSGLGRWLDP

SEQ ID NO: 12551 - protein, 9 aa, Homo sapiens
  light chain complementarity determining region 3 for antibody 6276
RQTLQTPWK

SEQ ID NO: 12552 - protein, 12 aa, Homo sapiens
  heavy chain complementarity determining region 3 for antibody 6276
ARLDWNYRAFDI

SEQ ID NO: 12553 - protein, 9 aa, Homo sapiens
  light chain complementarity determining region 3 for antibody 6277
RQSYTMPRT

SEQ ID NO: 12554 - protein, 18 aa, Homo sapiens
  heavy chain complementarity determining region 3 for antibody 6277
TTVLSQLLAGDWHLYFQH

SEQ ID NO: 12555 - protein, 10 aa, Homo sapiens
  light chain complementarity determining region 3 for antibody 6278
RQSYSTPLFT

SEQ ID NO: 12556 - protein, 23 aa, Homo sapiens
  heavy chain complementarity determining region 3 for antibody 6278
ARHFPMGGSTVTGTQSLLYYMDV

SEQ ID NO: 12557 - protein, 8 aa, Homo sapiens
  light chain complementarity determining region 3 for antibody 6279
RQSYSSPT

SEQ ID NO: 12558 - protein, 17 aa, Homo sapiens
  heavy chain complementarity determining region 3 for antibody 6279
AKGRGSVAMALIYYLDL

SEQ ID NO: 12559 - protein, 9 aa, Homo sapiens
  light chain complementarity determining region 3 for antibody 6280
RQRGYWPPT

SEQ ID NO: 12560 - protein, 14 aa, Homo sapiens
  heavy chain complementarity determining region 3 for antibody 6280
AKHTHNWYLGVLDC

SEQ ID NO: 12561 - protein, 9 aa, Homo sapiens
  light chain complementarity determining region 3 for antibody 6281
RQRGSWPPT

SEQ ID NO: 12562 - protein, 14 aa, Homo sapiens
  heavy chain complementarity determining region 3 for antibody 6281
AKGMTSWYLMVVDY

SEQ ID NO: 12563 - protein, 9 aa, Homo sapiens
  light chain complementarity determining region 3 for antibody 6282
RQLSNAPLT

SEQ ID NO: 12564 - protein, 17 aa, Homo sapiens
  heavy chain complementarity determining region 3 for antibody 6282
AKRLPDLLGGGHHYIDV

SEQ ID NO: 12565 - protein, 9 aa, Homo sapiens
  light chain complementarity determining region 3 for antibody 6283
RQLNSFPYT

SEQ ID NO: 12566 - protein, 21 aa, Homo sapiens
  heavy chain complementarity determining region 3 for antibody 6283
ARGSRTDCRSDDTGCRPMFDS

SEQ ID NO: 12567 - protein, 9 aa, Homo sapiens
  light chain complementarity determining region 3 for antibody 6284
RQLMVYPYT

SEQ ID NO: 12568 - protein, 14 aa, Homo sapiens
  heavy chain complementarity determining region 3 for antibody 6284
TRGHFDSTGFRLDY

SEQ ID NO: 12569 - protein, 9 aa, Homo sapiens
  light chain complementarity determining region 3 for antibody 6285
RQGTYWPYT

SEQ ID NO: 12570 - protein, 11 aa, Homo sapiens
  heavy chain complementarity determining region 3 for antibody 6285
AREGWGSLLDY

SEQ ID NO: 12571 - protein, 9 aa, Homo sapiens
  light chain complementarity determining region 3 for antibody 6286
RQGTHWPPS

SEQ ID NO: 12572 - protein, 13 aa, Homo sapiens
  heavy chain complementarity determining region 3 for antibody 6286
ARDTVTNKMGSDY

SEQ ID NO: 12573 - protein, 9 aa, Homo sapiens
  light chain complementarity determining region 3 for antibody 6287
RQGTHWPNT

SEQ ID NO: 12574 - protein, 11 aa, Homo sapiens
  heavy chain complementarity determining region 3 for antibody 6287
ARGDGWYGLDY

SEQ ID NO: 12575 - protein, 8 aa, Homo sapiens
  light chain complementarity determining region 3 for antibody 6288
RQGTHWPA

SEQ ID NO: 12576 - protein, 12 aa, Homo sapiens
  heavy chain complementarity determining region 3 for antibody 6288
AIVVPGRWDLDD

SEQ ID NO: 12577 - protein, 9 aa, Homo sapiens
  light chain complementarity determining region 3 for antibody 6289
RQFNSYPRT

SEQ ID NO: 12578 - protein, 13 aa, Homo sapiens
  heavy chain complementarity determining region 3 for antibody 6289
AADGPYGSSAFDY

SEQ ID NO: 12579 - protein, 9 aa, Homo sapiens
  light chain complementarity determining region 3 for antibody 6290
RQATHWPRT

SEQ ID NO: 12580 - protein, 12 aa, Homo sapiens
  heavy chain complementarity determining region 3 for antibody 6290
STDVETTFPSVS

SEQ ID NO: 12581 - protein, 9 aa, Homo sapiens
  light chain complementarity determining region 3 for antibody 6291
RHFGSATGT

SEQ ID NO: 12582 - protein, 13 aa, Homo sapiens
  heavy chain complementarity determining region 3 for antibody 6291
AKEGSSPGPDFEY

SEQ ID NO: 12583 - protein, 10 aa, Homo sapiens
  light chain complementarity determining region 3 for antibody 6292
RESYSTPLFT

SEQ ID NO: 12584 - protein, 23 aa, Homo sapiens
  heavy chain complementarity determining region 3 for antibody 6292
ARHFPKGGSGVTGTQSLHYYMDV

SEQ ID NO: 12585 - protein, 7 aa, Homo sapiens
  light chain complementarity determining region 3 for antibody 6293
RCRDCWV

SEQ ID NO: 12586 - protein, 20 aa, Homo sapiens
  heavy chain complementarity determining region 3 for antibody 6293
ATYLPGDCSCTGCYYWYFNF

SEQ ID NO: 12587 - protein, 7 aa, Homo sapiens
  light chain complementarity determining region 3 for antibody 6294
QYRSNWG

SEQ ID NO: 12588 - protein, 17 aa, Homo sapiens
  heavy chain complementarity determining region 3 for antibody 6294
ARNTMVGTWQRQGNLDH

SEQ ID NO: 12589 - protein, 7 aa, Homo sapiens
  light chain complementarity determining region 3 for antibody 6295
QYRSNWG

SEQ ID NO: 12590 - protein, 13 aa, Homo sapiens
  heavy chain complementarity determining region 3 for antibody 6295
AKEGSSPGPDFDS

SEQ ID NO: 12591 - protein, 9 aa, Homo sapiens
  light chain complementarity determining region 3 for antibody 6296
QVYTSAPHT

SEQ ID NO: 12592 - protein, 14 aa, Homo sapiens
  heavy chain complementarity determining region 3 for antibody 6296
CRGWLDPATPHYDF

SEQ ID NO: 12593 - protein, 9 aa, Homo sapiens
  light chain complementarity determining region 3 for antibody 6297
QVYSTYSRT

SEQ ID NO: 12594 - protein, 15 aa, Homo sapiens
  heavy chain complementarity determining region 3 for antibody 6297
ARDCISTNCYLIFDN

SEQ ID NO: 12595 - protein, 9 aa, Homo sapiens
  light chain complementarity determining region 3 for antibody 6298
QVYQSAPHT

SEQ ID NO: 12596 - protein, 14 aa, Homo sapiens
  heavy chain complementarity determining region 3 for antibody 6298
CRGWLDPATPHYDF

SEQ ID NO: 12597 - protein, 9 aa, Homo sapiens
  light chain complementarity determining region 3 for antibody 6299
QVYKSSPHT

SEQ ID NO: 12598 - protein, 14 aa, Homo sapiens
  heavy chain complementarity determining region 3 for antibody 6299
CRGWLDPATPHYDF

SEQ ID NO: 12599 - protein, 9 aa, Homo sapiens
  light chain complementarity determining region 3 for antibody 6300
QVYKSDPHT

SEQ ID NO: 12600 - protein, 14 aa, Homo sapiens
  heavy chain complementarity determining region 3 for antibody 6300
CRGWLDPATPHYDF

SEQ ID NO: 12601 - protein, 9 aa, Homo sapiens
  light chain complementarity determining region 3 for antibody 6301
QVYKSAPQT

SEQ ID NO: 12602 - protein, 14 aa, Homo sapiens
  heavy chain complementarity determining region 3 for antibody 6301
CRGWLDPATPHYDF

SEQ ID NO: 12603 - protein, 9 aa, Homo sapiens
  light chain complementarity determining region 3 for antibody 6302
QVYKSAPNT

SEQ ID NO: 12604 - protein, 14 aa, Homo sapiens
  heavy chain complementarity determining region 3 for antibody 6302
CRGWLDPATPHYDF

SEQ ID NO: 12605 - protein, 9 aa, Homo sapiens
  light chain complementarity determining region 3 for antibody 6303
QVYKSAPHT

SEQ ID NO: 12606 - protein, 16 aa, Homo sapiens
  heavy chain complementarity determining region 3 for antibody 6303
VGPHLTYNSGWRYFDY

SEQ ID NO: 12607 - protein, 9 aa, Homo sapiens
  light chain complementarity determining region 3 for antibody 6304
QVYKSAPHT

SEQ ID NO: 12608 - protein, 14 aa, Homo sapiens
  heavy chain complementarity determining region 3 for antibody 6304
GRGWLDPATPHYDF

SEQ ID NO: 12609 - protein, 9 aa, Homo sapiens
  light chain complementarity determining region 3 for antibody 6305
QVYKSAPHT

SEQ ID NO: 12610 - protein, 14 aa, Homo sapiens
  heavy chain complementarity determining region 3 for antibody 6305
FRGWLDPATPHYDF

SEQ ID NO: 12611 - protein, 9 aa, Homo sapiens
  light chain complementarity determining region 3 for antibody 6306
QVYKSAPHT

SEQ ID NO: 12612 - protein, 14 aa, Homo sapiens
  heavy chain complementarity determining region 3 for antibody 6306
CRGWLGPATPHYDF

SEQ ID NO: 12613 - protein, 9 aa, Homo sapiens
  light chain complementarity determining region 3 for antibody 6307
QVYKSAPHT

SEQ ID NO: 12614 - protein, 14 aa, Homo sapiens
  heavy chain complementarity determining region 3 for antibody 6307
CRGWLEPATPHYDF

SEQ ID NO: 12615 - protein, 9 aa, Homo sapiens
  light chain complementarity determining region 3 for antibody 6308
QVYKSAPHT

SEQ ID NO: 12616 - protein, 14 aa, Homo sapiens
  heavy chain complementarity determining region 3 for antibody 6308
CRGWLDRATPHYDF

SEQ ID NO: 12617 - protein, 9 aa, Homo sapiens
  light chain complementarity determining region 3 for antibody 6309
QVYKSAPHT

SEQ ID NO: 12618 - protein, 14 aa, Homo sapiens
  heavy chain complementarity determining region 3 for antibody 6309
CRGWLDPATRHYDF

SEQ ID NO: 12619 - protein, 9 aa, Homo sapiens
  light chain complementarity determining region 3 for antibody 6310
QVYKSAPHT

SEQ ID NO: 12620 - protein, 14 aa, Homo sapiens
  heavy chain complementarity determining region 3 for antibody 6310
CRGWLDPATPQYDF

SEQ ID NO: 12621 - protein, 9 aa, Homo sapiens
  light chain complementarity determining region 3 for antibody 6311
QVYKSAPHT

SEQ ID NO: 12622 - protein, 14 aa, Homo sapiens
  heavy chain complementarity determining region 3 for antibody 6311
CRGWLDPATPHYDV

SEQ ID NO: 12623 - protein, 9 aa, Homo sapiens
  light chain complementarity determining region 3 for antibody 6312
QVYKSAPHT

SEQ ID NO: 12624 - protein, 14 aa, Homo sapiens
  heavy chain complementarity determining region 3 for antibody 6312
CRGWLDPAKPHYDF

SEQ ID NO: 12625 - protein, 9 aa, Homo sapiens
  light chain complementarity determining region 3 for antibody 6313
QVYKSAPHT

SEQ ID NO: 12626 - protein, 17 aa, Homo sapiens
  heavy chain complementarity determining region 3 for antibody 6313
ARNTMVGTWQRQGNLDH

SEQ ID NO: 12627 - protein, 9 aa, Homo sapiens
  light chain complementarity determining region 3 for antibody 6314
QVYKSAPHT

SEQ ID NO: 12628 - protein, 10 aa, Homo sapiens
  heavy chain complementarity determining region 3 for antibody 6314
ARETSGAYDI

SEQ ID NO: 12629 - protein, 9 aa, Homo sapiens
  light chain complementarity determining region 3 for antibody 6315
QVYKSAPHT

SEQ ID NO: 12630 - protein, 13 aa, Homo sapiens
  heavy chain complementarity determining region 3 for antibody 6315
AKEGSAPGPDFEY

SEQ ID NO: 12631 - protein, 9 aa, Homo sapiens
  light chain complementarity determining region 3 for antibody 6316
QVYKSAPHN

SEQ ID NO: 12632 - protein, 14 aa, Homo sapiens
  heavy chain complementarity determining region 3 for antibody 6316
CRGWLDPATPHYDF

SEQ ID NO: 12633 - protein, 9 aa, Homo sapiens
  light chain complementarity determining region 3 for antibody 6317
QVYKSAHHT

SEQ ID NO: 12634 - protein, 14 aa, Homo sapiens
  heavy chain complementarity determining region 3 for antibody 6317
CRGWLDPATPHYDF

SEQ ID NO: 12635 - protein, 9 aa, Homo sapiens
  light chain complementarity determining region 3 for antibody 6318
QVYKRAPHT

SEQ ID NO: 12636 - protein, 14 aa, Homo sapiens
  heavy chain complementarity determining region 3 for antibody 6318
CRGWLDPATPHYDF

SEQ ID NO: 12637 - protein, 9 aa, Homo sapiens
  light chain complementarity determining region 3 for antibody 6319
QVYGTLRGT

SEQ ID NO: 12638 - protein, 15 aa, Homo sapiens
  heavy chain complementarity determining region 3 for antibody 6319
AKPRSNMFAHDAFDI

SEQ ID NO: 12639 - protein, 8 aa, Homo sapiens
  light chain complementarity determining region 3 for antibody 6320
QVYGDSFP

SEQ ID NO: 12640 - protein, 16 aa, Homo sapiens
  heavy chain complementarity determining region 3 for antibody 6320
AIWAAVSSGWSGPFDF

SEQ ID NO: 12641 - protein, 9 aa, Homo sapiens
  light chain complementarity determining region 3 for antibody 6321
QVYATSRGM

SEQ ID NO: 12642 - protein, 12 aa, Homo sapiens
  heavy chain complementarity determining region 3 for antibody 6321
AKAQTYYYAFDV

SEQ ID NO: 12643 - protein, 9 aa, Homo sapiens
  light chain complementarity determining region 3 for antibody 6322
QVDKSAPHT

SEQ ID NO: 12644 - protein, 14 aa, Homo sapiens
  heavy chain complementarity determining region 3 for antibody 6322
CRGWLDPATPHYDF

SEQ ID NO: 12645 - protein, 9 aa, Homo sapiens
  light chain complementarity determining region 3 for antibody 6323
QTYNSAFLT

SEQ ID NO: 12646 - protein, 18 aa, Homo sapiens
  heavy chain complementarity determining region 3 for antibody 6323
ARWAGSCSGRSCYAPFDF

SEQ ID NO: 12647 - protein, 9 aa, Homo sapiens
  light chain complementarity determining region 3 for antibody 6324
QRYYSSPLT

SEQ ID NO: 12648 - protein, 14 aa, Homo sapiens
  heavy chain complementarity determining region 3 for antibody 6324
TKPTRGPGSFLIDY

SEQ ID NO: 12649 - protein, 9 aa, Homo sapiens
  light chain complementarity determining region 3 for antibody 6325
QRYYSAPIT

SEQ ID NO: 12650 - protein, 14 aa, Homo sapiens
  heavy chain complementarity determining region 3 for antibody 6325
ARGESTSCDFIFDF

SEQ ID NO: 12651 - protein, 9 aa, Homo sapiens
  light chain complementarity determining region 3 for antibody 6326
QRYYNVPGT

SEQ ID NO: 12652 - protein, 14 aa, Homo sapiens
  heavy chain complementarity determining region 3 for antibody 6326
TRDGINTVVRGGDS

SEQ ID NO: 12653 - protein, 7 aa, Homo sapiens
  light chain complementarity determining region 3 for antibody 6327
QRYSSWT

SEQ ID NO: 12654 - protein, 12 aa, Homo sapiens
  heavy chain complementarity determining region 3 for antibody 6327
AIVVPGRWDLDD

SEQ ID NO: 12655 - protein, 9 aa, Homo sapiens
  light chain complementarity determining region 3 for antibody 6328
QRYNTVPWA

SEQ ID NO: 12656 - protein, 20 aa, Homo sapiens
  heavy chain complementarity determining region 3 for antibody 6328
TRDQRSIHSWLLAEGGGMDV

SEQ ID NO: 12657 - protein, 9 aa, Homo sapiens
  light chain complementarity determining region 3 for antibody 6329
QRYNTVPWA

SEQ ID NO: 12658 - protein, 20 aa, Homo sapiens
  heavy chain complementarity determining region 3 for antibody 6329
TRDQRSIHLWSLAEGGGRDV

SEQ ID NO: 12659 - protein, 9 aa, Homo sapiens
  light chain complementarity determining region 3 for antibody 6330
QRYNSYSYT

SEQ ID NO: 12660 - protein, 14 aa, Homo sapiens
  heavy chain complementarity determining region 3 for antibody 6330
VRDYCSGGTCYSGS

SEQ ID NO: 12661 - protein, 9 aa, Homo sapiens
  light chain complementarity determining region 3 for antibody 6331
QRYNSYSYT

SEQ ID NO: 12662 - protein, 12 aa, Homo sapiens
  heavy chain complementarity determining region 3 for antibody 6331
SRDKGGRNGMDV

SEQ ID NO: 12663 - protein, 9 aa, Homo sapiens
  light chain complementarity determining region 3 for antibody 6332
QRYNSYSYT

SEQ ID NO: 12664 - protein, 10 aa, Homo sapiens
  heavy chain complementarity determining region 3 for antibody 6332
ARTRVFLFDY

SEQ ID NO: 12665 - protein, 9 aa, Homo sapiens
  light chain complementarity determining region 3 for antibody 6333
QRYNSYSYT

SEQ ID NO: 12666 - protein, 10 aa, Homo sapiens
  heavy chain complementarity determining region 3 for antibody 6333
ARTRGLLFDY

SEQ ID NO: 12667 - protein, 9 aa, Homo sapiens
  light chain complementarity determining region 3 for antibody 6334
QRYNSYSYT

SEQ ID NO: 12668 - protein, 10 aa, Homo sapiens
  heavy chain complementarity determining region 3 for antibody 6334
ARTRGCLFDY

SEQ ID NO: 12669 - protein, 9 aa, Homo sapiens
  light chain complementarity determining region 3 for antibody 6335
QRYNSYSYT

SEQ ID NO: 12670 - protein, 11 aa, Homo sapiens
  heavy chain complementarity determining region 3 for antibody 6335
ARRSLGGAFDY

SEQ ID NO: 12671 - protein, 9 aa, Homo sapiens
  light chain complementarity determining region 3 for antibody 6336
QRYNSYSYT

SEQ ID NO: 12672 - protein, 12 aa, Homo sapiens
  heavy chain complementarity determining region 3 for antibody 6336
ARDKGGRNGMDV

SEQ ID NO: 12673 - protein, 9 aa, Homo sapiens
  light chain complementarity determining region 3 for antibody 6337
QRYNSYSYP

SEQ ID NO: 12674 - protein, 10 aa, Homo sapiens
  heavy chain complementarity determining region 3 for antibody 6337
ARTRGFLFDY

SEQ ID NO: 12675 - protein, 9 aa, Homo sapiens
  light chain complementarity determining region 3 for antibody 6338
QRYNSYSNT

SEQ ID NO: 12676 - protein, 10 aa, Homo sapiens
  heavy chain complementarity determining region 3 for antibody 6338
ARTRGFLFDY

SEQ ID NO: 12677 - protein, 9 aa, Homo sapiens
  light chain complementarity determining region 3 for antibody 6339
QRYNSYSLT

SEQ ID NO: 12678 - protein, 15 aa, Homo sapiens
  heavy chain complementarity determining region 3 for antibody 6339
ARSMVSGTTDDAFDI

SEQ ID NO: 12679 - protein, 9 aa, Homo sapiens
  light chain complementarity determining region 3 for antibody 6340
QRYNNWPFT

SEQ ID NO: 12680 - protein, 10 aa, Homo sapiens
  heavy chain complementarity determining region 3 for antibody 6340
VRSDSPGDDS

SEQ ID NO: 12681 - protein, 9 aa, Homo sapiens
  light chain complementarity determining region 3 for antibody 6341
QRYNGYSYT

SEQ ID NO: 12682 - protein, 10 aa, Homo sapiens
  heavy chain complementarity determining region 3 for antibody 6341
ARTRGFLFDY

SEQ ID NO: 12683 - protein, 10 aa, Homo sapiens
  light chain complementarity determining region 3 for antibody 6342
QRYHSYSPLT

SEQ ID NO: 12684 - protein, 16 aa, Homo sapiens
  heavy chain complementarity determining region 3 for antibody 6342
ARWFSRSSTGVSYMDV

SEQ ID NO: 12685 - protein, 9 aa, Homo sapiens
  light chain complementarity determining region 3 for antibody 6343
QRYHNWPGT

SEQ ID NO: 12686 - protein, 11 aa, Homo sapiens
  heavy chain complementarity determining region 3 for antibody 6343
AKGGFYFLTGD

SEQ ID NO: 12687 - protein, 9 aa, Homo sapiens
  light chain complementarity determining region 3 for antibody 6344
QRYHGYPWT

SEQ ID NO: 12688 - protein, 11 aa, Homo sapiens
  heavy chain complementarity determining region 3 for antibody 6344
ARIVARKPDDY

SEQ ID NO: 12689 - protein, 10 aa, Homo sapiens
  light chain complementarity determining region 3 for antibody 6345
QRYGSSPPLT

SEQ ID NO: 12690 - protein, 20 aa, Homo sapiens
  heavy chain complementarity determining region 3 for antibody 6345
GRDSSRSYSNSWAYYYGTDV

SEQ ID NO: 12691 - protein, 10 aa, Homo sapiens
  light chain complementarity determining region 3 for antibody 6346
QRYGSSPPFT

SEQ ID NO: 12692 - protein, 21 aa, Homo sapiens
  heavy chain complementarity determining region 3 for antibody 6346
ARWAGNCDATSCYGFSGPFDD

SEQ ID NO: 12693 - protein, 9 aa, Homo sapiens
  light chain complementarity determining region 3 for antibody 6347
QRYGSSPIT

SEQ ID NO: 12694 - protein, 12 aa, Homo sapiens
  heavy chain complementarity determining region 3 for antibody 6347
VKDRGGRSGMDL

SEQ ID NO: 12695 - protein, 9 aa, Homo sapiens
  light chain complementarity determining region 3 for antibody 6348
QRYGNSPVP

SEQ ID NO: 12696 - protein, 18 aa, Homo sapiens
  heavy chain complementarity determining region 3 for antibody 6348
ARGDYPEARTGYFLDFDY

SEQ ID NO: 12697 - protein, 9 aa, Homo sapiens
  light chain complementarity determining region 3 for antibody 6349
QRYGGPPGT

SEQ ID NO: 12698 - protein, 17 aa, Homo sapiens
  heavy chain complementarity determining region 3 for antibody 6349
ARGIWSCHLGGGSSMDV

SEQ ID NO: 12699 - protein, 9 aa, Homo sapiens
  light chain complementarity determining region 3 for antibody 6350
QRYGALPLT

SEQ ID NO: 12700 - protein, 13 aa, Homo sapiens
  heavy chain complementarity determining region 3 for antibody 6350
AKDRGGGWYAWGY

SEQ ID NO: 12701 - protein, 10 aa, Homo sapiens
  light chain complementarity determining region 3 for antibody 6351
QRYFSTPPWT

SEQ ID NO: 12702 - protein, 13 aa, Homo sapiens
  heavy chain complementarity determining region 3 for antibody 6351
ASLRRDNSGHFNY

SEQ ID NO: 12703 - protein, 9 aa, Homo sapiens
  light chain complementarity determining region 3 for antibody 6352
QRYDNLPYT

SEQ ID NO: 12704 - protein, 13 aa, Homo sapiens
  heavy chain complementarity determining region 3 for antibody 6352
AKEGSAPGPDFEY

SEQ ID NO: 12705 - protein, 9 aa, Homo sapiens
  light chain complementarity determining region 3 for antibody 6353
QRYDHYAHT

SEQ ID NO: 12706 - protein, 14 aa, Homo sapiens
  heavy chain complementarity determining region 3 for antibody 6353
ARDVHTTGWTLGGY

SEQ ID NO: 12707 - protein, 9 aa, Homo sapiens
  light chain complementarity determining region 3 for antibody 6354
QRTYSSPWT

SEQ ID NO: 12708 - protein, 15 aa, Homo sapiens
  heavy chain complementarity determining region 3 for antibody 6354
ARIWTSSTSCRYMDV

SEQ ID NO: 12709 - protein, 9 aa, Homo sapiens
  light chain complementarity determining region 3 for antibody 6355
QRTYRTPYT

SEQ ID NO: 12710 - protein, 14 aa, Homo sapiens
  heavy chain complementarity determining region 3 for antibody 6355
ARLHGSGLGRWLDP

SEQ ID NO: 12711 - protein, 10 aa, Homo sapiens
  light chain complementarity determining region 3 for antibody 6356
QRSYSTPLFT

SEQ ID NO: 12712 - protein, 15 aa, Homo sapiens
  heavy chain complementarity determining region 3 for antibody 6356
ARVGRPYHNAWYFDN

SEQ ID NO: 12713 - protein, 9 aa, Homo sapiens
  light chain complementarity determining region 3 for antibody 6357
QRSYSTPIT

SEQ ID NO: 12714 - protein, 17 aa, Homo sapiens
  heavy chain complementarity determining region 3 for antibody 6357
ARNTMVGTWQRQGNLDH

SEQ ID NO: 12715 - protein, 9 aa, Homo sapiens
  light chain complementarity determining region 3 for antibody 6358
QRRSNWPIT

SEQ ID NO: 12716 - protein, 12 aa, Homo sapiens
  heavy chain complementarity determining region 3 for antibody 6358
NADHGYVDGFDI

SEQ ID NO: 12717 - protein, 9 aa, Homo sapiens
  light chain complementarity determining region 3 for antibody 6359
QRNYNVPWT

SEQ ID NO: 12718 - protein, 14 aa, Homo sapiens
  heavy chain complementarity determining region 3 for antibody 6359
TRDGINTVVRGGDS

SEQ ID NO: 12719 - protein, 9 aa, Homo sapiens
  light chain complementarity determining region 3 for antibody 6360
QRNNNVPWA

SEQ ID NO: 12720 - protein, 20 aa, Homo sapiens
  heavy chain complementarity determining region 3 for antibody 6360
TRDQRSIHLWLLAEGGGMDV

SEQ ID NO: 12721 - protein, 9 aa, Homo sapiens
  light chain complementarity determining region 3 for antibody 6361
QRLSNAPLT

SEQ ID NO: 12722 - protein, 17 aa, Homo sapiens
  heavy chain complementarity determining region 3 for antibody 6361
AKRLPDLLGGGHHYIDV

SEQ ID NO: 12723 - protein, 9 aa, Homo sapiens
  light chain complementarity determining region 3 for antibody 6362
QRLHSYPYT

SEQ ID NO: 12724 - protein, 14 aa, Homo sapiens
  heavy chain complementarity determining region 3 for antibody 6362
ARGHFDSTGFRLDY

SEQ ID NO: 12725 - protein, 9 aa, Homo sapiens
  light chain complementarity determining region 3 for antibody 6363
QRLHSSPYT

SEQ ID NO: 12726 - protein, 14 aa, Homo sapiens
  heavy chain complementarity determining region 3 for antibody 6363
ARGHFDSTGFRLDY

SEQ ID NO: 12727 - protein, 9 aa, Homo sapiens
  light chain complementarity determining region 3 for antibody 6364
QRHYNVPWT

SEQ ID NO: 12728 - protein, 14 aa, Homo sapiens
  heavy chain complementarity determining region 3 for antibody 6364
TRDGINTVVRGGDS

SEQ ID NO: 12729 - protein, 9 aa, Homo sapiens
  light chain complementarity determining region 3 for antibody 6365
QRFSNLPRT

SEQ ID NO: 12730 - protein, 13 aa, Homo sapiens
  heavy chain complementarity determining region 3 for antibody 6365
AKEGSSPGPDFDS

SEQ ID NO: 12731 - protein, 9 aa, Homo sapiens
  light chain complementarity determining region 3 for antibody 6366
QRFANLPRT

SEQ ID NO: 12732 - protein, 9 aa, Homo sapiens
  heavy chain complementarity determining region 3 for antibody 6366
VRGRSNFRY

SEQ ID NO: 12733 - protein, 9 aa, Homo sapiens
  light chain complementarity determining region 3 for antibody 6367
QRDYYTPRT

SEQ ID NO: 12734 - protein, 11 aa, Homo sapiens
  heavy chain complementarity determining region 3 for antibody 6367
ARRSLGGAFDY

SEQ ID NO: 12735 - protein, 9 aa, Homo sapiens
  light chain complementarity determining region 3 for antibody 6368
QRDNTVPWA

SEQ ID NO: 12736 - protein, 20 aa, Homo sapiens
  heavy chain complementarity determining region 3 for antibody 6368
TRDQRSIHLWLLAEGGGMDV

SEQ ID NO: 12737 - protein, 9 aa, Homo sapiens
  light chain complementarity determining region 3 for antibody 6369
QRDDNVPLT

SEQ ID NO: 12738 - protein, 13 aa, Homo sapiens
  heavy chain complementarity determining region 3 for antibody 6369
GRSGYSYAKYFVD

SEQ ID NO: 12739 - protein, 9 aa, Homo sapiens
  light chain complementarity determining region 3 for antibody 6370
QQYYVSPIT

SEQ ID NO: 12740 - protein, 8 aa, Homo sapiens
  heavy chain complementarity determining region 3 for antibody 6370
ARRNDFDH

SEQ ID NO: 12741 - protein, 9 aa, Homo sapiens
  light chain complementarity determining region 3 for antibody 6371
QQYYTVPLT

SEQ ID NO: 12742 - protein, 10 aa, Homo sapiens
  heavy chain complementarity determining region 3 for antibody 6371
VGGEGWLTDF

SEQ ID NO: 12743 - protein, 10 aa, Homo sapiens
  light chain complementarity determining region 3 for antibody 6372
QQYYTTPRKK

SEQ ID NO: 12744 - protein, 12 aa, Homo sapiens
  heavy chain complementarity determining region 3 for antibody 6372
AKAQTYYYAFDV

SEQ ID NO: 12745 - protein, 10 aa, Homo sapiens
  light chain complementarity determining region 3 for antibody 6373
QQYYTTPLFT

SEQ ID NO: 12746 - protein, 13 aa, Homo sapiens
  heavy chain complementarity determining region 3 for antibody 6373
ARPNGDYGWAFNI

SEQ ID NO: 12747 - protein, 10 aa, Homo sapiens
  light chain complementarity determining region 3 for antibody 6374
QQYYTTPLFP

SEQ ID NO: 12748 - protein, 13 aa, Homo sapiens
  heavy chain complementarity determining region 3 for antibody 6374
ARPYGDYGWAFNI

SEQ ID NO: 12749 - protein, 9 aa, Homo sapiens
  light chain complementarity determining region 3 for antibody 6375
QQYYTSPRT

SEQ ID NO: 12750 - protein, 9 aa, Homo sapiens
  heavy chain complementarity determining region 3 for antibody 6375
ARENYYWDA

SEQ ID NO: 12751 - protein, 9 aa, Homo sapiens
  light chain complementarity determining region 3 for antibody 6376
QQYYTSPRP

SEQ ID NO: 12752 - protein, 9 aa, Homo sapiens
  heavy chain complementarity determining region 3 for antibody 6376
ARENYYLDA

SEQ ID NO: 12753 - protein, 10 aa, Homo sapiens
  light chain complementarity determining region 3 for antibody 6377
QQYYTGPALT

SEQ ID NO: 12754 - protein, 13 aa, Homo sapiens
  heavy chain complementarity determining region 3 for antibody 6377
ARYGYGYARPFDF

SEQ ID NO: 12755 - protein, 10 aa, Homo sapiens
  light chain complementarity determining region 3 for antibody 6378
QQYYTDPALP

SEQ ID NO: 12756 - protein, 13 aa, Homo sapiens
  heavy chain complementarity determining region 3 for antibody 6378
ARYGYGYARPFDF

SEQ ID NO: 12757 - protein, 9 aa, Homo sapiens
  light chain complementarity determining region 3 for antibody 6379
QQYYSYPRT

SEQ ID NO: 12758 - protein, 23 aa, Homo sapiens
  heavy chain complementarity determining region 3 for antibody 6379
AREGIYCSTTSCYNPVNVYYLDV

SEQ ID NO: 12759 - protein, 8 aa, Homo sapiens
  light chain complementarity determining region 3 for antibody 6380
QQYYSWQT

SEQ ID NO: 12760 - protein, 8 aa, Homo sapiens
  heavy chain complementarity determining region 3 for antibody 6380
ARDGDGYD

SEQ ID NO: 12761 - protein, 9 aa, Homo sapiens
  light chain complementarity determining region 3 for antibody 6381
QQYYSVPGA

SEQ ID NO: 12762 - protein, 17 aa, Homo sapiens
  heavy chain complementarity determining region 3 for antibody 6381
ASLRGYSHSYGFGVSES

SEQ ID NO: 12763 - protein, 9 aa, Homo sapiens
  light chain complementarity determining region 3 for antibody 6382
QQYYSTPYT

SEQ ID NO: 12764 - protein, 13 aa, Homo sapiens
  heavy chain complementarity determining region 3 for antibody 6382
ATEPYDGSGRGVY

SEQ ID NO: 12765 - protein, 9 aa, Homo sapiens
  light chain complementarity determining region 3 for antibody 6383
QQYYSTPYT

SEQ ID NO: 12766 - protein, 18 aa, Homo sapiens
  heavy chain complementarity determining region 3 for antibody 6383
ARSSYSGGYVYYYPFFDS

SEQ ID NO: 12767 - protein, 9 aa, Homo sapiens
  light chain complementarity determining region 3 for antibody 6384
QQYYSTPYT

SEQ ID NO: 12768 - protein, 14 aa, Homo sapiens
  heavy chain complementarity determining region 3 for antibody 6384
AASYSSGWLEHFQH

SEQ ID NO: 12769 - protein, 9 aa, Homo sapiens
  light chain complementarity determining region 3 for antibody 6385
QQYYSTPWT

SEQ ID NO: 12770 - protein, 18 aa, Homo sapiens
  heavy chain complementarity determining region 3 for antibody 6385
ARGPHQLRLGGYFYGLDV

SEQ ID NO: 12771 - protein, 9 aa, Homo sapiens
  light chain complementarity determining region 3 for antibody 6386
QQYYSTPWT

SEQ ID NO: 12772 - protein, 18 aa, Homo sapiens
  heavy chain complementarity determining region 3 for antibody 6386
ARGLRQLRLGGYFYGLDV

SEQ ID NO: 12773 - protein, 9 aa, Homo sapiens
  light chain complementarity determining region 3 for antibody 6387
QQYYSTPWT

SEQ ID NO: 12774 - protein, 18 aa, Homo sapiens
  heavy chain complementarity determining region 3 for antibody 6387
ARGLHQLRLGGYFCGLDV

SEQ ID NO: 12775 - protein, 9 aa, Homo sapiens
  light chain complementarity determining region 3 for antibody 6388
QQYYSTPWT

SEQ ID NO: 12776 - protein, 18 aa, Homo sapiens
  heavy chain complementarity determining region 3 for antibody 6388
ARGLHQLKLGGYFYGLDV

SEQ ID NO: 12777 - protein, 9 aa, Homo sapiens
  light chain complementarity determining region 3 for antibody 6389
QQYYSTPWT

SEQ ID NO: 12778 - protein, 18 aa, Homo sapiens
  heavy chain complementarity determining region 3 for antibody 6389
ARGLHKLRLGGYFYGLDV

SEQ ID NO: 12779 - protein, 9 aa, Homo sapiens
  light chain complementarity determining region 3 for antibody 6390
QQYYSTPWT

SEQ ID NO: 12780 - protein, 18 aa, Homo sapiens
  heavy chain complementarity determining region 3 for antibody 6390
ARGLDQLRRGGYFYGLDV

SEQ ID NO: 12781 - protein, 9 aa, Homo sapiens
  light chain complementarity determining region 3 for antibody 6391
QQYYSTPQT

SEQ ID NO: 12782 - protein, 17 aa, Homo sapiens
  heavy chain complementarity determining region 3 for antibody 6391
ARNTMVGTWQRQGNLDH

SEQ ID NO: 12783 - protein, 9 aa, Homo sapiens
  light chain complementarity determining region 3 for antibody 6392
QQYYSTPPT

SEQ ID NO: 12784 - protein, 10 aa, Homo sapiens
  heavy chain complementarity determining region 3 for antibody 6392
AKNSISYYDM

SEQ ID NO: 12785 - protein, 9 aa, Homo sapiens
  light chain complementarity determining region 3 for antibody 6393
QQYYSTPLT

SEQ ID NO: 12786 - protein, 9 aa, Homo sapiens
  heavy chain complementarity determining region 3 for antibody 6393
VKGERGVDY

SEQ ID NO: 12787 - protein, 9 aa, Homo sapiens
  light chain complementarity determining region 3 for antibody 6394
QQYYSTPLT

SEQ ID NO: 12788 - protein, 17 aa, Homo sapiens
  heavy chain complementarity determining region 3 for antibody 6394
ARGRGYGGNSARDAFDI

SEQ ID NO: 12789 - protein, 9 aa, Homo sapiens
  light chain complementarity determining region 3 for antibody 6395
QQYYSTLYP

SEQ ID NO: 12790 - protein, 15 aa, Homo sapiens
  heavy chain complementarity determining region 3 for antibody 6395
VKNSGWSGLRDSFGP

SEQ ID NO: 12791 - protein, 10 aa, Homo sapiens
  light chain complementarity determining region 3 for antibody 6396
QQYYSTHPLT

SEQ ID NO: 12792 - protein, 13 aa, Homo sapiens
  heavy chain complementarity determining region 3 for antibody 6396
AKRRTGDHYYFDY

SEQ ID NO: 12793 - protein, 9 aa, Homo sapiens
  light chain complementarity determining region 3 for antibody 6397
QQYYSSPVT

SEQ ID NO: 12794 - protein, 14 aa, Homo sapiens
  heavy chain complementarity determining region 3 for antibody 6397
AASYSSGWLEYFQY

SEQ ID NO: 12795 - protein, 9 aa, Homo sapiens
  light chain complementarity determining region 3 for antibody 6398
QQYYSSPQT

SEQ ID NO: 12796 - protein, 12 aa, Homo sapiens
  heavy chain complementarity determining region 3 for antibody 6398
ARLDWNYRAFDI

SEQ ID NO: 12797 - protein, 10 aa, Homo sapiens
  light chain complementarity determining region 3 for antibody 6399
QQYYSSPPWA

SEQ ID NO: 12798 - protein, 18 aa, Homo sapiens
  heavy chain complementarity determining region 3 for antibody 6399
TTVLSQLLAGDWHLYFQH

SEQ ID NO: 12799 - protein, 10 aa, Homo sapiens
  light chain complementarity determining region 3 for antibody 6400
QQYYSSPPWA

SEQ ID NO: 12800 - protein, 17 aa, Homo sapiens
  heavy chain complementarity determining region 3 for antibody 6400
SRDGRIIWPGSQGSLDS

SEQ ID NO: 12801 - protein, 10 aa, Homo sapiens
  light chain complementarity determining region 3 for antibody 6401
QQYYSSPPWA

SEQ ID NO: 12802 - protein, 11 aa, Homo sapiens
  heavy chain complementarity determining region 3 for antibody 6401
ATFGQQWRLAH

SEQ ID NO: 12803 - protein, 10 aa, Homo sapiens
  light chain complementarity determining region 3 for antibody 6402
QQYYSSPPWA

SEQ ID NO: 12804 - protein, 16 aa, Homo sapiens
  heavy chain complementarity determining region 3 for antibody 6402
ASLNRGDREFGVPPAL

SEQ ID NO: 12805 - protein, 10 aa, Homo sapiens
  light chain complementarity determining region 3 for antibody 6403
QQYYSSPPWA

SEQ ID NO: 12806 - protein, 16 aa, Homo sapiens
  heavy chain complementarity determining region 3 for antibody 6403
ASLNRGDKGFGVPPAL

SEQ ID NO: 12807 - protein, 10 aa, Homo sapiens
  light chain complementarity determining region 3 for antibody 6404
QQYYSSPPWA

SEQ ID NO: 12808 - protein, 16 aa, Homo sapiens
  heavy chain complementarity determining region 3 for antibody 6404
ASLNRGDKEVGVPPAL

SEQ ID NO: 12809 - protein, 10 aa, Homo sapiens
  light chain complementarity determining region 3 for antibody 6405
QQYYSSPPWA

SEQ ID NO: 12810 - protein, 16 aa, Homo sapiens
  heavy chain complementarity determining region 3 for antibody 6405
ASLNRGDKEFGVPRAL

SEQ ID NO: 12811 - protein, 10 aa, Homo sapiens
  light chain complementarity determining region 3 for antibody 6406
QQYYSSPPWA

SEQ ID NO: 12812 - protein, 16 aa, Homo sapiens
  heavy chain complementarity determining region 3 for antibody 6406
ASLNRGDKEFGVPPAF

SEQ ID NO: 12813 - protein, 10 aa, Homo sapiens
  light chain complementarity determining region 3 for antibody 6407
QQYYSSPPWA

SEQ ID NO: 12814 - protein, 11 aa, Homo sapiens
  heavy chain complementarity determining region 3 for antibody 6407
ARRSLGGAFDY

SEQ ID NO: 12815 - protein, 10 aa, Homo sapiens
  light chain complementarity determining region 3 for antibody 6408
QQYYSSPPWA

SEQ ID NO: 12816 - protein, 16 aa, Homo sapiens
  heavy chain complementarity determining region 3 for antibody 6408
ARLNRGDKEFGVPPAL

SEQ ID NO: 12817 - protein, 10 aa, Homo sapiens
  light chain complementarity determining region 3 for antibody 6409
QQYYSSPPWA

SEQ ID NO: 12818 - protein, 18 aa, Homo sapiens
  heavy chain complementarity determining region 3 for antibody 6409
ARGDYPEARTGYFLDFDY

SEQ ID NO: 12819 - protein, 10 aa, Homo sapiens
  light chain complementarity determining region 3 for antibody 6410
QQYYSSPPWA

SEQ ID NO: 12820 - protein, 10 aa, Homo sapiens
  heavy chain complementarity determining region 3 for antibody 6410
ARERSGSYDI

SEQ ID NO: 12821 - protein, 10 aa, Homo sapiens
  light chain complementarity determining region 3 for antibody 6411
QQYYSSPPWA

SEQ ID NO: 12822 - protein, 12 aa, Homo sapiens
  heavy chain complementarity determining region 3 for antibody 6411
AIVVPGRWDLDD

SEQ ID NO: 12823 - protein, 9 aa, Homo sapiens
  light chain complementarity determining region 3 for antibody 6412
QQYYSSPPP

SEQ ID NO: 12824 - protein, 15 aa, Homo sapiens
  heavy chain complementarity determining region 3 for antibody 6412
AKRHSSSRNYPYMDV

SEQ ID NO: 12825 - protein, 10 aa, Homo sapiens
  light chain complementarity determining region 3 for antibody 6413
QQYYSSPPLA

SEQ ID NO: 12826 - protein, 16 aa, Homo sapiens
  heavy chain complementarity determining region 3 for antibody 6413
ASLNRGDKEFGVPPAL

SEQ ID NO: 12827 - protein, 10 aa, Homo sapiens
  light chain complementarity determining region 3 for antibody 6414
QQYYSSPPCA

SEQ ID NO: 12828 - protein, 16 aa, Homo sapiens
  heavy chain complementarity determining region 3 for antibody 6414
ASLNRGDKEFGVPPAL

SEQ ID NO: 12829 - protein, 9 aa, Homo sapiens
  light chain complementarity determining region 3 for antibody 6415
QQYYSSPLT

SEQ ID NO: 12830 - protein, 14 aa, Homo sapiens
  heavy chain complementarity determining region 3 for antibody 6415
TKPTRGPGGFLIDY

SEQ ID NO: 12831 - protein, 9 aa, Homo sapiens
  light chain complementarity determining region 3 for antibody 6416
QQYYSSPLT

SEQ ID NO: 12832 - protein, 17 aa, Homo sapiens
  heavy chain complementarity determining region 3 for antibody 6416
AKDCCYGESDPDRYFGL

SEQ ID NO: 12833 - protein, 9 aa, Homo sapiens
  light chain complementarity determining region 3 for antibody 6417
QQYYSSPLT

SEQ ID NO: 12834 - protein, 14 aa, Homo sapiens
  heavy chain complementarity determining region 3 for antibody 6417
AASYSSGWLEYFQY

SEQ ID NO: 12835 - protein, 9 aa, Homo sapiens
  light chain complementarity determining region 3 for antibody 6418
QQYYSSPFT

SEQ ID NO: 12836 - protein, 14 aa, Homo sapiens
  heavy chain complementarity determining region 3 for antibody 6418
AASYSSGWLEYCQY

SEQ ID NO: 12837 - protein, 9 aa, Homo sapiens
  light chain complementarity determining region 3 for antibody 6419
QQYYSSPFT

SEQ ID NO: 12838 - protein, 14 aa, Homo sapiens
  heavy chain complementarity determining region 3 for antibody 6419
AASYSSGWLESFQY

SEQ ID NO: 12839 - protein, 9 aa, Homo sapiens
  light chain complementarity determining region 3 for antibody 6420
QQYYSSPFT

SEQ ID NO: 12840 - protein, 14 aa, Homo sapiens
  heavy chain complementarity determining region 3 for antibody 6420
AASYSSGWLDYFQY

SEQ ID NO: 12841 - protein, 9 aa, Homo sapiens
  light chain complementarity determining region 3 for antibody 6421
QQYYSSPFT

SEQ ID NO: 12842 - protein, 14 aa, Homo sapiens
  heavy chain complementarity determining region 3 for antibody 6421
AASYSSGRLEYFQY

SEQ ID NO: 12843 - protein, 10 aa, Homo sapiens
  light chain complementarity determining region 3 for antibody 6422
QQYYSSHPWA

SEQ ID NO: 12844 - protein, 16 aa, Homo sapiens
  heavy chain complementarity determining region 3 for antibody 6422
ASLNRGDKEFGVPPAL

SEQ ID NO: 12845 - protein, 9 aa, Homo sapiens
  light chain complementarity determining region 3 for antibody 6423
QQYYSRPFT

SEQ ID NO: 12846 - protein, 14 aa, Homo sapiens
  heavy chain complementarity determining region 3 for antibody 6423
AASYSSGWLEYFQY

SEQ ID NO: 12847 - protein, 9 aa, Homo sapiens
  light chain complementarity determining region 3 for antibody 6424
QQYYSGPQT

SEQ ID NO: 12848 - protein, 9 aa, Homo sapiens
  heavy chain complementarity determining region 3 for antibody 6424
GRDIWPEDH

SEQ ID NO: 12849 - protein, 9 aa, Homo sapiens
  light chain complementarity determining region 3 for antibody 6425
QQYYSDPIT

SEQ ID NO: 12850 - protein, 14 aa, Homo sapiens
  heavy chain complementarity determining region 3 for antibody 6425
ARGESPSCDFILDY

SEQ ID NO: 12851 - protein, 9 aa, Homo sapiens
  light chain complementarity determining region 3 for antibody 6426
QQYYSAPQK

SEQ ID NO: 12852 - protein, 9 aa, Homo sapiens
  heavy chain complementarity determining region 3 for antibody 6426
ARDVWPEDC

SEQ ID NO: 12853 - protein, 9 aa, Homo sapiens
  light chain complementarity determining region 3 for antibody 6427
QQYYSAPPA

SEQ ID NO: 12854 - protein, 9 aa, Homo sapiens
  heavy chain complementarity determining region 3 for antibody 6427
ARDVWPEDY

SEQ ID NO: 12855 - protein, 9 aa, Homo sapiens
  light chain complementarity determining region 3 for antibody 6428
QQYYSAPLT

SEQ ID NO: 12856 - protein, 15 aa, Homo sapiens
  heavy chain complementarity determining region 3 for antibody 6428
VRALSPTEMSYAIAY

SEQ ID NO: 12857 - protein, 9 aa, Homo sapiens
  light chain complementarity determining region 3 for antibody 6429
QQYYSAPLP

SEQ ID NO: 12858 - protein, 13 aa, Homo sapiens
  heavy chain complementarity determining region 3 for antibody 6429
ARGRASGSFLIDY

SEQ ID NO: 12859 - protein, 9 aa, Homo sapiens
  light chain complementarity determining region 3 for antibody 6430
QQYYSAPIT

SEQ ID NO: 12860 - protein, 11 aa, Homo sapiens
  heavy chain complementarity determining region 3 for antibody 6430
ARRSLGGAFDY

SEQ ID NO: 12861 - protein, 9 aa, Homo sapiens
  light chain complementarity determining region 3 for antibody 6431
QQYYSAPIT

SEQ ID NO: 12862 - protein, 17 aa, Homo sapiens
  heavy chain complementarity determining region 3 for antibody 6431
ARNTMVGTWQRQGNLDH

SEQ ID NO: 12863 - protein, 9 aa, Homo sapiens
  light chain complementarity determining region 3 for antibody 6432
QQYYSAPIT

SEQ ID NO: 12864 - protein, 14 aa, Homo sapiens
  heavy chain complementarity determining region 3 for antibody 6432
ARGESTSCDYIVDY

SEQ ID NO: 12865 - protein, 9 aa, Homo sapiens
  light chain complementarity determining region 3 for antibody 6433
QQYYSAPIT

SEQ ID NO: 12866 - protein, 14 aa, Homo sapiens
  heavy chain complementarity determining region 3 for antibody 6433
AKGESTSCDFMFDS

SEQ ID NO: 12867 - protein, 9 aa, Homo sapiens
  light chain complementarity determining region 3 for antibody 6434
QQYYSAPIP

SEQ ID NO: 12868 - protein, 14 aa, Homo sapiens
  heavy chain complementarity determining region 3 for antibody 6434
AKGESTSCDFIIDY

SEQ ID NO: 12869 - protein, 9 aa, Homo sapiens
  light chain complementarity determining region 3 for antibody 6435
QQYYSAPIN

SEQ ID NO: 12870 - protein, 15 aa, Homo sapiens
  heavy chain complementarity determining region 3 for antibody 6435
VRALSPTEMSYAIAY

SEQ ID NO: 12871 - protein, 9 aa, Homo sapiens
  light chain complementarity determining region 3 for antibody 6436
QQYYRVPYT

SEQ ID NO: 12872 - protein, 10 aa, Homo sapiens
  heavy chain complementarity determining region 3 for antibody 6436
CRDREGFGDV

SEQ ID NO: 12873 - protein, 9 aa, Homo sapiens
  light chain complementarity determining region 3 for antibody 6437
QQYYRTPRT

SEQ ID NO: 12874 - protein, 13 aa, Homo sapiens
  heavy chain complementarity determining region 3 for antibody 6437
VRDQPGSSDAFDV

SEQ ID NO: 12875 - protein, 9 aa, Homo sapiens
  light chain complementarity determining region 3 for antibody 6438
QQYYRTPNT

SEQ ID NO: 12876 - protein, 18 aa, Homo sapiens
  heavy chain complementarity determining region 3 for antibody 6438
ARRYYDFWSDSSGNWFDP

SEQ ID NO: 12877 - protein, 9 aa, Homo sapiens
  light chain complementarity determining region 3 for antibody 6439
QQYYRNPMT

SEQ ID NO: 12878 - protein, 13 aa, Homo sapiens
  heavy chain complementarity determining region 3 for antibody 6439
VRDQPGSSDAFDV

SEQ ID NO: 12879 - protein, 9 aa, Homo sapiens
  light chain complementarity determining region 3 for antibody 6440
QQYYRAPIT

SEQ ID NO: 12880 - protein, 14 aa, Homo sapiens
  heavy chain complementarity determining region 3 for antibody 6440
VRGESPSCDFIFGY

SEQ ID NO: 12881 - protein, 9 aa, Homo sapiens
  light chain complementarity determining region 3 for antibody 6441
QQYYRAPIT

SEQ ID NO: 12882 - protein, 14 aa, Homo sapiens
  heavy chain complementarity determining region 3 for antibody 6441
ARGESPSCDFILDY

SEQ ID NO: 12883 - protein, 9 aa, Homo sapiens
  light chain complementarity determining region 3 for antibody 6442
QQYYNTPIT

SEQ ID NO: 12884 - protein, 16 aa, Homo sapiens
  heavy chain complementarity determining region 3 for antibody 6442
AKDPFSIGSSGFYGGY

SEQ ID NO: 12885 - protein, 9 aa, Homo sapiens
  light chain complementarity determining region 3 for antibody 6443
QQYYNTPET

SEQ ID NO: 12886 - protein, 15 aa, Homo sapiens
  heavy chain complementarity determining region 3 for antibody 6443
ARDVFSGSYAYGDDY

SEQ ID NO: 12887 - protein, 9 aa, Homo sapiens
  light chain complementarity determining region 3 for antibody 6444
QQYYNTPET

SEQ ID NO: 12888 - protein, 15 aa, Homo sapiens
  heavy chain complementarity determining region 3 for antibody 6444
ARDLFSGSYAYGYDY

SEQ ID NO: 12889 - protein, 9 aa, Homo sapiens
  light chain complementarity determining region 3 for antibody 6445
QQYYNTPET

SEQ ID NO: 12890 - protein, 15 aa, Homo sapiens
  heavy chain complementarity determining region 3 for antibody 6445
ARDLFSGSYADGDDY

SEQ ID NO: 12891 - protein, 9 aa, Homo sapiens
  light chain complementarity determining region 3 for antibody 6446
QQYYNTPDT

SEQ ID NO: 12892 - protein, 12 aa, Homo sapiens
  heavy chain complementarity determining region 3 for antibody 6446
ARGGGSSSWYGF

SEQ ID NO: 12893 - protein, 9 aa, Homo sapiens
  light chain complementarity determining region 3 for antibody 6447
QQYYNSPLT

SEQ ID NO: 12894 - protein, 14 aa, Homo sapiens
  heavy chain complementarity determining region 3 for antibody 6447
ARANSGDVSFLIDY

SEQ ID NO: 12895 - protein, 9 aa, Homo sapiens
  light chain complementarity determining region 3 for antibody 6448
QQYYNSPLT

SEQ ID NO: 12896 - protein, 14 aa, Homo sapiens
  heavy chain complementarity determining region 3 for antibody 6448
AKANSGDVPFLIDY

SEQ ID NO: 12897 - protein, 10 aa, Homo sapiens
  light chain complementarity determining region 3 for antibody 6449
QQYYNRPPTT

SEQ ID NO: 12898 - protein, 17 aa, Homo sapiens
  heavy chain complementarity determining region 3 for antibody 6449
ATTERYYDRSGYHPFEN

SEQ ID NO: 12899 - protein, 10 aa, Homo sapiens
  light chain complementarity determining region 3 for antibody 6450
QQYYNRPPNT

SEQ ID NO: 12900 - protein, 17 aa, Homo sapiens
  heavy chain complementarity determining region 3 for antibody 6450
ATTERYYDRSGYRPFEN

SEQ ID NO: 12901 - protein, 10 aa, Homo sapiens
  light chain complementarity determining region 3 for antibody 6451
QQYYNRPPNP

SEQ ID NO: 12902 - protein, 17 aa, Homo sapiens
  heavy chain complementarity determining region 3 for antibody 6451
ATTERYYDRSGYHPFEN

SEQ ID NO: 12903 - protein, 10 aa, Homo sapiens
  light chain complementarity determining region 3 for antibody 6452
QQYYNRPPNI

SEQ ID NO: 12904 - protein, 17 aa, Homo sapiens
  heavy chain complementarity determining region 3 for antibody 6452
ATTERYYDRSGYHPFEN

SEQ ID NO: 12905 - protein, 9 aa, Homo sapiens
  light chain complementarity determining region 3 for antibody 6453
QQYYNPPLP

SEQ ID NO: 12906 - protein, 16 aa, Homo sapiens
  heavy chain complementarity determining region 3 for antibody 6453
ARKRYYYENDKGWFDS

SEQ ID NO: 12907 - protein, 9 aa, Homo sapiens
  light chain complementarity determining region 3 for antibody 6454
QQYYNNVLT

SEQ ID NO: 12908 - protein, 17 aa, Homo sapiens
  heavy chain complementarity determining region 3 for antibody 6454
ARKLYYYDSGDYGWFDP

SEQ ID NO: 12909 - protein, 9 aa, Homo sapiens
  light chain complementarity determining region 3 for antibody 6455
QQYYNLPFT

SEQ ID NO: 12910 - protein, 14 aa, Homo sapiens
  heavy chain complementarity determining region 3 for antibody 6455
AKGRIASCYDASDI

SEQ ID NO: 12911 - protein, 10 aa, Homo sapiens
  light chain complementarity determining region 3 for antibody 6456
QQYYNLASLT

SEQ ID NO: 12912 - protein, 13 aa, Homo sapiens
  heavy chain complementarity determining region 3 for antibody 6456
AKEGSSPGPDFEY

SEQ ID NO: 12913 - protein, 9 aa, Homo sapiens
  light chain complementarity determining region 3 for antibody 6457
QQYYNIPWT

SEQ ID NO: 12914 - protein, 14 aa, Homo sapiens
  heavy chain complementarity determining region 3 for antibody 6457
ARGESTSCDYILDY

SEQ ID NO: 12915 - protein, 9 aa, Homo sapiens
  light chain complementarity determining region 3 for antibody 6458
QQYYNIPFT

SEQ ID NO: 12916 - protein, 14 aa, Homo sapiens
  heavy chain complementarity determining region 3 for antibody 6458
ARGRIASCYDASDI

SEQ ID NO: 12917 - protein, 9 aa, Homo sapiens
  light chain complementarity determining region 3 for antibody 6459
QQYYNIPFT

SEQ ID NO: 12918 - protein, 14 aa, Homo sapiens
  heavy chain complementarity determining region 3 for antibody 6459
AKGRSASCYDASDI

SEQ ID NO: 12919 - protein, 9 aa, Homo sapiens
  light chain complementarity determining region 3 for antibody 6460
QQYYNIPFA

SEQ ID NO: 12920 - protein, 14 aa, Homo sapiens
  heavy chain complementarity determining region 3 for antibody 6460
VKGRIASRYSEADY

SEQ ID NO: 12921 - protein, 9 aa, Homo sapiens
  light chain complementarity determining region 3 for antibody 6461
QQYYNIPFA

SEQ ID NO: 12922 - protein, 10 aa, Homo sapiens
  heavy chain complementarity determining region 3 for antibody 6461
CRDREGFGDV

SEQ ID NO: 12923 - protein, 9 aa, Homo sapiens
  light chain complementarity determining region 3 for antibody 6462
QQYYNIPFA

SEQ ID NO: 12924 - protein, 12 aa, Homo sapiens
  heavy chain complementarity determining region 3 for antibody 6462
ARDKGGRNGMDV

SEQ ID NO: 12925 - protein, 9 aa, Homo sapiens
  light chain complementarity determining region 3 for antibody 6463
QQYYNAPPT

SEQ ID NO: 12926 - protein, 14 aa, Homo sapiens
  heavy chain complementarity determining region 3 for antibody 6463
ASGSATPGTFLVDF

SEQ ID NO: 12927 - protein, 9 aa, Homo sapiens
  light chain complementarity determining region 3 for antibody 6464
QQYYNAPLT

SEQ ID NO: 12928 - protein, 14 aa, Homo sapiens
  heavy chain complementarity determining region 3 for antibody 6464
ASGSATPGTCLVDF

SEQ ID NO: 12929 - protein, 9 aa, Homo sapiens
  light chain complementarity determining region 3 for antibody 6465
QQYYIIPFT

SEQ ID NO: 12930 - protein, 14 aa, Homo sapiens
  heavy chain complementarity determining region 3 for antibody 6465
AKGRIASCYDASDI

SEQ ID NO: 12931 - protein, 9 aa, Homo sapiens
  light chain complementarity determining region 3 for antibody 6466
QQYYIAPIT

SEQ ID NO: 12932 - protein, 15 aa, Homo sapiens
  heavy chain complementarity determining region 3 for antibody 6466
VRALSPTEMSYAIAY

SEQ ID NO: 12933 - protein, 9 aa, Homo sapiens
  light chain complementarity determining region 3 for antibody 6467
QQYYGVPLT

SEQ ID NO: 12934 - protein, 8 aa, Homo sapiens
  heavy chain complementarity determining region 3 for antibody 6467
ARDFSLTA

SEQ ID NO: 12935 - protein, 9 aa, Homo sapiens
  light chain complementarity determining region 3 for antibody 6468
QQYYGVPIT

SEQ ID NO: 12936 - protein, 14 aa, Homo sapiens
  heavy chain complementarity determining region 3 for antibody 6468
ARGHFDSTGFRLDY

SEQ ID NO: 12937 - protein, 9 aa, Homo sapiens
  light chain complementarity determining region 3 for antibody 6469
QQYYGVPIT

SEQ ID NO: 12938 - protein, 12 aa, Homo sapiens
  heavy chain complementarity determining region 3 for antibody 6469
ARDKGGRNGMDV

SEQ ID NO: 12939 - protein, 9 aa, Homo sapiens
  light chain complementarity determining region 3 for antibody 6470
QQYYGTPLT

SEQ ID NO: 12940 - protein, 17 aa, Homo sapiens
  heavy chain complementarity determining region 3 for antibody 6470
ATGLGFCGDSSATCSDC

SEQ ID NO: 12941 - protein, 9 aa, Homo sapiens
  light chain complementarity determining region 3 for antibody 6471
QQYYGTPLT

SEQ ID NO: 12942 - protein, 17 aa, Homo sapiens
  heavy chain complementarity determining region 3 for antibody 6471
ATGLGFCGDSRATCDDW

SEQ ID NO: 12943 - protein, 10 aa, Homo sapiens
  light chain complementarity determining region 3 for antibody 6472
QQYYGSPPWA

SEQ ID NO: 12944 - protein, 16 aa, Homo sapiens
  heavy chain complementarity determining region 3 for antibody 6472
ASLNRGDKEFGVPPAL

SEQ ID NO: 12945 - protein, 9 aa, Homo sapiens
  light chain complementarity determining region 3 for antibody 6473
QQYYGSPPT

SEQ ID NO: 12946 - protein, 15 aa, Homo sapiens
  heavy chain complementarity determining region 3 for antibody 6473
ATSIKYGDNSFLCDS

SEQ ID NO: 12947 - protein, 9 aa, Homo sapiens
  light chain complementarity determining region 3 for antibody 6474
QQYYGSPLT

SEQ ID NO: 12948 - protein, 15 aa, Homo sapiens
  heavy chain complementarity determining region 3 for antibody 6474
TTSRRYGGNSFLCDW

SEQ ID NO: 12949 - protein, 9 aa, Homo sapiens
  light chain complementarity determining region 3 for antibody 6475
QQYYGSPLT

SEQ ID NO: 12950 - protein, 14 aa, Homo sapiens
  heavy chain complementarity determining region 3 for antibody 6475
AKPTRGPGSFLVDY

SEQ ID NO: 12951 - protein, 9 aa, Homo sapiens
  light chain complementarity determining region 3 for antibody 6476
QQYYGRPLT

SEQ ID NO: 12952 - protein, 15 aa, Homo sapiens
  heavy chain complementarity determining region 3 for antibody 6476
ATSIKYGDNSFLCDS

SEQ ID NO: 12953 - protein, 9 aa, Homo sapiens
  light chain complementarity determining region 3 for antibody 6477
QQYYGAPLT

SEQ ID NO: 12954 - protein, 15 aa, Homo sapiens
  heavy chain complementarity determining region 3 for antibody 6477
AKSYDPEGATFYFHH

SEQ ID NO: 12955 - protein, 9 aa, Homo sapiens
  light chain complementarity determining region 3 for antibody 6478
QQYYETPLT

SEQ ID NO: 12956 - protein, 13 aa, Homo sapiens
  heavy chain complementarity determining region 3 for antibody 6478
AKEGPYPGLDLDY

SEQ ID NO: 12957 - protein, 9 aa, Homo sapiens
  light chain complementarity determining region 3 for antibody 6479
QQYYDPPPT

SEQ ID NO: 12958 - protein, 21 aa, Homo sapiens
  heavy chain complementarity determining region 3 for antibody 6479
ARGSRTDCRSGDTGCRPMFDS

SEQ ID NO: 12959 - protein, 9 aa, Homo sapiens
  light chain complementarity determining region 3 for antibody 6480
QQYYCTPWT

SEQ ID NO: 12960 - protein, 18 aa, Homo sapiens
  heavy chain complementarity determining region 3 for antibody 6480
ARGLHQLRLGGYFYGLDV

SEQ ID NO: 12961 - protein, 8 aa, Homo sapiens
  light chain complementarity determining region 3 for antibody 6481
QQYYATPT

SEQ ID NO: 12962 - protein, 16 aa, Homo sapiens
  heavy chain complementarity determining region 3 for antibody 6481
VRAADTSSWSLLISDY

SEQ ID NO: 12963 - protein, 8 aa, Homo sapiens
  light chain complementarity determining region 3 for antibody 6482
QQYYANPT

SEQ ID NO: 12964 - protein, 16 aa, Homo sapiens
  heavy chain complementarity determining region 3 for antibody 6482
VRAADTSSWSFLISDY

SEQ ID NO: 12965 - protein, 9 aa, Homo sapiens
  light chain complementarity determining region 3 for antibody 6483
QQYWSYPLT

SEQ ID NO: 12966 - protein, 13 aa, Homo sapiens
  heavy chain complementarity determining region 3 for antibody 6483
TRAGDGSGPPFDY

SEQ ID NO: 12967 - protein, 9 aa, Homo sapiens
  light chain complementarity determining region 3 for antibody 6484
QQYVTAPVT

SEQ ID NO: 12968 - protein, 16 aa, Homo sapiens
  heavy chain complementarity determining region 3 for antibody 6484
VGPHLTYNSGWRYFDY

SEQ ID NO: 12969 - protein, 9 aa, Homo sapiens
  light chain complementarity determining region 3 for antibody 6485
QQYVSDSYT

SEQ ID NO: 12970 - protein, 16 aa, Homo sapiens
  heavy chain complementarity determining region 3 for antibody 6485
ARDHCTTIKCPDAFDI

SEQ ID NO: 12971 - protein, 9 aa, Homo sapiens
  light chain complementarity determining region 3 for antibody 6486
QQYVSAPVT

SEQ ID NO: 12972 - protein, 16 aa, Homo sapiens
  heavy chain complementarity determining region 3 for antibody 6486
VGPYLTYNSGWRYFDY

SEQ ID NO: 12973 - protein, 9 aa, Homo sapiens
  light chain complementarity determining region 3 for antibody 6487
QQYVSAPVT

SEQ ID NO: 12974 - protein, 16 aa, Homo sapiens
  heavy chain complementarity determining region 3 for antibody 6487
VGPHLTYNSSWRYFDY

SEQ ID NO: 12975 - protein, 9 aa, Homo sapiens
  light chain complementarity determining region 3 for antibody 6488
QQYVSAPVT

SEQ ID NO: 12976 - protein, 12 aa, Homo sapiens
  heavy chain complementarity determining region 3 for antibody 6488
ALDEWHPSWYKY

SEQ ID NO: 12977 - protein, 9 aa, Homo sapiens
  light chain complementarity determining region 3 for antibody 6489
QQYVSAPVP

SEQ ID NO: 12978 - protein, 16 aa, Homo sapiens
  heavy chain complementarity determining region 3 for antibody 6489
VGPHLTYNSGWRYFDY

SEQ ID NO: 12979 - protein, 10 aa, Homo sapiens
  light chain complementarity determining region 3 for antibody 6490
QQYVNLASLT

SEQ ID NO: 12980 - protein, 13 aa, Homo sapiens
  heavy chain complementarity determining region 3 for antibody 6490
AKEGSSPGPDFEY

SEQ ID NO: 12981 - protein, 8 aa, Homo sapiens
  light chain complementarity determining region 3 for antibody 6491
QQYVGSLT

SEQ ID NO: 12982 - protein, 19 aa, Homo sapiens
  heavy chain complementarity determining region 3 for antibody 6491
AKRAGTMTTFNYYYYYMDV

SEQ ID NO: 12983 - protein, 9 aa, Homo sapiens
  light chain complementarity determining region 3 for antibody 6492
QQYTTAPWT

SEQ ID NO: 12984 - protein, 20 aa, Homo sapiens
  heavy chain complementarity determining region 3 for antibody 6492
TRDARGSSSYAYGGGGGLDV

SEQ ID NO: 12985 - protein, 8 aa, Homo sapiens
  light chain complementarity determining region 3 for antibody 6493
QQYTSYWT

SEQ ID NO: 12986 - protein, 10 aa, Homo sapiens
  heavy chain complementarity determining region 3 for antibody 6493
ARERSGSYDI

SEQ ID NO: 12987 - protein, 9 aa, Homo sapiens
  light chain complementarity determining region 3 for antibody 6494
QQYSVSPTT

SEQ ID NO: 12988 - protein, 8 aa, Homo sapiens
  heavy chain complementarity determining region 3 for antibody 6494
ARRNDFDY

SEQ ID NO: 12989 - protein, 9 aa, Homo sapiens
  light chain complementarity determining region 3 for antibody 6495
QQYSVSPIT

SEQ ID NO: 12990 - protein, 8 aa, Homo sapiens
  heavy chain complementarity determining region 3 for antibody 6495
ARRNDLDY

SEQ ID NO: 12991 - protein, 9 aa, Homo sapiens
  light chain complementarity determining region 3 for antibody 6496
QQYSVSPIT

SEQ ID NO: 12992 - protein, 8 aa, Homo sapiens
  heavy chain complementarity determining region 3 for antibody 6496
ARRNDFNY

SEQ ID NO: 12993 - protein, 9 aa, Homo sapiens
  light chain complementarity determining region 3 for antibody 6497
QQYSVSPIT

SEQ ID NO: 12994 - protein, 8 aa, Homo sapiens
  heavy chain complementarity determining region 3 for antibody 6497
ARRNDFDD

SEQ ID NO: 12995 - protein, 9 aa, Homo sapiens
  light chain complementarity determining region 3 for antibody 6498
QQYSVSPIT

SEQ ID NO: 12996 - protein, 12 aa, Homo sapiens
  heavy chain complementarity determining region 3 for antibody 6498
AIVVPGRWDLDD

SEQ ID NO: 12997 - protein, 9 aa, Homo sapiens
  light chain complementarity determining region 3 for antibody 6499
QQYSVSPIS

SEQ ID NO: 12998 - protein, 8 aa, Homo sapiens
  heavy chain complementarity determining region 3 for antibody 6499
ARRNDFDY

SEQ ID NO: 12999 - protein, 9 aa, Homo sapiens
  light chain complementarity determining region 3 for antibody 6500
QQYSTYSRT

SEQ ID NO: 13000 - protein, 15 aa, Homo sapiens
  heavy chain complementarity determining region 3 for antibody 6500
ARDCISTNCYLIFDN

SEQ ID NO: 13001 - protein, 9 aa, Homo sapiens
  light chain complementarity determining region 3 for antibody 6501
QQYSTYPWT

SEQ ID NO: 13002 - protein, 16 aa, Homo sapiens
  heavy chain complementarity determining region 3 for antibody 6501
VRDLAGFTRGGSTFDY

SEQ ID NO: 13003 - protein, 9 aa, Homo sapiens
  light chain complementarity determining region 3 for antibody 6502
QQYSTYPWT

SEQ ID NO: 13004 - protein, 10 aa, Homo sapiens
  heavy chain complementarity determining region 3 for antibody 6502
AHRISRAFDI

SEQ ID NO: 13005 - protein, 9 aa, Homo sapiens
  light chain complementarity determining region 3 for antibody 6503
QQYSTYPWK

SEQ ID NO: 13006 - protein, 10 aa, Homo sapiens
  heavy chain complementarity determining region 3 for antibody 6503
AHRINRAFDI

SEQ ID NO: 13007 - protein, 9 aa, Homo sapiens
  light chain complementarity determining region 3 for antibody 6504
QQYSTVPWT

SEQ ID NO: 13008 - protein, 13 aa, Homo sapiens
  heavy chain complementarity determining region 3 for antibody 6504
AKEGSSPGPDFDY

SEQ ID NO: 13009 - protein, 8 aa, Homo sapiens
  light chain complementarity determining region 3 for antibody 6505
QQYSSYWT

SEQ ID NO: 13010 - protein, 16 aa, Homo sapiens
  heavy chain complementarity determining region 3 for antibody 6505
ASLNRGDKEFGVPPAL

SEQ ID NO: 13011 - protein, 9 aa, Homo sapiens
  light chain complementarity determining region 3 for antibody 6506
QQYSSYSRT

SEQ ID NO: 13012 - protein, 16 aa, Homo sapiens
  heavy chain complementarity determining region 3 for antibody 6506
VGPHLTYNSGWRYFDY

SEQ ID NO: 13013 - protein, 10 aa, Homo sapiens
  light chain complementarity determining region 3 for antibody 6507
QQYSSYSPRP

SEQ ID NO: 13014 - protein, 15 aa, Homo sapiens
  heavy chain complementarity determining region 3 for antibody 6507
ARVGRPYHNAWYFDN

SEQ ID NO: 13015 - protein, 7 aa, Homo sapiens
  light chain complementarity determining region 3 for antibody 6508
QQYSSWT

SEQ ID NO: 13016 - protein, 12 aa, Homo sapiens
  heavy chain complementarity determining region 3 for antibody 6508
ATVVPGRWDLDD

SEQ ID NO: 13017 - protein, 7 aa, Homo sapiens
  light chain complementarity determining region 3 for antibody 6509
QQYSSWT

SEQ ID NO: 13018 - protein, 14 aa, Homo sapiens
  heavy chain complementarity determining region 3 for antibody 6509
ARRHYTSASRYFDL

SEQ ID NO: 13019 - protein, 7 aa, Homo sapiens
  light chain complementarity determining region 3 for antibody 6510
QQYSSWT

SEQ ID NO: 13020 - protein, 14 aa, Homo sapiens
  heavy chain complementarity determining region 3 for antibody 6510
ARRHYASSSRYFDL

SEQ ID NO: 13021 - protein, 7 aa, Homo sapiens
  light chain complementarity determining region 3 for antibody 6511
QQYSSWT

SEQ ID NO: 13022 - protein, 17 aa, Homo sapiens
  heavy chain complementarity determining region 3 for antibody 6511
ARNAMVGAWQRQGNLDH

SEQ ID NO: 13023 - protein, 7 aa, Homo sapiens
  light chain complementarity determining region 3 for antibody 6512
QQYSSWT

SEQ ID NO: 13024 - protein, 10 aa, Homo sapiens
  heavy chain complementarity determining region 3 for antibody 6512
ARETAGSYDI

SEQ ID NO: 13025 - protein, 7 aa, Homo sapiens
  light chain complementarity determining region 3 for antibody 6513
QQYSSWT

SEQ ID NO: 13026 - protein, 12 aa, Homo sapiens
  heavy chain complementarity determining region 3 for antibody 6513
AMVVPGRWDLDD

SEQ ID NO: 13027 - protein, 7 aa, Homo sapiens
  light chain complementarity determining region 3 for antibody 6514
QQYSSWT

SEQ ID NO: 13028 - protein, 13 aa, Homo sapiens
  heavy chain complementarity determining region 3 for antibody 6514
AKEGSSPGPDFEY

SEQ ID NO: 13029 - protein, 7 aa, Homo sapiens
  light chain complementarity determining region 3 for antibody 6515
QQYSSWT

SEQ ID NO: 13030 - protein, 12 aa, Homo sapiens
  heavy chain complementarity determining region 3 for antibody 6515
AKDRGGRSGMGV

SEQ ID NO: 13031 - protein, 7 aa, Homo sapiens
  light chain complementarity determining region 3 for antibody 6516
QQYSSWT

SEQ ID NO: 13032 - protein, 12 aa, Homo sapiens
  heavy chain complementarity determining region 3 for antibody 6516
AKDRGGQSGMDV

SEQ ID NO: 13033 - protein, 7 aa, Homo sapiens
  light chain complementarity determining region 3 for antibody 6517
QQYSSWT

SEQ ID NO: 13034 - protein, 12 aa, Homo sapiens
  heavy chain complementarity determining region 3 for antibody 6517
AIVVPGRWDLDA

SEQ ID NO: 13035 - protein, 7 aa, Homo sapiens
  light chain complementarity determining region 3 for antibody 6518
QQYSSWT

SEQ ID NO: 13036 - protein, 12 aa, Homo sapiens
  heavy chain complementarity determining region 3 for antibody 6518
AIVVPGRSDLDD

SEQ ID NO: 13037 - protein, 7 aa, Homo sapiens
  light chain complementarity determining region 3 for antibody 6519
QQYSSWT

SEQ ID NO: 13038 - protein, 12 aa, Homo sapiens
  heavy chain complementarity determining region 3 for antibody 6519
AIVVPGLWDLDD

SEQ ID NO: 13039 - protein, 7 aa, Homo sapiens
  light chain complementarity determining region 3 for antibody 6520
QQYSSWT

SEQ ID NO: 13040 - protein, 12 aa, Homo sapiens
  heavy chain complementarity determining region 3 for antibody 6520
AIVVPGCWDLDD

SEQ ID NO: 13041 - protein, 7 aa, Homo sapiens
  light chain complementarity determining region 3 for antibody 6521
QQYSSWT

SEQ ID NO: 13042 - protein, 12 aa, Homo sapiens
  heavy chain complementarity determining region 3 for antibody 6521
AIVGPGRWDLDD

SEQ ID NO: 13043 - protein, 7 aa, Homo sapiens
  light chain complementarity determining region 3 for antibody 6522
QQYSSWP

SEQ ID NO: 13044 - protein, 16 aa, Homo sapiens
  heavy chain complementarity determining region 3 for antibody 6522
AKEHSTAKQWYGDFDS

SEQ ID NO: 13045 - protein, 7 aa, Homo sapiens
  light chain complementarity determining region 3 for antibody 6523
QQYSSWK

SEQ ID NO: 13046 - protein, 12 aa, Homo sapiens
  heavy chain complementarity determining region 3 for antibody 6523
AIVVPGRWDLDD

SEQ ID NO: 13047 - protein, 9 aa, Homo sapiens
  light chain complementarity determining region 3 for antibody 6524
QQYSSTHYT

SEQ ID NO: 13048 - protein, 12 aa, Homo sapiens
  heavy chain complementarity determining region 3 for antibody 6524
ARESVSGSYLDY

SEQ ID NO: 13049 - protein, 8 aa, Homo sapiens
  light chain complementarity determining region 3 for antibody 6525
QQYSSSYP

SEQ ID NO: 13050 - protein, 9 aa, Homo sapiens
  heavy chain complementarity determining region 3 for antibody 6525
ARGLHLPYD

SEQ ID NO: 13051 - protein, 8 aa, Homo sapiens
  light chain complementarity determining region 3 for antibody 6526
QQYSSSYN

SEQ ID NO: 13052 - protein, 9 aa, Homo sapiens
  heavy chain complementarity determining region 3 for antibody 6526
ARGLHLPYD

SEQ ID NO: 13053 - protein, 8 aa, Homo sapiens
  light chain complementarity determining region 3 for antibody 6527
QQYSSSST

SEQ ID NO: 13054 - protein, 9 aa, Homo sapiens
  heavy chain complementarity determining region 3 for antibody 6527
ARGLHLPYD

SEQ ID NO: 13055 - protein, 11 aa, Homo sapiens
  light chain complementarity determining region 3 for antibody 6528
QQYSSSPPMYT

SEQ ID NO: 13056 - protein, 13 aa, Homo sapiens
  heavy chain complementarity determining region 3 for antibody 6528
AKEGSAPGPDFEY

SEQ ID NO: 13057 - protein, 10 aa, Homo sapiens
  light chain complementarity determining region 3 for antibody 6529
QQYSSSPAWT

SEQ ID NO: 13058 - protein, 16 aa, Homo sapiens
  heavy chain complementarity determining region 3 for antibody 6529
TWVGAFTGPPAPYFEN

SEQ ID NO: 13059 - protein, 8 aa, Homo sapiens
  light chain complementarity determining region 3 for antibody 6530
QQYSSCST

SEQ ID NO: 13060 - protein, 15 aa, Homo sapiens
  heavy chain complementarity determining region 3 for antibody 6530
GRGITGTVHPYHFDY

SEQ ID NO: 13061 - protein, 8 aa, Homo sapiens
  light chain complementarity determining region 3 for antibody 6531
QQYSSCCT

SEQ ID NO: 13062 - protein, 15 aa, Homo sapiens
  heavy chain complementarity determining region 3 for antibody 6531
GRGITGTVRPYHFDY

SEQ ID NO: 13063 - protein, 8 aa, Homo sapiens
  light chain complementarity determining region 3 for antibody 6532
QQYSSCCT

SEQ ID NO: 13064 - protein, 15 aa, Homo sapiens
  heavy chain complementarity determining region 3 for antibody 6532
GRGITGTGHPYHFDY

SEQ ID NO: 13065 - protein, 8 aa, Homo sapiens
  light chain complementarity determining region 3 for antibody 6533
QQYSSCCT

SEQ ID NO: 13066 - protein, 15 aa, Homo sapiens
  heavy chain complementarity determining region 3 for antibody 6533
GRGITGTAHPYHFDY

SEQ ID NO: 13067 - protein, 8 aa, Homo sapiens
  light chain complementarity determining region 3 for antibody 6534
QQYSSCCS

SEQ ID NO: 13068 - protein, 15 aa, Homo sapiens
  heavy chain complementarity determining region 3 for antibody 6534
VRGITGTIRPYHFDY

SEQ ID NO: 13069 - protein, 8 aa, Homo sapiens
  light chain complementarity determining region 3 for antibody 6535
QQYSSCCR

SEQ ID NO: 13070 - protein, 15 aa, Homo sapiens
  heavy chain complementarity determining region 3 for antibody 6535
VRGITGTIHPYHFDY

SEQ ID NO: 13071 - protein, 9 aa, Homo sapiens
  light chain complementarity determining region 3 for antibody 6536
QQYSSAPLS

SEQ ID NO: 13072 - protein, 12 aa, Homo sapiens
  heavy chain complementarity determining region 3 for antibody 6536
ARSGTEGRYFDL

SEQ ID NO: 13073 - protein, 9 aa, Homo sapiens
  light chain complementarity determining region 3 for antibody 6537
QQYSNWPWT

SEQ ID NO: 13074 - protein, 16 aa, Homo sapiens
  heavy chain complementarity determining region 3 for antibody 6537
AKAQYFGKSINGPFDS

SEQ ID NO: 13075 - protein, 9 aa, Homo sapiens
  light chain complementarity determining region 3 for antibody 6538
QQYSNWPIT

SEQ ID NO: 13076 - protein, 12 aa, Homo sapiens
  heavy chain complementarity determining region 3 for antibody 6538
ARDKGGRNGMDV

SEQ ID NO: 13077 - protein, 9 aa, Homo sapiens
  light chain complementarity determining region 3 for antibody 6539
QQYSNWPIT

SEQ ID NO: 13078 - protein, 15 aa, Homo sapiens
  heavy chain complementarity determining region 3 for antibody 6539
AKDVFSSGWYNCFDP

SEQ ID NO: 13079 - protein, 9 aa, Homo sapiens
  light chain complementarity determining region 3 for antibody 6540
QQYSNWPIP

SEQ ID NO: 13080 - protein, 15 aa, Homo sapiens
  heavy chain complementarity determining region 3 for antibody 6540
AKDVFSSGWYNFFDP

SEQ ID NO: 13081 - protein, 10 aa, Homo sapiens
  light chain complementarity determining region 3 for antibody 6541
QQYSDWAPRT

SEQ ID NO: 13082 - protein, 10 aa, Homo sapiens
  heavy chain complementarity determining region 3 for antibody 6541
AREQNHFFEY

SEQ ID NO: 13083 - protein, 9 aa, Homo sapiens
  light chain complementarity determining region 3 for antibody 6542
QQYSASPIT

SEQ ID NO: 13084 - protein, 8 aa, Homo sapiens
  heavy chain complementarity determining region 3 for antibody 6542
ARRNDFDY

SEQ ID NO: 13085 - protein, 9 aa, Homo sapiens
  light chain complementarity determining region 3 for antibody 6543
QQYRVSPIT

SEQ ID NO: 13086 - protein, 8 aa, Homo sapiens
  heavy chain complementarity determining region 3 for antibody 6543
ARRNDFDY

SEQ ID NO: 13087 - protein, 7 aa, Homo sapiens
  light chain complementarity determining region 3 for antibody 6544
QQYRTWT

SEQ ID NO: 13088 - protein, 12 aa, Homo sapiens
  heavy chain complementarity determining region 3 for antibody 6544
VKDRGGRSGMDL

SEQ ID NO: 13089 - protein, 9 aa, Homo sapiens
  light chain complementarity determining region 3 for antibody 6545
QQYRTVPWT

SEQ ID NO: 13090 - protein, 13 aa, Homo sapiens
  heavy chain complementarity determining region 3 for antibody 6545
AKEGSSPGPDLDY

SEQ ID NO: 13091 - protein, 9 aa, Homo sapiens
  light chain complementarity determining region 3 for antibody 6546
QQYRTVPWT

SEQ ID NO: 13092 - protein, 13 aa, Homo sapiens
  heavy chain complementarity determining region 3 for antibody 6546
AKEGSAPGPDFDY

SEQ ID NO: 13093 - protein, 9 aa, Homo sapiens
  light chain complementarity determining region 3 for antibody 6547
QQYRTVPRT

SEQ ID NO: 13094 - protein, 13 aa, Homo sapiens
  heavy chain complementarity determining region 3 for antibody 6547
AKEGSSPGPDFDY

SEQ ID NO: 13095 - protein, 9 aa, Homo sapiens
  light chain complementarity determining region 3 for antibody 6548
QQYRSYPLT

SEQ ID NO: 13096 - protein, 23 aa, Homo sapiens
  heavy chain complementarity determining region 3 for antibody 6548
ATGLGYCRGGRGFPDTVAGSYVF

SEQ ID NO: 13097 - protein, 9 aa, Homo sapiens
  light chain complementarity determining region 3 for antibody 6549
QQYRSYPLT

SEQ ID NO: 13098 - protein, 23 aa, Homo sapiens
  heavy chain complementarity determining region 3 for antibody 6549
ATGLGYCRGGRCVPDTVAGSYVF

SEQ ID NO: 13099 - protein, 9 aa, Homo sapiens
  light chain complementarity determining region 3 for antibody 6550
QQYRSYPLT

SEQ ID NO: 13100 - protein, 23 aa, Homo sapiens
  heavy chain complementarity determining region 3 for antibody 6550
ATGLGYCRGGRCFTDTVAGSYVF

SEQ ID NO: 13101 - protein, 9 aa, Homo sapiens
  light chain complementarity determining region 3 for antibody 6551
QQYRSYPLT

SEQ ID NO: 13102 - protein, 23 aa, Homo sapiens
  heavy chain complementarity determining region 3 for antibody 6551
ATGLGYCRGGRCFPDTMAGSYVF

SEQ ID NO: 13103 - protein, 9 aa, Homo sapiens
  light chain complementarity determining region 3 for antibody 6552
QQYRSYPLT

SEQ ID NO: 13104 - protein, 23 aa, Homo sapiens
  heavy chain complementarity determining region 3 for antibody 6552
ATGLGYCRGGRCFPDSVAGSYVF

SEQ ID NO: 13105 - protein, 9 aa, Homo sapiens
  light chain complementarity determining region 3 for antibody 6553
QQYRSYPLT

SEQ ID NO: 13106 - protein, 23 aa, Homo sapiens
  heavy chain complementarity determining region 3 for antibody 6553
ATGLGYCRGGRCFPDPVAGSYVF

SEQ ID NO: 13107 - protein, 9 aa, Homo sapiens
  light chain complementarity determining region 3 for antibody 6554
QQYRSYPLT

SEQ ID NO: 13108 - protein, 23 aa, Homo sapiens
  heavy chain complementarity determining region 3 for antibody 6554
ATGLGYCRGGRCFPDAVAGSYVF

SEQ ID NO: 13109 - protein, 9 aa, Homo sapiens
  light chain complementarity determining region 3 for antibody 6555
QQYRSYPLT

SEQ ID NO: 13110 - protein, 23 aa, Homo sapiens
  heavy chain complementarity determining region 3 for antibody 6555
ATGLGYCRGGRCFHDTVAGSYVF

SEQ ID NO: 13111 - protein, 9 aa, Homo sapiens
  light chain complementarity determining region 3 for antibody 6556
QQYRSYPLT

SEQ ID NO: 13112 - protein, 14 aa, Homo sapiens
  heavy chain complementarity determining region 3 for antibody 6556
ARGHFDSTGFRLDY

SEQ ID NO: 13113 - protein, 9 aa, Homo sapiens
  light chain complementarity determining region 3 for antibody 6557
QQYRSYPLT

SEQ ID NO: 13114 - protein, 23 aa, Homo sapiens
  heavy chain complementarity determining region 3 for antibody 6557
APGLGYCRGGRCFPDTVAGSYVF

SEQ ID NO: 13115 - protein, 7 aa, Homo sapiens
  light chain complementarity determining region 3 for antibody 6558
QQYRSWT

SEQ ID NO: 13116 - protein, 12 aa, Homo sapiens
  heavy chain complementarity determining region 3 for antibody 6558
AIVVPGRWDLDD

SEQ ID NO: 13117 - protein, 9 aa, Homo sapiens
  light chain complementarity determining region 3 for antibody 6559
QQYRSSPLT

SEQ ID NO: 13118 - protein, 23 aa, Homo sapiens
  heavy chain complementarity determining region 3 for antibody 6559
ATGLGYCRGGRCFPDTVAGSYVF

SEQ ID NO: 13119 - protein, 9 aa, Homo sapiens
  light chain complementarity determining region 3 for antibody 6560
QQYRNWPGT

SEQ ID NO: 13120 - protein, 11 aa, Homo sapiens
  heavy chain complementarity determining region 3 for antibody 6560
AKGGFYFLTGD

SEQ ID NO: 13121 - protein, 10 aa, Homo sapiens
  light chain complementarity determining region 3 for antibody 6561
QQYRDWAPRT

SEQ ID NO: 13122 - protein, 10 aa, Homo sapiens
  heavy chain complementarity determining region 3 for antibody 6561
AREQNPFFEY

SEQ ID NO: 13123 - protein, 10 aa, Homo sapiens
  light chain complementarity determining region 3 for antibody 6562
QQYRDWAPRT

SEQ ID NO: 13124 - protein, 10 aa, Homo sapiens
  heavy chain complementarity determining region 3 for antibody 6562
AREQNHFFDY

SEQ ID NO: 13125 - protein, 10 aa, Homo sapiens
  light chain complementarity determining region 3 for antibody 6563
QQYRDWAPRP

SEQ ID NO: 13126 - protein, 10 aa, Homo sapiens
  heavy chain complementarity determining region 3 for antibody 6563
AREQNHFFEY

SEQ ID NO: 13127 - protein, 9 aa, Homo sapiens
  light chain complementarity determining region 3 for antibody 6564
QQYNYYPLT

SEQ ID NO: 13128 - protein, 16 aa, Homo sapiens
  heavy chain complementarity determining region 3 for antibody 6564
VRDLAGFTRGGSTFDY

SEQ ID NO: 13129 - protein, 9 aa, Homo sapiens
  light chain complementarity determining region 3 for antibody 6565
QQYNYYPLT

SEQ ID NO: 13130 - protein, 15 aa, Homo sapiens
  heavy chain complementarity determining region 3 for antibody 6565
ARGDYGDYMGAPFDY

SEQ ID NO: 13131 - protein, 9 aa, Homo sapiens
  light chain complementarity determining region 3 for antibody 6566
QQYNYYPLT

SEQ ID NO: 13132 - protein, 15 aa, Homo sapiens
  heavy chain complementarity determining region 3 for antibody 6566
ARGDYGDYKGGPFDY

SEQ ID NO: 13133 - protein, 9 aa, Homo sapiens
  light chain complementarity determining region 3 for antibody 6567
QQYNYYPLT

SEQ ID NO: 13134 - protein, 15 aa, Homo sapiens
  heavy chain complementarity determining region 3 for antibody 6567
ARGDCGDYKGVPFDY

SEQ ID NO: 13135 - protein, 9 aa, Homo sapiens
  light chain complementarity determining region 3 for antibody 6568
QQYNYYPLT

SEQ ID NO: 13136 - protein, 12 aa, Homo sapiens
  heavy chain complementarity determining region 3 for antibody 6568
ARDKGGRNGMDV

SEQ ID NO: 13137 - protein, 9 aa, Homo sapiens
  light chain complementarity determining region 3 for antibody 6569
QQYNVYPLT

SEQ ID NO: 13138 - protein, 13 aa, Homo sapiens
  heavy chain complementarity determining region 3 for antibody 6569
ARDGSSGWYELAY

SEQ ID NO: 13139 - protein, 9 aa, Homo sapiens
  light chain complementarity determining region 3 for antibody 6570
QQYNTYSWT

SEQ ID NO: 13140 - protein, 13 aa, Homo sapiens
  heavy chain complementarity determining region 3 for antibody 6570
ATSPSSRLRAIDY

SEQ ID NO: 13141 - protein, 9 aa, Homo sapiens
  light chain complementarity determining region 3 for antibody 6571
QQYNTYSWT

SEQ ID NO: 13142 - protein, 17 aa, Homo sapiens
  heavy chain complementarity determining region 3 for antibody 6571
ARNTMVGTWQRQGNLDH

SEQ ID NO: 13143 - protein, 7 aa, Homo sapiens
  light chain complementarity determining region 3 for antibody 6572
QQYNTWT

SEQ ID NO: 13144 - protein, 10 aa, Homo sapiens
  heavy chain complementarity determining region 3 for antibody 6572
VYDFWSPRHY

SEQ ID NO: 13145 - protein, 7 aa, Homo sapiens
  light chain complementarity determining region 3 for antibody 6573
QQYNTWT

SEQ ID NO: 13146 - protein, 9 aa, Homo sapiens
  heavy chain complementarity determining region 3 for antibody 6573
VRNNYHMDV

SEQ ID NO: 13147 - protein, 7 aa, Homo sapiens
  light chain complementarity determining region 3 for antibody 6574
QQYNTWT

SEQ ID NO: 13148 - protein, 14 aa, Homo sapiens
  heavy chain complementarity determining region 3 for antibody 6574
VKGRIASCYSEADY

SEQ ID NO: 13149 - protein, 7 aa, Homo sapiens
  light chain complementarity determining region 3 for antibody 6575
QQYNTWT

SEQ ID NO: 13150 - protein, 13 aa, Homo sapiens
  heavy chain complementarity determining region 3 for antibody 6575
TTYMAARPEYFRH

SEQ ID NO: 13151 - protein, 7 aa, Homo sapiens
  light chain complementarity determining region 3 for antibody 6576
QQYNTWT

SEQ ID NO: 13152 - protein, 14 aa, Homo sapiens
  heavy chain complementarity determining region 3 for antibody 6576
TRGHFDSTGFRLDY

SEQ ID NO: 13153 - protein, 7 aa, Homo sapiens
  light chain complementarity determining region 3 for antibody 6577
QQYNTWT

SEQ ID NO: 13154 - protein, 13 aa, Homo sapiens
  heavy chain complementarity determining region 3 for antibody 6577
TREGDSSGPDFHL

SEQ ID NO: 13155 - protein, 7 aa, Homo sapiens
  light chain complementarity determining region 3 for antibody 6578
QQYNTWT

SEQ ID NO: 13156 - protein, 20 aa, Homo sapiens
  heavy chain complementarity determining region 3 for antibody 6578
TRDQRSIHLWSFSEGGGMDV

SEQ ID NO: 13157 - protein, 7 aa, Homo sapiens
  light chain complementarity determining region 3 for antibody 6579
QQYNTWT

SEQ ID NO: 13158 - protein, 12 aa, Homo sapiens
  heavy chain complementarity determining region 3 for antibody 6579
TRDPEGDEDFDY

SEQ ID NO: 13159 - protein, 7 aa, Homo sapiens
  light chain complementarity determining region 3 for antibody 6580
QQYNTWT

SEQ ID NO: 13160 - protein, 12 aa, Homo sapiens
  heavy chain complementarity determining region 3 for antibody 6580
TRDKGGRNGMDV

SEQ ID NO: 13161 - protein, 7 aa, Homo sapiens
  light chain complementarity determining region 3 for antibody 6581
QQYNTWT

SEQ ID NO: 13162 - protein, 20 aa, Homo sapiens
  heavy chain complementarity determining region 3 for antibody 6581
TRDARGSISYAYGGGGGLDV

SEQ ID NO: 13163 - protein, 7 aa, Homo sapiens
  light chain complementarity determining region 3 for antibody 6582
QQYNTWT

SEQ ID NO: 13164 - protein, 16 aa, Homo sapiens
  heavy chain complementarity determining region 3 for antibody 6582
TADVGDHRDRYVTLDH

SEQ ID NO: 13165 - protein, 7 aa, Homo sapiens
  light chain complementarity determining region 3 for antibody 6583
QQYNTWT

SEQ ID NO: 13166 - protein, 16 aa, Homo sapiens
  heavy chain complementarity determining region 3 for antibody 6583
SADLGGHVDYYATLDY

SEQ ID NO: 13167 - protein, 7 aa, Homo sapiens
  light chain complementarity determining region 3 for antibody 6584
QQYNTWT

SEQ ID NO: 13168 - protein, 14 aa, Homo sapiens
  heavy chain complementarity determining region 3 for antibody 6584
GRDVHTTGWTLGGY

SEQ ID NO: 13169 - protein, 7 aa, Homo sapiens
  light chain complementarity determining region 3 for antibody 6585
QQYNTWT

SEQ ID NO: 13170 - protein, 12 aa, Homo sapiens
  heavy chain complementarity determining region 3 for antibody 6585
GRDKGGRNGMDV

SEQ ID NO: 13171 - protein, 7 aa, Homo sapiens
  light chain complementarity determining region 3 for antibody 6586
QQYNTWT

SEQ ID NO: 13172 - protein, 10 aa, Homo sapiens
  heavy chain complementarity determining region 3 for antibody 6586
CRDRWGFGDV

SEQ ID NO: 13173 - protein, 7 aa, Homo sapiens
  light chain complementarity determining region 3 for antibody 6587
QQYNTWT

SEQ ID NO: 13174 - protein, 14 aa, Homo sapiens
  heavy chain complementarity determining region 3 for antibody 6587
ATGGGSGFEGAFDV

SEQ ID NO: 13175 - protein, 7 aa, Homo sapiens
  light chain complementarity determining region 3 for antibody 6588
QQYNTWT

SEQ ID NO: 13176 - protein, 13 aa, Homo sapiens
  heavy chain complementarity determining region 3 for antibody 6588
ATGAWGSSWWGDY

SEQ ID NO: 13177 - protein, 7 aa, Homo sapiens
  light chain complementarity determining region 3 for antibody 6589
QQYNTWT

SEQ ID NO: 13178 - protein, 15 aa, Homo sapiens
  heavy chain complementarity determining region 3 for antibody 6589
ARVGRPYHNAWYFDN

SEQ ID NO: 13179 - protein, 7 aa, Homo sapiens
  light chain complementarity determining region 3 for antibody 6590
QQYNTWT

SEQ ID NO: 13180 - protein, 15 aa, Homo sapiens
  heavy chain complementarity determining region 3 for antibody 6590
ARSMVSGTTDDAFDI

SEQ ID NO: 13181 - protein, 7 aa, Homo sapiens
  light chain complementarity determining region 3 for antibody 6591
QQYNTWT

SEQ ID NO: 13182 - protein, 10 aa, Homo sapiens
  heavy chain complementarity determining region 3 for antibody 6591
ARRWERYFDY

SEQ ID NO: 13183 - protein, 7 aa, Homo sapiens
  light chain complementarity determining region 3 for antibody 6592
QQYNTWT

SEQ ID NO: 13184 - protein, 6 aa, Homo sapiens
  heavy chain complementarity determining region 3 for antibody 6592
ARISAY

SEQ ID NO: 13185 - protein, 7 aa, Homo sapiens
  light chain complementarity determining region 3 for antibody 6593
QQYNTWT

SEQ ID NO: 13186 - protein, 10 aa, Homo sapiens
  heavy chain complementarity determining region 3 for antibody 6593
ARHKSYAFDL

SEQ ID NO: 13187 - protein, 7 aa, Homo sapiens
  light chain complementarity determining region 3 for antibody 6594
QQYNTWT

SEQ ID NO: 13188 - protein, 17 aa, Homo sapiens
  heavy chain complementarity determining region 3 for antibody 6594
ARGTGIGSGSYYADFDY

SEQ ID NO: 13189 - protein, 7 aa, Homo sapiens
  light chain complementarity determining region 3 for antibody 6595
QQYNTWT

SEQ ID NO: 13190 - protein, 9 aa, Homo sapiens
  heavy chain complementarity determining region 3 for antibody 6595
ARGRNNFRY

SEQ ID NO: 13191 - protein, 7 aa, Homo sapiens
  light chain complementarity determining region 3 for antibody 6596
QQYNTWT

SEQ ID NO: 13192 - protein, 8 aa, Homo sapiens
  heavy chain complementarity determining region 3 for antibody 6596
ARGNWYAG

SEQ ID NO: 13193 - protein, 7 aa, Homo sapiens
  light chain complementarity determining region 3 for antibody 6597
QQYNTWT

SEQ ID NO: 13194 - protein, 15 aa, Homo sapiens
  heavy chain complementarity determining region 3 for antibody 6597
ARGLLATGGWYYFDY

SEQ ID NO: 13195 - protein, 7 aa, Homo sapiens
  light chain complementarity determining region 3 for antibody 6598
QQYNTWT

SEQ ID NO: 13196 - protein, 16 aa, Homo sapiens
  heavy chain complementarity determining region 3 for antibody 6598
ARGHTFPGERRGGSDF

SEQ ID NO: 13197 - protein, 7 aa, Homo sapiens
  light chain complementarity determining region 3 for antibody 6599
QQYNTWT

SEQ ID NO: 13198 - protein, 9 aa, Homo sapiens
  heavy chain complementarity determining region 3 for antibody 6599
ARGGLYPGY

SEQ ID NO: 13199 - protein, 7 aa, Homo sapiens
  light chain complementarity determining region 3 for antibody 6600
QQYNTWT

SEQ ID NO: 13200 - protein, 10 aa, Homo sapiens
  heavy chain complementarity determining region 3 for antibody 6600
ARGGLAGDVS

SEQ ID NO: 13201 - protein, 7 aa, Homo sapiens
  light chain complementarity determining region 3 for antibody 6601
QQYNTWT

SEQ ID NO: 13202 - protein, 18 aa, Homo sapiens
  heavy chain complementarity determining region 3 for antibody 6601
ARGDYPEARTGYFLDFDY

SEQ ID NO: 13203 - protein, 7 aa, Homo sapiens
  light chain complementarity determining region 3 for antibody 6602
QQYNTWT

SEQ ID NO: 13204 - protein, 9 aa, Homo sapiens
  heavy chain complementarity determining region 3 for antibody 6602
ARFWTYGRK

SEQ ID NO: 13205 - protein, 7 aa, Homo sapiens
  light chain complementarity determining region 3 for antibody 6603
QQYNTWT

SEQ ID NO: 13206 - protein, 13 aa, Homo sapiens
  heavy chain complementarity determining region 3 for antibody 6603
ARDTVTNKMGSDY

SEQ ID NO: 13207 - protein, 7 aa, Homo sapiens
  light chain complementarity determining region 3 for antibody 6604
QQYNTWT

SEQ ID NO: 13208 - protein, 12 aa, Homo sapiens
  heavy chain complementarity determining region 3 for antibody 6604
ARDQGGRNGMDV

SEQ ID NO: 13209 - protein, 7 aa, Homo sapiens
  light chain complementarity determining region 3 for antibody 6605
QQYNTWT

SEQ ID NO: 13210 - protein, 12 aa, Homo sapiens
  heavy chain complementarity determining region 3 for antibody 6605
ARDKVGRNGMDV

SEQ ID NO: 13211 - protein, 7 aa, Homo sapiens
  light chain complementarity determining region 3 for antibody 6606
QQYNTWT

SEQ ID NO: 13212 - protein, 12 aa, Homo sapiens
  heavy chain complementarity determining region 3 for antibody 6606
ARDKRGRNGMDV

SEQ ID NO: 13213 - protein, 7 aa, Homo sapiens
  light chain complementarity determining region 3 for antibody 6607
QQYNTWT

SEQ ID NO: 13214 - protein, 12 aa, Homo sapiens
  heavy chain complementarity determining region 3 for antibody 6607
ARDKGVRNGMDV

SEQ ID NO: 13215 - protein, 7 aa, Homo sapiens
  light chain complementarity determining region 3 for antibody 6608
QQYNTWT

SEQ ID NO: 13216 - protein, 12 aa, Homo sapiens
  heavy chain complementarity determining region 3 for antibody 6608
ARDKGGRNGRDV

SEQ ID NO: 13217 - protein, 7 aa, Homo sapiens
  light chain complementarity determining region 3 for antibody 6609
QQYNTWT

SEQ ID NO: 13218 - protein, 12 aa, Homo sapiens
  heavy chain complementarity determining region 3 for antibody 6609
ARDKGGRNGMNV

SEQ ID NO: 13219 - protein, 7 aa, Homo sapiens
  light chain complementarity determining region 3 for antibody 6610
QQYNTWT

SEQ ID NO: 13220 - protein, 12 aa, Homo sapiens
  heavy chain complementarity determining region 3 for antibody 6610
ARDKGGRNGMHV

SEQ ID NO: 13221 - protein, 7 aa, Homo sapiens
  light chain complementarity determining region 3 for antibody 6611
QQYNTWT

SEQ ID NO: 13222 - protein, 12 aa, Homo sapiens
  heavy chain complementarity determining region 3 for antibody 6611
ARDKGGRNGMDL

SEQ ID NO: 13223 - protein, 7 aa, Homo sapiens
  light chain complementarity determining region 3 for antibody 6612
QQYNTWT

SEQ ID NO: 13224 - protein, 12 aa, Homo sapiens
  heavy chain complementarity determining region 3 for antibody 6612
ARDKGGRNGMDD

SEQ ID NO: 13225 - protein, 7 aa, Homo sapiens
  light chain complementarity determining region 3 for antibody 6613
QQYNTWT

SEQ ID NO: 13226 - protein, 26 aa, Homo sapiens
  heavy chain complementarity determining region 3 for antibody 6613
ARDFPKGGSYISGWYENTGGSYYMDV

SEQ ID NO: 13227 - protein, 7 aa, Homo sapiens
  light chain complementarity determining region 3 for antibody 6614
QQYNTWT

SEQ ID NO: 13228 - protein, 14 aa, Homo sapiens
  heavy chain complementarity determining region 3 for antibody 6614
ANYRASIGANCFDP

SEQ ID NO: 13229 - protein, 7 aa, Homo sapiens
  light chain complementarity determining region 3 for antibody 6615
QQYNTWT

SEQ ID NO: 13230 - protein, 10 aa, Homo sapiens
  heavy chain complementarity determining region 3 for antibody 6615
AHRINRAFDI

SEQ ID NO: 13231 - protein, 7 aa, Homo sapiens
  light chain complementarity determining region 3 for antibody 6616
QQYNTWT

SEQ ID NO: 13232 - protein, 13 aa, Homo sapiens
  heavy chain complementarity determining region 3 for antibody 6616
AADGPYGSSAFDY

SEQ ID NO: 13233 - protein, 7 aa, Homo sapiens
  light chain complementarity determining region 3 for antibody 6617
QQYNTWQ

SEQ ID NO: 13234 - protein, 12 aa, Homo sapiens
  heavy chain complementarity determining region 3 for antibody 6617
ARDKGGRNGMDV

SEQ ID NO: 13235 - protein, 7 aa, Homo sapiens
  light chain complementarity determining region 3 for antibody 6618
QQYNTWP

SEQ ID NO: 13236 - protein, 16 aa, Homo sapiens
  heavy chain complementarity determining region 3 for antibody 6618
SADLGDHVDYYATLDY

SEQ ID NO: 13237 - protein, 7 aa, Homo sapiens
  light chain complementarity determining region 3 for antibody 6619
QQYNTWP

SEQ ID NO: 13238 - protein, 12 aa, Homo sapiens
  heavy chain complementarity determining region 3 for antibody 6619
ARDRGGRNGMDV

SEQ ID NO: 13239 - protein, 7 aa, Homo sapiens
  light chain complementarity determining region 3 for antibody 6620
QQYNTWP

SEQ ID NO: 13240 - protein, 12 aa, Homo sapiens
  heavy chain complementarity determining region 3 for antibody 6620
ARDKGGRNGMDD

SEQ ID NO: 13241 - protein, 7 aa, Homo sapiens
  light chain complementarity determining region 3 for antibody 6621
QQYNTWP

SEQ ID NO: 13242 - protein, 12 aa, Homo sapiens
  heavy chain complementarity determining region 3 for antibody 6621
ARDKDGRNGMDV

SEQ ID NO: 13243 - protein, 7 aa, Homo sapiens
  light chain complementarity determining region 3 for antibody 6622
QQYNTST

SEQ ID NO: 13244 - protein, 12 aa, Homo sapiens
  heavy chain complementarity determining region 3 for antibody 6622
ARDKGGRNGMDV

SEQ ID NO: 13245 - protein, 8 aa, Homo sapiens
  light chain complementarity determining region 3 for antibody 6623
QQYNTFYS

SEQ ID NO: 13246 - protein, 10 aa, Homo sapiens
  heavy chain complementarity determining region 3 for antibody 6623
VYDFWGPRHY

SEQ ID NO: 13247 - protein, 9 aa, Homo sapiens
  light chain complementarity determining region 3 for antibody 6624
QQYNTAPWT

SEQ ID NO: 13248 - protein, 20 aa, Homo sapiens
  heavy chain complementarity determining region 3 for antibody 6624
TRDARGSSAYAYGGGGGLDV

SEQ ID NO: 13249 - protein, 9 aa, Homo sapiens
  light chain complementarity determining region 3 for antibody 6625
QQYNTAPWT

SEQ ID NO: 13250 - protein, 20 aa, Homo sapiens
  heavy chain complementarity determining region 3 for antibody 6625
TRDARGSPSYAYGGGGGLDV

SEQ ID NO: 13251 - protein, 9 aa, Homo sapiens
  light chain complementarity determining region 3 for antibody 6626
QQYNSYYHT

SEQ ID NO: 13252 - protein, 14 aa, Homo sapiens
  heavy chain complementarity determining region 3 for antibody 6626
GRDVHTTGWTLGGY

SEQ ID NO: 13253 - protein, 9 aa, Homo sapiens
  light chain complementarity determining region 3 for antibody 6627
QQYNSYYHT

SEQ ID NO: 13254 - protein, 14 aa, Homo sapiens
  heavy chain complementarity determining region 3 for antibody 6627
ARDVHTTGWTLGGY

SEQ ID NO: 13255 - protein, 9 aa, Homo sapiens
  light chain complementarity determining region 3 for antibody 6628
QQYNSYSWT

SEQ ID NO: 13256 - protein, 18 aa, Homo sapiens
  heavy chain complementarity determining region 3 for antibody 6628
ARGLHQLILGGYFYDLDV

SEQ ID NO: 13257 - protein, 9 aa, Homo sapiens
  light chain complementarity determining region 3 for antibody 6629
QQYNSYSST

SEQ ID NO: 13258 - protein, 16 aa, Homo sapiens
  heavy chain complementarity determining region 3 for antibody 6629
VGPHLTYNSGWRYFDY

SEQ ID NO: 13259 - protein, 9 aa, Homo sapiens
  light chain complementarity determining region 3 for antibody 6630
QQYNSYSRT

SEQ ID NO: 13260 - protein, 16 aa, Homo sapiens
  heavy chain complementarity determining region 3 for antibody 6630
VGTHLTYNSGWRYFDY

SEQ ID NO: 13261 - protein, 9 aa, Homo sapiens
  light chain complementarity determining region 3 for antibody 6631
QQYNSYSRT

SEQ ID NO: 13262 - protein, 16 aa, Homo sapiens
  heavy chain complementarity determining region 3 for antibody 6631
VGPHLTYNSGWRYSDY

SEQ ID NO: 13263 - protein, 9 aa, Homo sapiens
  light chain complementarity determining region 3 for antibody 6632
QQYNSYSRT

SEQ ID NO: 13264 - protein, 16 aa, Homo sapiens
  heavy chain complementarity determining region 3 for antibody 6632
VGPHLTYNSGWRSFDY

SEQ ID NO: 13265 - protein, 9 aa, Homo sapiens
  light chain complementarity determining region 3 for antibody 6633
QQYNSYSRT

SEQ ID NO: 13266 - protein, 16 aa, Homo sapiens
  heavy chain complementarity determining region 3 for antibody 6633
VGPHLTYNSGWRDFDY

SEQ ID NO: 13267 - protein, 9 aa, Homo sapiens
  light chain complementarity determining region 3 for antibody 6634
QQYNSYSRT

SEQ ID NO: 13268 - protein, 16 aa, Homo sapiens
  heavy chain complementarity determining region 3 for antibody 6634
VGPHLTYNSGWGYFDY

SEQ ID NO: 13269 - protein, 9 aa, Homo sapiens
  light chain complementarity determining region 3 for antibody 6635
QQYNSYSRT

SEQ ID NO: 13270 - protein, 16 aa, Homo sapiens
  heavy chain complementarity determining region 3 for antibody 6635
VGPHLTYNSGLRYFDY

SEQ ID NO: 13271 - protein, 9 aa, Homo sapiens
  light chain complementarity determining region 3 for antibody 6636
QQYNSYSRT

SEQ ID NO: 13272 - protein, 16 aa, Homo sapiens
  heavy chain complementarity determining region 3 for antibody 6636
VGPHLTYDSGWRYFDY

SEQ ID NO: 13273 - protein, 9 aa, Homo sapiens
  light chain complementarity determining region 3 for antibody 6637
QQYNSYSRT

SEQ ID NO: 13274 - protein, 16 aa, Homo sapiens
  heavy chain complementarity determining region 3 for antibody 6637
VGPHLTDNSGWRYFDY

SEQ ID NO: 13275 - protein, 9 aa, Homo sapiens
  light chain complementarity determining region 3 for antibody 6638
QQYNSYSRT

SEQ ID NO: 13276 - protein, 16 aa, Homo sapiens
  heavy chain complementarity determining region 3 for antibody 6638
VGPHLTCNSGWRYFDY

SEQ ID NO: 13277 - protein, 9 aa, Homo sapiens
  light chain complementarity determining region 3 for antibody 6639
QQYNSYSRT

SEQ ID NO: 13278 - protein, 16 aa, Homo sapiens
  heavy chain complementarity determining region 3 for antibody 6639
VGPHLPYNSGWRYFDY

SEQ ID NO: 13279 - protein, 9 aa, Homo sapiens
  light chain complementarity determining region 3 for antibody 6640
QQYNSYSRT

SEQ ID NO: 13280 - protein, 16 aa, Homo sapiens
  heavy chain complementarity determining region 3 for antibody 6640
VGPDLTYNSGWRYFDY

SEQ ID NO: 13281 - protein, 9 aa, Homo sapiens
  light chain complementarity determining region 3 for antibody 6641
QQYNSYSRT

SEQ ID NO: 13282 - protein, 16 aa, Homo sapiens
  heavy chain complementarity determining region 3 for antibody 6641
VGPDLTYNSGWRDFDY

SEQ ID NO: 13283 - protein, 9 aa, Homo sapiens
  light chain complementarity determining region 3 for antibody 6642
QQYNSYSRT

SEQ ID NO: 13284 - protein, 16 aa, Homo sapiens
  heavy chain complementarity determining region 3 for antibody 6642
VGLHLTYNSGWRYFDY

SEQ ID NO: 13285 - protein, 9 aa, Homo sapiens
  light chain complementarity determining region 3 for antibody 6643
QQYNSYSRT

SEQ ID NO: 13286 - protein, 11 aa, Homo sapiens
  heavy chain complementarity determining region 3 for antibody 6643
TRGGYSVGYDY

SEQ ID NO: 13287 - protein, 9 aa, Homo sapiens
  light chain complementarity determining region 3 for antibody 6644
QQYNSYSRT

SEQ ID NO: 13288 - protein, 13 aa, Homo sapiens
  heavy chain complementarity determining region 3 for antibody 6644
TKEGSSAGPDFVY

SEQ ID NO: 13289 - protein, 9 aa, Homo sapiens
  light chain complementarity determining region 3 for antibody 6645
QQYNSYSRT

SEQ ID NO: 13290 - protein, 16 aa, Homo sapiens
  heavy chain complementarity determining region 3 for antibody 6645
GGPHLTYNSGWRYFDY

SEQ ID NO: 13291 - protein, 9 aa, Homo sapiens
  light chain complementarity determining region 3 for antibody 6646
QQYNSYSRT

SEQ ID NO: 13292 - protein, 10 aa, Homo sapiens
  heavy chain complementarity determining region 3 for antibody 6646
CRDREGFGDV

SEQ ID NO: 13293 - protein, 9 aa, Homo sapiens
  light chain complementarity determining region 3 for antibody 6647
QQYNSYSRT

SEQ ID NO: 13294 - protein, 15 aa, Homo sapiens
  heavy chain complementarity determining region 3 for antibody 6647
ARIWTSSTNCRYMDV

SEQ ID NO: 13295 - protein, 9 aa, Homo sapiens
  light chain complementarity determining region 3 for antibody 6648
QQYNSYSRT

SEQ ID NO: 13296 - protein, 12 aa, Homo sapiens
  heavy chain complementarity determining region 3 for antibody 6648
ARGAKLLWFGGS

SEQ ID NO: 13297 - protein, 9 aa, Homo sapiens
  light chain complementarity determining region 3 for antibody 6649
QQYNSYSRT

SEQ ID NO: 13298 - protein, 12 aa, Homo sapiens
  heavy chain complementarity determining region 3 for antibody 6649
ARDKGGRNGMDV

SEQ ID NO: 13299 - protein, 9 aa, Homo sapiens
  light chain complementarity determining region 3 for antibody 6650
QQYNSYSRT

SEQ ID NO: 13300 - protein, 12 aa, Homo sapiens
  heavy chain complementarity determining region 3 for antibody 6650
ALDEWHPSWYKY

SEQ ID NO: 13301 - protein, 9 aa, Homo sapiens
  light chain complementarity determining region 3 for antibody 6651
QQYNSYSRT

SEQ ID NO: 13302 - protein, 17 aa, Homo sapiens
  heavy chain complementarity determining region 3 for antibody 6651
AKSLGSCRSSTCEIFDS

SEQ ID NO: 13303 - protein, 9 aa, Homo sapiens
  light chain complementarity determining region 3 for antibody 6652
QQYNSYSRT

SEQ ID NO: 13304 - protein, 12 aa, Homo sapiens
  heavy chain complementarity determining region 3 for antibody 6652
AIVVPGRWDLDD

SEQ ID NO: 13305 - protein, 9 aa, Homo sapiens
  light chain complementarity determining region 3 for antibody 6653
QQYNSYSRT

SEQ ID NO: 13306 - protein, 9 aa, Homo sapiens
  heavy chain complementarity determining region 3 for antibody 6653
AGWGGLSNY

SEQ ID NO: 13307 - protein, 9 aa, Homo sapiens
  light chain complementarity determining region 3 for antibody 6654
QQYNSYSRT

SEQ ID NO: 13308 - protein, 16 aa, Homo sapiens
  heavy chain complementarity determining region 3 for antibody 6654
AGPHLTYNSGWRYFDY

SEQ ID NO: 13309 - protein, 10 aa, Homo sapiens
  light chain complementarity determining region 3 for antibody 6655
QQYNSYSPRQ

SEQ ID NO: 13310 - protein, 15 aa, Homo sapiens
  heavy chain complementarity determining region 3 for antibody 6655
ARVGRPYHNAWYFDN

SEQ ID NO: 13311 - protein, 10 aa, Homo sapiens
  light chain complementarity determining region 3 for antibody 6656
QQYNSYSPRP

SEQ ID NO: 13312 - protein, 16 aa, Homo sapiens
  heavy chain complementarity determining region 3 for antibody 6656
VRDLAGFTRGGSTFDY

SEQ ID NO: 13313 - protein, 10 aa, Homo sapiens
  light chain complementarity determining region 3 for antibody 6657
QQYNSYSPRP

SEQ ID NO: 13314 - protein, 15 aa, Homo sapiens
  heavy chain complementarity determining region 3 for antibody 6657
ARVSRPYHNAWYFDN

SEQ ID NO: 13315 - protein, 10 aa, Homo sapiens
  light chain complementarity determining region 3 for antibody 6658
QQYNSYSPRP

SEQ ID NO: 13316 - protein, 15 aa, Homo sapiens
  heavy chain complementarity determining region 3 for antibody 6658
ARVGRPYPNAWYFDN

SEQ ID NO: 13317 - protein, 10 aa, Homo sapiens
  light chain complementarity determining region 3 for antibody 6659
QQYNSYSPRP

SEQ ID NO: 13318 - protein, 15 aa, Homo sapiens
  heavy chain complementarity determining region 3 for antibody 6659
ARVGRPYHSAWYFDN

SEQ ID NO: 13319 - protein, 10 aa, Homo sapiens
  light chain complementarity determining region 3 for antibody 6660
QQYNSYSPRP

SEQ ID NO: 13320 - protein, 15 aa, Homo sapiens
  heavy chain complementarity determining region 3 for antibody 6660
ARVGRPYHNAWYFDT

SEQ ID NO: 13321 - protein, 10 aa, Homo sapiens
  light chain complementarity determining region 3 for antibody 6661
QQYNSYSPRP

SEQ ID NO: 13322 - protein, 15 aa, Homo sapiens
  heavy chain complementarity determining region 3 for antibody 6661
ARVGRPYHNACYFDN

SEQ ID NO: 13323 - protein, 10 aa, Homo sapiens
  light chain complementarity determining region 3 for antibody 6662
QQYNSYSPRP

SEQ ID NO: 13324 - protein, 15 aa, Homo sapiens
  heavy chain complementarity determining region 3 for antibody 6662
ARVGRPHHNAWYFDN

SEQ ID NO: 13325 - protein, 10 aa, Homo sapiens
  light chain complementarity determining region 3 for antibody 6663
QQYNSYSPRP

SEQ ID NO: 13326 - protein, 9 aa, Homo sapiens
  heavy chain complementarity determining region 3 for antibody 6663
ARSEYQPTY

SEQ ID NO: 13327 - protein, 10 aa, Homo sapiens
  light chain complementarity determining region 3 for antibody 6664
QQYNSYSPRP

SEQ ID NO: 13328 - protein, 15 aa, Homo sapiens
  heavy chain complementarity determining region 3 for antibody 6664
ARIWTSSTNCRYMDV

SEQ ID NO: 13329 - protein, 10 aa, Homo sapiens
  light chain complementarity determining region 3 for antibody 6665
QQYNSYSPRP

SEQ ID NO: 13330 - protein, 12 aa, Homo sapiens
  heavy chain complementarity determining region 3 for antibody 6665
ARDKGGRNGMDV

SEQ ID NO: 13331 - protein, 10 aa, Homo sapiens
  light chain complementarity determining region 3 for antibody 6666
QQYNSYSPRP

SEQ ID NO: 13332 - protein, 13 aa, Homo sapiens
  heavy chain complementarity determining region 3 for antibody 6666
AKEGSSPGPDFEY

SEQ ID NO: 13333 - protein, 10 aa, Homo sapiens
  light chain complementarity determining region 3 for antibody 6667
QQYNSYSPIP

SEQ ID NO: 13334 - protein, 15 aa, Homo sapiens
  heavy chain complementarity determining region 3 for antibody 6667
ARVGRPYHNAWYFDN

SEQ ID NO: 13335 - protein, 10 aa, Homo sapiens
  light chain complementarity determining region 3 for antibody 6668
QQYNSYSPGP

SEQ ID NO: 13336 - protein, 15 aa, Homo sapiens
  heavy chain complementarity determining region 3 for antibody 6668
ARVGRPYHNAWYFDN

SEQ ID NO: 13337 - protein, 11 aa, Homo sapiens
  light chain complementarity determining region 3 for antibody 6669
QQYNSYSPGGA

SEQ ID NO: 13338 - protein, 9 aa, Homo sapiens
  heavy chain complementarity determining region 3 for antibody 6669
GRAWTYARH

SEQ ID NO: 13339 - protein, 9 aa, Homo sapiens
  light chain complementarity determining region 3 for antibody 6670
QQYNSYSNT

SEQ ID NO: 13340 - protein, 14 aa, Homo sapiens
  heavy chain complementarity determining region 3 for antibody 6670
GRDVHTTGWTLGGY

SEQ ID NO: 13341 - protein, 9 aa, Homo sapiens
  light chain complementarity determining region 3 for antibody 6671
QQYNSYSLT

SEQ ID NO: 13342 - protein, 11 aa, Homo sapiens
  heavy chain complementarity determining region 3 for antibody 6671
VRVSTGWNFDY

SEQ ID NO: 13343 - protein, 9 aa, Homo sapiens
  light chain complementarity determining region 3 for antibody 6672
QQYNSYSLT

SEQ ID NO: 13344 - protein, 16 aa, Homo sapiens
  heavy chain complementarity determining region 3 for antibody 6672
VGPHLTYNSGWRYFDY

SEQ ID NO: 13345 - protein, 9 aa, Homo sapiens
  light chain complementarity determining region 3 for antibody 6673
QQYNSYSLT

SEQ ID NO: 13346 - protein, 12 aa, Homo sapiens
  heavy chain complementarity determining region 3 for antibody 6673
SRDKGGRNGMDV

SEQ ID NO: 13347 - protein, 9 aa, Homo sapiens
  light chain complementarity determining region 3 for antibody 6674
QQYNSYSLT

SEQ ID NO: 13348 - protein, 12 aa, Homo sapiens
  heavy chain complementarity determining region 3 for antibody 6674
NADHGYVDGFDI

SEQ ID NO: 13349 - protein, 9 aa, Homo sapiens
  light chain complementarity determining region 3 for antibody 6675
QQYNSYSLT

SEQ ID NO: 13350 - protein, 15 aa, Homo sapiens
  heavy chain complementarity determining region 3 for antibody 6675
ARSMVSGTTDEAFDI

SEQ ID NO: 13351 - protein, 9 aa, Homo sapiens
  light chain complementarity determining region 3 for antibody 6676
QQYNSYSLT

SEQ ID NO: 13352 - protein, 15 aa, Homo sapiens
  heavy chain complementarity determining region 3 for antibody 6676
ARSMVSGTTDDTFDI

SEQ ID NO: 13353 - protein, 9 aa, Homo sapiens
  light chain complementarity determining region 3 for antibody 6677
QQYNSYSLT

SEQ ID NO: 13354 - protein, 15 aa, Homo sapiens
  heavy chain complementarity determining region 3 for antibody 6677
ARSMVSGTTDDAFDV

SEQ ID NO: 13355 - protein, 9 aa, Homo sapiens
  light chain complementarity determining region 3 for antibody 6678
QQYNSYSLT

SEQ ID NO: 13356 - protein, 15 aa, Homo sapiens
  heavy chain complementarity determining region 3 for antibody 6678
ARSMVSGTTDDAFDL

SEQ ID NO: 13357 - protein, 9 aa, Homo sapiens
  light chain complementarity determining region 3 for antibody 6679
QQYNSYSLT

SEQ ID NO: 13358 - protein, 15 aa, Homo sapiens
  heavy chain complementarity determining region 3 for antibody 6679
ARSMVSGTKDDAFDI

SEQ ID NO: 13359 - protein, 9 aa, Homo sapiens
  light chain complementarity determining region 3 for antibody 6680
QQYNSYSLT

SEQ ID NO: 13360 - protein, 15 aa, Homo sapiens
  heavy chain complementarity determining region 3 for antibody 6680
ARSMVPGTTDDAFDI

SEQ ID NO: 13361 - protein, 9 aa, Homo sapiens
  light chain complementarity determining region 3 for antibody 6681
QQYNSYSLT

SEQ ID NO: 13362 - protein, 13 aa, Homo sapiens
  heavy chain complementarity determining region 3 for antibody 6681
ARPYGDYGWAFNI

SEQ ID NO: 13363 - protein, 9 aa, Homo sapiens
  light chain complementarity determining region 3 for antibody 6682
QQYNSYSLT

SEQ ID NO: 13364 - protein, 12 aa, Homo sapiens
  heavy chain complementarity determining region 3 for antibody 6682
ARLDWNYRAFDI

SEQ ID NO: 13365 - protein, 9 aa, Homo sapiens
  light chain complementarity determining region 3 for antibody 6683
QQYNSYSLT

SEQ ID NO: 13366 - protein, 14 aa, Homo sapiens
  heavy chain complementarity determining region 3 for antibody 6683
ARGHFDSTGFRLDY

SEQ ID NO: 13367 - protein, 9 aa, Homo sapiens
  light chain complementarity determining region 3 for antibody 6684
QQYNSYSLT

SEQ ID NO: 13368 - protein, 13 aa, Homo sapiens
  heavy chain complementarity determining region 3 for antibody 6684
AKEGSSPGPDFEY

SEQ ID NO: 13369 - protein, 9 aa, Homo sapiens
  light chain complementarity determining region 3 for antibody 6685
QQYNSYSLT

SEQ ID NO: 13370 - protein, 12 aa, Homo sapiens
  heavy chain complementarity determining region 3 for antibody 6685
AKDKGGRSGMDV

SEQ ID NO: 13371 - protein, 9 aa, Homo sapiens
  light chain complementarity determining region 3 for antibody 6686
QQYNSYSLT

SEQ ID NO: 13372 - protein, 15 aa, Homo sapiens
  heavy chain complementarity determining region 3 for antibody 6686
AGSMVSGTTDDAFDI

SEQ ID NO: 13373 - protein, 9 aa, Homo sapiens
  light chain complementarity determining region 3 for antibody 6687
QQYNSYSIT

SEQ ID NO: 13374 - protein, 20 aa, Homo sapiens
  heavy chain complementarity determining region 3 for antibody 6687
TRDQRSIHLWSCSEGGGMDV

SEQ ID NO: 13375 - protein, 9 aa, Homo sapiens
  light chain complementarity determining region 3 for antibody 6688
QQYNSYSIT

SEQ ID NO: 13376 - protein, 15 aa, Homo sapiens
  heavy chain complementarity determining region 3 for antibody 6688
ARVGRPYHNAWYFDN

SEQ ID NO: 13377 - protein, 9 aa, Homo sapiens
  light chain complementarity determining region 3 for antibody 6689
QQYNSYSIT

SEQ ID NO: 13378 - protein, 15 aa, Homo sapiens
  heavy chain complementarity determining region 3 for antibody 6689
ARSMVSGTTDDAFDI

SEQ ID NO: 13379 - protein, 9 aa, Homo sapiens
  light chain complementarity determining region 3 for antibody 6690
QQYNSYSHT

SEQ ID NO: 13380 - protein, 10 aa, Homo sapiens
  heavy chain complementarity determining region 3 for antibody 6690
VREGYWSLDH

SEQ ID NO: 13381 - protein, 9 aa, Homo sapiens
  light chain complementarity determining region 3 for antibody 6691
QQYNSYSHT

SEQ ID NO: 13382 - protein, 13 aa, Homo sapiens
  heavy chain complementarity determining region 3 for antibody 6691
TKEGSSAGPDFVY

SEQ ID NO: 13383 - protein, 9 aa, Homo sapiens
  light chain complementarity determining region 3 for antibody 6692
QQYNSYSHT

SEQ ID NO: 13384 - protein, 9 aa, Homo sapiens
  heavy chain complementarity determining region 3 for antibody 6692
GSRRPYFDS

SEQ ID NO: 13385 - protein, 9 aa, Homo sapiens
  light chain complementarity determining region 3 for antibody 6693
QQYNSYSHT

SEQ ID NO: 13386 - protein, 14 aa, Homo sapiens
  heavy chain complementarity determining region 3 for antibody 6693
GRDVHTTGWTLVGY

SEQ ID NO: 13387 - protein, 9 aa, Homo sapiens
  light chain complementarity determining region 3 for antibody 6694
QQYNSYSHT

SEQ ID NO: 13388 - protein, 14 aa, Homo sapiens
  heavy chain complementarity determining region 3 for antibody 6694
GRDVHTTGWTLGSY

SEQ ID NO: 13389 - protein, 9 aa, Homo sapiens
  light chain complementarity determining region 3 for antibody 6695
QQYNSYSHT

SEQ ID NO: 13390 - protein, 14 aa, Homo sapiens
  heavy chain complementarity determining region 3 for antibody 6695
GRDVHTTGWTLGDY

SEQ ID NO: 13391 - protein, 9 aa, Homo sapiens
  light chain complementarity determining region 3 for antibody 6696
QQYNSYSHT

SEQ ID NO: 13392 - protein, 14 aa, Homo sapiens
  heavy chain complementarity determining region 3 for antibody 6696
GRDVHTAGWTLGGY

SEQ ID NO: 13393 - protein, 9 aa, Homo sapiens
  light chain complementarity determining region 3 for antibody 6697
QQYNSYSHT

SEQ ID NO: 13394 - protein, 14 aa, Homo sapiens
  heavy chain complementarity determining region 3 for antibody 6697
GRDVHNTGWTLGGY

SEQ ID NO: 13395 - protein, 9 aa, Homo sapiens
  light chain complementarity determining region 3 for antibody 6698
QQYNSYSHT

SEQ ID NO: 13396 - protein, 14 aa, Homo sapiens
  heavy chain complementarity determining region 3 for antibody 6698
DRDVHTTGWTLGGY

SEQ ID NO: 13397 - protein, 9 aa, Homo sapiens
  light chain complementarity determining region 3 for antibody 6699
QQYNSYSHT

SEQ ID NO: 13398 - protein, 14 aa, Homo sapiens
  heavy chain complementarity determining region 3 for antibody 6699
CRDVHTTGWTLGGY

SEQ ID NO: 13399 - protein, 9 aa, Homo sapiens
  light chain complementarity determining region 3 for antibody 6700
QQYNSYSHT

SEQ ID NO: 13400 - protein, 17 aa, Homo sapiens
  heavy chain complementarity determining region 3 for antibody 6700
ARNTMVGTWQRQGNLDH

SEQ ID NO: 13401 - protein, 9 aa, Homo sapiens
  light chain complementarity determining region 3 for antibody 6701
QQYNSYSHT

SEQ ID NO: 13402 - protein, 14 aa, Homo sapiens
  heavy chain complementarity determining region 3 for antibody 6701
ARLHGSGLGRWLDP

SEQ ID NO: 13403 - protein, 9 aa, Homo sapiens
  light chain complementarity determining region 3 for antibody 6702
QQYNSYSHT

SEQ ID NO: 13404 - protein, 14 aa, Homo sapiens
  heavy chain complementarity determining region 3 for antibody 6702
ARDVRTTGWTLGGY

SEQ ID NO: 13405 - protein, 9 aa, Homo sapiens
  light chain complementarity determining region 3 for antibody 6703
QQYNSYSHT

SEQ ID NO: 13406 - protein, 14 aa, Homo sapiens
  heavy chain complementarity determining region 3 for antibody 6703
ARDVHTTSWTLGGY

SEQ ID NO: 13407 - protein, 9 aa, Homo sapiens
  light chain complementarity determining region 3 for antibody 6704
QQYNSYSHT

SEQ ID NO: 13408 - protein, 14 aa, Homo sapiens
  heavy chain complementarity determining region 3 for antibody 6704
ARDVHTTGWTVGGY

SEQ ID NO: 13409 - protein, 9 aa, Homo sapiens
  light chain complementarity determining region 3 for antibody 6705
QQYNSYSHT

SEQ ID NO: 13410 - protein, 14 aa, Homo sapiens
  heavy chain complementarity determining region 3 for antibody 6705
ARDVHTTGWTLGRY

SEQ ID NO: 13411 - protein, 9 aa, Homo sapiens
  light chain complementarity determining region 3 for antibody 6706
QQYNSYSHT

SEQ ID NO: 13412 - protein, 14 aa, Homo sapiens
  heavy chain complementarity determining region 3 for antibody 6706
ARDVHTTGWTLGGF

SEQ ID NO: 13413 - protein, 9 aa, Homo sapiens
  light chain complementarity determining region 3 for antibody 6707
QQYNSYSHT

SEQ ID NO: 13414 - protein, 14 aa, Homo sapiens
  heavy chain complementarity determining region 3 for antibody 6707
ARDVHTTGWTLGGD

SEQ ID NO: 13415 - protein, 9 aa, Homo sapiens
  light chain complementarity determining region 3 for antibody 6708
QQYNSYSHT

SEQ ID NO: 13416 - protein, 14 aa, Homo sapiens
  heavy chain complementarity determining region 3 for antibody 6708
ARDVHTTGWSVGGY

SEQ ID NO: 13417 - protein, 9 aa, Homo sapiens
  light chain complementarity determining region 3 for antibody 6709
QQYNSYSHT

SEQ ID NO: 13418 - protein, 14 aa, Homo sapiens
  heavy chain complementarity determining region 3 for antibody 6709
ARDVHTTGSTLGGY

SEQ ID NO: 13419 - protein, 9 aa, Homo sapiens
  light chain complementarity determining region 3 for antibody 6710
QQYNSYSHT

SEQ ID NO: 13420 - protein, 14 aa, Homo sapiens
  heavy chain complementarity determining region 3 for antibody 6710
ARDVHTTCWTLGGY

SEQ ID NO: 13421 - protein, 9 aa, Homo sapiens
  light chain complementarity determining region 3 for antibody 6711
QQYNSYSHT

SEQ ID NO: 13422 - protein, 14 aa, Homo sapiens
  heavy chain complementarity determining region 3 for antibody 6711
ARDVDTTGWTLGGY

SEQ ID NO: 13423 - protein, 9 aa, Homo sapiens
  light chain complementarity determining region 3 for antibody 6712
QQYNSYSHT

SEQ ID NO: 13424 - protein, 13 aa, Homo sapiens
  heavy chain complementarity determining region 3 for antibody 6712
AKEGSAPGPDFEY

SEQ ID NO: 13425 - protein, 9 aa, Homo sapiens
  light chain complementarity determining region 3 for antibody 6713
QQYNSYSHT

SEQ ID NO: 13426 - protein, 12 aa, Homo sapiens
  heavy chain complementarity determining region 3 for antibody 6713
AKDKGGRSGMDV

SEQ ID NO: 13427 - protein, 9 aa, Homo sapiens
  light chain complementarity determining region 3 for antibody 6714
QQYNSYSHP

SEQ ID NO: 13428 - protein, 14 aa, Homo sapiens
  heavy chain complementarity determining region 3 for antibody 6714
GRDVHTTGWTLGGY

SEQ ID NO: 13429 - protein, 9 aa, Homo sapiens
  light chain complementarity determining region 3 for antibody 6715
QQYNSYSHP

SEQ ID NO: 13430 - protein, 14 aa, Homo sapiens
  heavy chain complementarity determining region 3 for antibody 6715
ARDVHTTGWTLGGY

SEQ ID NO: 13431 - protein, 10 aa, Homo sapiens
  light chain complementarity determining region 3 for antibody 6716
QQYNSYSGYT

SEQ ID NO: 13432 - protein, 15 aa, Homo sapiens
  heavy chain complementarity determining region 3 for antibody 6716
ARDRGDPQLYNWFDP

SEQ ID NO: 13433 - protein, 10 aa, Homo sapiens
  light chain complementarity determining region 3 for antibody 6717
QQYNSYSGYT

SEQ ID NO: 13434 - protein, 12 aa, Homo sapiens
  heavy chain complementarity determining region 3 for antibody 6717
ARDKGGRNGMDV

SEQ ID NO: 13435 - protein, 10 aa, Homo sapiens
  light chain complementarity determining region 3 for antibody 6718
QQYNSYSGYT

SEQ ID NO: 13436 - protein, 12 aa, Homo sapiens
  heavy chain complementarity determining region 3 for antibody 6718
AIVVPGRWVLDD

SEQ ID NO: 13437 - protein, 10 aa, Homo sapiens
  light chain complementarity determining region 3 for antibody 6719
QQYNSYSGYT

SEQ ID NO: 13438 - protein, 12 aa, Homo sapiens
  heavy chain complementarity determining region 3 for antibody 6719
AIVVPGRWDLDG

SEQ ID NO: 13439 - protein, 10 aa, Homo sapiens
  light chain complementarity determining region 3 for antibody 6720
QQYNSYSGYT

SEQ ID NO: 13440 - protein, 12 aa, Homo sapiens
  heavy chain complementarity determining region 3 for antibody 6720
AIVVPGRGDLDD

SEQ ID NO: 13441 - protein, 9 aa, Homo sapiens
  light chain complementarity determining region 3 for antibody 6721
QQYNSYSFT

SEQ ID NO: 13442 - protein, 15 aa, Homo sapiens
  heavy chain complementarity determining region 3 for antibody 6721
ARSMVSGTTDDAFDI

SEQ ID NO: 13443 - protein, 9 aa, Homo sapiens
  light chain complementarity determining region 3 for antibody 6722
QQYNSYPYT

SEQ ID NO: 13444 - protein, 9 aa, Homo sapiens
  heavy chain complementarity determining region 3 for antibody 6722
ARFWTYGRK

SEQ ID NO: 13445 - protein, 9 aa, Homo sapiens
  light chain complementarity determining region 3 for antibody 6723
QQYNSYPYT

SEQ ID NO: 13446 - protein, 13 aa, Homo sapiens
  heavy chain complementarity determining region 3 for antibody 6723
AKEGSSPGPDFDY

SEQ ID NO: 13447 - protein, 9 aa, Homo sapiens
  light chain complementarity determining region 3 for antibody 6724
QQYNSYPWT

SEQ ID NO: 13448 - protein, 11 aa, Homo sapiens
  heavy chain complementarity determining region 3 for antibody 6724
VRVSTGWSFDY

SEQ ID NO: 13449 - protein, 9 aa, Homo sapiens
  light chain complementarity determining region 3 for antibody 6725
QQYNSYPWT

SEQ ID NO: 13450 - protein, 14 aa, Homo sapiens
  heavy chain complementarity determining region 3 for antibody 6725
VRGEGSGYYRTADY

SEQ ID NO: 13451 - protein, 9 aa, Homo sapiens
  light chain complementarity determining region 3 for antibody 6726
QQYNSYPWT

SEQ ID NO: 13452 - protein, 14 aa, Homo sapiens
  heavy chain complementarity determining region 3 for antibody 6726
VREQGSGYYRTADY

SEQ ID NO: 13453 - protein, 9 aa, Homo sapiens
  light chain complementarity determining region 3 for antibody 6727
QQYNSYPWT

SEQ ID NO: 13454 - protein, 14 aa, Homo sapiens
  heavy chain complementarity determining region 3 for antibody 6727
VREEGSGYYRTAGY

SEQ ID NO: 13455 - protein, 9 aa, Homo sapiens
  light chain complementarity determining region 3 for antibody 6728
QQYNSYPWT

SEQ ID NO: 13456 - protein, 14 aa, Homo sapiens
  heavy chain complementarity determining region 3 for antibody 6728
VREEGSGYYGTADY

SEQ ID NO: 13457 - protein, 9 aa, Homo sapiens
  light chain complementarity determining region 3 for antibody 6729
QQYNSYPWT

SEQ ID NO: 13458 - protein, 14 aa, Homo sapiens
  heavy chain complementarity determining region 3 for antibody 6729
VREEGSGDYRTADY

SEQ ID NO: 13459 - protein, 9 aa, Homo sapiens
  light chain complementarity determining region 3 for antibody 6730
QQYNSYPWT

SEQ ID NO: 13460 - protein, 18 aa, Homo sapiens
  heavy chain complementarity determining region 3 for antibody 6730
TTVLSQLLAGDWHLYFQH

SEQ ID NO: 13461 - protein, 9 aa, Homo sapiens
  light chain complementarity determining region 3 for antibody 6731
QQYNSYPWT

SEQ ID NO: 13462 - protein, 12 aa, Homo sapiens
  heavy chain complementarity determining region 3 for antibody 6731
TTGHRSGSYYDN

SEQ ID NO: 13463 - protein, 9 aa, Homo sapiens
  light chain complementarity determining region 3 for antibody 6732
QQYNSYPWT

SEQ ID NO: 13464 - protein, 12 aa, Homo sapiens
  heavy chain complementarity determining region 3 for antibody 6732
TRSGAGRDYLDY

SEQ ID NO: 13465 - protein, 9 aa, Homo sapiens
  light chain complementarity determining region 3 for antibody 6733
QQYNSYPWT

SEQ ID NO: 13466 - protein, 11 aa, Homo sapiens
  heavy chain complementarity determining region 3 for antibody 6733
TRIVARKPDDY

SEQ ID NO: 13467 - protein, 9 aa, Homo sapiens
  light chain complementarity determining region 3 for antibody 6734
QQYNSYPWT

SEQ ID NO: 13468 - protein, 14 aa, Homo sapiens
  heavy chain complementarity determining region 3 for antibody 6734
TRGHFDSTGFRLDY

SEQ ID NO: 13469 - protein, 9 aa, Homo sapiens
  light chain complementarity determining region 3 for antibody 6735
QQYNSYPWT

SEQ ID NO: 13470 - protein, 13 aa, Homo sapiens
  heavy chain complementarity determining region 3 for antibody 6735
TREGDSSGPDFHL

SEQ ID NO: 13471 - protein, 9 aa, Homo sapiens
  light chain complementarity determining region 3 for antibody 6736
QQYNSYPWT

SEQ ID NO: 13472 - protein, 15 aa, Homo sapiens
  heavy chain complementarity determining region 3 for antibody 6736
RKEGPGSSGWLTGHY

SEQ ID NO: 13473 - protein, 9 aa, Homo sapiens
  light chain complementarity determining region 3 for antibody 6737
QQYNSYPWT

SEQ ID NO: 13474 - protein, 15 aa, Homo sapiens
  heavy chain complementarity determining region 3 for antibody 6737
GKEWPGSSGWLTGHY

SEQ ID NO: 13475 - protein, 9 aa, Homo sapiens
  light chain complementarity determining region 3 for antibody 6738
QQYNSYPWT

SEQ ID NO: 13476 - protein, 15 aa, Homo sapiens
  heavy chain complementarity determining region 3 for antibody 6738
GKERPGSSGWLTGHY

SEQ ID NO: 13477 - protein, 9 aa, Homo sapiens
  light chain complementarity determining region 3 for antibody 6739
QQYNSYPWT

SEQ ID NO: 13478 - protein, 15 aa, Homo sapiens
  heavy chain complementarity determining region 3 for antibody 6739
GKEGSGSSGWLTGHY

SEQ ID NO: 13479 - protein, 9 aa, Homo sapiens
  light chain complementarity determining region 3 for antibody 6740
QQYNSYPWT

SEQ ID NO: 13480 - protein, 15 aa, Homo sapiens
  heavy chain complementarity determining region 3 for antibody 6740
GKEGPRSSGWLTGHY

SEQ ID NO: 13481 - protein, 9 aa, Homo sapiens
  light chain complementarity determining region 3 for antibody 6741
QQYNSYPWT

SEQ ID NO: 13482 - protein, 15 aa, Homo sapiens
  heavy chain complementarity determining region 3 for antibody 6741
GKEGPGSSSWLTGHY

SEQ ID NO: 13483 - protein, 9 aa, Homo sapiens
  light chain complementarity determining region 3 for antibody 6742
QQYNSYPWT

SEQ ID NO: 13484 - protein, 15 aa, Homo sapiens
  heavy chain complementarity determining region 3 for antibody 6742
GKEGPGSSGWSTGHY

SEQ ID NO: 13485 - protein, 9 aa, Homo sapiens
  light chain complementarity determining region 3 for antibody 6743
QQYNSYPWT

SEQ ID NO: 13486 - protein, 15 aa, Homo sapiens
  heavy chain complementarity determining region 3 for antibody 6743
GKEGPGSSGWMTGHY

SEQ ID NO: 13487 - protein, 9 aa, Homo sapiens
  light chain complementarity determining region 3 for antibody 6744
QQYNSYPWT

SEQ ID NO: 13488 - protein, 15 aa, Homo sapiens
  heavy chain complementarity determining region 3 for antibody 6744
GKEGPGSSGWLTGYY

SEQ ID NO: 13489 - protein, 9 aa, Homo sapiens
  light chain complementarity determining region 3 for antibody 6745
QQYNSYPWT

SEQ ID NO: 13490 - protein, 15 aa, Homo sapiens
  heavy chain complementarity determining region 3 for antibody 6745
GKEGPGSSGWLTGHS

SEQ ID NO: 13491 - protein, 9 aa, Homo sapiens
  light chain complementarity determining region 3 for antibody 6746
QQYNSYPWT

SEQ ID NO: 13492 - protein, 15 aa, Homo sapiens
  heavy chain complementarity determining region 3 for antibody 6746
GKEGPGSSGWLNGHY

SEQ ID NO: 13493 - protein, 9 aa, Homo sapiens
  light chain complementarity determining region 3 for antibody 6747
QQYNSYPWT

SEQ ID NO: 13494 - protein, 15 aa, Homo sapiens
  heavy chain complementarity determining region 3 for antibody 6747
GKEGPGSSGWFTGHY

SEQ ID NO: 13495 - protein, 9 aa, Homo sapiens
  light chain complementarity determining region 3 for antibody 6748
QQYNSYPWT

SEQ ID NO: 13496 - protein, 15 aa, Homo sapiens
  heavy chain complementarity determining region 3 for antibody 6748
GKEGPGSSGSLTGHY

SEQ ID NO: 13497 - protein, 9 aa, Homo sapiens
  light chain complementarity determining region 3 for antibody 6749
QQYNSYPWT

SEQ ID NO: 13498 - protein, 15 aa, Homo sapiens
  heavy chain complementarity determining region 3 for antibody 6749
GKEGPGSSGCLTGHY

SEQ ID NO: 13499 - protein, 9 aa, Homo sapiens
  light chain complementarity determining region 3 for antibody 6750
QQYNSYPWT

SEQ ID NO: 13500 - protein, 15 aa, Homo sapiens
  heavy chain complementarity determining region 3 for antibody 6750
GKEGPGNSGWLTGHY

SEQ ID NO: 13501 - protein, 9 aa, Homo sapiens
  light chain complementarity determining region 3 for antibody 6751
QQYNSYPWT

SEQ ID NO: 13502 - protein, 15 aa, Homo sapiens
  heavy chain complementarity determining region 3 for antibody 6751
GKEGPGGSGWLTGRY

SEQ ID NO: 13503 - protein, 9 aa, Homo sapiens
  light chain complementarity determining region 3 for antibody 6752
QQYNSYPWT

SEQ ID NO: 13504 - protein, 15 aa, Homo sapiens
  heavy chain complementarity determining region 3 for antibody 6752
GKEGPESSGWLTGHY

SEQ ID NO: 13505 - protein, 9 aa, Homo sapiens
  light chain complementarity determining region 3 for antibody 6753
QQYNSYPWT

SEQ ID NO: 13506 - protein, 10 aa, Homo sapiens
  heavy chain complementarity determining region 3 for antibody 6753
CRDRWGFGDV

SEQ ID NO: 13507 - protein, 9 aa, Homo sapiens
  light chain complementarity determining region 3 for antibody 6754
QQYNSYPWT

SEQ ID NO: 13508 - protein, 10 aa, Homo sapiens
  heavy chain complementarity determining region 3 for antibody 6754
ATSTSGWYVY

SEQ ID NO: 13509 - protein, 9 aa, Homo sapiens
  light chain complementarity determining region 3 for antibody 6755
QQYNSYPWT

SEQ ID NO: 13510 - protein, 14 aa, Homo sapiens
  heavy chain complementarity determining region 3 for antibody 6755
ATGGGSGVEGAFDV

SEQ ID NO: 13511 - protein, 9 aa, Homo sapiens
  light chain complementarity determining region 3 for antibody 6756
QQYNSYPWT

SEQ ID NO: 13512 - protein, 14 aa, Homo sapiens
  heavy chain complementarity determining region 3 for antibody 6756
ATGGGSGFEGALDV

SEQ ID NO: 13513 - protein, 9 aa, Homo sapiens
  light chain complementarity determining region 3 for antibody 6757
QQYNSYPWT

SEQ ID NO: 13514 - protein, 14 aa, Homo sapiens
  heavy chain complementarity determining region 3 for antibody 6757
ATGGGGGFEGAFDV

SEQ ID NO: 13515 - protein, 9 aa, Homo sapiens
  light chain complementarity determining region 3 for antibody 6758
QQYNSYPWT

SEQ ID NO: 13516 - protein, 13 aa, Homo sapiens
  heavy chain complementarity determining region 3 for antibody 6758
ATGAWGSSWWGDY

SEQ ID NO: 13517 - protein, 9 aa, Homo sapiens
  light chain complementarity determining region 3 for antibody 6759
QQYNSYPWT

SEQ ID NO: 13518 - protein, 11 aa, Homo sapiens
  heavy chain complementarity determining region 3 for antibody 6759
ASIVARKPDDY

SEQ ID NO: 13519 - protein, 9 aa, Homo sapiens
  light chain complementarity determining region 3 for antibody 6760
QQYNSYPWT

SEQ ID NO: 13520 - protein, 16 aa, Homo sapiens
  heavy chain complementarity determining region 3 for antibody 6760
ARWFSRSSTGVSYMDV

SEQ ID NO: 13521 - protein, 9 aa, Homo sapiens
  light chain complementarity determining region 3 for antibody 6761
QQYNSYPWT

SEQ ID NO: 13522 - protein, 11 aa, Homo sapiens
  heavy chain complementarity determining region 3 for antibody 6761
ARVVARKPDDY

SEQ ID NO: 13523 - protein, 9 aa, Homo sapiens
  light chain complementarity determining region 3 for antibody 6762
QQYNSYPWT

SEQ ID NO: 13524 - protein, 11 aa, Homo sapiens
  heavy chain complementarity determining region 3 for antibody 6762
ARTVARKPDDY

SEQ ID NO: 13525 - protein, 9 aa, Homo sapiens
  light chain complementarity determining region 3 for antibody 6763
QQYNSYPWT

SEQ ID NO: 13526 - protein, 10 aa, Homo sapiens
  heavy chain complementarity determining region 3 for antibody 6763
ARRWERYFDY

SEQ ID NO: 13527 - protein, 9 aa, Homo sapiens
  light chain complementarity determining region 3 for antibody 6764
QQYNSYPWT

SEQ ID NO: 13528 - protein, 13 aa, Homo sapiens
  heavy chain complementarity determining region 3 for antibody 6764
ARNYYDSIGSFDI

SEQ ID NO: 13529 - protein, 9 aa, Homo sapiens
  light chain complementarity determining region 3 for antibody 6765
QQYNSYPWT

SEQ ID NO: 13530 - protein, 17 aa, Homo sapiens
  heavy chain complementarity determining region 3 for antibody 6765
ARNTMVHGWQRQGSVDH

SEQ ID NO: 13531 - protein, 9 aa, Homo sapiens
  light chain complementarity determining region 3 for antibody 6766
QQYNSYPWT

SEQ ID NO: 13532 - protein, 17 aa, Homo sapiens
  heavy chain complementarity determining region 3 for antibody 6766
ARNTMVGAWQRQGNLDH

SEQ ID NO: 13533 - protein, 9 aa, Homo sapiens
  light chain complementarity determining region 3 for antibody 6767
QQYNSYPWT

SEQ ID NO: 13534 - protein, 14 aa, Homo sapiens
  heavy chain complementarity determining region 3 for antibody 6767
ARLHGSGLGRWLDP

SEQ ID NO: 13535 - protein, 9 aa, Homo sapiens
  light chain complementarity determining region 3 for antibody 6768
QQYNSYPWT

SEQ ID NO: 13536 - protein, 11 aa, Homo sapiens
  heavy chain complementarity determining region 3 for antibody 6768
ARIVDRKPDDY

SEQ ID NO: 13537 - protein, 9 aa, Homo sapiens
  light chain complementarity determining region 3 for antibody 6769
QQYNSYPWT

SEQ ID NO: 13538 - protein, 11 aa, Homo sapiens
  heavy chain complementarity determining region 3 for antibody 6769
ARIVARKQDDY

SEQ ID NO: 13539 - protein, 9 aa, Homo sapiens
  light chain complementarity determining region 3 for antibody 6770
QQYNSYPWT

SEQ ID NO: 13540 - protein, 11 aa, Homo sapiens
  heavy chain complementarity determining region 3 for antibody 6770
ARIVARKPNDY

SEQ ID NO: 13541 - protein, 9 aa, Homo sapiens
  light chain complementarity determining region 3 for antibody 6771
QQYNSYPWT

SEQ ID NO: 13542 - protein, 11 aa, Homo sapiens
  heavy chain complementarity determining region 3 for antibody 6771
ARIVARKPEDY

SEQ ID NO: 13543 - protein, 9 aa, Homo sapiens
  light chain complementarity determining region 3 for antibody 6772
QQYNSYPWT

SEQ ID NO: 13544 - protein, 11 aa, Homo sapiens
  heavy chain complementarity determining region 3 for antibody 6772
ARIVARKPADY

SEQ ID NO: 13545 - protein, 9 aa, Homo sapiens
  light chain complementarity determining region 3 for antibody 6773
QQYNSYPWT

SEQ ID NO: 13546 - protein, 23 aa, Homo sapiens
  heavy chain complementarity determining region 3 for antibody 6773
ARHFPKGGSGVTGTQSLLYYMDV

SEQ ID NO: 13547 - protein, 9 aa, Homo sapiens
  light chain complementarity determining region 3 for antibody 6774
QQYNSYPWT

SEQ ID NO: 13548 - protein, 11 aa, Homo sapiens
  heavy chain complementarity determining region 3 for antibody 6774
ARGGGVGTADY

SEQ ID NO: 13549 - protein, 9 aa, Homo sapiens
  light chain complementarity determining region 3 for antibody 6775
QQYNSYPWT

SEQ ID NO: 13550 - protein, 14 aa, Homo sapiens
  heavy chain complementarity determining region 3 for antibody 6775
ARGGGSGFEGAFDV

SEQ ID NO: 13551 - protein, 9 aa, Homo sapiens
  light chain complementarity determining region 3 for antibody 6776
QQYNSYPWT

SEQ ID NO: 13552 - protein, 10 aa, Homo sapiens
  heavy chain complementarity determining region 3 for antibody 6776
ARETSGAYDI

SEQ ID NO: 13553 - protein, 9 aa, Homo sapiens
  light chain complementarity determining region 3 for antibody 6777
QQYNSYPWT

SEQ ID NO: 13554 - protein, 14 aa, Homo sapiens
  heavy chain complementarity determining region 3 for antibody 6777
AREEGSGYYRTADY

SEQ ID NO: 13555 - protein, 9 aa, Homo sapiens
  light chain complementarity determining region 3 for antibody 6778
QQYNSYPWT

SEQ ID NO: 13556 - protein, 13 aa, Homo sapiens
  heavy chain complementarity determining region 3 for antibody 6778
ARDTVTNKMGSDY

SEQ ID NO: 13557 - protein, 9 aa, Homo sapiens
  light chain complementarity determining region 3 for antibody 6779
QQYNSYPWT

SEQ ID NO: 13558 - protein, 14 aa, Homo sapiens
  heavy chain complementarity determining region 3 for antibody 6779
ARDTTYNWNDGGIS

SEQ ID NO: 13559 - protein, 9 aa, Homo sapiens
  light chain complementarity determining region 3 for antibody 6780
QQYNSYPWT

SEQ ID NO: 13560 - protein, 12 aa, Homo sapiens
  heavy chain complementarity determining region 3 for antibody 6780
ARDLAGAPYVDS

SEQ ID NO: 13561 - protein, 9 aa, Homo sapiens
  light chain complementarity determining region 3 for antibody 6781
QQYNSYPWT

SEQ ID NO: 13562 - protein, 26 aa, Homo sapiens
  heavy chain complementarity determining region 3 for antibody 6781
ARDFPKGGSYSSGWYGSVGGKYYMDV

SEQ ID NO: 13563 - protein, 9 aa, Homo sapiens
  light chain complementarity determining region 3 for antibody 6782
QQYNSYPWT

SEQ ID NO: 13564 - protein, 16 aa, Homo sapiens
  heavy chain complementarity determining region 3 for antibody 6782
AKSLNIEVSHSGPFDF

SEQ ID NO: 13565 - protein, 9 aa, Homo sapiens
  light chain complementarity determining region 3 for antibody 6783
QQYNSYPWT

SEQ ID NO: 13566 - protein, 11 aa, Homo sapiens
  heavy chain complementarity determining region 3 for antibody 6783
AKGGFYFLTGD

SEQ ID NO: 13567 - protein, 9 aa, Homo sapiens
  light chain complementarity determining region 3 for antibody 6784
QQYNSYPWT

SEQ ID NO: 13568 - protein, 10 aa, Homo sapiens
  heavy chain complementarity determining region 3 for antibody 6784
AHRINRAFDI

SEQ ID NO: 13569 - protein, 9 aa, Homo sapiens
  light chain complementarity determining region 3 for antibody 6785
QQYNSYPWT

SEQ ID NO: 13570 - protein, 14 aa, Homo sapiens
  heavy chain complementarity determining region 3 for antibody 6785
AAGGGSGFEGAFDV

SEQ ID NO: 13571 - protein, 9 aa, Homo sapiens
  light chain complementarity determining region 3 for antibody 6786
QQYNSYPWT

SEQ ID NO: 13572 - protein, 16 aa, Homo sapiens
  heavy chain complementarity determining region 3 for antibody 6786
AADLGDHADAYATLDS

SEQ ID NO: 13573 - protein, 9 aa, Homo sapiens
  light chain complementarity determining region 3 for antibody 6787
QQYNSYPWR

SEQ ID NO: 13574 - protein, 15 aa, Homo sapiens
  heavy chain complementarity determining region 3 for antibody 6787
GKEGPGSSGWLTGHY

SEQ ID NO: 13575 - protein, 9 aa, Homo sapiens
  light chain complementarity determining region 3 for antibody 6788
QQYNSYPWA

SEQ ID NO: 13576 - protein, 15 aa, Homo sapiens
  heavy chain complementarity determining region 3 for antibody 6788
GKEGPGSSGWLTGHY

SEQ ID NO: 13577 - protein, 9 aa, Homo sapiens
  light chain complementarity determining region 3 for antibody 6789
QQYNSYPTT

SEQ ID NO: 13578 - protein, 13 aa, Homo sapiens
  heavy chain complementarity determining region 3 for antibody 6789
AKEGSSPGPDFEY

SEQ ID NO: 13579 - protein, 8 aa, Homo sapiens
  light chain complementarity determining region 3 for antibody 6790
QQYNSYPT

SEQ ID NO: 13580 - protein, 23 aa, Homo sapiens
  heavy chain complementarity determining region 3 for antibody 6790
ARHFPKGGSGVTGTQSLHYYMDV

SEQ ID NO: 13581 - protein, 9 aa, Homo sapiens
  light chain complementarity determining region 3 for antibody 6791
QQYNSYPRT

SEQ ID NO: 13582 - protein, 14 aa, Homo sapiens
  heavy chain complementarity determining region 3 for antibody 6791
ATGGGSGFEGAFDV

SEQ ID NO: 13583 - protein, 9 aa, Homo sapiens
  light chain complementarity determining region 3 for antibody 6792
QQYNSYPPT

SEQ ID NO: 13584 - protein, 13 aa, Homo sapiens
  heavy chain complementarity determining region 3 for antibody 6792
GKEGSSPGPDFEY

SEQ ID NO: 13585 - protein, 9 aa, Homo sapiens
  light chain complementarity determining region 3 for antibody 6793
QQYNSYPPT

SEQ ID NO: 13586 - protein, 10 aa, Homo sapiens
  heavy chain complementarity determining region 3 for antibody 6793
CRDRWGFGDV

SEQ ID NO: 13587 - protein, 9 aa, Homo sapiens
  light chain complementarity determining region 3 for antibody 6794
QQYNSYPPT

SEQ ID NO: 13588 - protein, 16 aa, Homo sapiens
  heavy chain complementarity determining region 3 for antibody 6794
ATDVGDHSDRFTTLDY

SEQ ID NO: 13589 - protein, 9 aa, Homo sapiens
  light chain complementarity determining region 3 for antibody 6795
QQYNSYPPT

SEQ ID NO: 13590 - protein, 15 aa, Homo sapiens
  heavy chain complementarity determining region 3 for antibody 6795
ARVGRPYHNAWYFDN

SEQ ID NO: 13591 - protein, 9 aa, Homo sapiens
  light chain complementarity determining region 3 for antibody 6796
QQYNSYPPT

SEQ ID NO: 13592 - protein, 14 aa, Homo sapiens
  heavy chain complementarity determining region 3 for antibody 6796
ARGHFDSTGFRLDY

SEQ ID NO: 13593 - protein, 9 aa, Homo sapiens
  light chain complementarity determining region 3 for antibody 6797
QQYNSYPPT

SEQ ID NO: 13594 - protein, 18 aa, Homo sapiens
  heavy chain complementarity determining region 3 for antibody 6797
ARGDYPEARTGYFLDFDY

SEQ ID NO: 13595 - protein, 9 aa, Homo sapiens
  light chain complementarity determining region 3 for antibody 6798
QQYNSYPPT

SEQ ID NO: 13596 - protein, 10 aa, Homo sapiens
  heavy chain complementarity determining region 3 for antibody 6798
ARERSGSYDI

SEQ ID NO: 13597 - protein, 9 aa, Homo sapiens
  light chain complementarity determining region 3 for antibody 6799
QQYNSYPPT

SEQ ID NO: 13598 - protein, 13 aa, Homo sapiens
  heavy chain complementarity determining region 3 for antibody 6799
AKPHYHGSGSPDY

SEQ ID NO: 13599 - protein, 9 aa, Homo sapiens
  light chain complementarity determining region 3 for antibody 6800
QQYNSYPPT

SEQ ID NO: 13600 - protein, 13 aa, Homo sapiens
  heavy chain complementarity determining region 3 for antibody 6800
AKERSSPGPDFEY

SEQ ID NO: 13601 - protein, 9 aa, Homo sapiens
  light chain complementarity determining region 3 for antibody 6801
QQYNSYPPT

SEQ ID NO: 13602 - protein, 13 aa, Homo sapiens
  heavy chain complementarity determining region 3 for antibody 6801
AKEGSTPGPDFEY

SEQ ID NO: 13603 - protein, 9 aa, Homo sapiens
  light chain complementarity determining region 3 for antibody 6802
QQYNSYPPT

SEQ ID NO: 13604 - protein, 13 aa, Homo sapiens
  heavy chain complementarity determining region 3 for antibody 6802
AKEGSSPVPDFEY

SEQ ID NO: 13605 - protein, 9 aa, Homo sapiens
  light chain complementarity determining region 3 for antibody 6803
QQYNSYPPT

SEQ ID NO: 13606 - protein, 13 aa, Homo sapiens
  heavy chain complementarity determining region 3 for antibody 6803
AKEGSSPGPDFEH

SEQ ID NO: 13607 - protein, 9 aa, Homo sapiens
  light chain complementarity determining region 3 for antibody 6804
QQYNSYPPT

SEQ ID NO: 13608 - protein, 13 aa, Homo sapiens
  heavy chain complementarity determining region 3 for antibody 6804
AKEGSSPGPDFDY

SEQ ID NO: 13609 - protein, 9 aa, Homo sapiens
  light chain complementarity determining region 3 for antibody 6805
QQYNSYPPT

SEQ ID NO: 13610 - protein, 13 aa, Homo sapiens
  heavy chain complementarity determining region 3 for antibody 6805
AKEGSSPGPAFEY

SEQ ID NO: 13611 - protein, 9 aa, Homo sapiens
  light chain complementarity determining region 3 for antibody 6806
QQYNSYPPT

SEQ ID NO: 13612 - protein, 13 aa, Homo sapiens
  heavy chain complementarity determining region 3 for antibody 6806
AKEGSSHGPDFEY

SEQ ID NO: 13613 - protein, 9 aa, Homo sapiens
  light chain complementarity determining region 3 for antibody 6807
QQYNSYPPT

SEQ ID NO: 13614 - protein, 13 aa, Homo sapiens
  heavy chain complementarity determining region 3 for antibody 6807
AKEGSSAGPDFEY

SEQ ID NO: 13615 - protein, 9 aa, Homo sapiens
  light chain complementarity determining region 3 for antibody 6808
QQYNSYPPT

SEQ ID NO: 13616 - protein, 13 aa, Homo sapiens
  heavy chain complementarity determining region 3 for antibody 6808
AKEGSAPGPDVEY

SEQ ID NO: 13617 - protein, 9 aa, Homo sapiens
  light chain complementarity determining region 3 for antibody 6809
QQYNSYPPT

SEQ ID NO: 13618 - protein, 13 aa, Homo sapiens
  heavy chain complementarity determining region 3 for antibody 6809
AKEGPSPGPDFEY

SEQ ID NO: 13619 - protein, 9 aa, Homo sapiens
  light chain complementarity determining region 3 for antibody 6810
QQYNSYPPT

SEQ ID NO: 13620 - protein, 13 aa, Homo sapiens
  heavy chain complementarity determining region 3 for antibody 6810
AKDGSSPGPDFEY

SEQ ID NO: 13621 - protein, 10 aa, Homo sapiens
  light chain complementarity determining region 3 for antibody 6811
QQYNSYPPRP

SEQ ID NO: 13622 - protein, 15 aa, Homo sapiens
  heavy chain complementarity determining region 3 for antibody 6811
ARVGRPYHNAWYFDN

SEQ ID NO: 13623 - protein, 9 aa, Homo sapiens
  light chain complementarity determining region 3 for antibody 6812
QQYNSYPPK

SEQ ID NO: 13624 - protein, 13 aa, Homo sapiens
  heavy chain complementarity determining region 3 for antibody 6812
AKEGSSPGPDFEY

SEQ ID NO: 13625 - protein, 9 aa, Homo sapiens
  light chain complementarity determining region 3 for antibody 6813
QQYNSYPLT

SEQ ID NO: 13626 - protein, 14 aa, Homo sapiens
  heavy chain complementarity determining region 3 for antibody 6813
VREEGSGYYRTADY

SEQ ID NO: 13627 - protein, 9 aa, Homo sapiens
  light chain complementarity determining region 3 for antibody 6814
QQYNSYPLT

SEQ ID NO: 13628 - protein, 14 aa, Homo sapiens
  heavy chain complementarity determining region 3 for antibody 6814
TRGHFDSTGFRLDY

SEQ ID NO: 13629 - protein, 9 aa, Homo sapiens
  light chain complementarity determining region 3 for antibody 6815
QQYNSYPLT

SEQ ID NO: 13630 - protein, 12 aa, Homo sapiens
  heavy chain complementarity determining region 3 for antibody 6815
MRGSPPSSSLDY

SEQ ID NO: 13631 - protein, 9 aa, Homo sapiens
  light chain complementarity determining region 3 for antibody 6816
QQYNSYPLT

SEQ ID NO: 13632 - protein, 14 aa, Homo sapiens
  heavy chain complementarity determining region 3 for antibody 6816
ARGHFDSTGFRLDY

SEQ ID NO: 13633 - protein, 9 aa, Homo sapiens
  light chain complementarity determining region 3 for antibody 6817
QQYNSYPLT

SEQ ID NO: 13634 - protein, 16 aa, Homo sapiens
  heavy chain complementarity determining region 3 for antibody 6817
ARFIVEAQYAYYAMDA

SEQ ID NO: 13635 - protein, 9 aa, Homo sapiens
  light chain complementarity determining region 3 for antibody 6818
QQYNSYPHT

SEQ ID NO: 13636 - protein, 14 aa, Homo sapiens
  heavy chain complementarity determining region 3 for antibody 6818
GRDVHTTGWTLGGY

SEQ ID NO: 13637 - protein, 9 aa, Homo sapiens
  light chain complementarity determining region 3 for antibody 6819
QQYNSYPGT

SEQ ID NO: 13638 - protein, 14 aa, Homo sapiens
  heavy chain complementarity determining region 3 for antibody 6819
ATGGGSGFEGAFDV

SEQ ID NO: 13639 - protein, 9 aa, Homo sapiens
  light chain complementarity determining region 3 for antibody 6820
QQYNSYLLT

SEQ ID NO: 13640 - protein, 8 aa, Homo sapiens
  heavy chain complementarity determining region 3 for antibody 6820
ARDLIITS

SEQ ID NO: 13641 - protein, 7 aa, Homo sapiens
  light chain complementarity determining region 3 for antibody 6821
QQYNSWT

SEQ ID NO: 13642 - protein, 16 aa, Homo sapiens
  heavy chain complementarity determining region 3 for antibody 6821
VRDLAGFTRGGSTFDY

SEQ ID NO: 13643 - protein, 7 aa, Homo sapiens
  light chain complementarity determining region 3 for antibody 6822
QQYNSWT

SEQ ID NO: 13644 - protein, 9 aa, Homo sapiens
  heavy chain complementarity determining region 3 for antibody 6822
GSRRPYFDS

SEQ ID NO: 13645 - protein, 7 aa, Homo sapiens
  light chain complementarity determining region 3 for antibody 6823
QQYNSWT

SEQ ID NO: 13646 - protein, 10 aa, Homo sapiens
  heavy chain complementarity determining region 3 for antibody 6823
CRDREGFGDV

SEQ ID NO: 13647 - protein, 7 aa, Homo sapiens
  light chain complementarity determining region 3 for antibody 6824
QQYNSWT

SEQ ID NO: 13648 - protein, 9 aa, Homo sapiens
  heavy chain complementarity determining region 3 for antibody 6824
ARSEYQPTY

SEQ ID NO: 13649 - protein, 7 aa, Homo sapiens
  light chain complementarity determining region 3 for antibody 6825
QQYNSWT

SEQ ID NO: 13650 - protein, 11 aa, Homo sapiens
  heavy chain complementarity determining region 3 for antibody 6825
ARRSLGGAFDY

SEQ ID NO: 13651 - protein, 7 aa, Homo sapiens
  light chain complementarity determining region 3 for antibody 6826
QQYNSWT

SEQ ID NO: 13652 - protein, 12 aa, Homo sapiens
  heavy chain complementarity determining region 3 for antibody 6826
AKYKGGRSGMDV

SEQ ID NO: 13653 - protein, 7 aa, Homo sapiens
  light chain complementarity determining region 3 for antibody 6827
QQYNSWT

SEQ ID NO: 13654 - protein, 12 aa, Homo sapiens
  heavy chain complementarity determining region 3 for antibody 6827
AKGKGGRSGMDV

SEQ ID NO: 13655 - protein, 7 aa, Homo sapiens
  light chain complementarity determining region 3 for antibody 6828
QQYNSWT

SEQ ID NO: 13656 - protein, 12 aa, Homo sapiens
  heavy chain complementarity determining region 3 for antibody 6828
AKDKGGWSGMDV

SEQ ID NO: 13657 - protein, 7 aa, Homo sapiens
  light chain complementarity determining region 3 for antibody 6829
QQYNSWT

SEQ ID NO: 13658 - protein, 12 aa, Homo sapiens
  heavy chain complementarity determining region 3 for antibody 6829
AKDKGGRSSMDV

SEQ ID NO: 13659 - protein, 7 aa, Homo sapiens
  light chain complementarity determining region 3 for antibody 6830
QQYNSWT

SEQ ID NO: 13660 - protein, 12 aa, Homo sapiens
  heavy chain complementarity determining region 3 for antibody 6830
AKDKGGRSGMDA

SEQ ID NO: 13661 - protein, 7 aa, Homo sapiens
  light chain complementarity determining region 3 for antibody 6831
QQYNSWT

SEQ ID NO: 13662 - protein, 12 aa, Homo sapiens
  heavy chain complementarity determining region 3 for antibody 6831
AKDKGGRSGIDV

SEQ ID NO: 13663 - protein, 7 aa, Homo sapiens
  light chain complementarity determining region 3 for antibody 6832
QQYNSWT

SEQ ID NO: 13664 - protein, 12 aa, Homo sapiens
  heavy chain complementarity determining region 3 for antibody 6832
AKDEGGRSGMDV

SEQ ID NO: 13665 - protein, 7 aa, Homo sapiens
  light chain complementarity determining region 3 for antibody 6833
QQYNSWT

SEQ ID NO: 13666 - protein, 12 aa, Homo sapiens
  heavy chain complementarity determining region 3 for antibody 6833
AIVVPGRWDLDD

SEQ ID NO: 13667 - protein, 7 aa, Homo sapiens
  light chain complementarity determining region 3 for antibody 6834
QQYNSWT

SEQ ID NO: 13668 - protein, 12 aa, Homo sapiens
  heavy chain complementarity determining region 3 for antibody 6834
AEDKGGRSGMDV

SEQ ID NO: 13669 - protein, 8 aa, Homo sapiens
  light chain complementarity determining region 3 for antibody 6835
QQYNSWRT

SEQ ID NO: 13670 - protein, 11 aa, Homo sapiens
  heavy chain complementarity determining region 3 for antibody 6835
ATDVYGGAHEY

SEQ ID NO: 13671 - protein, 9 aa, Homo sapiens
  light chain complementarity determining region 3 for antibody 6836
QQYNSWPRT

SEQ ID NO: 13672 - protein, 14 aa, Homo sapiens
  heavy chain complementarity determining region 3 for antibody 6836
TTAPGFWGTSPFDY

SEQ ID NO: 13673 - protein, 9 aa, Homo sapiens
  light chain complementarity determining region 3 for antibody 6837
QQYNSSSHT

SEQ ID NO: 13674 - protein, 14 aa, Homo sapiens
  heavy chain complementarity determining region 3 for antibody 6837
ARDVHTTGWTLGGY

SEQ ID NO: 13675 - protein, 9 aa, Homo sapiens
  light chain complementarity determining region 3 for antibody 6838
QQYNSSPWT

SEQ ID NO: 13676 - protein, 14 aa, Homo sapiens
  heavy chain complementarity determining region 3 for antibody 6838
VREEGSGYYRTADY

SEQ ID NO: 13677 - protein, 9 aa, Homo sapiens
  light chain complementarity determining region 3 for antibody 6839
QQYNSSPWT

SEQ ID NO: 13678 - protein, 15 aa, Homo sapiens
  heavy chain complementarity determining region 3 for antibody 6839
GKEGPGSSGWLTGHY

SEQ ID NO: 13679 - protein, 9 aa, Homo sapiens
  light chain complementarity determining region 3 for antibody 6840
QQYNSSPPT

SEQ ID NO: 13680 - protein, 13 aa, Homo sapiens
  heavy chain complementarity determining region 3 for antibody 6840
AKEGSSPGPDFEY

SEQ ID NO: 13681 - protein, 9 aa, Homo sapiens
  light chain complementarity determining region 3 for antibody 6841
QQYNSSPHT

SEQ ID NO: 13682 - protein, 9 aa, Homo sapiens
  heavy chain complementarity determining region 3 for antibody 6841
ATDRSWFDP

SEQ ID NO: 13683 - protein, 9 aa, Homo sapiens
  light chain complementarity determining region 3 for antibody 6842
QQYNSPPNT

SEQ ID NO: 13684 - protein, 15 aa, Homo sapiens
  heavy chain complementarity determining region 3 for antibody 6842
ARHLSGETKVRYFDY

SEQ ID NO: 13685 - protein, 9 aa, Homo sapiens
  light chain complementarity determining region 3 for antibody 6843
QQYNSNSLT

SEQ ID NO: 13686 - protein, 15 aa, Homo sapiens
  heavy chain complementarity determining region 3 for antibody 6843
ARSMVSGTTDDAFDI

SEQ ID NO: 13687 - protein, 9 aa, Homo sapiens
  light chain complementarity determining region 3 for antibody 6844
QQYNSHPPT

SEQ ID NO: 13688 - protein, 13 aa, Homo sapiens
  heavy chain complementarity determining region 3 for antibody 6844
AKEGSSPGPDFEY

SEQ ID NO: 13689 - protein, 9 aa, Homo sapiens
  light chain complementarity determining region 3 for antibody 6845
QQYNSFPLT

SEQ ID NO: 13690 - protein, 14 aa, Homo sapiens
  heavy chain complementarity determining region 3 for antibody 6845
TRDRWGSRLDAFDI

SEQ ID NO: 13691 - protein, 9 aa, Homo sapiens
  light chain complementarity determining region 3 for antibody 6846
QQYNSCPWT

SEQ ID NO: 13692 - protein, 15 aa, Homo sapiens
  heavy chain complementarity determining region 3 for antibody 6846
GKEGPGSSGWLTGHY

SEQ ID NO: 13693 - protein, 9 aa, Homo sapiens
  light chain complementarity determining region 3 for antibody 6847
QQYNSAPFT

SEQ ID NO: 13694 - protein, 10 aa, Homo sapiens
  heavy chain complementarity determining region 3 for antibody 6847
VREGHWNLDH

SEQ ID NO: 13695 - protein, 9 aa, Homo sapiens
  light chain complementarity determining region 3 for antibody 6848
QQYNRYQWT

SEQ ID NO: 13696 - protein, 14 aa, Homo sapiens
  heavy chain complementarity determining region 3 for antibody 6848
VREQGSGYYRTADY

SEQ ID NO: 13697 - protein, 9 aa, Homo sapiens
  light chain complementarity determining region 3 for antibody 6849
QQYNRYPWT

SEQ ID NO: 13698 - protein, 14 aa, Homo sapiens
  heavy chain complementarity determining region 3 for antibody 6849
VREQGSGYYRPADY

SEQ ID NO: 13699 - protein, 9 aa, Homo sapiens
  light chain complementarity determining region 3 for antibody 6850
QQYNRYPRT

SEQ ID NO: 13700 - protein, 14 aa, Homo sapiens
  heavy chain complementarity determining region 3 for antibody 6850
VREQGSGYYRTADY

SEQ ID NO: 13701 - protein, 9 aa, Homo sapiens
  light chain complementarity determining region 3 for antibody 6851
QQYNNYSHT

SEQ ID NO: 13702 - protein, 14 aa, Homo sapiens
  heavy chain complementarity determining region 3 for antibody 6851
GRDVHTSGWTLGGY

SEQ ID NO: 13703 - protein, 9 aa, Homo sapiens
  light chain complementarity determining region 3 for antibody 6852
QQYNNYPLT

SEQ ID NO: 13704 - protein, 14 aa, Homo sapiens
  heavy chain complementarity determining region 3 for antibody 6852
ANYRASIGARRFDP

SEQ ID NO: 13705 - protein, 9 aa, Homo sapiens
  light chain complementarity determining region 3 for antibody 6853
QQYNNYPLT

SEQ ID NO: 13706 - protein, 14 aa, Homo sapiens
  heavy chain complementarity determining region 3 for antibody 6853
ANYRASIGARCFDH

SEQ ID NO: 13707 - protein, 9 aa, Homo sapiens
  light chain complementarity determining region 3 for antibody 6854
QQYNNWPWT

SEQ ID NO: 13708 - protein, 18 aa, Homo sapiens
  heavy chain complementarity determining region 3 for antibody 6854
ASWAGSCSSTSGYAVYDY

SEQ ID NO: 13709 - protein, 9 aa, Homo sapiens
  light chain complementarity determining region 3 for antibody 6855
QQYNNWPWT

SEQ ID NO: 13710 - protein, 18 aa, Homo sapiens
  heavy chain complementarity determining region 3 for antibody 6855
ASWAGSCSSTSCCAVYDY

SEQ ID NO: 13711 - protein, 9 aa, Homo sapiens
  light chain complementarity determining region 3 for antibody 6856
QQYNNWPWT

SEQ ID NO: 13712 - protein, 11 aa, Homo sapiens
  heavy chain complementarity determining region 3 for antibody 6856
ASHDEQWLPGY

SEQ ID NO: 13713 - protein, 9 aa, Homo sapiens
  light chain complementarity determining region 3 for antibody 6857
QQYNNWPRT

SEQ ID NO: 13714 - protein, 10 aa, Homo sapiens
  heavy chain complementarity determining region 3 for antibody 6857
VTSVLDGTTR

SEQ ID NO: 13715 - protein, 9 aa, Homo sapiens
  light chain complementarity determining region 3 for antibody 6858
QQYNNWPRT

SEQ ID NO: 13716 - protein, 16 aa, Homo sapiens
  heavy chain complementarity determining region 3 for antibody 6858
VRDLAGFTRGGSTFDY

SEQ ID NO: 13717 - protein, 9 aa, Homo sapiens
  light chain complementarity determining region 3 for antibody 6859
QQYNNWPRT

SEQ ID NO: 13718 - protein, 19 aa, Homo sapiens
  heavy chain complementarity determining region 3 for antibody 6859
ARSTYYYNSSGYYYLAFDI

SEQ ID NO: 13719 - protein, 9 aa, Homo sapiens
  light chain complementarity determining region 3 for antibody 6860
QQYNNWPRT

SEQ ID NO: 13720 - protein, 14 aa, Homo sapiens
  heavy chain complementarity determining region 3 for antibody 6860
ARGHFDSTGFRLDY

SEQ ID NO: 13721 - protein, 9 aa, Homo sapiens
  light chain complementarity determining region 3 for antibody 6861
QQYNNWPRP

SEQ ID NO: 13722 - protein, 11 aa, Homo sapiens
  heavy chain complementarity determining region 3 for antibody 6861
VSAFITTFGVV

SEQ ID NO: 13723 - protein, 10 aa, Homo sapiens
  light chain complementarity determining region 3 for antibody 6862
QQYNNWPPYT

SEQ ID NO: 13724 - protein, 14 aa, Homo sapiens
  heavy chain complementarity determining region 3 for antibody 6862
ARENCYGTGSCFDF

SEQ ID NO: 13725 - protein, 10 aa, Homo sapiens
  light chain complementarity determining region 3 for antibody 6863
QQYNNWPPYT

SEQ ID NO: 13726 - protein, 12 aa, Homo sapiens
  heavy chain complementarity determining region 3 for antibody 6863
ARDKGGRNGMDV

SEQ ID NO: 13727 - protein, 10 aa, Homo sapiens
  light chain complementarity determining region 3 for antibody 6864
QQYNNWPPYT

SEQ ID NO: 13728 - protein, 23 aa, Homo sapiens
  heavy chain complementarity determining region 3 for antibody 6864
ARAVRRSTIFGPERGKQKNWFDP

SEQ ID NO: 13729 - protein, 10 aa, Homo sapiens
  light chain complementarity determining region 3 for antibody 6865
QQYNNWPPVT

SEQ ID NO: 13730 - protein, 16 aa, Homo sapiens
  heavy chain complementarity determining region 3 for antibody 6865
VGPHLTYNSGWRYFDY

SEQ ID NO: 13731 - protein, 11 aa, Homo sapiens
  light chain complementarity determining region 3 for antibody 6866
QQYNNWPPSST

SEQ ID NO: 13732 - protein, 20 aa, Homo sapiens
  heavy chain complementarity determining region 3 for antibody 6866
ARDRVICDGGNCYSQLYYDY

SEQ ID NO: 13733 - protein, 10 aa, Homo sapiens
  light chain complementarity determining region 3 for antibody 6867
QQYNNWPPGT

SEQ ID NO: 13734 - protein, 10 aa, Homo sapiens
  heavy chain complementarity determining region 3 for antibody 6867
ARTRGFLFDY

SEQ ID NO: 13735 - protein, 9 aa, Homo sapiens
  light chain complementarity determining region 3 for antibody 6868
QQYNNWPLT

SEQ ID NO: 13736 - protein, 17 aa, Homo sapiens
  heavy chain complementarity determining region 3 for antibody 6868
ARNTMVGTWQRQGNLDH

SEQ ID NO: 13737 - protein, 9 aa, Homo sapiens
  light chain complementarity determining region 3 for antibody 6869
QQYNNWPLT

SEQ ID NO: 13738 - protein, 15 aa, Homo sapiens
  heavy chain complementarity determining region 3 for antibody 6869
ARDNPITKWYFGLYY

SEQ ID NO: 13739 - protein, 9 aa, Homo sapiens
  light chain complementarity determining region 3 for antibody 6870
QQYNNWPLT

SEQ ID NO: 13740 - protein, 15 aa, Homo sapiens
  heavy chain complementarity determining region 3 for antibody 6870
ARDNPITKWYFGLVY

SEQ ID NO: 13741 - protein, 9 aa, Homo sapiens
  light chain complementarity determining region 3 for antibody 6871
QQYNNWPLT

SEQ ID NO: 13742 - protein, 16 aa, Homo sapiens
  heavy chain complementarity determining region 3 for antibody 6871
AKAPPDGYKDYYGMDV

SEQ ID NO: 13743 - protein, 9 aa, Homo sapiens
  light chain complementarity determining region 3 for antibody 6872
QQYNNWPGT

SEQ ID NO: 13744 - protein, 18 aa, Homo sapiens
  heavy chain complementarity determining region 3 for antibody 6872
ASWAGSCSSTSCYAVYDY

SEQ ID NO: 13745 - protein, 9 aa, Homo sapiens
  light chain complementarity determining region 3 for antibody 6873
QQYNNWPFT

SEQ ID NO: 13746 - protein, 10 aa, Homo sapiens
  heavy chain complementarity determining region 3 for antibody 6873
VRSDSPVDDS

SEQ ID NO: 13747 - protein, 9 aa, Homo sapiens
  light chain complementarity determining region 3 for antibody 6874
QQYNNWPFT

SEQ ID NO: 13748 - protein, 10 aa, Homo sapiens
  heavy chain complementarity determining region 3 for antibody 6874
VRSDSPGEDS

SEQ ID NO: 13749 - protein, 9 aa, Homo sapiens
  light chain complementarity determining region 3 for antibody 6875
QQYNNWPFT

SEQ ID NO: 13750 - protein, 10 aa, Homo sapiens
  heavy chain complementarity determining region 3 for antibody 6875
VRSDSPGDDA

SEQ ID NO: 13751 - protein, 9 aa, Homo sapiens
  light chain complementarity determining region 3 for antibody 6876
QQYNNWPET

SEQ ID NO: 13752 - protein, 13 aa, Homo sapiens
  heavy chain complementarity determining region 3 for antibody 6876
AKEGSSPGPDLDY

SEQ ID NO: 13753 - protein, 9 aa, Homo sapiens
  light chain complementarity determining region 3 for antibody 6877
QQYNNWPAT

SEQ ID NO: 13754 - protein, 18 aa, Homo sapiens
  heavy chain complementarity determining region 3 for antibody 6877
ARGFCGGDCSVGGRASDY

SEQ ID NO: 13755 - protein, 9 aa, Homo sapiens
  light chain complementarity determining region 3 for antibody 6878
QQYNNWPAP

SEQ ID NO: 13756 - protein, 18 aa, Homo sapiens
  heavy chain complementarity determining region 3 for antibody 6878
ARGFCGGDCSVGGRTSDY

SEQ ID NO: 13757 - protein, 9 aa, Homo sapiens
  light chain complementarity determining region 3 for antibody 6879
QQYNNRPRT

SEQ ID NO: 13758 - protein, 10 aa, Homo sapiens
  heavy chain complementarity determining region 3 for antibody 6879
VTSLLDGTTR

SEQ ID NO: 13759 - protein, 9 aa, Homo sapiens
  light chain complementarity determining region 3 for antibody 6880
QQYNNLPQT

SEQ ID NO: 13760 - protein, 16 aa, Homo sapiens
  heavy chain complementarity determining region 3 for antibody 6880
ARDLWVAAWYPGALDV

SEQ ID NO: 13761 - protein, 9 aa, Homo sapiens
  light chain complementarity determining region 3 for antibody 6881
QQYNNCPFT

SEQ ID NO: 13762 - protein, 10 aa, Homo sapiens
  heavy chain complementarity determining region 3 for antibody 6881
VRSDSPGDDS

SEQ ID NO: 13763 - protein, 10 aa, Homo sapiens
  light chain complementarity determining region 3 for antibody 6882
QQYNKWPPWR

SEQ ID NO: 13764 - protein, 15 aa, Homo sapiens
  heavy chain complementarity determining region 3 for antibody 6882
AREIRVGASEYYFDR

SEQ ID NO: 13765 - protein, 10 aa, Homo sapiens
  light chain complementarity determining region 3 for antibody 6883
QQYNKWPPWR

SEQ ID NO: 13766 - protein, 15 aa, Homo sapiens
  heavy chain complementarity determining region 3 for antibody 6883
ARDIRVGASEYYFDH

SEQ ID NO: 13767 - protein, 10 aa, Homo sapiens
  light chain complementarity determining region 3 for antibody 6884
QQYNKWPPWR

SEQ ID NO: 13768 - protein, 15 aa, Homo sapiens
  heavy chain complementarity determining region 3 for antibody 6884
ARDIRVGASEYCFDR

SEQ ID NO: 13769 - protein, 10 aa, Homo sapiens
  light chain complementarity determining region 3 for antibody 6885
QQYNKWPPWG

SEQ ID NO: 13770 - protein, 15 aa, Homo sapiens
  heavy chain complementarity determining region 3 for antibody 6885
ARDIRVGASEYYFDR

SEQ ID NO: 13771 - protein, 9 aa, Homo sapiens
  light chain complementarity determining region 3 for antibody 6886
QQYNIYPWT

SEQ ID NO: 13772 - protein, 15 aa, Homo sapiens
  heavy chain complementarity determining region 3 for antibody 6886
GKEGPGSSGWLTGHY

SEQ ID NO: 13773 - protein, 10 aa, Homo sapiens
  light chain complementarity determining region 3 for antibody 6887
QQYNIWPRGT

SEQ ID NO: 13774 - protein, 17 aa, Homo sapiens
  heavy chain complementarity determining region 3 for antibody 6887
ASWNSTLVVIPAAVFDF

SEQ ID NO: 13775 - protein, 10 aa, Homo sapiens
  light chain complementarity determining region 3 for antibody 6888
QQYNIWPRGP

SEQ ID NO: 13776 - protein, 17 aa, Homo sapiens
  heavy chain complementarity determining region 3 for antibody 6888
ASWNSPLVVIPAAVFDF

SEQ ID NO: 13777 - protein, 9 aa, Homo sapiens
  light chain complementarity determining region 3 for antibody 6889
QQYNGYPWT

SEQ ID NO: 13778 - protein, 15 aa, Homo sapiens
  heavy chain complementarity determining region 3 for antibody 6889
GKEGPGSSGWLTGHY

SEQ ID NO: 13779 - protein, 9 aa, Homo sapiens
  light chain complementarity determining region 3 for antibody 6890
QQYNGYPWT

SEQ ID NO: 13780 - protein, 9 aa, Homo sapiens
  heavy chain complementarity determining region 3 for antibody 6890
AGWGGLSNY

SEQ ID NO: 13781 - protein, 9 aa, Homo sapiens
  light chain complementarity determining region 3 for antibody 6891
QQYNGYPNT

SEQ ID NO: 13782 - protein, 8 aa, Homo sapiens
  heavy chain complementarity determining region 3 for antibody 6891
TGGRYWDV

SEQ ID NO: 13783 - protein, 10 aa, Homo sapiens
  light chain complementarity determining region 3 for antibody 6892
QQYNFYSTLT

SEQ ID NO: 13784 - protein, 16 aa, Homo sapiens
  heavy chain complementarity determining region 3 for antibody 6892
GRQVVSGTKGPNRLDY

SEQ ID NO: 13785 - protein, 10 aa, Homo sapiens
  light chain complementarity determining region 3 for antibody 6893
QQYNFYSTLT

SEQ ID NO: 13786 - protein, 16 aa, Homo sapiens
  heavy chain complementarity determining region 3 for antibody 6893
GRQVISATKWPNRPDY

SEQ ID NO: 13787 - protein, 10 aa, Homo sapiens
  light chain complementarity determining region 3 for antibody 6894
QQYNFYSTLT

SEQ ID NO: 13788 - protein, 16 aa, Homo sapiens
  heavy chain complementarity determining region 3 for antibody 6894
GRQVISATKWPNHLDY

SEQ ID NO: 13789 - protein, 10 aa, Homo sapiens
  light chain complementarity determining region 3 for antibody 6895
QQYNFYSTLT

SEQ ID NO: 13790 - protein, 16 aa, Homo sapiens
  heavy chain complementarity determining region 3 for antibody 6895
GRQVISATKWPKRLDY

SEQ ID NO: 13791 - protein, 10 aa, Homo sapiens
  light chain complementarity determining region 3 for antibody 6896
QQYNFYSTLT

SEQ ID NO: 13792 - protein, 16 aa, Homo sapiens
  heavy chain complementarity determining region 3 for antibody 6896
GRQVISANKWPNRLDY

SEQ ID NO: 13793 - protein, 10 aa, Homo sapiens
  light chain complementarity determining region 3 for antibody 6897
QQYNFYSTLT

SEQ ID NO: 13794 - protein, 16 aa, Homo sapiens
  heavy chain complementarity determining region 3 for antibody 6897
GRQGISATKWPNRLDY

SEQ ID NO: 13795 - protein, 10 aa, Homo sapiens
  light chain complementarity determining region 3 for antibody 6898
QQYNFYSTLP

SEQ ID NO: 13796 - protein, 16 aa, Homo sapiens
  heavy chain complementarity determining region 3 for antibody 6898
GRQVVSGTKWPNRLDY

SEQ ID NO: 13797 - protein, 10 aa, Homo sapiens
  light chain complementarity determining region 3 for antibody 6899
QQYNFYSTLP

SEQ ID NO: 13798 - protein, 16 aa, Homo sapiens
  heavy chain complementarity determining region 3 for antibody 6899
GRQVISGTKWPNRLDY

SEQ ID NO: 13799 - protein, 10 aa, Homo sapiens
  light chain complementarity determining region 3 for antibody 6900
QQYNFYSTLN

SEQ ID NO: 13800 - protein, 16 aa, Homo sapiens
  heavy chain complementarity determining region 3 for antibody 6900
GRQVISATKWPNRLDY

SEQ ID NO: 13801 - protein, 9 aa, Homo sapiens
  light chain complementarity determining region 3 for antibody 6901
QQYNFFPWT

SEQ ID NO: 13802 - protein, 15 aa, Homo sapiens
  heavy chain complementarity determining region 3 for antibody 6901
ARIRGEQQTGGPFDY

SEQ ID NO: 13803 - protein, 9 aa, Homo sapiens
  light chain complementarity determining region 3 for antibody 6902
QQYNDYPLT

SEQ ID NO: 13804 - protein, 13 aa, Homo sapiens
  heavy chain complementarity determining region 3 for antibody 6902
ARDGSSDWYELAY

SEQ ID NO: 13805 - protein, 9 aa, Homo sapiens
  light chain complementarity determining region 3 for antibody 6903
QQYNDWPWT

SEQ ID NO: 13806 - protein, 9 aa, Homo sapiens
  heavy chain complementarity determining region 3 for antibody 6903
AGRPDSLDM

SEQ ID NO: 13807 - protein, 11 aa, Homo sapiens
  light chain complementarity determining region 3 for antibody 6904
QQYNDWPPTLT

SEQ ID NO: 13808 - protein, 16 aa, Homo sapiens
  heavy chain complementarity determining region 3 for antibody 6904
AKVVIGSLGIEDFRDY

SEQ ID NO: 13809 - protein, 9 aa, Homo sapiens
  light chain complementarity determining region 3 for antibody 6905
QQYNDWHRT

SEQ ID NO: 13810 - protein, 17 aa, Homo sapiens
  heavy chain complementarity determining region 3 for antibody 6905
ARDLPSRCSRTSCAFDY

SEQ ID NO: 13811 - protein, 9 aa, Homo sapiens
  light chain complementarity determining region 3 for antibody 6906
QQYLTYPLT

SEQ ID NO: 13812 - protein, 10 aa, Homo sapiens
  heavy chain complementarity determining region 3 for antibody 6906
CRDREGFGDV

SEQ ID NO: 13813 - protein, 9 aa, Homo sapiens
  light chain complementarity determining region 3 for antibody 6907
QQYLTYPLT

SEQ ID NO: 13814 - protein, 9 aa, Homo sapiens
  heavy chain complementarity determining region 3 for antibody 6907
ARSEYQPTY

SEQ ID NO: 13815 - protein, 9 aa, Homo sapiens
  light chain complementarity determining region 3 for antibody 6908
QQYLTYPLT

SEQ ID NO: 13816 - protein, 18 aa, Homo sapiens
  heavy chain complementarity determining region 3 for antibody 6908
ARGSYCDSSSWCHYGFDI

SEQ ID NO: 13817 - protein, 9 aa, Homo sapiens
  light chain complementarity determining region 3 for antibody 6909
QQYLSIPLT

SEQ ID NO: 13818 - protein, 17 aa, Homo sapiens
  heavy chain complementarity determining region 3 for antibody 6909
ARNTMVHGWQRQGSVDH

SEQ ID NO: 13819 - protein, 8 aa, Homo sapiens
  light chain complementarity determining region 3 for antibody 6910
QQYLNHFT

SEQ ID NO: 13820 - protein, 11 aa, Homo sapiens
  heavy chain complementarity determining region 3 for antibody 6910
ARDRGGGALDH

SEQ ID NO: 13821 - protein, 9 aa, Homo sapiens
  light chain complementarity determining region 3 for antibody 6911
QQYLKYPFT

SEQ ID NO: 13822 - protein, 11 aa, Homo sapiens
  heavy chain complementarity determining region 3 for antibody 6911
RRGSGMVPFDY

SEQ ID NO: 13823 - protein, 9 aa, Homo sapiens
  light chain complementarity determining region 3 for antibody 6912
QQYLKYPFT

SEQ ID NO: 13824 - protein, 13 aa, Homo sapiens
  heavy chain complementarity determining region 3 for antibody 6912
AKGGSSPGPDFDY

SEQ ID NO: 13825 - protein, 9 aa, Homo sapiens
  light chain complementarity determining region 3 for antibody 6913
QQYKTYPWT

SEQ ID NO: 13826 - protein, 14 aa, Homo sapiens
  heavy chain complementarity determining region 3 for antibody 6913
AREEGSGWYRTSDF

SEQ ID NO: 13827 - protein, 7 aa, Homo sapiens
  light chain complementarity determining region 3 for antibody 6914
QQYKTWT

SEQ ID NO: 13828 - protein, 12 aa, Homo sapiens
  heavy chain complementarity determining region 3 for antibody 6914
ARDKGGRNGMDV

SEQ ID NO: 13829 - protein, 9 aa, Homo sapiens
  light chain complementarity determining region 3 for antibody 6915
QQYKTVPWT

SEQ ID NO: 13830 - protein, 14 aa, Homo sapiens
  heavy chain complementarity determining region 3 for antibody 6915
ARGHFDSTGFRLDY

SEQ ID NO: 13831 - protein, 9 aa, Homo sapiens
  light chain complementarity determining region 3 for antibody 6916
QQYKTVPWP

SEQ ID NO: 13832 - protein, 20 aa, Homo sapiens
  heavy chain complementarity determining region 3 for antibody 6916
AKDGRGTADYHSAGGGGLDV

SEQ ID NO: 13833 - protein, 9 aa, Homo sapiens
  light chain complementarity determining region 3 for antibody 6917
QQYKTAPWT

SEQ ID NO: 13834 - protein, 20 aa, Homo sapiens
  heavy chain complementarity determining region 3 for antibody 6917
TSDARGSISYAYGGGGGLDV

SEQ ID NO: 13835 - protein, 9 aa, Homo sapiens
  light chain complementarity determining region 3 for antibody 6918
QQYKTAPWT

SEQ ID NO: 13836 - protein, 20 aa, Homo sapiens
  heavy chain complementarity determining region 3 for antibody 6918
TREARGSISYAYGGGGGLDV

SEQ ID NO: 13837 - protein, 9 aa, Homo sapiens
  light chain complementarity determining region 3 for antibody 6919
QQYKTAPWT

SEQ ID NO: 13838 - protein, 20 aa, Homo sapiens
  heavy chain complementarity determining region 3 for antibody 6919
TRDARGSSYYADGGGGGMDV

SEQ ID NO: 13839 - protein, 9 aa, Homo sapiens
  light chain complementarity determining region 3 for antibody 6920
QQYKTAPWT

SEQ ID NO: 13840 - protein, 20 aa, Homo sapiens
  heavy chain complementarity determining region 3 for antibody 6920
TRDARGSISYAYGGGGGLDA

SEQ ID NO: 13841 - protein, 9 aa, Homo sapiens
  light chain complementarity determining region 3 for antibody 6921
QQYKTAPWT

SEQ ID NO: 13842 - protein, 20 aa, Homo sapiens
  heavy chain complementarity determining region 3 for antibody 6921
TRDARGSISYAYGGCGGLDV

SEQ ID NO: 13843 - protein, 9 aa, Homo sapiens
  light chain complementarity determining region 3 for antibody 6922
QQYKTAPWT

SEQ ID NO: 13844 - protein, 20 aa, Homo sapiens
  heavy chain complementarity determining region 3 for antibody 6922
TRDARGSISYADGGGGGLDV

SEQ ID NO: 13845 - protein, 9 aa, Homo sapiens
  light chain complementarity determining region 3 for antibody 6923
QQYKTAPWT

SEQ ID NO: 13846 - protein, 20 aa, Homo sapiens
  heavy chain complementarity determining region 3 for antibody 6923
TRDARGSISDAYGGGGGLDV

SEQ ID NO: 13847 - protein, 9 aa, Homo sapiens
  light chain complementarity determining region 3 for antibody 6924
QQYKTAPWT

SEQ ID NO: 13848 - protein, 20 aa, Homo sapiens
  heavy chain complementarity determining region 3 for antibody 6924
TRDAGGSISYAYGGGGGLDV

SEQ ID NO: 13849 - protein, 9 aa, Homo sapiens
  light chain complementarity determining region 3 for antibody 6925
QQYKTAPWT

SEQ ID NO: 13850 - protein, 20 aa, Homo sapiens
  heavy chain complementarity determining region 3 for antibody 6925
ARDARGSISYAYGGGGGLDV

SEQ ID NO: 13851 - protein, 9 aa, Homo sapiens
  light chain complementarity determining region 3 for antibody 6926
QQYKTAPWT

SEQ ID NO: 13852 - protein, 13 aa, Homo sapiens
  heavy chain complementarity determining region 3 for antibody 6926
AKEGSSPGPDFEY

SEQ ID NO: 13853 - protein, 9 aa, Homo sapiens
  light chain complementarity determining region 3 for antibody 6927
QQYKTAPWA

SEQ ID NO: 13854 - protein, 20 aa, Homo sapiens
  heavy chain complementarity determining region 3 for antibody 6927
TRDARGSISYAYGGGGGLDV

SEQ ID NO: 13855 - protein, 9 aa, Homo sapiens
  light chain complementarity determining region 3 for antibody 6928
QQYKTAPGT

SEQ ID NO: 13856 - protein, 20 aa, Homo sapiens
  heavy chain complementarity determining region 3 for antibody 6928
TRDARGSISYAYGGGGGLDV

SEQ ID NO: 13857 - protein, 8 aa, Homo sapiens
  light chain complementarity determining region 3 for antibody 6929
QQYKSYWT

SEQ ID NO: 13858 - protein, 10 aa, Homo sapiens
  heavy chain complementarity determining region 3 for antibody 6929
TRERSGSYDI

SEQ ID NO: 13859 - protein, 8 aa, Homo sapiens
  light chain complementarity determining region 3 for antibody 6930
QQYKSYWT

SEQ ID NO: 13860 - protein, 10 aa, Homo sapiens
  heavy chain complementarity determining region 3 for antibody 6930
ASERSGSYDI

SEQ ID NO: 13861 - protein, 8 aa, Homo sapiens
  light chain complementarity determining region 3 for antibody 6931
QQYKSYWT

SEQ ID NO: 13862 - protein, 11 aa, Homo sapiens
  heavy chain complementarity determining region 3 for antibody 6931
ARRSLGGAFDY

SEQ ID NO: 13863 - protein, 8 aa, Homo sapiens
  light chain complementarity determining region 3 for antibody 6932
QQYKSYWT

SEQ ID NO: 13864 - protein, 17 aa, Homo sapiens
  heavy chain complementarity determining region 3 for antibody 6932
ARNTMVGTWQRQGNLDH

SEQ ID NO: 13865 - protein, 8 aa, Homo sapiens
  light chain complementarity determining region 3 for antibody 6933
QQYKSYWT

SEQ ID NO: 13866 - protein, 14 aa, Homo sapiens
  heavy chain complementarity determining region 3 for antibody 6933
ARLHGSGLGRWLDP

SEQ ID NO: 13867 - protein, 8 aa, Homo sapiens
  light chain complementarity determining region 3 for antibody 6934
QQYKSYWT

SEQ ID NO: 13868 - protein, 10 aa, Homo sapiens
  heavy chain complementarity determining region 3 for antibody 6934
ARERSGYYDI

SEQ ID NO: 13869 - protein, 8 aa, Homo sapiens
  light chain complementarity determining region 3 for antibody 6935
QQYKSYWT

SEQ ID NO: 13870 - protein, 10 aa, Homo sapiens
  heavy chain complementarity determining region 3 for antibody 6935
ARERSGSYDV

SEQ ID NO: 13871 - protein, 8 aa, Homo sapiens
  light chain complementarity determining region 3 for antibody 6936
QQYKSYWT

SEQ ID NO: 13872 - protein, 10 aa, Homo sapiens
  heavy chain complementarity determining region 3 for antibody 6936
ARERSGSDDI

SEQ ID NO: 13873 - protein, 8 aa, Homo sapiens
  light chain complementarity determining region 3 for antibody 6937
QQYKSYWT

SEQ ID NO: 13874 - protein, 12 aa, Homo sapiens
  heavy chain complementarity determining region 3 for antibody 6937
ARDKGGRNGMDV

SEQ ID NO: 13875 - protein, 8 aa, Homo sapiens
  light chain complementarity determining region 3 for antibody 6938
QQYKSYWT

SEQ ID NO: 13876 - protein, 10 aa, Homo sapiens
  heavy chain complementarity determining region 3 for antibody 6938
AMERSGSYDI

SEQ ID NO: 13877 - protein, 8 aa, Homo sapiens
  light chain complementarity determining region 3 for antibody 6939
QQYKSYWT

SEQ ID NO: 13878 - protein, 12 aa, Homo sapiens
  heavy chain complementarity determining region 3 for antibody 6939
AIVVPGRWDLDD

SEQ ID NO: 13879 - protein, 9 aa, Homo sapiens
  light chain complementarity determining region 3 for antibody 6940
QQYKSYSRT

SEQ ID NO: 13880 - protein, 17 aa, Homo sapiens
  heavy chain complementarity determining region 3 for antibody 6940
AKSLGSCRSSTCEIFDA

SEQ ID NO: 13881 - protein, 9 aa, Homo sapiens
  light chain complementarity determining region 3 for antibody 6941
QQYKSYSHT

SEQ ID NO: 13882 - protein, 14 aa, Homo sapiens
  heavy chain complementarity determining region 3 for antibody 6941
GRDVHTTGWTLGGY

SEQ ID NO: 13883 - protein, 9 aa, Homo sapiens
  light chain complementarity determining region 3 for antibody 6942
QQYKSYPYT

SEQ ID NO: 13884 - protein, 9 aa, Homo sapiens
  heavy chain complementarity determining region 3 for antibody 6942
ARCWTYGRK

SEQ ID NO: 13885 - protein, 7 aa, Homo sapiens
  light chain complementarity determining region 3 for antibody 6943
QQYKSWT

SEQ ID NO: 13886 - protein, 12 aa, Homo sapiens
  heavy chain complementarity determining region 3 for antibody 6943
VKDSGGRSGMDV

SEQ ID NO: 13887 - protein, 7 aa, Homo sapiens
  light chain complementarity determining region 3 for antibody 6944
QQYKSWT

SEQ ID NO: 13888 - protein, 12 aa, Homo sapiens
  heavy chain complementarity determining region 3 for antibody 6944
VKDRGGRSGMVV

SEQ ID NO: 13889 - protein, 7 aa, Homo sapiens
  light chain complementarity determining region 3 for antibody 6945
QQYKSWT

SEQ ID NO: 13890 - protein, 12 aa, Homo sapiens
  heavy chain complementarity determining region 3 for antibody 6945
VKDRGGRSGIDV

SEQ ID NO: 13891 - protein, 7 aa, Homo sapiens
  light chain complementarity determining region 3 for antibody 6946
QQYKSWT

SEQ ID NO: 13892 - protein, 12 aa, Homo sapiens
  heavy chain complementarity determining region 3 for antibody 6946
VKDRGGRRGMDV

SEQ ID NO: 13893 - protein, 7 aa, Homo sapiens
  light chain complementarity determining region 3 for antibody 6947
QQYKSWT

SEQ ID NO: 13894 - protein, 14 aa, Homo sapiens
  heavy chain complementarity determining region 3 for antibody 6947
ARGHFDSTGFRLDY

SEQ ID NO: 13895 - protein, 7 aa, Homo sapiens
  light chain complementarity determining region 3 for antibody 6948
QQYKSWT

SEQ ID NO: 13896 - protein, 12 aa, Homo sapiens
  heavy chain complementarity determining region 3 for antibody 6948
ARDKGGRNGMDV

SEQ ID NO: 13897 - protein, 8 aa, Homo sapiens
  light chain complementarity determining region 3 for antibody 6949
QQYKSWRT

SEQ ID NO: 13898 - protein, 11 aa, Homo sapiens
  heavy chain complementarity determining region 3 for antibody 6949
ARDLYGGAHHT

SEQ ID NO: 13899 - protein, 8 aa, Homo sapiens
  light chain complementarity determining region 3 for antibody 6950
QQYKSHWT

SEQ ID NO: 13900 - protein, 10 aa, Homo sapiens
  heavy chain complementarity determining region 3 for antibody 6950
ARERSGSYDI

SEQ ID NO: 13901 - protein, 10 aa, Homo sapiens
  light chain complementarity determining region 3 for antibody 6951
QQYKNWPPYT

SEQ ID NO: 13902 - protein, 14 aa, Homo sapiens
  heavy chain complementarity determining region 3 for antibody 6951
ARENCYGTGSCSDI

SEQ ID NO: 13903 - protein, 10 aa, Homo sapiens
  light chain complementarity determining region 3 for antibody 6952
QQYKNWPPYP

SEQ ID NO: 13904 - protein, 14 aa, Homo sapiens
  heavy chain complementarity determining region 3 for antibody 6952
ARENCYGTGSCFDI

SEQ ID NO: 13905 - protein, 10 aa, Homo sapiens
  light chain complementarity determining region 3 for antibody 6953
QQYKNWHPYT

SEQ ID NO: 13906 - protein, 14 aa, Homo sapiens
  heavy chain complementarity determining region 3 for antibody 6953
ARENCYGTGSCFDI

SEQ ID NO: 13907 - protein, 9 aa, Homo sapiens
  light chain complementarity determining region 3 for antibody 6954
QQYKIYPWT

SEQ ID NO: 13908 - protein, 11 aa, Homo sapiens
  heavy chain complementarity determining region 3 for antibody 6954
VRVSTGWNFDY

SEQ ID NO: 13909 - protein, 9 aa, Homo sapiens
  light chain complementarity determining region 3 for antibody 6955
QQYKIYPWT

SEQ ID NO: 13910 - protein, 16 aa, Homo sapiens
  heavy chain complementarity determining region 3 for antibody 6955
VGPHLTYNSGWRYFDY

SEQ ID NO: 13911 - protein, 9 aa, Homo sapiens
  light chain complementarity determining region 3 for antibody 6956
QQYKIYPWT

SEQ ID NO: 13912 - protein, 13 aa, Homo sapiens
  heavy chain complementarity determining region 3 for antibody 6956
DKEGSSPGPDFDY

SEQ ID NO: 13913 - protein, 9 aa, Homo sapiens
  light chain complementarity determining region 3 for antibody 6957
QQYKIYPWT

SEQ ID NO: 13914 - protein, 14 aa, Homo sapiens
  heavy chain complementarity determining region 3 for antibody 6957
ARGHFDSTGFRLDY

SEQ ID NO: 13915 - protein, 9 aa, Homo sapiens
  light chain complementarity determining region 3 for antibody 6958
QQYKIYPWT

SEQ ID NO: 13916 - protein, 9 aa, Homo sapiens
  heavy chain complementarity determining region 3 for antibody 6958
ARFWTYGRK

SEQ ID NO: 13917 - protein, 9 aa, Homo sapiens
  light chain complementarity determining region 3 for antibody 6959
QQYKIYPWT

SEQ ID NO: 13918 - protein, 13 aa, Homo sapiens
  heavy chain complementarity determining region 3 for antibody 6959
AKEGYSPGPDFDY

SEQ ID NO: 13919 - protein, 9 aa, Homo sapiens
  light chain complementarity determining region 3 for antibody 6960
QQYKIYPWT

SEQ ID NO: 13920 - protein, 13 aa, Homo sapiens
  heavy chain complementarity determining region 3 for antibody 6960
AKEGSSPGSDFDY

SEQ ID NO: 13921 - protein, 9 aa, Homo sapiens
  light chain complementarity determining region 3 for antibody 6961
QQYKIYPWT

SEQ ID NO: 13922 - protein, 13 aa, Homo sapiens
  heavy chain complementarity determining region 3 for antibody 6961
AKEGSSPGPAFDY

SEQ ID NO: 13923 - protein, 9 aa, Homo sapiens
  light chain complementarity determining region 3 for antibody 6962
QQYKIYPWT

SEQ ID NO: 13924 - protein, 13 aa, Homo sapiens
  heavy chain complementarity determining region 3 for antibody 6962
AKEGSAPGPDFEY

SEQ ID NO: 13925 - protein, 9 aa, Homo sapiens
  light chain complementarity determining region 3 for antibody 6963
QQYKIYPWT

SEQ ID NO: 13926 - protein, 9 aa, Homo sapiens
  heavy chain complementarity determining region 3 for antibody 6963
AGWGGLSNY

SEQ ID NO: 13927 - protein, 9 aa, Homo sapiens
  light chain complementarity determining region 3 for antibody 6964
QQYKIYPWT

SEQ ID NO: 13928 - protein, 12 aa, Homo sapiens
  heavy chain complementarity determining region 3 for antibody 6964
ACSRSWGGSIDY

SEQ ID NO: 13929 - protein, 9 aa, Homo sapiens
  light chain complementarity determining region 3 for antibody 6965
QQYKIYPRT

SEQ ID NO: 13930 - protein, 13 aa, Homo sapiens
  heavy chain complementarity determining region 3 for antibody 6965
AKEGSSPGPDFDY

SEQ ID NO: 13931 - protein, 9 aa, Homo sapiens
  light chain complementarity determining region 3 for antibody 6966
QQYKHVPWT

SEQ ID NO: 13932 - protein, 10 aa, Homo sapiens
  heavy chain complementarity determining region 3 for antibody 6966
ARERSGSYDI

SEQ ID NO: 13933 - protein, 9 aa, Homo sapiens
  light chain complementarity determining region 3 for antibody 6967
QQYKDAPWT

SEQ ID NO: 13934 - protein, 20 aa, Homo sapiens
  heavy chain complementarity determining region 3 for antibody 6967
TRGARGSSSYAYGGGGGLDV

SEQ ID NO: 13935 - protein, 9 aa, Homo sapiens
  light chain complementarity determining region 3 for antibody 6968
QQYKDAPWT

SEQ ID NO: 13936 - protein, 20 aa, Homo sapiens
  heavy chain complementarity determining region 3 for antibody 6968
SRDARGSSSYAYGGGGGLDV

SEQ ID NO: 13937 - protein, 9 aa, Homo sapiens
  light chain complementarity determining region 3 for antibody 6969
QQYKDAPWT

SEQ ID NO: 13938 - protein, 12 aa, Homo sapiens
  heavy chain complementarity determining region 3 for antibody 6969
ARLDWNYRAFDI

SEQ ID NO: 13939 - protein, 9 aa, Homo sapiens
  light chain complementarity determining region 3 for antibody 6970
QQYKDAPWT

SEQ ID NO: 13940 - protein, 20 aa, Homo sapiens
  heavy chain complementarity determining region 3 for antibody 6970
ARDARGSSSYAYGGGGGLDV

SEQ ID NO: 13941 - protein, 9 aa, Homo sapiens
  light chain complementarity determining region 3 for antibody 6971
QQYKDAPWK

SEQ ID NO: 13942 - protein, 20 aa, Homo sapiens
  heavy chain complementarity determining region 3 for antibody 6971
TRDARGSSSYAYGGGGGLDV

SEQ ID NO: 13943 - protein, 9 aa, Homo sapiens
  light chain complementarity determining region 3 for antibody 6972
QQYKDAPRT

SEQ ID NO: 13944 - protein, 20 aa, Homo sapiens
  heavy chain complementarity determining region 3 for antibody 6972
TRDARGSSSYAYGGGGGLDV

SEQ ID NO: 13945 - protein, 9 aa, Homo sapiens
  light chain complementarity determining region 3 for antibody 6973
QQYITYPLT

SEQ ID NO: 13946 - protein, 18 aa, Homo sapiens
  heavy chain complementarity determining region 3 for antibody 6973
ARGSYCDSSSWCPYGFDI

SEQ ID NO: 13947 - protein, 7 aa, Homo sapiens
  light chain complementarity determining region 3 for antibody 6974
QQYITWT

SEQ ID NO: 13948 - protein, 12 aa, Homo sapiens
  heavy chain complementarity determining region 3 for antibody 6974
ARDKGGRNGMDV

SEQ ID NO: 13949 - protein, 9 aa, Homo sapiens
  light chain complementarity determining region 3 for antibody 6975
QQYISYPWT

SEQ ID NO: 13950 - protein, 15 aa, Homo sapiens
  heavy chain complementarity determining region 3 for antibody 6975
GKEGPGSSGWLTGHY

SEQ ID NO: 13951 - protein, 9 aa, Homo sapiens
  light chain complementarity determining region 3 for antibody 6976
QQYHYWPGT

SEQ ID NO: 13952 - protein, 11 aa, Homo sapiens
  heavy chain complementarity determining region 3 for antibody 6976
AKGGFYFLTGD

SEQ ID NO: 13953 - protein, 7 aa, Homo sapiens
  light chain complementarity determining region 3 for antibody 6977
QQYHTWT

SEQ ID NO: 13954 - protein, 12 aa, Homo sapiens
  heavy chain complementarity determining region 3 for antibody 6977
ARDKGGRNGMDV

SEQ ID NO: 13955 - protein, 9 aa, Homo sapiens
  light chain complementarity determining region 3 for antibody 6978
QQYHTPLRT

SEQ ID NO: 13956 - protein, 19 aa, Homo sapiens
  heavy chain complementarity determining region 3 for antibody 6978
VRARSDCSSAGCFEGFFDS

SEQ ID NO: 13957 - protein, 9 aa, Homo sapiens
  light chain complementarity determining region 3 for antibody 6979
QQYHTHLRT

SEQ ID NO: 13958 - protein, 19 aa, Homo sapiens
  heavy chain complementarity determining region 3 for antibody 6979
VRARSDCSSAGCFEGFFDS

SEQ ID NO: 13959 - protein, 10 aa, Homo sapiens
  light chain complementarity determining region 3 for antibody 6980
QQYHSYSPLT

SEQ ID NO: 13960 - protein, 16 aa, Homo sapiens
  heavy chain complementarity determining region 3 for antibody 6980
ARWFSRSSTGGSYMDV

SEQ ID NO: 13961 - protein, 10 aa, Homo sapiens
  light chain complementarity determining region 3 for antibody 6981
QQYHSYSPLT

SEQ ID NO: 13962 - protein, 16 aa, Homo sapiens
  heavy chain complementarity determining region 3 for antibody 6981
AGWFSRSSTGVSYMDV

SEQ ID NO: 13963 - protein, 8 aa, Homo sapiens
  light chain complementarity determining region 3 for antibody 6982
QQYHSYSD

SEQ ID NO: 13964 - protein, 12 aa, Homo sapiens
  heavy chain complementarity determining region 3 for antibody 6982
LHGSRTICFYTF

SEQ ID NO: 13965 - protein, 8 aa, Homo sapiens
  light chain complementarity determining region 3 for antibody 6983
QQYHSYSD

SEQ ID NO: 13966 - protein, 12 aa, Homo sapiens
  heavy chain complementarity determining region 3 for antibody 6983
LHCSRTICFYTV

SEQ ID NO: 13967 - protein, 9 aa, Homo sapiens
  light chain complementarity determining region 3 for antibody 6984
QQYHSYPWT

SEQ ID NO: 13968 - protein, 11 aa, Homo sapiens
  heavy chain complementarity determining region 3 for antibody 6984
ARIVARKPDDY

SEQ ID NO: 13969 - protein, 9 aa, Homo sapiens
  light chain complementarity determining region 3 for antibody 6985
QQYHSYPPT

SEQ ID NO: 13970 - protein, 13 aa, Homo sapiens
  heavy chain complementarity determining region 3 for antibody 6985
AKEGSSPGPDFEY

SEQ ID NO: 13971 - protein, 9 aa, Homo sapiens
  light chain complementarity determining region 3 for antibody 6986
QQYHSTPWT

SEQ ID NO: 13972 - protein, 11 aa, Homo sapiens
  heavy chain complementarity determining region 3 for antibody 6986
ATGKDNARTGY

SEQ ID NO: 13973 - protein, 9 aa, Homo sapiens
  light chain complementarity determining region 3 for antibody 6987
QQYHRYYHT

SEQ ID NO: 13974 - protein, 14 aa, Homo sapiens
  heavy chain complementarity determining region 3 for antibody 6987
GRDVHTTGWTLGGY

SEQ ID NO: 13975 - protein, 9 aa, Homo sapiens
  light chain complementarity determining region 3 for antibody 6988
QQYHRYSPT

SEQ ID NO: 13976 - protein, 14 aa, Homo sapiens
  heavy chain complementarity determining region 3 for antibody 6988
GRDVHTTGWTLGGY

SEQ ID NO: 13977 - protein, 9 aa, Homo sapiens
  light chain complementarity determining region 3 for antibody 6989
QQYHRYSNT

SEQ ID NO: 13978 - protein, 14 aa, Homo sapiens
  heavy chain complementarity determining region 3 for antibody 6989
GRDVHTTGWTLGGY

SEQ ID NO: 13979 - protein, 9 aa, Homo sapiens
  light chain complementarity determining region 3 for antibody 6990
QQYHRYSHT

SEQ ID NO: 13980 - protein, 14 aa, Homo sapiens
  heavy chain complementarity determining region 3 for antibody 6990
SRDVHTTGWTLGGY

SEQ ID NO: 13981 - protein, 9 aa, Homo sapiens
  light chain complementarity determining region 3 for antibody 6991
QQYHRYSHT

SEQ ID NO: 13982 - protein, 14 aa, Homo sapiens
  heavy chain complementarity determining region 3 for antibody 6991
GRDVRTTGWTLGGY

SEQ ID NO: 13983 - protein, 9 aa, Homo sapiens
  light chain complementarity determining region 3 for antibody 6992
QQYHRYSHT

SEQ ID NO: 13984 - protein, 14 aa, Homo sapiens
  heavy chain complementarity determining region 3 for antibody 6992
GRDVQTTGWTLGGY

SEQ ID NO: 13985 - protein, 9 aa, Homo sapiens
  light chain complementarity determining region 3 for antibody 6993
QQYHRYSHT

SEQ ID NO: 13986 - protein, 14 aa, Homo sapiens
  heavy chain complementarity determining region 3 for antibody 6993
GRDVHTTGWTLVGY

SEQ ID NO: 13987 - protein, 9 aa, Homo sapiens
  light chain complementarity determining region 3 for antibody 6994
QQYHRYSHT

SEQ ID NO: 13988 - protein, 14 aa, Homo sapiens
  heavy chain complementarity determining region 3 for antibody 6994
GRDVHTTGWTLGGS

SEQ ID NO: 13989 - protein, 9 aa, Homo sapiens
  light chain complementarity determining region 3 for antibody 6995
QQYHRYSHT

SEQ ID NO: 13990 - protein, 14 aa, Homo sapiens
  heavy chain complementarity determining region 3 for antibody 6995
GRDVHTTGLTLGGY

SEQ ID NO: 13991 - protein, 9 aa, Homo sapiens
  light chain complementarity determining region 3 for antibody 6996
QQYHRYSHT

SEQ ID NO: 13992 - protein, 14 aa, Homo sapiens
  heavy chain complementarity determining region 3 for antibody 6996
GRDVHATGWTLGGY

SEQ ID NO: 13993 - protein, 9 aa, Homo sapiens
  light chain complementarity determining region 3 for antibody 6997
QQYHRYSHP

SEQ ID NO: 13994 - protein, 14 aa, Homo sapiens
  heavy chain complementarity determining region 3 for antibody 6997
GRDVHTTGWTLGGY

SEQ ID NO: 13995 - protein, 9 aa, Homo sapiens
  light chain complementarity determining region 3 for antibody 6998
QQYHRYPPT

SEQ ID NO: 13996 - protein, 14 aa, Homo sapiens
  heavy chain complementarity determining region 3 for antibody 6998
ARDVHTTGWTLGGY

SEQ ID NO: 13997 - protein, 9 aa, Homo sapiens
  light chain complementarity determining region 3 for antibody 6999
QQYHRYPHT

SEQ ID NO: 13998 - protein, 16 aa, Homo sapiens
  heavy chain complementarity determining region 3 for antibody 6999
VGPHLTYNSGWRYFDY

SEQ ID NO: 13999 - protein, 9 aa, Homo sapiens
  light chain complementarity determining region 3 for antibody 7000
QQYHRYPHT

SEQ ID NO: 14000 - protein, 14 aa, Homo sapiens
  heavy chain complementarity determining region 3 for antibody 7000
ARDVHTTGWTLVGY

SEQ ID NO: 14001 - protein, 9 aa, Homo sapiens
  light chain complementarity determining region 3 for antibody 7001
QQYHRYPHT

SEQ ID NO: 14002 - protein, 14 aa, Homo sapiens
  heavy chain complementarity determining region 3 for antibody 7001
ARDVHTTGWRLGGY

SEQ ID NO: 14003 - protein, 9 aa, Homo sapiens
  light chain complementarity determining region 3 for antibody 7002
QQYHRSSHT

SEQ ID NO: 14004 - protein, 14 aa, Homo sapiens
  heavy chain complementarity determining region 3 for antibody 7002
GRDVHTTGWTLGGY

SEQ ID NO: 14005 - protein, 10 aa, Homo sapiens
  light chain complementarity determining region 3 for antibody 7003
QQYHNWPPLT

SEQ ID NO: 14006 - protein, 16 aa, Homo sapiens
  heavy chain complementarity determining region 3 for antibody 7003
VKDGWKQVWLRGSFDV

SEQ ID NO: 14007 - protein, 9 aa, Homo sapiens
  light chain complementarity determining region 3 for antibody 7004
QQYHNWPGT

SEQ ID NO: 14008 - protein, 17 aa, Homo sapiens
  heavy chain complementarity determining region 3 for antibody 7004
VTHYYHDSGIYHDFFNY

SEQ ID NO: 14009 - protein, 9 aa, Homo sapiens
  light chain complementarity determining region 3 for antibody 7005
QQYHNWPGT

SEQ ID NO: 14010 - protein, 16 aa, Homo sapiens
  heavy chain complementarity determining region 3 for antibody 7005
VGPHLTYNSGWRYFDY

SEQ ID NO: 14011 - protein, 9 aa, Homo sapiens
  light chain complementarity determining region 3 for antibody 7006
QQYHNWPGT

SEQ ID NO: 14012 - protein, 13 aa, Homo sapiens
  heavy chain complementarity determining region 3 for antibody 7006
TKEGSSAGPDFVY

SEQ ID NO: 14013 - protein, 9 aa, Homo sapiens
  light chain complementarity determining region 3 for antibody 7007
QQYHNWPGT

SEQ ID NO: 14014 - protein, 11 aa, Homo sapiens
  heavy chain complementarity determining region 3 for antibody 7007
ATGGFYFLTGD

SEQ ID NO: 14015 - protein, 9 aa, Homo sapiens
  light chain complementarity determining region 3 for antibody 7008
QQYHNWPGT

SEQ ID NO: 14016 - protein, 11 aa, Homo sapiens
  heavy chain complementarity determining region 3 for antibody 7008
ATFGQQWRLAH

SEQ ID NO: 14017 - protein, 9 aa, Homo sapiens
  light chain complementarity determining region 3 for antibody 7009
QQYHNWPGT

SEQ ID NO: 14018 - protein, 14 aa, Homo sapiens
  heavy chain complementarity determining region 3 for antibody 7009
ARLHGSGLGRWLDP

SEQ ID NO: 14019 - protein, 9 aa, Homo sapiens
  light chain complementarity determining region 3 for antibody 7010
QQYHNWPGT

SEQ ID NO: 14020 - protein, 12 aa, Homo sapiens
  heavy chain complementarity determining region 3 for antibody 7010
ARLDWNYRAFDI

SEQ ID NO: 14021 - protein, 9 aa, Homo sapiens
  light chain complementarity determining region 3 for antibody 7011
QQYHNWPGT

SEQ ID NO: 14022 - protein, 11 aa, Homo sapiens
  heavy chain complementarity determining region 3 for antibody 7011
ARGGFYFLTGD

SEQ ID NO: 14023 - protein, 9 aa, Homo sapiens
  light chain complementarity determining region 3 for antibody 7012
QQYHNWPGT

SEQ ID NO: 14024 - protein, 11 aa, Homo sapiens
  heavy chain complementarity determining region 3 for antibody 7012
AREGWGSLLDY

SEQ ID NO: 14025 - protein, 9 aa, Homo sapiens
  light chain complementarity determining region 3 for antibody 7013
QQYHNWPGT

SEQ ID NO: 14026 - protein, 11 aa, Homo sapiens
  heavy chain complementarity determining region 3 for antibody 7013
AKGSFYFLTGD

SEQ ID NO: 14027 - protein, 9 aa, Homo sapiens
  light chain complementarity determining region 3 for antibody 7014
QQYHNWPGT

SEQ ID NO: 14028 - protein, 11 aa, Homo sapiens
  heavy chain complementarity determining region 3 for antibody 7014
AKGGLYFLTGD

SEQ ID NO: 14029 - protein, 9 aa, Homo sapiens
  light chain complementarity determining region 3 for antibody 7015
QQYHNWPGT

SEQ ID NO: 14030 - protein, 11 aa, Homo sapiens
  heavy chain complementarity determining region 3 for antibody 7015
AKGGFYFLTGN

SEQ ID NO: 14031 - protein, 9 aa, Homo sapiens
  light chain complementarity determining region 3 for antibody 7016
QQYHNWPGT

SEQ ID NO: 14032 - protein, 11 aa, Homo sapiens
  heavy chain complementarity determining region 3 for antibody 7016
AKGGFYFLTGH

SEQ ID NO: 14033 - protein, 9 aa, Homo sapiens
  light chain complementarity determining region 3 for antibody 7017
QQYHNWPGT

SEQ ID NO: 14034 - protein, 11 aa, Homo sapiens
  heavy chain complementarity determining region 3 for antibody 7017
AKGGFSFLTGD

SEQ ID NO: 14035 - protein, 9 aa, Homo sapiens
  light chain complementarity determining region 3 for antibody 7018
QQYHNWPGT

SEQ ID NO: 14036 - protein, 11 aa, Homo sapiens
  heavy chain complementarity determining region 3 for antibody 7018
AKGGFCFLTGD

SEQ ID NO: 14037 - protein, 9 aa, Homo sapiens
  light chain complementarity determining region 3 for antibody 7019
QQYHNWPGT

SEQ ID NO: 14038 - protein, 13 aa, Homo sapiens
  heavy chain complementarity determining region 3 for antibody 7019
AKEGSSPGPDFDS

SEQ ID NO: 14039 - protein, 9 aa, Homo sapiens
  light chain complementarity determining region 3 for antibody 7020
QQYHNWPGT

SEQ ID NO: 14040 - protein, 20 aa, Homo sapiens
  heavy chain complementarity determining region 3 for antibody 7020
AKDGRGTAFYHGAGGGGLDV

SEQ ID NO: 14041 - protein, 9 aa, Homo sapiens
  light chain complementarity determining region 3 for antibody 7021
QQYHNWPGT

SEQ ID NO: 14042 - protein, 9 aa, Homo sapiens
  heavy chain complementarity determining region 3 for antibody 7021
AGWGGLSNY

SEQ ID NO: 14043 - protein, 9 aa, Homo sapiens
  light chain complementarity determining region 3 for antibody 7022
QQYHNWPGM

SEQ ID NO: 14044 - protein, 11 aa, Homo sapiens
  heavy chain complementarity determining region 3 for antibody 7022
AKGGFYFLTGD

SEQ ID NO: 14045 - protein, 10 aa, Homo sapiens
  light chain complementarity determining region 3 for antibody 7023
QQYHNLPPWT

SEQ ID NO: 14046 - protein, 18 aa, Homo sapiens
  heavy chain complementarity determining region 3 for antibody 7023
AKDTSGTPYDTSGYYYDY

SEQ ID NO: 14047 - protein, 10 aa, Homo sapiens
  light chain complementarity determining region 3 for antibody 7024
QQYHNLPPWP

SEQ ID NO: 14048 - protein, 18 aa, Homo sapiens
  heavy chain complementarity determining region 3 for antibody 7024
AKDTFGTPYDTSGYYYDY

SEQ ID NO: 14049 - protein, 10 aa, Homo sapiens
  light chain complementarity determining region 3 for antibody 7025
QQYHNLASLT

SEQ ID NO: 14050 - protein, 13 aa, Homo sapiens
  heavy chain complementarity determining region 3 for antibody 7025
AKEGSSPGPDFEY

SEQ ID NO: 14051 - protein, 8 aa, Homo sapiens
  light chain complementarity determining region 3 for antibody 7026
QQYHMYSD

SEQ ID NO: 14052 - protein, 14 aa, Homo sapiens
  heavy chain complementarity determining region 3 for antibody 7026
ARGHFDSTGFRLDY

SEQ ID NO: 14053 - protein, 7 aa, Homo sapiens
  light chain complementarity determining region 3 for antibody 7027
QQYHIGT

SEQ ID NO: 14054 - protein, 11 aa, Homo sapiens
  heavy chain complementarity determining region 3 for antibody 7027
VRVSTGWSFDY

SEQ ID NO: 14055 - protein, 9 aa, Homo sapiens
  light chain complementarity determining region 3 for antibody 7028
QQYHGYTWT

SEQ ID NO: 14056 - protein, 9 aa, Homo sapiens
  heavy chain complementarity determining region 3 for antibody 7028
AGWGGLSNY

SEQ ID NO: 14057 - protein, 9 aa, Homo sapiens
  light chain complementarity determining region 3 for antibody 7029
QQYHGYPWT

SEQ ID NO: 14058 - protein, 16 aa, Homo sapiens
  heavy chain complementarity determining region 3 for antibody 7029
VRDLAGFTRGGSTFDY

SEQ ID NO: 14059 - protein, 9 aa, Homo sapiens
  light chain complementarity determining region 3 for antibody 7030
QQYHGYPWT

SEQ ID NO: 14060 - protein, 16 aa, Homo sapiens
  heavy chain complementarity determining region 3 for antibody 7030
VGPHLTYNSGWRYFDY

SEQ ID NO: 14061 - protein, 9 aa, Homo sapiens
  light chain complementarity determining region 3 for antibody 7031
QQYHGYPWT

SEQ ID NO: 14062 - protein, 14 aa, Homo sapiens
  heavy chain complementarity determining region 3 for antibody 7031
TRGHFDSTGFRLDY

SEQ ID NO: 14063 - protein, 9 aa, Homo sapiens
  light chain complementarity determining region 3 for antibody 7032
QQYHGYPWT

SEQ ID NO: 14064 - protein, 12 aa, Homo sapiens
  heavy chain complementarity determining region 3 for antibody 7032
NADHGYVDGFDI

SEQ ID NO: 14065 - protein, 9 aa, Homo sapiens
  light chain complementarity determining region 3 for antibody 7033
QQYHGYPWT

SEQ ID NO: 14066 - protein, 9 aa, Homo sapiens
  heavy chain complementarity determining region 3 for antibody 7033
GSRRPYFDS

SEQ ID NO: 14067 - protein, 9 aa, Homo sapiens
  light chain complementarity determining region 3 for antibody 7034
QQYHGYPWT

SEQ ID NO: 14068 - protein, 14 aa, Homo sapiens
  heavy chain complementarity determining region 3 for antibody 7034
GRDTTHDWSDGGIY

SEQ ID NO: 14069 - protein, 9 aa, Homo sapiens
  light chain complementarity determining region 3 for antibody 7035
QQYHGYPWT

SEQ ID NO: 14070 - protein, 10 aa, Homo sapiens
  heavy chain complementarity determining region 3 for antibody 7035
CRDREGFGDV

SEQ ID NO: 14071 - protein, 9 aa, Homo sapiens
  light chain complementarity determining region 3 for antibody 7036
QQYHGYPWT

SEQ ID NO: 14072 - protein, 9 aa, Homo sapiens
  heavy chain complementarity determining region 3 for antibody 7036
ARSEYQPTY

SEQ ID NO: 14073 - protein, 9 aa, Homo sapiens
  light chain complementarity determining region 3 for antibody 7037
QQYHGYPWT

SEQ ID NO: 14074 - protein, 11 aa, Homo sapiens
  heavy chain complementarity determining region 3 for antibody 7037
ARIVSRKPDDY

SEQ ID NO: 14075 - protein, 9 aa, Homo sapiens
  light chain complementarity determining region 3 for antibody 7038
QQYHGYPWT

SEQ ID NO: 14076 - protein, 11 aa, Homo sapiens
  heavy chain complementarity determining region 3 for antibody 7038
ARIVARRPDDY

SEQ ID NO: 14077 - protein, 9 aa, Homo sapiens
  light chain complementarity determining region 3 for antibody 7039
QQYHGYPWT

SEQ ID NO: 14078 - protein, 11 aa, Homo sapiens
  heavy chain complementarity determining region 3 for antibody 7039
ARIVARQPDDY

SEQ ID NO: 14079 - protein, 9 aa, Homo sapiens
  light chain complementarity determining region 3 for antibody 7040
QQYHGYPWT

SEQ ID NO: 14080 - protein, 11 aa, Homo sapiens
  heavy chain complementarity determining region 3 for antibody 7040
ARIVARKPNDY

SEQ ID NO: 14081 - protein, 9 aa, Homo sapiens
  light chain complementarity determining region 3 for antibody 7041
QQYHGYPWT

SEQ ID NO: 14082 - protein, 11 aa, Homo sapiens
  heavy chain complementarity determining region 3 for antibody 7041
ARIVARKPHDY

SEQ ID NO: 14083 - protein, 9 aa, Homo sapiens
  light chain complementarity determining region 3 for antibody 7042
QQYHGYPWT

SEQ ID NO: 14084 - protein, 11 aa, Homo sapiens
  heavy chain complementarity determining region 3 for antibody 7042
ARIVARKPDDS

SEQ ID NO: 14085 - protein, 9 aa, Homo sapiens
  light chain complementarity determining region 3 for antibody 7043
QQYHGYPWT

SEQ ID NO: 14086 - protein, 11 aa, Homo sapiens
  heavy chain complementarity determining region 3 for antibody 7043
ARIGARKPDDY

SEQ ID NO: 14087 - protein, 9 aa, Homo sapiens
  light chain complementarity determining region 3 for antibody 7044
QQYHGYPWT

SEQ ID NO: 14088 - protein, 14 aa, Homo sapiens
  heavy chain complementarity determining region 3 for antibody 7044
ARGHFDSTGFRLDY

SEQ ID NO: 14089 - protein, 9 aa, Homo sapiens
  light chain complementarity determining region 3 for antibody 7045
QQYHGYPWT

SEQ ID NO: 14090 - protein, 10 aa, Homo sapiens
  heavy chain complementarity determining region 3 for antibody 7045
ARETSGAYDI

SEQ ID NO: 14091 - protein, 9 aa, Homo sapiens
  light chain complementarity determining region 3 for antibody 7046
QQYHGYPWT

SEQ ID NO: 14092 - protein, 12 aa, Homo sapiens
  heavy chain complementarity determining region 3 for antibody 7046
ARDKGGRNGMDV

SEQ ID NO: 14093 - protein, 9 aa, Homo sapiens
  light chain complementarity determining region 3 for antibody 7047
QQYHGYPWT

SEQ ID NO: 14094 - protein, 13 aa, Homo sapiens
  heavy chain complementarity determining region 3 for antibody 7047
AKEGSSPGPDFDS

SEQ ID NO: 14095 - protein, 9 aa, Homo sapiens
  light chain complementarity determining region 3 for antibody 7048
QQYHGYPWT

SEQ ID NO: 14096 - protein, 12 aa, Homo sapiens
  heavy chain complementarity determining region 3 for antibody 7048
AIVVPGRWDLDD

SEQ ID NO: 14097 - protein, 9 aa, Homo sapiens
  light chain complementarity determining region 3 for antibody 7049
QQYHGYPWT

SEQ ID NO: 14098 - protein, 9 aa, Homo sapiens
  heavy chain complementarity determining region 3 for antibody 7049
AGWGGVSNY

SEQ ID NO: 14099 - protein, 9 aa, Homo sapiens
  light chain complementarity determining region 3 for antibody 7050
QQYHGYPWT

SEQ ID NO: 14100 - protein, 9 aa, Homo sapiens
  heavy chain complementarity determining region 3 for antibody 7050
AGWGGLSNH

SEQ ID NO: 14101 - protein, 9 aa, Homo sapiens
  light chain complementarity determining region 3 for antibody 7051
QQYHGYPWT

SEQ ID NO: 14102 - protein, 9 aa, Homo sapiens
  heavy chain complementarity determining region 3 for antibody 7051
AGWGGLSDY

SEQ ID NO: 14103 - protein, 9 aa, Homo sapiens
  light chain complementarity determining region 3 for antibody 7052
QQYHGYPWT

SEQ ID NO: 14104 - protein, 9 aa, Homo sapiens
  heavy chain complementarity determining region 3 for antibody 7052
AGWGGLLNY

SEQ ID NO: 14105 - protein, 9 aa, Homo sapiens
  light chain complementarity determining region 3 for antibody 7053
QQYHGYPWT

SEQ ID NO: 14106 - protein, 11 aa, Homo sapiens
  heavy chain complementarity determining region 3 for antibody 7053
AGIVARKPDDY

SEQ ID NO: 14107 - protein, 9 aa, Homo sapiens
  light chain complementarity determining region 3 for antibody 7054
QQYHGYPWP

SEQ ID NO: 14108 - protein, 9 aa, Homo sapiens
  heavy chain complementarity determining region 3 for antibody 7054
AGWGGLSNY

SEQ ID NO: 14109 - protein, 9 aa, Homo sapiens
  light chain complementarity determining region 3 for antibody 7055
QQYHGFPCT

SEQ ID NO: 14110 - protein, 11 aa, Homo sapiens
  heavy chain complementarity determining region 3 for antibody 7055
ARIVARKPDDY

SEQ ID NO: 14111 - protein, 9 aa, Homo sapiens
  light chain complementarity determining region 3 for antibody 7056
QQYHGDPWT

SEQ ID NO: 14112 - protein, 11 aa, Homo sapiens
  heavy chain complementarity determining region 3 for antibody 7056
ARIVARKPDDY

SEQ ID NO: 14113 - protein, 9 aa, Homo sapiens
  light chain complementarity determining region 3 for antibody 7057
QQYHGCPWT

SEQ ID NO: 14114 - protein, 17 aa, Homo sapiens
  heavy chain complementarity determining region 3 for antibody 7057
ARNTMVDGWQRQGSVDH

SEQ ID NO: 14115 - protein, 9 aa, Homo sapiens
  light chain complementarity determining region 3 for antibody 7058
QQYHGCPWT

SEQ ID NO: 14116 - protein, 9 aa, Homo sapiens
  heavy chain complementarity determining region 3 for antibody 7058
AGWGGLSNY

SEQ ID NO: 14117 - protein, 9 aa, Homo sapiens
  light chain complementarity determining region 3 for antibody 7059
QQYHFYPWT

SEQ ID NO: 14118 - protein, 11 aa, Homo sapiens
  heavy chain complementarity determining region 3 for antibody 7059
ARIVARRPDDY

SEQ ID NO: 14119 - protein, 8 aa, Homo sapiens
  light chain complementarity determining region 3 for antibody 7060
QQYGYSYT

SEQ ID NO: 14120 - protein, 15 aa, Homo sapiens
  heavy chain complementarity determining region 3 for antibody 7060
ARGLLATGGWYYFDY

SEQ ID NO: 14121 - protein, 8 aa, Homo sapiens
  light chain complementarity determining region 3 for antibody 7061
QQYGYSRT

SEQ ID NO: 14122 - protein, 15 aa, Homo sapiens
  heavy chain complementarity determining region 3 for antibody 7061
ARGLLATGGWYYFDY

SEQ ID NO: 14123 - protein, 8 aa, Homo sapiens
  light chain complementarity determining region 3 for antibody 7062
QQYGYSRT

SEQ ID NO: 14124 - protein, 15 aa, Homo sapiens
  heavy chain complementarity determining region 3 for antibody 7062
ARGLLAAGGWYYFDY

SEQ ID NO: 14125 - protein, 8 aa, Homo sapiens
  light chain complementarity determining region 3 for antibody 7063
QQYGYSQT

SEQ ID NO: 14126 - protein, 15 aa, Homo sapiens
  heavy chain complementarity determining region 3 for antibody 7063
ARGLLAAGGWYYFDY

SEQ ID NO: 14127 - protein, 9 aa, Homo sapiens
  light chain complementarity determining region 3 for antibody 7064
QQYGYSPVP

SEQ ID NO: 14128 - protein, 18 aa, Homo sapiens
  heavy chain complementarity determining region 3 for antibody 7064
ARGDYPEARTGYFLDFDY

SEQ ID NO: 14129 - protein, 9 aa, Homo sapiens
  light chain complementarity determining region 3 for antibody 7065
QQYGYSPPT

SEQ ID NO: 14130 - protein, 18 aa, Homo sapiens
  heavy chain complementarity determining region 3 for antibody 7065
ARGDYPEARSDYYLDFDY

SEQ ID NO: 14131 - protein, 8 aa, Homo sapiens
  light chain complementarity determining region 3 for antibody 7066
QQYGYSPP

SEQ ID NO: 14132 - protein, 15 aa, Homo sapiens
  heavy chain complementarity determining region 3 for antibody 7066
ARGLLATGGWYYFDY

SEQ ID NO: 14133 - protein, 9 aa, Homo sapiens
  light chain complementarity determining region 3 for antibody 7067
QQYGYSPLT

SEQ ID NO: 14134 - protein, 18 aa, Homo sapiens
  heavy chain complementarity determining region 3 for antibody 7067
ARGGYPEARSDYYLDFDY

SEQ ID NO: 14135 - protein, 9 aa, Homo sapiens
  light chain complementarity determining region 3 for antibody 7068
QQYGYSPLT

SEQ ID NO: 14136 - protein, 18 aa, Homo sapiens
  heavy chain complementarity determining region 3 for antibody 7068
ARGDYPEARSDYYRDFDY

SEQ ID NO: 14137 - protein, 9 aa, Homo sapiens
  light chain complementarity determining region 3 for antibody 7069
QQYGYSPLT

SEQ ID NO: 14138 - protein, 18 aa, Homo sapiens
  heavy chain complementarity determining region 3 for antibody 7069
ARGDYPEARSDYFLDFDY

SEQ ID NO: 14139 - protein, 9 aa, Homo sapiens
  light chain complementarity determining region 3 for antibody 7070
QQYGYSPLT

SEQ ID NO: 14140 - protein, 18 aa, Homo sapiens
  heavy chain complementarity determining region 3 for antibody 7070
ARGDHPEARSDYYLDFDY

SEQ ID NO: 14141 - protein, 9 aa, Homo sapiens
  light chain complementarity determining region 3 for antibody 7071
QQYGYSPLP

SEQ ID NO: 14142 - protein, 18 aa, Homo sapiens
  heavy chain complementarity determining region 3 for antibody 7071
ARGDYPEARSSYYLDFDY

SEQ ID NO: 14143 - protein, 8 aa, Homo sapiens
  light chain complementarity determining region 3 for antibody 7072
QQYGYSNT

SEQ ID NO: 14144 - protein, 15 aa, Homo sapiens
  heavy chain complementarity determining region 3 for antibody 7072
ARGLLATGGWYYFDY

SEQ ID NO: 14145 - protein, 8 aa, Homo sapiens
  light chain complementarity determining region 3 for antibody 7073
QQYGYSHT

SEQ ID NO: 14146 - protein, 11 aa, Homo sapiens
  heavy chain complementarity determining region 3 for antibody 7073
GRDVDYSTPGF

SEQ ID NO: 14147 - protein, 8 aa, Homo sapiens
  light chain complementarity determining region 3 for antibody 7074
QQYGYSHT

SEQ ID NO: 14148 - protein, 10 aa, Homo sapiens
  heavy chain complementarity determining region 3 for antibody 7074
CRDREGFGDV

SEQ ID NO: 14149 - protein, 8 aa, Homo sapiens
  light chain complementarity determining region 3 for antibody 7075
QQYGYSHT

SEQ ID NO: 14150 - protein, 11 aa, Homo sapiens
  heavy chain complementarity determining region 3 for antibody 7075
ATFGQQWRLAH

SEQ ID NO: 14151 - protein, 8 aa, Homo sapiens
  light chain complementarity determining region 3 for antibody 7076
QQYGYSHT

SEQ ID NO: 14152 - protein, 15 aa, Homo sapiens
  heavy chain complementarity determining region 3 for antibody 7076
ARGLPATGGWYYFDY

SEQ ID NO: 14153 - protein, 8 aa, Homo sapiens
  light chain complementarity determining region 3 for antibody 7077
QQYGYSHT

SEQ ID NO: 14154 - protein, 15 aa, Homo sapiens
  heavy chain complementarity determining region 3 for antibody 7077
ARGLLATGGWYYLDY

SEQ ID NO: 14155 - protein, 8 aa, Homo sapiens
  light chain complementarity determining region 3 for antibody 7078
QQYGYSHT

SEQ ID NO: 14156 - protein, 15 aa, Homo sapiens
  heavy chain complementarity determining region 3 for antibody 7078
ARGLLATGGWYYFDS

SEQ ID NO: 14157 - protein, 8 aa, Homo sapiens
  light chain complementarity determining region 3 for antibody 7079
QQYGYSHT

SEQ ID NO: 14158 - protein, 15 aa, Homo sapiens
  heavy chain complementarity determining region 3 for antibody 7079
ARGLLATGGWYSFDY

SEQ ID NO: 14159 - protein, 8 aa, Homo sapiens
  light chain complementarity determining region 3 for antibody 7080
QQYGYSHT

SEQ ID NO: 14160 - protein, 15 aa, Homo sapiens
  heavy chain complementarity determining region 3 for antibody 7080
ARGLLATGGWYCFDY

SEQ ID NO: 14161 - protein, 8 aa, Homo sapiens
  light chain complementarity determining region 3 for antibody 7081
QQYGYSHT

SEQ ID NO: 14162 - protein, 15 aa, Homo sapiens
  heavy chain complementarity determining region 3 for antibody 7081
ARGLLATGGWHYFDY

SEQ ID NO: 14163 - protein, 8 aa, Homo sapiens
  light chain complementarity determining region 3 for antibody 7082
QQYGYSHT

SEQ ID NO: 14164 - protein, 15 aa, Homo sapiens
  heavy chain complementarity determining region 3 for antibody 7082
ARGLLATCGWYYFDY

SEQ ID NO: 14165 - protein, 8 aa, Homo sapiens
  light chain complementarity determining region 3 for antibody 7083
QQYGYSHT

SEQ ID NO: 14166 - protein, 15 aa, Homo sapiens
  heavy chain complementarity determining region 3 for antibody 7083
ARGLLAPGGWYYFDY

SEQ ID NO: 14167 - protein, 8 aa, Homo sapiens
  light chain complementarity determining region 3 for antibody 7084
QQYGYSHT

SEQ ID NO: 14168 - protein, 15 aa, Homo sapiens
  heavy chain complementarity determining region 3 for antibody 7084
ARGLLAAGGWYYCDY

SEQ ID NO: 14169 - protein, 8 aa, Homo sapiens
  light chain complementarity determining region 3 for antibody 7085
QQYGYSHT

SEQ ID NO: 14170 - protein, 15 aa, Homo sapiens
  heavy chain complementarity determining region 3 for antibody 7085
ARGLLAAGGWYCFDY

SEQ ID NO: 14171 - protein, 8 aa, Homo sapiens
  light chain complementarity determining region 3 for antibody 7086
QQYGYSHT

SEQ ID NO: 14172 - protein, 15 aa, Homo sapiens
  heavy chain complementarity determining region 3 for antibody 7086
ARGLLAAGGWDYFDY

SEQ ID NO: 14173 - protein, 8 aa, Homo sapiens
  light chain complementarity determining region 3 for antibody 7087
QQYGYSHT

SEQ ID NO: 14174 - protein, 15 aa, Homo sapiens
  heavy chain complementarity determining region 3 for antibody 7087
ARGLLAAGGWCYFDY

SEQ ID NO: 14175 - protein, 8 aa, Homo sapiens
  light chain complementarity determining region 3 for antibody 7088
QQYGYSHT

SEQ ID NO: 14176 - protein, 18 aa, Homo sapiens
  heavy chain complementarity determining region 3 for antibody 7088
ARGDYPEARTGYFLDFDY

SEQ ID NO: 14177 - protein, 8 aa, Homo sapiens
  light chain complementarity determining region 3 for antibody 7089
QQYGYSHT

SEQ ID NO: 14178 - protein, 10 aa, Homo sapiens
  heavy chain complementarity determining region 3 for antibody 7089
ARETSGSYDI

SEQ ID NO: 14179 - protein, 8 aa, Homo sapiens
  light chain complementarity determining region 3 for antibody 7090
QQYGYSHT

SEQ ID NO: 14180 - protein, 12 aa, Homo sapiens
  heavy chain complementarity determining region 3 for antibody 7090
ARDKGGRNGMDV

SEQ ID NO: 14181 - protein, 8 aa, Homo sapiens
  light chain complementarity determining region 3 for antibody 7091
QQYGYSHT

SEQ ID NO: 14182 - protein, 17 aa, Homo sapiens
  heavy chain complementarity determining region 3 for antibody 7091
AKRLPDLLGGGHHYIDV

SEQ ID NO: 14183 - protein, 8 aa, Homo sapiens
  light chain complementarity determining region 3 for antibody 7092
QQYGYSHT

SEQ ID NO: 14184 - protein, 12 aa, Homo sapiens
  heavy chain complementarity determining region 3 for antibody 7092
AKPAYGSGSPDY

SEQ ID NO: 14185 - protein, 8 aa, Homo sapiens
  light chain complementarity determining region 3 for antibody 7093
QQYGYSHT

SEQ ID NO: 14186 - protein, 15 aa, Homo sapiens
  heavy chain complementarity determining region 3 for antibody 7093
AGGLLATGGWYYFDY

SEQ ID NO: 14187 - protein, 8 aa, Homo sapiens
  light chain complementarity determining region 3 for antibody 7094
QQYGYSHT

SEQ ID NO: 14188 - protein, 15 aa, Homo sapiens
  heavy chain complementarity determining region 3 for antibody 7094
AGGLLAAGGWYYFDY

SEQ ID NO: 14189 - protein, 9 aa, Homo sapiens
  light chain complementarity determining region 3 for antibody 7095
QQYGYPPLT

SEQ ID NO: 14190 - protein, 18 aa, Homo sapiens
  heavy chain complementarity determining region 3 for antibody 7095
ARGDYPEARSDYYLDFDY

SEQ ID NO: 14191 - protein, 8 aa, Homo sapiens
  light chain complementarity determining region 3 for antibody 7096
QQYGYPHT

SEQ ID NO: 14192 - protein, 15 aa, Homo sapiens
  heavy chain complementarity determining region 3 for antibody 7096
ARGLLAAGGWYYFDY

SEQ ID NO: 14193 - protein, 9 aa, Homo sapiens
  light chain complementarity determining region 3 for antibody 7097
QQYGTTTLT

SEQ ID NO: 14194 - protein, 6 aa, Homo sapiens
  heavy chain complementarity determining region 3 for antibody 7097
TTGYHA

SEQ ID NO: 14195 - protein, 9 aa, Homo sapiens
  light chain complementarity determining region 3 for antibody 7098
QQYGTTPLT

SEQ ID NO: 14196 - protein, 6 aa, Homo sapiens
  heavy chain complementarity determining region 3 for antibody 7098
TTGFHA

SEQ ID NO: 14197 - protein, 9 aa, Homo sapiens
  light chain complementarity determining region 3 for antibody 7099
QQYGTTPLT

SEQ ID NO: 14198 - protein, 6 aa, Homo sapiens
  heavy chain complementarity determining region 3 for antibody 7099
TTGCHA

SEQ ID NO: 14199 - protein, 9 aa, Homo sapiens
  light chain complementarity determining region 3 for antibody 7100
QQYGTTPLT

SEQ ID NO: 14200 - protein, 6 aa, Homo sapiens
  heavy chain complementarity determining region 3 for antibody 7100
TPGYHA

SEQ ID NO: 14201 - protein, 9 aa, Homo sapiens
  light chain complementarity determining region 3 for antibody 7101
QQYGTTPFT

SEQ ID NO: 14202 - protein, 12 aa, Homo sapiens
  heavy chain complementarity determining region 3 for antibody 7101
NADHGYVDGFDI

SEQ ID NO: 14203 - protein, 9 aa, Homo sapiens
  light chain complementarity determining region 3 for antibody 7102
QQYGTSQVT

SEQ ID NO: 14204 - protein, 13 aa, Homo sapiens
  heavy chain complementarity determining region 3 for antibody 7102
AKDRGSGWFAWGY

SEQ ID NO: 14205 - protein, 9 aa, Homo sapiens
  light chain complementarity determining region 3 for antibody 7103
QQYGTSPVT

SEQ ID NO: 14206 - protein, 11 aa, Homo sapiens
  heavy chain complementarity determining region 3 for antibody 7103
VRVSTGWNFDY

SEQ ID NO: 14207 - protein, 9 aa, Homo sapiens
  light chain complementarity determining region 3 for antibody 7104
QQYGTSPVT

SEQ ID NO: 14208 - protein, 13 aa, Homo sapiens
  heavy chain complementarity determining region 3 for antibody 7104
TREGDSSGPDFHL

SEQ ID NO: 14209 - protein, 9 aa, Homo sapiens
  light chain complementarity determining region 3 for antibody 7105
QQYGTSPVT

SEQ ID NO: 14210 - protein, 10 aa, Homo sapiens
  heavy chain complementarity determining region 3 for antibody 7105
CRDRWGFGDV

SEQ ID NO: 14211 - protein, 9 aa, Homo sapiens
  light chain complementarity determining region 3 for antibody 7106
QQYGTSPVT

SEQ ID NO: 14212 - protein, 14 aa, Homo sapiens
  heavy chain complementarity determining region 3 for antibody 7106
ARLHGSGLGRWLDP

SEQ ID NO: 14213 - protein, 9 aa, Homo sapiens
  light chain complementarity determining region 3 for antibody 7107
QQYGTSPVT

SEQ ID NO: 14214 - protein, 13 aa, Homo sapiens
  heavy chain complementarity determining region 3 for antibody 7107
AKGRGSGWFAWGY

SEQ ID NO: 14215 - protein, 9 aa, Homo sapiens
  light chain complementarity determining region 3 for antibody 7108
QQYGTSPVT

SEQ ID NO: 14216 - protein, 13 aa, Homo sapiens
  heavy chain complementarity determining region 3 for antibody 7108
AKERGSGWYAWGY

SEQ ID NO: 14217 - protein, 9 aa, Homo sapiens
  light chain complementarity determining region 3 for antibody 7109
QQYGTSPVT

SEQ ID NO: 14218 - protein, 13 aa, Homo sapiens
  heavy chain complementarity determining region 3 for antibody 7109
AKDSGSGWFAWGY

SEQ ID NO: 14219 - protein, 9 aa, Homo sapiens
  light chain complementarity determining region 3 for antibody 7110
QQYGTSPVT

SEQ ID NO: 14220 - protein, 13 aa, Homo sapiens
  heavy chain complementarity determining region 3 for antibody 7110
AKDRGSGGFAWGY

SEQ ID NO: 14221 - protein, 9 aa, Homo sapiens
  light chain complementarity determining region 3 for antibody 7111
QQYGTSPVT

SEQ ID NO: 14222 - protein, 13 aa, Homo sapiens
  heavy chain complementarity determining region 3 for antibody 7111
AKARGSGWFAWGY

SEQ ID NO: 14223 - protein, 9 aa, Homo sapiens
  light chain complementarity determining region 3 for antibody 7112
QQYGTSPVN

SEQ ID NO: 14224 - protein, 13 aa, Homo sapiens
  heavy chain complementarity determining region 3 for antibody 7112
AKDRGSGWFAWGY

SEQ ID NO: 14225 - protein, 9 aa, Homo sapiens
  light chain complementarity determining region 3 for antibody 7113
QQYGTSPIT

SEQ ID NO: 14226 - protein, 13 aa, Homo sapiens
  heavy chain complementarity determining region 3 for antibody 7113
AKDRGSGWFAWGY

SEQ ID NO: 14227 - protein, 9 aa, Homo sapiens
  light chain complementarity determining region 3 for antibody 7114
QQYGTSPGT

SEQ ID NO: 14228 - protein, 13 aa, Homo sapiens
  heavy chain complementarity determining region 3 for antibody 7114
AKDRGSGWFAWGY

SEQ ID NO: 14229 - protein, 9 aa, Homo sapiens
  light chain complementarity determining region 3 for antibody 7115
QQYGTSPFT

SEQ ID NO: 14230 - protein, 13 aa, Homo sapiens
  heavy chain complementarity determining region 3 for antibody 7115
AKDRGSGWFAWGY

SEQ ID NO: 14231 - protein, 9 aa, Homo sapiens
  light chain complementarity determining region 3 for antibody 7116
QQYGTSPDT

SEQ ID NO: 14232 - protein, 17 aa, Homo sapiens
  heavy chain complementarity determining region 3 for antibody 7116
ARNTMVGTWQRQGNLDH

SEQ ID NO: 14233 - protein, 9 aa, Homo sapiens
  light chain complementarity determining region 3 for antibody 7117
QQYGTSPAT

SEQ ID NO: 14234 - protein, 13 aa, Homo sapiens
  heavy chain complementarity determining region 3 for antibody 7117
AKDRGSGWFAWGY

SEQ ID NO: 14235 - protein, 9 aa, Homo sapiens
  light chain complementarity determining region 3 for antibody 7118
QQYGTPPVT

SEQ ID NO: 14236 - protein, 13 aa, Homo sapiens
  heavy chain complementarity determining region 3 for antibody 7118
AKDRGSGWFAWGY

SEQ ID NO: 14237 - protein, 9 aa, Homo sapiens
  light chain complementarity determining region 3 for antibody 7119
QQYGTLPLT

SEQ ID NO: 14238 - protein, 16 aa, Homo sapiens
  heavy chain complementarity determining region 3 for antibody 7119
VRDLAGFTRGGSTFDY

SEQ ID NO: 14239 - protein, 9 aa, Homo sapiens
  light chain complementarity determining region 3 for antibody 7120
QQYGTIPLT

SEQ ID NO: 14240 - protein, 11 aa, Homo sapiens
  heavy chain complementarity determining region 3 for antibody 7120
ARSPASGTVDS

SEQ ID NO: 14241 - protein, 9 aa, Homo sapiens
  light chain complementarity determining region 3 for antibody 7121
QQYGTIPLT

SEQ ID NO: 14242 - protein, 17 aa, Homo sapiens
  heavy chain complementarity determining region 3 for antibody 7121
ARQGRHCDGGSCHPPEY

SEQ ID NO: 14243 - protein, 9 aa, Homo sapiens
  light chain complementarity determining region 3 for antibody 7122
QQYGTIPLP

SEQ ID NO: 14244 - protein, 16 aa, Homo sapiens
  heavy chain complementarity determining region 3 for antibody 7122
VRDLAGFTRGGSTFDY

SEQ ID NO: 14245 - protein, 9 aa, Homo sapiens
  light chain complementarity determining region 3 for antibody 7123
QQYGTIPLP

SEQ ID NO: 14246 - protein, 11 aa, Homo sapiens
  heavy chain complementarity determining region 3 for antibody 7123
ARSPATGTVDS

SEQ ID NO: 14247 - protein, 9 aa, Homo sapiens
  light chain complementarity determining region 3 for antibody 7124
QQYGTGMDT

SEQ ID NO: 14248 - protein, 11 aa, Homo sapiens
  heavy chain complementarity determining region 3 for antibody 7124
ARDRADDYFDS

SEQ ID NO: 14249 - protein, 7 aa, Homo sapiens
  light chain complementarity determining region 3 for antibody 7125
QQYGSYT

SEQ ID NO: 14250 - protein, 14 aa, Homo sapiens
  heavy chain complementarity determining region 3 for antibody 7125
GRDVHTTGWTLGGY

SEQ ID NO: 14251 - protein, 7 aa, Homo sapiens
  light chain complementarity determining region 3 for antibody 7126
QQYGSYT

SEQ ID NO: 14252 - protein, 16 aa, Homo sapiens
  heavy chain complementarity determining region 3 for antibody 7126
ARWFSRSSTGVSYMDV

SEQ ID NO: 14253 - protein, 7 aa, Homo sapiens
  light chain complementarity determining region 3 for antibody 7127
QQYGSYT

SEQ ID NO: 14254 - protein, 9 aa, Homo sapiens
  heavy chain complementarity determining region 3 for antibody 7127
ARSEYQPTY

SEQ ID NO: 14255 - protein, 7 aa, Homo sapiens
  light chain complementarity determining region 3 for antibody 7128
QQYGSYT

SEQ ID NO: 14256 - protein, 10 aa, Homo sapiens
  heavy chain complementarity determining region 3 for antibody 7128
ARRWERYSDY

SEQ ID NO: 14257 - protein, 7 aa, Homo sapiens
  light chain complementarity determining region 3 for antibody 7129
QQYGSYT

SEQ ID NO: 14258 - protein, 10 aa, Homo sapiens
  heavy chain complementarity determining region 3 for antibody 7129
ARRWERYLDY

SEQ ID NO: 14259 - protein, 7 aa, Homo sapiens
  light chain complementarity determining region 3 for antibody 7130
QQYGSYT

SEQ ID NO: 14260 - protein, 10 aa, Homo sapiens
  heavy chain complementarity determining region 3 for antibody 7130
ARRWERYFDH

SEQ ID NO: 14261 - protein, 7 aa, Homo sapiens
  light chain complementarity determining region 3 for antibody 7131
QQYGSYT

SEQ ID NO: 14262 - protein, 10 aa, Homo sapiens
  heavy chain complementarity determining region 3 for antibody 7131
ARRWERYFDD

SEQ ID NO: 14263 - protein, 7 aa, Homo sapiens
  light chain complementarity determining region 3 for antibody 7132
QQYGSYT

SEQ ID NO: 14264 - protein, 10 aa, Homo sapiens
  heavy chain complementarity determining region 3 for antibody 7132
ARRWERCFDY

SEQ ID NO: 14265 - protein, 7 aa, Homo sapiens
  light chain complementarity determining region 3 for antibody 7133
QQYGSYT

SEQ ID NO: 14266 - protein, 10 aa, Homo sapiens
  heavy chain complementarity determining region 3 for antibody 7133
ARRWARYFDY

SEQ ID NO: 14267 - protein, 7 aa, Homo sapiens
  light chain complementarity determining region 3 for antibody 7134
QQYGSYT

SEQ ID NO: 14268 - protein, 10 aa, Homo sapiens
  heavy chain complementarity determining region 3 for antibody 7134
ARRRERYFDY

SEQ ID NO: 14269 - protein, 7 aa, Homo sapiens
  light chain complementarity determining region 3 for antibody 7135
QQYGSYT

SEQ ID NO: 14270 - protein, 10 aa, Homo sapiens
  heavy chain complementarity determining region 3 for antibody 7135
ARRCERYFDY

SEQ ID NO: 14271 - protein, 7 aa, Homo sapiens
  light chain complementarity determining region 3 for antibody 7136
QQYGSYT

SEQ ID NO: 14272 - protein, 17 aa, Homo sapiens
  heavy chain complementarity determining region 3 for antibody 7136
ARNTMVGTWQRQGNLDH

SEQ ID NO: 14273 - protein, 7 aa, Homo sapiens
  light chain complementarity determining region 3 for antibody 7137
QQYGSYT

SEQ ID NO: 14274 - protein, 15 aa, Homo sapiens
  heavy chain complementarity determining region 3 for antibody 7137
ARGLLATGGWYYFDY

SEQ ID NO: 14275 - protein, 7 aa, Homo sapiens
  light chain complementarity determining region 3 for antibody 7138
QQYGSYT

SEQ ID NO: 14276 - protein, 19 aa, Homo sapiens
  heavy chain complementarity determining region 3 for antibody 7138
ARERVRCRSGICYDATFDI

SEQ ID NO: 14277 - protein, 9 aa, Homo sapiens
  light chain complementarity determining region 3 for antibody 7139
QQYGSYLWT

SEQ ID NO: 14278 - protein, 11 aa, Homo sapiens
  heavy chain complementarity determining region 3 for antibody 7139
ALKIAAFPFDY

SEQ ID NO: 14279 - protein, 8 aa, Homo sapiens
  light chain complementarity determining region 3 for antibody 7140
QQYGSSWT

SEQ ID NO: 14280 - protein, 15 aa, Homo sapiens
  heavy chain complementarity determining region 3 for antibody 7140
ARAGSVLAGLSFFDA

SEQ ID NO: 14281 - protein, 9 aa, Homo sapiens
  light chain complementarity determining region 3 for antibody 7141
QQYGSSTWT

SEQ ID NO: 14282 - protein, 17 aa, Homo sapiens
  heavy chain complementarity determining region 3 for antibody 7141
EKGRGSVAMALIYYLDL

SEQ ID NO: 14283 - protein, 9 aa, Homo sapiens
  light chain complementarity determining region 3 for antibody 7142
QQYGSSTWT

SEQ ID NO: 14284 - protein, 18 aa, Homo sapiens
  heavy chain complementarity determining region 3 for antibody 7142
ASWAGYCGGDCSSVSLDY

SEQ ID NO: 14285 - protein, 9 aa, Homo sapiens
  light chain complementarity determining region 3 for antibody 7143
QQYGSSTWT

SEQ ID NO: 14286 - protein, 10 aa, Homo sapiens
  heavy chain complementarity determining region 3 for antibody 7143
ARETSGSYDI

SEQ ID NO: 14287 - protein, 9 aa, Homo sapiens
  light chain complementarity determining region 3 for antibody 7144
QQYGSSTWT

SEQ ID NO: 14288 - protein, 10 aa, Homo sapiens
  heavy chain complementarity determining region 3 for antibody 7144
ARERSGSYDI

SEQ ID NO: 14289 - protein, 9 aa, Homo sapiens
  light chain complementarity determining region 3 for antibody 7145
QQYGSSTWT

SEQ ID NO: 14290 - protein, 15 aa, Homo sapiens
  heavy chain complementarity determining region 3 for antibody 7145
ARERPQRKYSDGWDH

SEQ ID NO: 14291 - protein, 9 aa, Homo sapiens
  light chain complementarity determining region 3 for antibody 7146
QQYGSSTWT

SEQ ID NO: 14292 - protein, 15 aa, Homo sapiens
  heavy chain complementarity determining region 3 for antibody 7146
ARELPQCKYSDGWDH

SEQ ID NO: 14293 - protein, 9 aa, Homo sapiens
  light chain complementarity determining region 3 for antibody 7147
QQYGSSTWT

SEQ ID NO: 14294 - protein, 15 aa, Homo sapiens
  heavy chain complementarity determining region 3 for antibody 7147
ARELPHRTYSDGWDH

SEQ ID NO: 14295 - protein, 9 aa, Homo sapiens
  light chain complementarity determining region 3 for antibody 7148
QQYGSSTWT

SEQ ID NO: 14296 - protein, 17 aa, Homo sapiens
  heavy chain complementarity determining region 3 for antibody 7148
AKGRGSVSMALIYYLDL

SEQ ID NO: 14297 - protein, 9 aa, Homo sapiens
  light chain complementarity determining region 3 for antibody 7149
QQYGSSTWT

SEQ ID NO: 14298 - protein, 17 aa, Homo sapiens
  heavy chain complementarity determining region 3 for antibody 7149
AKGRGSVAMSLIYYLDL

SEQ ID NO: 14299 - protein, 9 aa, Homo sapiens
  light chain complementarity determining region 3 for antibody 7150
QQYGSSTWT

SEQ ID NO: 14300 - protein, 17 aa, Homo sapiens
  heavy chain complementarity determining region 3 for antibody 7150
AKGRGSVAMARIYDLDL

SEQ ID NO: 14301 - protein, 9 aa, Homo sapiens
  light chain complementarity determining region 3 for antibody 7151
QQYGSSTWT

SEQ ID NO: 14302 - protein, 17 aa, Homo sapiens
  heavy chain complementarity determining region 3 for antibody 7151
AKGRGSVAMALLYYLDL

SEQ ID NO: 14303 - protein, 9 aa, Homo sapiens
  light chain complementarity determining region 3 for antibody 7152
QQYGSSTWT

SEQ ID NO: 14304 - protein, 17 aa, Homo sapiens
  heavy chain complementarity determining region 3 for antibody 7152
AKGRGSVAMALIYYVDL

SEQ ID NO: 14305 - protein, 9 aa, Homo sapiens
  light chain complementarity determining region 3 for antibody 7153
QQYGSSTWT

SEQ ID NO: 14306 - protein, 17 aa, Homo sapiens
  heavy chain complementarity determining region 3 for antibody 7153
AKGRGSVAMALIYYPDL

SEQ ID NO: 14307 - protein, 9 aa, Homo sapiens
  light chain complementarity determining region 3 for antibody 7154
QQYGSSTWT

SEQ ID NO: 14308 - protein, 17 aa, Homo sapiens
  heavy chain complementarity determining region 3 for antibody 7154
AKGRGSVAMALIYYFDL

SEQ ID NO: 14309 - protein, 9 aa, Homo sapiens
  light chain complementarity determining region 3 for antibody 7155
QQYGSSTWT

SEQ ID NO: 14310 - protein, 17 aa, Homo sapiens
  heavy chain complementarity determining region 3 for antibody 7155
AKGRGSVAMALIHYLDL

SEQ ID NO: 14311 - protein, 9 aa, Homo sapiens
  light chain complementarity determining region 3 for antibody 7156
QQYGSSTWT

SEQ ID NO: 14312 - protein, 17 aa, Homo sapiens
  heavy chain complementarity determining region 3 for antibody 7156
AKGRGSVAMALICYLDL

SEQ ID NO: 14313 - protein, 9 aa, Homo sapiens
  light chain complementarity determining region 3 for antibody 7157
QQYGSSTWT

SEQ ID NO: 14314 - protein, 17 aa, Homo sapiens
  heavy chain complementarity determining region 3 for antibody 7157
AKGRGSVAMAIIYYLDL

SEQ ID NO: 14315 - protein, 9 aa, Homo sapiens
  light chain complementarity determining region 3 for antibody 7158
QQYGSSTWT

SEQ ID NO: 14316 - protein, 17 aa, Homo sapiens
  heavy chain complementarity determining region 3 for antibody 7158
AKGRGSAAMALIYYLDL

SEQ ID NO: 14317 - protein, 9 aa, Homo sapiens
  light chain complementarity determining region 3 for antibody 7159
QQYGSSTWT

SEQ ID NO: 14318 - protein, 17 aa, Homo sapiens
  heavy chain complementarity determining region 3 for antibody 7159
AKGRGGVAMALIYYLDL

SEQ ID NO: 14319 - protein, 9 aa, Homo sapiens
  light chain complementarity determining region 3 for antibody 7160
QQYGSSTWT

SEQ ID NO: 14320 - protein, 17 aa, Homo sapiens
  heavy chain complementarity determining region 3 for antibody 7160
AKGHGSVAMALIYYLDL

SEQ ID NO: 14321 - protein, 9 aa, Homo sapiens
  light chain complementarity determining region 3 for antibody 7161
QQYGSSTWT

SEQ ID NO: 14322 - protein, 17 aa, Homo sapiens
  heavy chain complementarity determining region 3 for antibody 7161
AKGCGSVAMALIYYLDL

SEQ ID NO: 14323 - protein, 9 aa, Homo sapiens
  light chain complementarity determining region 3 for antibody 7162
QQYGSSTWT

SEQ ID NO: 14324 - protein, 13 aa, Homo sapiens
  heavy chain complementarity determining region 3 for antibody 7162
AKEGSSPGPDFEY

SEQ ID NO: 14325 - protein, 9 aa, Homo sapiens
  light chain complementarity determining region 3 for antibody 7163
QQYGSSTWT

SEQ ID NO: 14326 - protein, 17 aa, Homo sapiens
  heavy chain complementarity determining region 3 for antibody 7163
AKCRGSVAMALIYYLDL

SEQ ID NO: 14327 - protein, 9 aa, Homo sapiens
  light chain complementarity determining region 3 for antibody 7164
QQYGSSTWP

SEQ ID NO: 14328 - protein, 15 aa, Homo sapiens
  heavy chain complementarity determining region 3 for antibody 7164
ARELPQRKYSDGWDH

SEQ ID NO: 14329 - protein, 9 aa, Homo sapiens
  light chain complementarity determining region 3 for antibody 7165
QQYGSSTWM

SEQ ID NO: 14330 - protein, 17 aa, Homo sapiens
  heavy chain complementarity determining region 3 for antibody 7165
AKGRGSVAMALIYYLDL

SEQ ID NO: 14331 - protein, 9 aa, Homo sapiens
  light chain complementarity determining region 3 for antibody 7166
QQYGSSTWK

SEQ ID NO: 14332 - protein, 17 aa, Homo sapiens
  heavy chain complementarity determining region 3 for antibody 7166
AKGRGSVAMALIYYLDL

SEQ ID NO: 14333 - protein, 9 aa, Homo sapiens
  light chain complementarity determining region 3 for antibody 7167
QQYGSSTRT

SEQ ID NO: 14334 - protein, 15 aa, Homo sapiens
  heavy chain complementarity determining region 3 for antibody 7167
ARELPQRKYSDGWDH

SEQ ID NO: 14335 - protein, 10 aa, Homo sapiens
  light chain complementarity determining region 3 for antibody 7168
QQYGSSSTRT

SEQ ID NO: 14336 - protein, 20 aa, Homo sapiens
  heavy chain complementarity determining region 3 for antibody 7168
TRDARGSISYAYGGGGGLDV

SEQ ID NO: 14337 - protein, 10 aa, Homo sapiens
  light chain complementarity determining region 3 for antibody 7169
QQYGSSSTGT

SEQ ID NO: 14338 - protein, 20 aa, Homo sapiens
  heavy chain complementarity determining region 3 for antibody 7169
TRDARGSISYAYGGGGGLDV

SEQ ID NO: 14339 - protein, 9 aa, Homo sapiens
  light chain complementarity determining region 3 for antibody 7170
QQYGSSSIT

SEQ ID NO: 14340 - protein, 13 aa, Homo sapiens
  heavy chain complementarity determining region 3 for antibody 7170
AKDRLKVLRFLEC

SEQ ID NO: 14341 - protein, 9 aa, Homo sapiens
  light chain complementarity determining region 3 for antibody 7171
QQYGSSSIT

SEQ ID NO: 14342 - protein, 13 aa, Homo sapiens
  heavy chain complementarity determining region 3 for antibody 7171
AKDLLKVVRFLEC

SEQ ID NO: 14343 - protein, 9 aa, Homo sapiens
  light chain complementarity determining region 3 for antibody 7172
QQYGSSSIT

SEQ ID NO: 14344 - protein, 13 aa, Homo sapiens
  heavy chain complementarity determining region 3 for antibody 7172
AKDLLKVLRFLER

SEQ ID NO: 14345 - protein, 9 aa, Homo sapiens
  light chain complementarity determining region 3 for antibody 7173
QQYGSSSET

SEQ ID NO: 14346 - protein, 11 aa, Homo sapiens
  heavy chain complementarity determining region 3 for antibody 7173
VRVSTGWNFDY

SEQ ID NO: 14347 - protein, 9 aa, Homo sapiens
  light chain complementarity determining region 3 for antibody 7174
QQYGSSPYP

SEQ ID NO: 14348 - protein, 10 aa, Homo sapiens
  heavy chain complementarity determining region 3 for antibody 7174
TTIIWHDIDY

SEQ ID NO: 14349 - protein, 9 aa, Homo sapiens
  light chain complementarity determining region 3 for antibody 7175
QQYGSSPYP

SEQ ID NO: 14350 - protein, 8 aa, Homo sapiens
  heavy chain complementarity determining region 3 for antibody 7175
ARYYGMGT

SEQ ID NO: 14351 - protein, 9 aa, Homo sapiens
  light chain complementarity determining region 3 for antibody 7176
QQYGSSPWT

SEQ ID NO: 14352 - protein, 16 aa, Homo sapiens
  heavy chain complementarity determining region 3 for antibody 7176
VRDLAGFTRGGSTFDY

SEQ ID NO: 14353 - protein, 9 aa, Homo sapiens
  light chain complementarity determining region 3 for antibody 7177
QQYGSSPWT

SEQ ID NO: 14354 - protein, 11 aa, Homo sapiens
  heavy chain complementarity determining region 3 for antibody 7177
TRGGYSVGYDY

SEQ ID NO: 14355 - protein, 9 aa, Homo sapiens
  light chain complementarity determining region 3 for antibody 7178
QQYGSSPWT

SEQ ID NO: 14356 - protein, 11 aa, Homo sapiens
  heavy chain complementarity determining region 3 for antibody 7178
GKDYHDAAADR

SEQ ID NO: 14357 - protein, 9 aa, Homo sapiens
  light chain complementarity determining region 3 for antibody 7179
QQYGSSPWT

SEQ ID NO: 14358 - protein, 10 aa, Homo sapiens
  heavy chain complementarity determining region 3 for antibody 7179
ARERSGSYGI

SEQ ID NO: 14359 - protein, 9 aa, Homo sapiens
  light chain complementarity determining region 3 for antibody 7180
QQYGSSPWT

SEQ ID NO: 14360 - protein, 10 aa, Homo sapiens
  heavy chain complementarity determining region 3 for antibody 7180
ARERSGSYDL

SEQ ID NO: 14361 - protein, 9 aa, Homo sapiens
  light chain complementarity determining region 3 for antibody 7181
QQYGSSPWT

SEQ ID NO: 14362 - protein, 10 aa, Homo sapiens
  heavy chain complementarity determining region 3 for antibody 7181
ARERSGPYDI

SEQ ID NO: 14363 - protein, 9 aa, Homo sapiens
  light chain complementarity determining region 3 for antibody 7182
QQYGSSPWT

SEQ ID NO: 14364 - protein, 10 aa, Homo sapiens
  heavy chain complementarity determining region 3 for antibody 7182
ARERSCSYDI

SEQ ID NO: 14365 - protein, 9 aa, Homo sapiens
  light chain complementarity determining region 3 for antibody 7183
QQYGSSPWT

SEQ ID NO: 14366 - protein, 10 aa, Homo sapiens
  heavy chain complementarity determining region 3 for antibody 7183
AREGSGSYDI

SEQ ID NO: 14367 - protein, 9 aa, Homo sapiens
  light chain complementarity determining region 3 for antibody 7184
QQYGSSPWP

SEQ ID NO: 14368 - protein, 10 aa, Homo sapiens
  heavy chain complementarity determining region 3 for antibody 7184
LISPYYGLDV

SEQ ID NO: 14369 - protein, 9 aa, Homo sapiens
  light chain complementarity determining region 3 for antibody 7185
QQYGSSPWM

SEQ ID NO: 14370 - protein, 10 aa, Homo sapiens
  heavy chain complementarity determining region 3 for antibody 7185
ARERSGSYDI

SEQ ID NO: 14371 - protein, 8 aa, Homo sapiens
  light chain complementarity determining region 3 for antibody 7186
QQYGSSPT

SEQ ID NO: 14372 - protein, 16 aa, Homo sapiens
  heavy chain complementarity determining region 3 for antibody 7186
ARGRPYCGGDCYHFDY

SEQ ID NO: 14373 - protein, 9 aa, Homo sapiens
  light chain complementarity determining region 3 for antibody 7187
QQYGSSPST

SEQ ID NO: 14374 - protein, 17 aa, Homo sapiens
  heavy chain complementarity determining region 3 for antibody 7187
ARNTMVHGWQRQGSVDH

SEQ ID NO: 14375 - protein, 9 aa, Homo sapiens
  light chain complementarity determining region 3 for antibody 7188
QQYGSSPRT

SEQ ID NO: 14376 - protein, 18 aa, Homo sapiens
  heavy chain complementarity determining region 3 for antibody 7188
ARPRSLRGVSGTGDAFDI

SEQ ID NO: 14377 - protein, 9 aa, Homo sapiens
  light chain complementarity determining region 3 for antibody 7189
QQYGSSPRT

SEQ ID NO: 14378 - protein, 12 aa, Homo sapiens
  heavy chain complementarity determining region 3 for antibody 7189
ARDKGGRNGMDV

SEQ ID NO: 14379 - protein, 9 aa, Homo sapiens
  light chain complementarity determining region 3 for antibody 7190
QQYGSSPRT

SEQ ID NO: 14380 - protein, 11 aa, Homo sapiens
  heavy chain complementarity determining region 3 for antibody 7190
AKGGFYFLTGD

SEQ ID NO: 14381 - protein, 9 aa, Homo sapiens
  light chain complementarity determining region 3 for antibody 7191
QQYGSSPQT

SEQ ID NO: 14382 - protein, 13 aa, Homo sapiens
  heavy chain complementarity determining region 3 for antibody 7191
AKEGSSPGPDFEY

SEQ ID NO: 14383 - protein, 10 aa, Homo sapiens
  light chain complementarity determining region 3 for antibody 7192
QQYGSSPQET

SEQ ID NO: 14384 - protein, 20 aa, Homo sapiens
  heavy chain complementarity determining region 3 for antibody 7192
STYLPGDCTCTGCFYWYSDF

SEQ ID NO: 14385 - protein, 10 aa, Homo sapiens
  light chain complementarity determining region 3 for antibody 7193
QQYGSSPQET

SEQ ID NO: 14386 - protein, 13 aa, Homo sapiens
  heavy chain complementarity determining region 3 for antibody 7193
AKEGSAPGPDFEY

SEQ ID NO: 14387 - protein, 10 aa, Homo sapiens
  light chain complementarity determining region 3 for antibody 7194
QQYGSSPPYT

SEQ ID NO: 14388 - protein, 13 aa, Homo sapiens
  heavy chain complementarity determining region 3 for antibody 7194
AKEGSSPGSDFEY

SEQ ID NO: 14389 - protein, 10 aa, Homo sapiens
  light chain complementarity determining region 3 for antibody 7195
QQYGSSPPYT

SEQ ID NO: 14390 - protein, 13 aa, Homo sapiens
  heavy chain complementarity determining region 3 for antibody 7195
AKEGSSPGPDLEY

SEQ ID NO: 14391 - protein, 10 aa, Homo sapiens
  light chain complementarity determining region 3 for antibody 7196
QQYGSSPPYT

SEQ ID NO: 14392 - protein, 12 aa, Homo sapiens
  heavy chain complementarity determining region 3 for antibody 7196
AIVVPGRWDLDD

SEQ ID NO: 14393 - protein, 10 aa, Homo sapiens
  light chain complementarity determining region 3 for antibody 7197
QQYGSSPPWT

SEQ ID NO: 14394 - protein, 11 aa, Homo sapiens
  heavy chain complementarity determining region 3 for antibody 7197
ARGIPHYYLDL

SEQ ID NO: 14395 - protein, 10 aa, Homo sapiens
  light chain complementarity determining region 3 for antibody 7198
QQYGSSPPVT

SEQ ID NO: 14396 - protein, 11 aa, Homo sapiens
  heavy chain complementarity determining region 3 for antibody 7198
AREQHGQAPDY

SEQ ID NO: 14397 - protein, 10 aa, Homo sapiens
  light chain complementarity determining region 3 for antibody 7199
QQYGSSPPVT

SEQ ID NO: 14398 - protein, 19 aa, Homo sapiens
  heavy chain complementarity determining region 3 for antibody 7199
AREAVRCSDGVCYNATFDI

SEQ ID NO: 14399 - protein, 11 aa, Homo sapiens
  light chain complementarity determining region 3 for antibody 7200
QQYGSSPPMYT

SEQ ID NO: 14400 - protein, 16 aa, Homo sapiens
  heavy chain complementarity determining region 3 for antibody 7200
VRDLAGFTRGGSTFDY

SEQ ID NO: 14401 - protein, 11 aa, Homo sapiens
  light chain complementarity determining region 3 for antibody 7201
QQYGSSPPMYT

SEQ ID NO: 14402 - protein, 17 aa, Homo sapiens
  heavy chain complementarity determining region 3 for antibody 7201
ARNTMVGTWQRQGNLDH

SEQ ID NO: 14403 - protein, 11 aa, Homo sapiens
  light chain complementarity determining region 3 for antibody 7202
QQYGSSPPMYT

SEQ ID NO: 14404 - protein, 15 aa, Homo sapiens
  heavy chain complementarity determining region 3 for antibody 7202
ARGLLATGGWYYFDY

SEQ ID NO: 14405 - protein, 11 aa, Homo sapiens
  light chain complementarity determining region 3 for antibody 7203
QQYGSSPPMYT

SEQ ID NO: 14406 - protein, 10 aa, Homo sapiens
  heavy chain complementarity determining region 3 for antibody 7203
ARETSGAYDI

SEQ ID NO: 14407 - protein, 11 aa, Homo sapiens
  light chain complementarity determining region 3 for antibody 7204
QQYGSSPPMYT

SEQ ID NO: 14408 - protein, 16 aa, Homo sapiens
  heavy chain complementarity determining region 3 for antibody 7204
ARDLWVAAWYPGALDV

SEQ ID NO: 14409 - protein, 11 aa, Homo sapiens
  light chain complementarity determining region 3 for antibody 7205
QQYGSSPPMYT

SEQ ID NO: 14410 - protein, 13 aa, Homo sapiens
  heavy chain complementarity determining region 3 for antibody 7205
AKEGSSPGPDFDS

SEQ ID NO: 14411 - protein, 11 aa, Homo sapiens
  light chain complementarity determining region 3 for antibody 7206
QQYGSSPPMYT

SEQ ID NO: 14412 - protein, 13 aa, Homo sapiens
  heavy chain complementarity determining region 3 for antibody 7206
AKEGSAPGPVFEY

SEQ ID NO: 14413 - protein, 11 aa, Homo sapiens
  light chain complementarity determining region 3 for antibody 7207
QQYGSSPPMFT

SEQ ID NO: 14414 - protein, 13 aa, Homo sapiens
  heavy chain complementarity determining region 3 for antibody 7207
AKEGSAPGPDFEY

SEQ ID NO: 14415 - protein, 10 aa, Homo sapiens
  light chain complementarity determining region 3 for antibody 7208
QQYGSSPPLT

SEQ ID NO: 14416 - protein, 20 aa, Homo sapiens
  heavy chain complementarity determining region 3 for antibody 7208
GRDSSRSYSNSWAQYYGTDV

SEQ ID NO: 14417 - protein, 10 aa, Homo sapiens
  light chain complementarity determining region 3 for antibody 7209
QQYGSSPPLT

SEQ ID NO: 14418 - protein, 20 aa, Homo sapiens
  heavy chain complementarity determining region 3 for antibody 7209
GRDSSRSYCNSWAYYYGTDV

SEQ ID NO: 14419 - protein, 10 aa, Homo sapiens
  light chain complementarity determining region 3 for antibody 7210
QQYGSSPPLP

SEQ ID NO: 14420 - protein, 20 aa, Homo sapiens
  heavy chain complementarity determining region 3 for antibody 7210
GRDSSRSYSNSWAYYYGTDV

SEQ ID NO: 14421 - protein, 10 aa, Homo sapiens
  light chain complementarity determining region 3 for antibody 7211
QQYGSSPPIT

SEQ ID NO: 14422 - protein, 11 aa, Homo sapiens
  heavy chain complementarity determining region 3 for antibody 7211
AREQHGQAPGY

SEQ ID NO: 14423 - protein, 10 aa, Homo sapiens
  light chain complementarity determining region 3 for antibody 7212
QQYGSSPPIT

SEQ ID NO: 14424 - protein, 14 aa, Homo sapiens
  heavy chain complementarity determining region 3 for antibody 7212
AKETQLGYYHYMDV

SEQ ID NO: 14425 - protein, 10 aa, Homo sapiens
  light chain complementarity determining region 3 for antibody 7213
QQYGSSPPIT

SEQ ID NO: 14426 - protein, 12 aa, Homo sapiens
  heavy chain complementarity determining region 3 for antibody 7213
AIVVPGRWDLDD

SEQ ID NO: 14427 - protein, 10 aa, Homo sapiens
  light chain complementarity determining region 3 for antibody 7214
QQYGSSPPFT

SEQ ID NO: 14428 - protein, 11 aa, Homo sapiens
  heavy chain complementarity determining region 3 for antibody 7214
AREQHGQAPDY

SEQ ID NO: 14429 - protein, 10 aa, Homo sapiens
  light chain complementarity determining region 3 for antibody 7215
QQYGSSPPDT

SEQ ID NO: 14430 - protein, 13 aa, Homo sapiens
  heavy chain complementarity determining region 3 for antibody 7215
AKEGSSPGPDFEY

SEQ ID NO: 14431 - protein, 9 aa, Homo sapiens
  light chain complementarity determining region 3 for antibody 7216
QQYGSSPNT

SEQ ID NO: 14432 - protein, 17 aa, Homo sapiens
  heavy chain complementarity determining region 3 for antibody 7216
AKGRGSVAMALIYDLDL

SEQ ID NO: 14433 - protein, 10 aa, Homo sapiens
  light chain complementarity determining region 3 for antibody 7217
QQYGSSPLYT

SEQ ID NO: 14434 - protein, 19 aa, Homo sapiens
  heavy chain complementarity determining region 3 for antibody 7217
ARERVRCRSGICYDATFDI

SEQ ID NO: 14435 - protein, 10 aa, Homo sapiens
  light chain complementarity determining region 3 for antibody 7218
QQYGSSPLYT

SEQ ID NO: 14436 - protein, 13 aa, Homo sapiens
  heavy chain complementarity determining region 3 for antibody 7218
AKEGSSPGPDFEY

SEQ ID NO: 14437 - protein, 9 aa, Homo sapiens
  light chain complementarity determining region 3 for antibody 7219
QQYGSSPLT

SEQ ID NO: 14438 - protein, 11 aa, Homo sapiens
  heavy chain complementarity determining region 3 for antibody 7219
GRVIAFDIVDV

SEQ ID NO: 14439 - protein, 9 aa, Homo sapiens
  light chain complementarity determining region 3 for antibody 7220
QQYGSSPLT

SEQ ID NO: 14440 - protein, 10 aa, Homo sapiens
  heavy chain complementarity determining region 3 for antibody 7220
CRDREGFGDV

SEQ ID NO: 14441 - protein, 9 aa, Homo sapiens
  light chain complementarity determining region 3 for antibody 7221
QQYGSSPLT

SEQ ID NO: 14442 - protein, 11 aa, Homo sapiens
  heavy chain complementarity determining region 3 for antibody 7221
ATFGQQWRLAH

SEQ ID NO: 14443 - protein, 9 aa, Homo sapiens
  light chain complementarity determining region 3 for antibody 7222
QQYGSSPLT

SEQ ID NO: 14444 - protein, 17 aa, Homo sapiens
  heavy chain complementarity determining region 3 for antibody 7222
ARNTMVGAWQRQGNLDH

SEQ ID NO: 14445 - protein, 9 aa, Homo sapiens
  light chain complementarity determining region 3 for antibody 7223
QQYGSSPLT

SEQ ID NO: 14446 - protein, 11 aa, Homo sapiens
  heavy chain complementarity determining region 3 for antibody 7223
AKGGFYFLTGD

SEQ ID NO: 14447 - protein, 9 aa, Homo sapiens
  light chain complementarity determining region 3 for antibody 7224
QQYGSSPLT

SEQ ID NO: 14448 - protein, 13 aa, Homo sapiens
  heavy chain complementarity determining region 3 for antibody 7224
AKERSSGWYAWGY

SEQ ID NO: 14449 - protein, 9 aa, Homo sapiens
  light chain complementarity determining region 3 for antibody 7225
QQYGSSPLP

SEQ ID NO: 14450 - protein, 13 aa, Homo sapiens
  heavy chain complementarity determining region 3 for antibody 7225
AKDRSSGWYAWGY

SEQ ID NO: 14451 - protein, 9 aa, Homo sapiens
  light chain complementarity determining region 3 for antibody 7226
QQYGSSPIT

SEQ ID NO: 14452 - protein, 13 aa, Homo sapiens
  heavy chain complementarity determining region 3 for antibody 7226
AKEGSSPGPDFDY

SEQ ID NO: 14453 - protein, 9 aa, Homo sapiens
  light chain complementarity determining region 3 for antibody 7227
QQYGSSPHI

SEQ ID NO: 14454 - protein, 17 aa, Homo sapiens
  heavy chain complementarity determining region 3 for antibody 7227
ARNAMVHGWQRQGSVDH

SEQ ID NO: 14455 - protein, 9 aa, Homo sapiens
  light chain complementarity determining region 3 for antibody 7228
QQYGSSPET

SEQ ID NO: 14456 - protein, 17 aa, Homo sapiens
  heavy chain complementarity determining region 3 for antibody 7228
ARNTMVGTWQRQGNLDH

SEQ ID NO: 14457 - protein, 9 aa, Homo sapiens
  light chain complementarity determining region 3 for antibody 7229
QQYGSSPEP

SEQ ID NO: 14458 - protein, 10 aa, Homo sapiens
  heavy chain complementarity determining region 3 for antibody 7229
ARETSGAYDI

SEQ ID NO: 14459 - protein, 9 aa, Homo sapiens
  light chain complementarity determining region 3 for antibody 7230
QQYGSSPDT

SEQ ID NO: 14460 - protein, 17 aa, Homo sapiens
  heavy chain complementarity determining region 3 for antibody 7230
ARNTMVGTWRRQGNLDH

SEQ ID NO: 14461 - protein, 9 aa, Homo sapiens
  light chain complementarity determining region 3 for antibody 7231
QQYGSSPDT

SEQ ID NO: 14462 - protein, 17 aa, Homo sapiens
  heavy chain complementarity determining region 3 for antibody 7231
ARNTMVGTWQRQGSLDH

SEQ ID NO: 14463 - protein, 9 aa, Homo sapiens
  light chain complementarity determining region 3 for antibody 7232
QQYGSSLWT

SEQ ID NO: 14464 - protein, 19 aa, Homo sapiens
  heavy chain complementarity determining region 3 for antibody 7232
ARYGRYLVVEPAAKDAFDT

SEQ ID NO: 14465 - protein, 8 aa, Homo sapiens
  light chain complementarity determining region 3 for antibody 7233
QQYGSSLT

SEQ ID NO: 14466 - protein, 19 aa, Homo sapiens
  heavy chain complementarity determining region 3 for antibody 7233
ARSIYCSSTSCYKFDALDM

SEQ ID NO: 14467 - protein, 8 aa, Homo sapiens
  light chain complementarity determining region 3 for antibody 7234
QQYGSSLT

SEQ ID NO: 14468 - protein, 13 aa, Homo sapiens
  heavy chain complementarity determining region 3 for antibody 7234
ARRPGLDYVGFES

SEQ ID NO: 14469 - protein, 8 aa, Homo sapiens
  light chain complementarity determining region 3 for antibody 7235
QQYGSSLT

SEQ ID NO: 14470 - protein, 13 aa, Homo sapiens
  heavy chain complementarity determining region 3 for antibody 7235
ARRPGLDYVGFDY

SEQ ID NO: 14471 - protein, 8 aa, Homo sapiens
  light chain complementarity determining region 3 for antibody 7236
QQYGSSLP

SEQ ID NO: 14472 - protein, 19 aa, Homo sapiens
  heavy chain complementarity determining region 3 for antibody 7236
ARWNGIRSQNNCWSGPFDH

SEQ ID NO: 14473 - protein, 8 aa, Homo sapiens
  light chain complementarity determining region 3 for antibody 7237
QQYGSSLP

SEQ ID NO: 14474 - protein, 19 aa, Homo sapiens
  heavy chain complementarity determining region 3 for antibody 7237
AGWNGIRVQNNFWSGPFDH

SEQ ID NO: 14475 - protein, 6 aa, Homo sapiens
  light chain complementarity determining region 3 for antibody 7238
QQYGSS

SEQ ID NO: 14476 - protein, 21 aa, Homo sapiens
  heavy chain complementarity determining region 3 for antibody 7238
ARDLGTYGSGSHQYYYYCMDV

SEQ ID NO: 14477 - protein, 6 aa, Homo sapiens
  light chain complementarity determining region 3 for antibody 7239
QQYGSS

SEQ ID NO: 14478 - protein, 21 aa, Homo sapiens
  heavy chain complementarity determining region 3 for antibody 7239
ARDLGTDGSGSHQYYYYGMDV

SEQ ID NO: 14479 - protein, 9 aa, Homo sapiens
  light chain complementarity determining region 3 for antibody 7240
QQYGSSAPT

SEQ ID NO: 14480 - protein, 16 aa, Homo sapiens
  heavy chain complementarity determining region 3 for antibody 7240
ARHGVLPAAIHDAFDI

SEQ ID NO: 14481 - protein, 9 aa, Homo sapiens
  light chain complementarity determining region 3 for antibody 7241
QQYGSSALT

SEQ ID NO: 14482 - protein, 16 aa, Homo sapiens
  heavy chain complementarity determining region 3 for antibody 7241
ARHGVLPAATHDAFDI

SEQ ID NO: 14483 - protein, 9 aa, Homo sapiens
  light chain complementarity determining region 3 for antibody 7242
QQYGSSALT

SEQ ID NO: 14484 - protein, 16 aa, Homo sapiens
  heavy chain complementarity determining region 3 for antibody 7242
ARHGVLPAASHDAFDI

SEQ ID NO: 14485 - protein, 9 aa, Homo sapiens
  light chain complementarity determining region 3 for antibody 7243
QQYGSSALT

SEQ ID NO: 14486 - protein, 16 aa, Homo sapiens
  heavy chain complementarity determining region 3 for antibody 7243
ARHGVLPAAIRDAFDI

SEQ ID NO: 14487 - protein, 9 aa, Homo sapiens
  light chain complementarity determining region 3 for antibody 7244
QQYGSSALT

SEQ ID NO: 14488 - protein, 16 aa, Homo sapiens
  heavy chain complementarity determining region 3 for antibody 7244
ARHGALPAAIHDAFDI

SEQ ID NO: 14489 - protein, 9 aa, Homo sapiens
  light chain complementarity determining region 3 for antibody 7245
QQYGSSALT

SEQ ID NO: 14490 - protein, 18 aa, Homo sapiens
  heavy chain complementarity determining region 3 for antibody 7245
ARGDYPEARTGYFLDFDY

SEQ ID NO: 14491 - protein, 9 aa, Homo sapiens
  light chain complementarity determining region 3 for antibody 7246
QQYGSSALT

SEQ ID NO: 14492 - protein, 13 aa, Homo sapiens
  heavy chain complementarity determining region 3 for antibody 7246
AKGRGSGWYAWGY

SEQ ID NO: 14493 - protein, 9 aa, Homo sapiens
  light chain complementarity determining region 3 for antibody 7247
QQYGSSALP

SEQ ID NO: 14494 - protein, 13 aa, Homo sapiens
  heavy chain complementarity determining region 3 for antibody 7247
AKDRGSGWYAWGY

SEQ ID NO: 14495 - protein, 9 aa, Homo sapiens
  light chain complementarity determining region 3 for antibody 7248
QQYGSPPRT

SEQ ID NO: 14496 - protein, 10 aa, Homo sapiens
  heavy chain complementarity determining region 3 for antibody 7248
CRDREGFGDV

SEQ ID NO: 14497 - protein, 8 aa, Homo sapiens
  light chain complementarity determining region 3 for antibody 7249
QQYGSPLT

SEQ ID NO: 14498 - protein, 13 aa, Homo sapiens
  heavy chain complementarity determining region 3 for antibody 7249
ARRPGLDYVGFEY

SEQ ID NO: 14499 - protein, 8 aa, Homo sapiens
  light chain complementarity determining region 3 for antibody 7250
QQYGSPLP

SEQ ID NO: 14500 - protein, 19 aa, Homo sapiens
  heavy chain complementarity determining region 3 for antibody 7250
ARWNGIRVQNNFWSGPFDH

SEQ ID NO: 14501 - protein, 9 aa, Homo sapiens
  light chain complementarity determining region 3 for antibody 7251
QQYGRSPWT

SEQ ID NO: 14502 - protein, 10 aa, Homo sapiens
  heavy chain complementarity determining region 3 for antibody 7251
ARERSGSYDI

SEQ ID NO: 14503 - protein, 10 aa, Homo sapiens
  light chain complementarity determining region 3 for antibody 7252
QQYGRSPLYT

SEQ ID NO: 14504 - protein, 13 aa, Homo sapiens
  heavy chain complementarity determining region 3 for antibody 7252
TTYMAARPEYFQH

SEQ ID NO: 14505 - protein, 10 aa, Homo sapiens
  light chain complementarity determining region 3 for antibody 7253
QQYGRSPLYT

SEQ ID NO: 14506 - protein, 13 aa, Homo sapiens
  heavy chain complementarity determining region 3 for antibody 7253
TTYMAARPESFRH

SEQ ID NO: 14507 - protein, 10 aa, Homo sapiens
  light chain complementarity determining region 3 for antibody 7254
QQYGRSPLYT

SEQ ID NO: 14508 - protein, 13 aa, Homo sapiens
  heavy chain complementarity determining region 3 for antibody 7254
TTYMAARHEYFRH

SEQ ID NO: 14509 - protein, 10 aa, Homo sapiens
  light chain complementarity determining region 3 for antibody 7255
QQYGRSPLYT

SEQ ID NO: 14510 - protein, 12 aa, Homo sapiens
  heavy chain complementarity determining region 3 for antibody 7255
ARDKGGRNGMDV

SEQ ID NO: 14511 - protein, 9 aa, Homo sapiens
  light chain complementarity determining region 3 for antibody 7256
QQYGRSPLT

SEQ ID NO: 14512 - protein, 9 aa, Homo sapiens
  heavy chain complementarity determining region 3 for antibody 7256
ARGGGYNYY

SEQ ID NO: 14513 - protein, 9 aa, Homo sapiens
  light chain complementarity determining region 3 for antibody 7257
QQYGRSPLP

SEQ ID NO: 14514 - protein, 9 aa, Homo sapiens
  heavy chain complementarity determining region 3 for antibody 7257
ARGSGYNYY

SEQ ID NO: 14515 - protein, 9 aa, Homo sapiens
  light chain complementarity determining region 3 for antibody 7258
QQYGRSPDT

SEQ ID NO: 14516 - protein, 17 aa, Homo sapiens
  heavy chain complementarity determining region 3 for antibody 7258
ARNTMVGTWQRQGNLDH

SEQ ID NO: 14517 - protein, 9 aa, Homo sapiens
  light chain complementarity determining region 3 for antibody 7259
QQYGNWPWT

SEQ ID NO: 14518 - protein, 17 aa, Homo sapiens
  heavy chain complementarity determining region 3 for antibody 7259
VTHYYHDSGIYYDFFNY

SEQ ID NO: 14519 - protein, 9 aa, Homo sapiens
  light chain complementarity determining region 3 for antibody 7260
QQYGNWPWT

SEQ ID NO: 14520 - protein, 17 aa, Homo sapiens
  heavy chain complementarity determining region 3 for antibody 7260
VTHYYHDSGIYHDFFNY

SEQ ID NO: 14521 - protein, 9 aa, Homo sapiens
  light chain complementarity determining region 3 for antibody 7261
QQYGNTPFT

SEQ ID NO: 14522 - protein, 12 aa, Homo sapiens
  heavy chain complementarity determining region 3 for antibody 7261
NADHGYVDGFDT

SEQ ID NO: 14523 - protein, 9 aa, Homo sapiens
  light chain complementarity determining region 3 for antibody 7262
QQYGNTPFT

SEQ ID NO: 14524 - protein, 10 aa, Homo sapiens
  heavy chain complementarity determining region 3 for antibody 7262
ARETSGAYDI

SEQ ID NO: 14525 - protein, 9 aa, Homo sapiens
  light chain complementarity determining region 3 for antibody 7263
QQYGNSRWT

SEQ ID NO: 14526 - protein, 10 aa, Homo sapiens
  heavy chain complementarity determining region 3 for antibody 7263
TTEDYGAGRS

SEQ ID NO: 14527 - protein, 9 aa, Homo sapiens
  light chain complementarity determining region 3 for antibody 7264
QQYGNSRWT

SEQ ID NO: 14528 - protein, 10 aa, Homo sapiens
  heavy chain complementarity determining region 3 for antibody 7264
CRDREGFGDV

SEQ ID NO: 14529 - protein, 9 aa, Homo sapiens
  light chain complementarity determining region 3 for antibody 7265
QQYGNSRWT

SEQ ID NO: 14530 - protein, 10 aa, Homo sapiens
  heavy chain complementarity determining region 3 for antibody 7265
ATEDWGSGRS

SEQ ID NO: 14531 - protein, 9 aa, Homo sapiens
  light chain complementarity determining region 3 for antibody 7266
QQYGNSRWT

SEQ ID NO: 14532 - protein, 14 aa, Homo sapiens
  heavy chain complementarity determining region 3 for antibody 7266
ARGTIGDYTDYFPY

SEQ ID NO: 14533 - protein, 9 aa, Homo sapiens
  light chain complementarity determining region 3 for antibody 7267
QQYGNSRGT

SEQ ID NO: 14534 - protein, 10 aa, Homo sapiens
  heavy chain complementarity determining region 3 for antibody 7267
TTEDYGSGRS

SEQ ID NO: 14535 - protein, 9 aa, Homo sapiens
  light chain complementarity determining region 3 for antibody 7268
QQYGNSPVP

SEQ ID NO: 14536 - protein, 16 aa, Homo sapiens
  heavy chain complementarity determining region 3 for antibody 7268
VRDLAGFTRGGSTFDY

SEQ ID NO: 14537 - protein, 9 aa, Homo sapiens
  light chain complementarity determining region 3 for antibody 7269
QQYGNSPVP

SEQ ID NO: 14538 - protein, 15 aa, Homo sapiens
  heavy chain complementarity determining region 3 for antibody 7269
GKEGPGSSGWLTGHY

SEQ ID NO: 14539 - protein, 9 aa, Homo sapiens
  light chain complementarity determining region 3 for antibody 7270
QQYGNSPVP

SEQ ID NO: 14540 - protein, 18 aa, Homo sapiens
  heavy chain complementarity determining region 3 for antibody 7270
ERGDYPEARTGYFLDFDY

SEQ ID NO: 14541 - protein, 9 aa, Homo sapiens
  light chain complementarity determining region 3 for antibody 7271
QQYGNSPVP

SEQ ID NO: 14542 - protein, 18 aa, Homo sapiens
  heavy chain complementarity determining region 3 for antibody 7271
ARVDYPEARTGYFLDFDY

SEQ ID NO: 14543 - protein, 9 aa, Homo sapiens
  light chain complementarity determining region 3 for antibody 7272
QQYGNSPVP

SEQ ID NO: 14544 - protein, 18 aa, Homo sapiens
  heavy chain complementarity determining region 3 for antibody 7272
ARSDYPEARTGYFLDFDY

SEQ ID NO: 14545 - protein, 9 aa, Homo sapiens
  light chain complementarity determining region 3 for antibody 7273
QQYGNSPVP

SEQ ID NO: 14546 - protein, 17 aa, Homo sapiens
  heavy chain complementarity determining region 3 for antibody 7273
ARNTMVHGWQRQGSVDH

SEQ ID NO: 14547 - protein, 9 aa, Homo sapiens
  light chain complementarity determining region 3 for antibody 7274
QQYGNSPVP

SEQ ID NO: 14548 - protein, 17 aa, Homo sapiens
  heavy chain complementarity determining region 3 for antibody 7274
ARNTMVGTWQRQGNLDH

SEQ ID NO: 14549 - protein, 9 aa, Homo sapiens
  light chain complementarity determining region 3 for antibody 7275
QQYGNSPVP

SEQ ID NO: 14550 - protein, 18 aa, Homo sapiens
  heavy chain complementarity determining region 3 for antibody 7275
ARGVYPEARTGYFLDFDY

SEQ ID NO: 14551 - protein, 9 aa, Homo sapiens
  light chain complementarity determining region 3 for antibody 7276
QQYGNSPVP

SEQ ID NO: 14552 - protein, 18 aa, Homo sapiens
  heavy chain complementarity determining region 3 for antibody 7276
ARGGYPEARTGYFLDFDY

SEQ ID NO: 14553 - protein, 9 aa, Homo sapiens
  light chain complementarity determining region 3 for antibody 7277
QQYGNSPVP

SEQ ID NO: 14554 - protein, 18 aa, Homo sapiens
  heavy chain complementarity determining region 3 for antibody 7277
ARGDYPEARTGYFPDFDY

SEQ ID NO: 14555 - protein, 9 aa, Homo sapiens
  light chain complementarity determining region 3 for antibody 7278
QQYGNSPVP

SEQ ID NO: 14556 - protein, 18 aa, Homo sapiens
  heavy chain complementarity determining region 3 for antibody 7278
ARGDYPEARTGYFLDFHY

SEQ ID NO: 14557 - protein, 9 aa, Homo sapiens
  light chain complementarity determining region 3 for antibody 7279
QQYGNSPVP

SEQ ID NO: 14558 - protein, 18 aa, Homo sapiens
  heavy chain complementarity determining region 3 for antibody 7279
ARGDYPEARTGYFLDFGY

SEQ ID NO: 14559 - protein, 9 aa, Homo sapiens
  light chain complementarity determining region 3 for antibody 7280
QQYGNSPVP

SEQ ID NO: 14560 - protein, 18 aa, Homo sapiens
  heavy chain complementarity determining region 3 for antibody 7280
ARGDYPEARTGYFLDFDD

SEQ ID NO: 14561 - protein, 9 aa, Homo sapiens
  light chain complementarity determining region 3 for antibody 7281
QQYGNSPVP

SEQ ID NO: 14562 - protein, 18 aa, Homo sapiens
  heavy chain complementarity determining region 3 for antibody 7281
ARGDDPEARTGYFLDFDY

SEQ ID NO: 14563 - protein, 9 aa, Homo sapiens
  light chain complementarity determining region 3 for antibody 7282
QQYGNSPVP

SEQ ID NO: 14564 - protein, 18 aa, Homo sapiens
  heavy chain complementarity determining region 3 for antibody 7282
ARGDCAEARTGYFLDFDY

SEQ ID NO: 14565 - protein, 9 aa, Homo sapiens
  light chain complementarity determining region 3 for antibody 7283
QQYGNSPVP

SEQ ID NO: 14566 - protein, 14 aa, Homo sapiens
  heavy chain complementarity determining region 3 for antibody 7283
ARDTTYNWNDGGIS

SEQ ID NO: 14567 - protein, 9 aa, Homo sapiens
  light chain complementarity determining region 3 for antibody 7284
QQYGNSPVP

SEQ ID NO: 14568 - protein, 9 aa, Homo sapiens
  heavy chain complementarity determining region 3 for antibody 7284
AGWGGLSNY

SEQ ID NO: 14569 - protein, 9 aa, Homo sapiens
  light chain complementarity determining region 3 for antibody 7285
QQYGNSPVP

SEQ ID NO: 14570 - protein, 18 aa, Homo sapiens
  heavy chain complementarity determining region 3 for antibody 7285
AGGDYPEARTGYFLDFDY

SEQ ID NO: 14571 - protein, 9 aa, Homo sapiens
  light chain complementarity determining region 3 for antibody 7286
QQYGNSPVH

SEQ ID NO: 14572 - protein, 18 aa, Homo sapiens
  heavy chain complementarity determining region 3 for antibody 7286
ARGDYPEARTGYFLDFDY

SEQ ID NO: 14573 - protein, 10 aa, Homo sapiens
  light chain complementarity determining region 3 for antibody 7287
QQYGNSPSVP

SEQ ID NO: 14574 - protein, 22 aa, Homo sapiens
  heavy chain complementarity determining region 3 for antibody 7287
ARDKLWSDYVWGNYRPSDAFDF

SEQ ID NO: 14575 - protein, 10 aa, Homo sapiens
  light chain complementarity determining region 3 for antibody 7288
QQYGNSPRYP

SEQ ID NO: 14576 - protein, 18 aa, Homo sapiens
  heavy chain complementarity determining region 3 for antibody 7288
ARWASLCSSANCYVPFDY

SEQ ID NO: 14577 - protein, 11 aa, Homo sapiens
  light chain complementarity determining region 3 for antibody 7289
QQYGNSPPGYT

SEQ ID NO: 14578 - protein, 13 aa, Homo sapiens
  heavy chain complementarity determining region 3 for antibody 7289
ALVRSISCLAFHY

SEQ ID NO: 14579 - protein, 11 aa, Homo sapiens
  light chain complementarity determining region 3 for antibody 7290
QQYGNSPPGYP

SEQ ID NO: 14580 - protein, 13 aa, Homo sapiens
  heavy chain complementarity determining region 3 for antibody 7290
ALVRSISCLSFHY

SEQ ID NO: 14581 - protein, 11 aa, Homo sapiens
  light chain complementarity determining region 3 for antibody 7291
QQYGNSPPGNT

SEQ ID NO: 14582 - protein, 13 aa, Homo sapiens
  heavy chain complementarity determining region 3 for antibody 7291
ALVRSISCLSFHY

SEQ ID NO: 14583 - protein, 9 aa, Homo sapiens
  light chain complementarity determining region 3 for antibody 7292
QQYGNSPPA

SEQ ID NO: 14584 - protein, 18 aa, Homo sapiens
  heavy chain complementarity determining region 3 for antibody 7292
AGGDYPEARTGYYLDFDY

SEQ ID NO: 14585 - protein, 9 aa, Homo sapiens
  light chain complementarity determining region 3 for antibody 7293
QQYGNSPLA

SEQ ID NO: 14586 - protein, 18 aa, Homo sapiens
  heavy chain complementarity determining region 3 for antibody 7293
AGGDYTEARTGYYLDFDY

SEQ ID NO: 14587 - protein, 9 aa, Homo sapiens
  light chain complementarity determining region 3 for antibody 7294
QQYGNSPLA

SEQ ID NO: 14588 - protein, 18 aa, Homo sapiens
  heavy chain complementarity determining region 3 for antibody 7294
AGGDYSEARNGYYLDFDY

SEQ ID NO: 14589 - protein, 9 aa, Homo sapiens
  light chain complementarity determining region 3 for antibody 7295
QQYGNSPLA

SEQ ID NO: 14590 - protein, 18 aa, Homo sapiens
  heavy chain complementarity determining region 3 for antibody 7295
AGGDYPEARTGYYLDFDH

SEQ ID NO: 14591 - protein, 9 aa, Homo sapiens
  light chain complementarity determining region 3 for antibody 7296
QQYGNSPLA

SEQ ID NO: 14592 - protein, 18 aa, Homo sapiens
  heavy chain complementarity determining region 3 for antibody 7296
AGGDYPEARTGYSLDFDY

SEQ ID NO: 14593 - protein, 9 aa, Homo sapiens
  light chain complementarity determining region 3 for antibody 7297
QQYGNSLYT

SEQ ID NO: 14594 - protein, 13 aa, Homo sapiens
  heavy chain complementarity determining region 3 for antibody 7297
TWISSATYLFLHP

SEQ ID NO: 14595 - protein, 9 aa, Homo sapiens
  light chain complementarity determining region 3 for antibody 7298
QQYGNSLYP

SEQ ID NO: 14596 - protein, 13 aa, Homo sapiens
  heavy chain complementarity determining region 3 for antibody 7298
TWISSATYLFLHS

SEQ ID NO: 14597 - protein, 8 aa, Homo sapiens
  light chain complementarity determining region 3 for antibody 7299
QQYGNSLT

SEQ ID NO: 14598 - protein, 18 aa, Homo sapiens
  heavy chain complementarity determining region 3 for antibody 7299
VRWAGIANNDVWSGPFDN

SEQ ID NO: 14599 - protein, 8 aa, Homo sapiens
  light chain complementarity determining region 3 for antibody 7300
QQYGNSLT

SEQ ID NO: 14600 - protein, 18 aa, Homo sapiens
  heavy chain complementarity determining region 3 for antibody 7300
VRWAGIANNDCWSGPFDN

SEQ ID NO: 14601 - protein, 8 aa, Homo sapiens
  light chain complementarity determining region 3 for antibody 7301
QQYGNSLT

SEQ ID NO: 14602 - protein, 17 aa, Homo sapiens
  heavy chain complementarity determining region 3 for antibody 7301
ARNTMVGTWQRQGNLDH

SEQ ID NO: 14603 - protein, 8 aa, Homo sapiens
  light chain complementarity determining region 3 for antibody 7302
QQYGNSLT

SEQ ID NO: 14604 - protein, 16 aa, Homo sapiens
  heavy chain complementarity determining region 3 for antibody 7302
ARHGVLPAAIHDAFDI

SEQ ID NO: 14605 - protein, 8 aa, Homo sapiens
  light chain complementarity determining region 3 for antibody 7303
QQYGNSFP

SEQ ID NO: 14606 - protein, 10 aa, Homo sapiens
  heavy chain complementarity determining region 3 for antibody 7303
CRDREGFGDV

SEQ ID NO: 14607 - protein, 8 aa, Homo sapiens
  light chain complementarity determining region 3 for antibody 7304
QQYGNSFP

SEQ ID NO: 14608 - protein, 16 aa, Homo sapiens
  heavy chain complementarity determining region 3 for antibody 7304
AIWAAVSSGWGGPFDF

SEQ ID NO: 14609 - protein, 9 aa, Homo sapiens
  light chain complementarity determining region 3 for antibody 7305
QQYGNPVYT

SEQ ID NO: 14610 - protein, 15 aa, Homo sapiens
  heavy chain complementarity determining region 3 for antibody 7305
ARVGRPYHNAWYFDN

SEQ ID NO: 14611 - protein, 9 aa, Homo sapiens
  light chain complementarity determining region 3 for antibody 7306
QQYGNPVYT

SEQ ID NO: 14612 - protein, 14 aa, Homo sapiens
  heavy chain complementarity determining region 3 for antibody 7306
ARGHFDSTGFRLDY

SEQ ID NO: 14613 - protein, 9 aa, Homo sapiens
  light chain complementarity determining region 3 for antibody 7307
QQYGNPVYT

SEQ ID NO: 14614 - protein, 11 aa, Homo sapiens
  heavy chain complementarity determining region 3 for antibody 7307
AAVDSWGTHVY

SEQ ID NO: 14615 - protein, 9 aa, Homo sapiens
  light chain complementarity determining region 3 for antibody 7308
QQYGNPVYT

SEQ ID NO: 14616 - protein, 11 aa, Homo sapiens
  heavy chain complementarity determining region 3 for antibody 7308
AAVDSWGALVY

SEQ ID NO: 14617 - protein, 9 aa, Homo sapiens
  light chain complementarity determining region 3 for antibody 7309
QQYGNPVYT

SEQ ID NO: 14618 - protein, 11 aa, Homo sapiens
  heavy chain complementarity determining region 3 for antibody 7309
AAVASWGTLVY

SEQ ID NO: 14619 - protein, 9 aa, Homo sapiens
  light chain complementarity determining region 3 for antibody 7310
QQYGNPVYP

SEQ ID NO: 14620 - protein, 11 aa, Homo sapiens
  heavy chain complementarity determining region 3 for antibody 7310
AAVDSWGTLVY

SEQ ID NO: 14621 - protein, 9 aa, Homo sapiens
  light chain complementarity determining region 3 for antibody 7311
QQYGNPVST

SEQ ID NO: 14622 - protein, 11 aa, Homo sapiens
  heavy chain complementarity determining region 3 for antibody 7311
AAVDSWGTLVY

SEQ ID NO: 14623 - protein, 9 aa, Homo sapiens
  light chain complementarity determining region 3 for antibody 7312
QQYGNPVNT

SEQ ID NO: 14624 - protein, 11 aa, Homo sapiens
  heavy chain complementarity determining region 3 for antibody 7312
AAVDSWGTLVY

SEQ ID NO: 14625 - protein, 9 aa, Homo sapiens
  light chain complementarity determining region 3 for antibody 7313
QQYGNPVFT

SEQ ID NO: 14626 - protein, 11 aa, Homo sapiens
  heavy chain complementarity determining region 3 for antibody 7313
AAVDSWGTLVY

SEQ ID NO: 14627 - protein, 9 aa, Homo sapiens
  light chain complementarity determining region 3 for antibody 7314
QQYGNLSPT

SEQ ID NO: 14628 - protein, 9 aa, Homo sapiens
  heavy chain complementarity determining region 3 for antibody 7314
ARGNGFNMF

SEQ ID NO: 14629 - protein, 9 aa, Homo sapiens
  light chain complementarity determining region 3 for antibody 7315
QQYGNLPPT

SEQ ID NO: 14630 - protein, 9 aa, Homo sapiens
  heavy chain complementarity determining region 3 for antibody 7315
ARGNGFTMF

SEQ ID NO: 14631 - protein, 9 aa, Homo sapiens
  light chain complementarity determining region 3 for antibody 7316
QQYGNLPPA

SEQ ID NO: 14632 - protein, 13 aa, Homo sapiens
  heavy chain complementarity determining region 3 for antibody 7316
TKEGSSAGPDFVY

SEQ ID NO: 14633 - protein, 9 aa, Homo sapiens
  light chain complementarity determining region 3 for antibody 7317
QQYGNKPFT

SEQ ID NO: 14634 - protein, 12 aa, Homo sapiens
  heavy chain complementarity determining region 3 for antibody 7317
NADHGYVDGFDI

SEQ ID NO: 14635 - protein, 7 aa, Homo sapiens
  light chain complementarity determining region 3 for antibody 7318
QQYGIYT

SEQ ID NO: 14636 - protein, 10 aa, Homo sapiens
  heavy chain complementarity determining region 3 for antibody 7318
ARRWERYFDY

SEQ ID NO: 14637 - protein, 9 aa, Homo sapiens
  light chain complementarity determining region 3 for antibody 7319
QQYGHPVYT

SEQ ID NO: 14638 - protein, 11 aa, Homo sapiens
  heavy chain complementarity determining region 3 for antibody 7319
AAVDSWGTLVY

SEQ ID NO: 14639 - protein, 9 aa, Homo sapiens
  light chain complementarity determining region 3 for antibody 7320
QQYGGSSLT

SEQ ID NO: 14640 - protein, 12 aa, Homo sapiens
  heavy chain complementarity determining region 3 for antibody 7320
ARRVAGPYCLDY

SEQ ID NO: 14641 - protein, 10 aa, Homo sapiens
  light chain complementarity determining region 3 for antibody 7321
QQYGGSPRNT

SEQ ID NO: 14642 - protein, 18 aa, Homo sapiens
  heavy chain complementarity determining region 3 for antibody 7321
ARDRGMSVAGTWFAWFDS

SEQ ID NO: 14643 - protein, 10 aa, Homo sapiens
  light chain complementarity determining region 3 for antibody 7322
QQYGGSPRHT

SEQ ID NO: 14644 - protein, 18 aa, Homo sapiens
  heavy chain complementarity determining region 3 for antibody 7322
ARDRGMSVAGTWFAWFDS

SEQ ID NO: 14645 - protein, 10 aa, Homo sapiens
  light chain complementarity determining region 3 for antibody 7323
QQYGGSPRDT

SEQ ID NO: 14646 - protein, 18 aa, Homo sapiens
  heavy chain complementarity determining region 3 for antibody 7323
ARDRGMSVAGTWFAWFDS

SEQ ID NO: 14647 - protein, 9 aa, Homo sapiens
  light chain complementarity determining region 3 for antibody 7324
QQYGGSPQT

SEQ ID NO: 14648 - protein, 10 aa, Homo sapiens
  heavy chain complementarity determining region 3 for antibody 7324
AKYLRRAFDV

SEQ ID NO: 14649 - protein, 11 aa, Homo sapiens
  light chain complementarity determining region 3 for antibody 7325
QQYGGSPPQGT

SEQ ID NO: 14650 - protein, 18 aa, Homo sapiens
  heavy chain complementarity determining region 3 for antibody 7325
AKDNRWYCSTTNCYLFDS

SEQ ID NO: 14651 - protein, 10 aa, Homo sapiens
  light chain complementarity determining region 3 for antibody 7326
QQYGGSPPLT

SEQ ID NO: 14652 - protein, 14 aa, Homo sapiens
  heavy chain complementarity determining region 3 for antibody 7326
AKTTLITTAWGMDV

SEQ ID NO: 14653 - protein, 11 aa, Homo sapiens
  light chain complementarity determining region 3 for antibody 7327
QQYGGSPPGGT

SEQ ID NO: 14654 - protein, 18 aa, Homo sapiens
  heavy chain complementarity determining region 3 for antibody 7327
AKDNRWYCSTTNCYLFDS

SEQ ID NO: 14655 - protein, 10 aa, Homo sapiens
  light chain complementarity determining region 3 for antibody 7328
QQYGGSPPFT

SEQ ID NO: 14656 - protein, 12 aa, Homo sapiens
  heavy chain complementarity determining region 3 for antibody 7328
ARDKGGRNGMDV

SEQ ID NO: 14657 - protein, 10 aa, Homo sapiens
  light chain complementarity determining region 3 for antibody 7329
QQYGGSPPFT

SEQ ID NO: 14658 - protein, 14 aa, Homo sapiens
  heavy chain complementarity determining region 3 for antibody 7329
AKTTRITTAWGMDV

SEQ ID NO: 14659 - protein, 10 aa, Homo sapiens
  light chain complementarity determining region 3 for antibody 7330
QQYGGSPPFT

SEQ ID NO: 14660 - protein, 14 aa, Homo sapiens
  heavy chain complementarity determining region 3 for antibody 7330
AKTTLMTTAWGMDV

SEQ ID NO: 14661 - protein, 10 aa, Homo sapiens
  light chain complementarity determining region 3 for antibody 7331
QQYGGSPPFT

SEQ ID NO: 14662 - protein, 14 aa, Homo sapiens
  heavy chain complementarity determining region 3 for antibody 7331
AKTTLITTAWRMDV

SEQ ID NO: 14663 - protein, 10 aa, Homo sapiens
  light chain complementarity determining region 3 for antibody 7332
QQYGGSPPFT

SEQ ID NO: 14664 - protein, 14 aa, Homo sapiens
  heavy chain complementarity determining region 3 for antibody 7332
AKTTLITPAWGMDV

SEQ ID NO: 14665 - protein, 10 aa, Homo sapiens
  light chain complementarity determining region 3 for antibody 7333
QQYGGSPPFT

SEQ ID NO: 14666 - protein, 14 aa, Homo sapiens
  heavy chain complementarity determining region 3 for antibody 7333
AKTTLIATAWGMDV

SEQ ID NO: 14667 - protein, 10 aa, Homo sapiens
  light chain complementarity determining region 3 for antibody 7334
QQYGGSPPFT

SEQ ID NO: 14668 - protein, 14 aa, Homo sapiens
  heavy chain complementarity determining region 3 for antibody 7334
AKTSLITTAWGMDV

SEQ ID NO: 14669 - protein, 11 aa, Homo sapiens
  light chain complementarity determining region 3 for antibody 7335
QQYGGSPPEGT

SEQ ID NO: 14670 - protein, 18 aa, Homo sapiens
  heavy chain complementarity determining region 3 for antibody 7335
ARDNRWYCSTTNCYLFDS

SEQ ID NO: 14671 - protein, 11 aa, Homo sapiens
  light chain complementarity determining region 3 for antibody 7336
QQYGGSPPEGT

SEQ ID NO: 14672 - protein, 18 aa, Homo sapiens
  heavy chain complementarity determining region 3 for antibody 7336
AKDNRWYRSTTNCYLFDS

SEQ ID NO: 14673 - protein, 11 aa, Homo sapiens
  light chain complementarity determining region 3 for antibody 7337
QQYGGSPPEGT

SEQ ID NO: 14674 - protein, 18 aa, Homo sapiens
  heavy chain complementarity determining region 3 for antibody 7337
AKDNRWYCSTTTCYLFDS

SEQ ID NO: 14675 - protein, 11 aa, Homo sapiens
  light chain complementarity determining region 3 for antibody 7338
QQYGGSPPEGT

SEQ ID NO: 14676 - protein, 18 aa, Homo sapiens
  heavy chain complementarity determining region 3 for antibody 7338
AKDNRWYCSTTNGYLFDS

SEQ ID NO: 14677 - protein, 11 aa, Homo sapiens
  light chain complementarity determining region 3 for antibody 7339
QQYGGSPPEGT

SEQ ID NO: 14678 - protein, 18 aa, Homo sapiens
  heavy chain complementarity determining region 3 for antibody 7339
AKDNRWYCSTTNCYLLDS

SEQ ID NO: 14679 - protein, 11 aa, Homo sapiens
  light chain complementarity determining region 3 for antibody 7340
QQYGGSPPEGT

SEQ ID NO: 14680 - protein, 18 aa, Homo sapiens
  heavy chain complementarity determining region 3 for antibody 7340
AKDNRWYCSTTNCYLFGS

SEQ ID NO: 14681 - protein, 11 aa, Homo sapiens
  light chain complementarity determining region 3 for antibody 7341
QQYGGSPPEGT

SEQ ID NO: 14682 - protein, 18 aa, Homo sapiens
  heavy chain complementarity determining region 3 for antibody 7341
AKDNRWYCSTTNCFLFDS

SEQ ID NO: 14683 - protein, 11 aa, Homo sapiens
  light chain complementarity determining region 3 for antibody 7342
QQYGGSPPEGT

SEQ ID NO: 14684 - protein, 18 aa, Homo sapiens
  heavy chain complementarity determining region 3 for antibody 7342
AKDNRWYCSTANCYLFDS

SEQ ID NO: 14685 - protein, 11 aa, Homo sapiens
  light chain complementarity determining region 3 for antibody 7343
QQYGGSPPEGT

SEQ ID NO: 14686 - protein, 10 aa, Homo sapiens
  heavy chain complementarity determining region 3 for antibody 7343
AHRINRAFDI

SEQ ID NO: 14687 - protein, 10 aa, Homo sapiens
  light chain complementarity determining region 3 for antibody 7344
QQYGGSPMYT

SEQ ID NO: 14688 - protein, 13 aa, Homo sapiens
  heavy chain complementarity determining region 3 for antibody 7344
TADVYDYVWGPRW

SEQ ID NO: 14689 - protein, 10 aa, Homo sapiens
  light chain complementarity determining region 3 for antibody 7345
QQYGGSPMYT

SEQ ID NO: 14690 - protein, 13 aa, Homo sapiens
  heavy chain complementarity determining region 3 for antibody 7345
AADFYDYVWGPRW

SEQ ID NO: 14691 - protein, 9 aa, Homo sapiens
  light chain complementarity determining region 3 for antibody 7346
QQYGGSPLT

SEQ ID NO: 14692 - protein, 10 aa, Homo sapiens
  heavy chain complementarity determining region 3 for antibody 7346
CRDRWGFGDV

SEQ ID NO: 14693 - protein, 9 aa, Homo sapiens
  light chain complementarity determining region 3 for antibody 7347
QQYGGSLPT

SEQ ID NO: 14694 - protein, 10 aa, Homo sapiens
  heavy chain complementarity determining region 3 for antibody 7347
CRDRWGFGDV

SEQ ID NO: 14695 - protein, 9 aa, Homo sapiens
  light chain complementarity determining region 3 for antibody 7348
QQYGGSLLT

SEQ ID NO: 14696 - protein, 10 aa, Homo sapiens
  heavy chain complementarity determining region 3 for antibody 7348
CRDRWGLGDV

SEQ ID NO: 14697 - protein, 9 aa, Homo sapiens
  light chain complementarity determining region 3 for antibody 7349
QQYGGSLLT

SEQ ID NO: 14698 - protein, 10 aa, Homo sapiens
  heavy chain complementarity determining region 3 for antibody 7349
CRDRWGFGDA

SEQ ID NO: 14699 - protein, 9 aa, Homo sapiens
  light chain complementarity determining region 3 for antibody 7350
QQYGGSLLT

SEQ ID NO: 14700 - protein, 12 aa, Homo sapiens
  heavy chain complementarity determining region 3 for antibody 7350
ARDKGGRNGMDV

SEQ ID NO: 14701 - protein, 9 aa, Homo sapiens
  light chain complementarity determining region 3 for antibody 7351
QQYGGSLLT

SEQ ID NO: 14702 - protein, 13 aa, Homo sapiens
  heavy chain complementarity determining region 3 for antibody 7351
AKEGSSPGPDFEY

SEQ ID NO: 14703 - protein, 9 aa, Homo sapiens
  light chain complementarity determining region 3 for antibody 7352
QQYGGSLIP

SEQ ID NO: 14704 - protein, 10 aa, Homo sapiens
  heavy chain complementarity determining region 3 for antibody 7352
CRDRWGFGDV

SEQ ID NO: 14705 - protein, 9 aa, Homo sapiens
  light chain complementarity determining region 3 for antibody 7353
QQYGGSLFT

SEQ ID NO: 14706 - protein, 10 aa, Homo sapiens
  heavy chain complementarity determining region 3 for antibody 7353
CRDRWGFGDV

SEQ ID NO: 14707 - protein, 10 aa, Homo sapiens
  light chain complementarity determining region 3 for antibody 7354
QQYGGPPRYT

SEQ ID NO: 14708 - protein, 18 aa, Homo sapiens
  heavy chain complementarity determining region 3 for antibody 7354
ARDRGMSVAGTWFAWFDS

SEQ ID NO: 14709 - protein, 9 aa, Homo sapiens
  light chain complementarity determining region 3 for antibody 7355
QQYGGLPPT

SEQ ID NO: 14710 - protein, 9 aa, Homo sapiens
  heavy chain complementarity determining region 3 for antibody 7355
ARGNGFNLF

SEQ ID NO: 14711 - protein, 9 aa, Homo sapiens
  light chain complementarity determining region 3 for antibody 7356
QQYGGALLT

SEQ ID NO: 14712 - protein, 10 aa, Homo sapiens
  heavy chain complementarity determining region 3 for antibody 7356
CRDRWGFGDV

SEQ ID NO: 14713 - protein, 9 aa, Homo sapiens
  light chain complementarity determining region 3 for antibody 7357
QQYGELALT

SEQ ID NO: 14714 - protein, 13 aa, Homo sapiens
  heavy chain complementarity determining region 3 for antibody 7357
AEDRGSGWYAWGY

SEQ ID NO: 14715 - protein, 9 aa, Homo sapiens
  light chain complementarity determining region 3 for antibody 7358
QQYGDSTVP

SEQ ID NO: 14716 - protein, 18 aa, Homo sapiens
  heavy chain complementarity determining region 3 for antibody 7358
ARGDYPEARTGYFLDFDY

SEQ ID NO: 14717 - protein, 9 aa, Homo sapiens
  light chain complementarity determining region 3 for antibody 7359
QQYGDSPVP

SEQ ID NO: 14718 - protein, 18 aa, Homo sapiens
  heavy chain complementarity determining region 3 for antibody 7359
ARGDYPEARTGYFLDLDY

SEQ ID NO: 14719 - protein, 9 aa, Homo sapiens
  light chain complementarity determining region 3 for antibody 7360
QQYGDSPVP

SEQ ID NO: 14720 - protein, 18 aa, Homo sapiens
  heavy chain complementarity determining region 3 for antibody 7360
ARGDYPEARTGYFLDFDD

SEQ ID NO: 14721 - protein, 9 aa, Homo sapiens
  light chain complementarity determining region 3 for antibody 7361
QQYGDSPVP

SEQ ID NO: 14722 - protein, 18 aa, Homo sapiens
  heavy chain complementarity determining region 3 for antibody 7361
ARGDYPEARTGYCLDFDY

SEQ ID NO: 14723 - protein, 9 aa, Homo sapiens
  light chain complementarity determining region 3 for antibody 7362
QQYGDSPVP

SEQ ID NO: 14724 - protein, 18 aa, Homo sapiens
  heavy chain complementarity determining region 3 for antibody 7362
ARGDCPEARTGYFLDFDY

SEQ ID NO: 14725 - protein, 9 aa, Homo sapiens
  light chain complementarity determining region 3 for antibody 7363
QQYGDSPVP

SEQ ID NO: 14726 - protein, 18 aa, Homo sapiens
  heavy chain complementarity determining region 3 for antibody 7363
AKGDYPEARTGYFLDFDY

SEQ ID NO: 14727 - protein, 9 aa, Homo sapiens
  light chain complementarity determining region 3 for antibody 7364
QQYGDSPVP

SEQ ID NO: 14728 - protein, 18 aa, Homo sapiens
  heavy chain complementarity determining region 3 for antibody 7364
AGGDYPEARTGYFLDFDY

SEQ ID NO: 14729 - protein, 9 aa, Homo sapiens
  light chain complementarity determining region 3 for antibody 7365
QQYGDSPAP

SEQ ID NO: 14730 - protein, 18 aa, Homo sapiens
  heavy chain complementarity determining region 3 for antibody 7365
ARGDYPEARTGYFLDFDY

SEQ ID NO: 14731 - protein, 8 aa, Homo sapiens
  light chain complementarity determining region 3 for antibody 7366
QQYGDSFS

SEQ ID NO: 14732 - protein, 12 aa, Homo sapiens
  heavy chain complementarity determining region 3 for antibody 7366
ARDKGGLNGMDV

SEQ ID NO: 14733 - protein, 8 aa, Homo sapiens
  light chain complementarity determining region 3 for antibody 7367
QQYGDSFP

SEQ ID NO: 14734 - protein, 10 aa, Homo sapiens
  heavy chain complementarity determining region 3 for antibody 7367
CRDRWGFGDV

SEQ ID NO: 14735 - protein, 8 aa, Homo sapiens
  light chain complementarity determining region 3 for antibody 7368
QQYGDSFP

SEQ ID NO: 14736 - protein, 16 aa, Homo sapiens
  heavy chain complementarity determining region 3 for antibody 7368
AYWAGVASSWSGPLDY

SEQ ID NO: 14737 - protein, 8 aa, Homo sapiens
  light chain complementarity determining region 3 for antibody 7369
QQYGDSFP

SEQ ID NO: 14738 - protein, 14 aa, Homo sapiens
  heavy chain complementarity determining region 3 for antibody 7369
ARGTPGDYTDYFPY

SEQ ID NO: 14739 - protein, 8 aa, Homo sapiens
  light chain complementarity determining region 3 for antibody 7370
QQYGDSFP

SEQ ID NO: 14740 - protein, 16 aa, Homo sapiens
  heavy chain complementarity determining region 3 for antibody 7370
AKERGYSSAWYGELDY

SEQ ID NO: 14741 - protein, 8 aa, Homo sapiens
  light chain complementarity determining region 3 for antibody 7371
QQYGDSFP

SEQ ID NO: 14742 - protein, 13 aa, Homo sapiens
  heavy chain complementarity determining region 3 for antibody 7371
AKEGSSPGPDFEY

SEQ ID NO: 14743 - protein, 9 aa, Homo sapiens
  light chain complementarity determining region 3 for antibody 7372
QQYGATPLT

SEQ ID NO: 14744 - protein, 6 aa, Homo sapiens
  heavy chain complementarity determining region 3 for antibody 7372
TTGYHA

SEQ ID NO: 14745 - protein, 9 aa, Homo sapiens
  light chain complementarity determining region 3 for antibody 7373
QQYGASPRT

SEQ ID NO: 14746 - protein, 17 aa, Homo sapiens
  heavy chain complementarity determining region 3 for antibody 7373
ATTDGSGNSHYYHGMDV

SEQ ID NO: 14747 - protein, 9 aa, Homo sapiens
  light chain complementarity determining region 3 for antibody 7374
QQYFVSPIT

SEQ ID NO: 14748 - protein, 8 aa, Homo sapiens
  heavy chain complementarity determining region 3 for antibody 7374
ARRNDFDH

SEQ ID NO: 14749 - protein, 9 aa, Homo sapiens
  light chain complementarity determining region 3 for antibody 7375
QQYFSNSPT

SEQ ID NO: 14750 - protein, 12 aa, Homo sapiens
  heavy chain complementarity determining region 3 for antibody 7375
AREGQQLVPIDY

SEQ ID NO: 14751 - protein, 9 aa, Homo sapiens
  light chain complementarity determining region 3 for antibody 7376
QQYFSAPLT

SEQ ID NO: 14752 - protein, 11 aa, Homo sapiens
  heavy chain complementarity determining region 3 for antibody 7376
ARDRANSYSDY

SEQ ID NO: 14753 - protein, 9 aa, Homo sapiens
  light chain complementarity determining region 3 for antibody 7377
QQYFNNPLT

SEQ ID NO: 14754 - protein, 17 aa, Homo sapiens
  heavy chain complementarity determining region 3 for antibody 7377
ARKSYYYDSSDFGWFGP

SEQ ID NO: 14755 - protein, 9 aa, Homo sapiens
  light chain complementarity determining region 3 for antibody 7378
QQYFNIPFT

SEQ ID NO: 14756 - protein, 14 aa, Homo sapiens
  heavy chain complementarity determining region 3 for antibody 7378
AKGRIASCYDASDI

SEQ ID NO: 14757 - protein, 9 aa, Homo sapiens
  light chain complementarity determining region 3 for antibody 7379
QQYFNIPFA

SEQ ID NO: 14758 - protein, 14 aa, Homo sapiens
  heavy chain complementarity determining region 3 for antibody 7379
AKGRIASCYDVSDM

SEQ ID NO: 14759 - protein, 9 aa, Homo sapiens
  light chain complementarity determining region 3 for antibody 7380
QQYFNAPVA

SEQ ID NO: 14760 - protein, 17 aa, Homo sapiens
  heavy chain complementarity determining region 3 for antibody 7380
ASLRGWSDSYGFGVSEY

SEQ ID NO: 14761 - protein, 9 aa, Homo sapiens
  light chain complementarity determining region 3 for antibody 7381
QQYFGWPLP

SEQ ID NO: 14762 - protein, 14 aa, Homo sapiens
  heavy chain complementarity determining region 3 for antibody 7381
TRGSGTYYAGSSDY

SEQ ID NO: 14763 - protein, 9 aa, Homo sapiens
  light chain complementarity determining region 3 for antibody 7382
QQYEDDPLT

SEQ ID NO: 14764 - protein, 11 aa, Homo sapiens
  heavy chain complementarity determining region 3 for antibody 7382
ARRFFKIGFDH

SEQ ID NO: 14765 - protein, 9 aa, Homo sapiens
  light chain complementarity determining region 3 for antibody 7383
QQYDYWPWT

SEQ ID NO: 14766 - protein, 17 aa, Homo sapiens
  heavy chain complementarity determining region 3 for antibody 7383
VTHYYHDSGIYHDFFNY

SEQ ID NO: 14767 - protein, 10 aa, Homo sapiens
  light chain complementarity determining region 3 for antibody 7384
QQYDYSTPWT

SEQ ID NO: 14768 - protein, 14 aa, Homo sapiens
  heavy chain complementarity determining region 3 for antibody 7384
SHPTRAARLPIFDY

SEQ ID NO: 14769 - protein, 10 aa, Homo sapiens
  light chain complementarity determining region 3 for antibody 7385
QQYDYSPPWT

SEQ ID NO: 14770 - protein, 14 aa, Homo sapiens
  heavy chain complementarity determining region 3 for antibody 7385
SRPTRGARLPIFDY

SEQ ID NO: 14771 - protein, 10 aa, Homo sapiens
  light chain complementarity determining region 3 for antibody 7386
QQYDYSPPWT

SEQ ID NO: 14772 - protein, 14 aa, Homo sapiens
  heavy chain complementarity determining region 3 for antibody 7386
SRPTRAARLPIFDY

SEQ ID NO: 14773 - protein, 10 aa, Homo sapiens
  light chain complementarity determining region 3 for antibody 7387
QQYDYSPPWT

SEQ ID NO: 14774 - protein, 14 aa, Homo sapiens
  heavy chain complementarity determining region 3 for antibody 7387
SPPTRGARLPIFDY

SEQ ID NO: 14775 - protein, 10 aa, Homo sapiens
  light chain complementarity determining region 3 for antibody 7388
QQYDYSPPWT

SEQ ID NO: 14776 - protein, 14 aa, Homo sapiens
  heavy chain complementarity determining region 3 for antibody 7388
SHPTRAARRPIFDY

SEQ ID NO: 14777 - protein, 10 aa, Homo sapiens
  light chain complementarity determining region 3 for antibody 7389
QQYDYSPPWT

SEQ ID NO: 14778 - protein, 14 aa, Homo sapiens
  heavy chain complementarity determining region 3 for antibody 7389
SHPTRAARLPIFDS

SEQ ID NO: 14779 - protein, 10 aa, Homo sapiens
  light chain complementarity determining region 3 for antibody 7390
QQYDYSPPWT

SEQ ID NO: 14780 - protein, 14 aa, Homo sapiens
  heavy chain complementarity determining region 3 for antibody 7390
SHPTKAARLPTFDY

SEQ ID NO: 14781 - protein, 10 aa, Homo sapiens
  light chain complementarity determining region 3 for antibody 7391
QQYDYSPPWT

SEQ ID NO: 14782 - protein, 14 aa, Homo sapiens
  heavy chain complementarity determining region 3 for antibody 7391
SHPTKAACLPIFDY

SEQ ID NO: 14783 - protein, 10 aa, Homo sapiens
  light chain complementarity determining region 3 for antibody 7392
QQYDYSPPWT

SEQ ID NO: 14784 - protein, 14 aa, Homo sapiens
  heavy chain complementarity determining region 3 for antibody 7392
SHPPKAARLPIFDY

SEQ ID NO: 14785 - protein, 10 aa, Homo sapiens
  light chain complementarity determining region 3 for antibody 7393
QQYDYSPPWT

SEQ ID NO: 14786 - protein, 14 aa, Homo sapiens
  heavy chain complementarity determining region 3 for antibody 7393
SHMTKAARLPIFDY

SEQ ID NO: 14787 - protein, 10 aa, Homo sapiens
  light chain complementarity determining region 3 for antibody 7394
QQYDYSPPWT

SEQ ID NO: 14788 - protein, 12 aa, Homo sapiens
  heavy chain complementarity determining region 3 for antibody 7394
AIVVPGRWDLDD

SEQ ID NO: 14789 - protein, 10 aa, Homo sapiens
  light chain complementarity determining region 3 for antibody 7395
QQYDYSPPGT

SEQ ID NO: 14790 - protein, 14 aa, Homo sapiens
  heavy chain complementarity determining region 3 for antibody 7395
SHPTRGARLPIFDY

SEQ ID NO: 14791 - protein, 10 aa, Homo sapiens
  light chain complementarity determining region 3 for antibody 7396
QQYDYSPPGT

SEQ ID NO: 14792 - protein, 14 aa, Homo sapiens
  heavy chain complementarity determining region 3 for antibody 7396
SHPTKAARLPIFDY

SEQ ID NO: 14793 - protein, 9 aa, Homo sapiens
  light chain complementarity determining region 3 for antibody 7397
QQYDTWPWT

SEQ ID NO: 14794 - protein, 17 aa, Homo sapiens
  heavy chain complementarity determining region 3 for antibody 7397
VTHYYHDSGIYYDFFNY

SEQ ID NO: 14795 - protein, 10 aa, Homo sapiens
  light chain complementarity determining region 3 for antibody 7398
QQYDTWPPWR

SEQ ID NO: 14796 - protein, 15 aa, Homo sapiens
  heavy chain complementarity determining region 3 for antibody 7398
ARDIRVGASKYYFDY

SEQ ID NO: 14797 - protein, 9 aa, Homo sapiens
  light chain complementarity determining region 3 for antibody 7399
QQYDTSPLT

SEQ ID NO: 14798 - protein, 17 aa, Homo sapiens
  heavy chain complementarity determining region 3 for antibody 7399
ARNTMVGAWQRQGNLDH

SEQ ID NO: 14799 - protein, 9 aa, Homo sapiens
  light chain complementarity determining region 3 for antibody 7400
QQYDTSPLT

SEQ ID NO: 14800 - protein, 14 aa, Homo sapiens
  heavy chain complementarity determining region 3 for antibody 7400
ARASGGDTDFLIDF

SEQ ID NO: 14801 - protein, 9 aa, Homo sapiens
  light chain complementarity determining region 3 for antibody 7401
QQYDTLPLT

SEQ ID NO: 14802 - protein, 21 aa, Homo sapiens
  heavy chain complementarity determining region 3 for antibody 7401
ARATQRRFCSTTSCYPDAFDV

SEQ ID NO: 14803 - protein, 9 aa, Homo sapiens
  light chain complementarity determining region 3 for antibody 7402
QQYDTLPLT

SEQ ID NO: 14804 - protein, 21 aa, Homo sapiens
  heavy chain complementarity determining region 3 for antibody 7402
ARATERRFCSTTSCYTDAFDV

SEQ ID NO: 14805 - protein, 10 aa, Homo sapiens
  light chain complementarity determining region 3 for antibody 7403
QQYDTLASLT

SEQ ID NO: 14806 - protein, 13 aa, Homo sapiens
  heavy chain complementarity determining region 3 for antibody 7403
AKEGSSPGPDFEY

SEQ ID NO: 14807 - protein, 9 aa, Homo sapiens
  light chain complementarity determining region 3 for antibody 7404
QQYDTAPFT

SEQ ID NO: 14808 - protein, 10 aa, Homo sapiens
  heavy chain complementarity determining region 3 for antibody 7404
VREGNWNLDY

SEQ ID NO: 14809 - protein, 9 aa, Homo sapiens
  light chain complementarity determining region 3 for antibody 7405
QQYDSYSRT

SEQ ID NO: 14810 - protein, 16 aa, Homo sapiens
  heavy chain complementarity determining region 3 for antibody 7405
VGPHLTYNSGWRYFDY

SEQ ID NO: 14811 - protein, 9 aa, Homo sapiens
  light chain complementarity determining region 3 for antibody 7406
QQYDSYPLT

SEQ ID NO: 14812 - protein, 10 aa, Homo sapiens
  heavy chain complementarity determining region 3 for antibody 7406
CRDRWGFGDV

SEQ ID NO: 14813 - protein, 9 aa, Homo sapiens
  light chain complementarity determining region 3 for antibody 7407
QQYDSSPYT

SEQ ID NO: 14814 - protein, 14 aa, Homo sapiens
  heavy chain complementarity determining region 3 for antibody 7407
ARDRWGFRGDAFDI

SEQ ID NO: 14815 - protein, 10 aa, Homo sapiens
  light chain complementarity determining region 3 for antibody 7408
QQYDSSPPWT

SEQ ID NO: 14816 - protein, 14 aa, Homo sapiens
  heavy chain complementarity determining region 3 for antibody 7408
SHPTRAARLPIFDY

SEQ ID NO: 14817 - protein, 10 aa, Homo sapiens
  light chain complementarity determining region 3 for antibody 7409
QQYDSSPPWT

SEQ ID NO: 14818 - protein, 14 aa, Homo sapiens
  heavy chain complementarity determining region 3 for antibody 7409
SHPTKAARLPIFDY

SEQ ID NO: 14819 - protein, 9 aa, Homo sapiens
  light chain complementarity determining region 3 for antibody 7410
QQYDSLPRT

SEQ ID NO: 14820 - protein, 9 aa, Homo sapiens
  heavy chain complementarity determining region 3 for antibody 7410
ARGRSNFRH

SEQ ID NO: 14821 - protein, 9 aa, Homo sapiens
  light chain complementarity determining region 3 for antibody 7411
QQYDSLPPA

SEQ ID NO: 14822 - protein, 13 aa, Homo sapiens
  heavy chain complementarity determining region 3 for antibody 7411
TKEGSSAGPDFVY

SEQ ID NO: 14823 - protein, 9 aa, Homo sapiens
  light chain complementarity determining region 3 for antibody 7412
QQYDSLPFT

SEQ ID NO: 14824 - protein, 14 aa, Homo sapiens
  heavy chain complementarity determining region 3 for antibody 7412
ARSRFSGNYFSLKY

SEQ ID NO: 14825 - protein, 9 aa, Homo sapiens
  light chain complementarity determining region 3 for antibody 7413
QQYDSFPYT

SEQ ID NO: 14826 - protein, 17 aa, Homo sapiens
  heavy chain complementarity determining region 3 for antibody 7413
AREDWSDVDLRAFYFDS

SEQ ID NO: 14827 - protein, 9 aa, Homo sapiens
  light chain complementarity determining region 3 for antibody 7414
QQYDRYANT

SEQ ID NO: 14828 - protein, 14 aa, Homo sapiens
  heavy chain complementarity determining region 3 for antibody 7414
ARDVHTTGWTLGGY

SEQ ID NO: 14829 - protein, 9 aa, Homo sapiens
  light chain complementarity determining region 3 for antibody 7415
QQYDRYAHT

SEQ ID NO: 14830 - protein, 14 aa, Homo sapiens
  heavy chain complementarity determining region 3 for antibody 7415
ARDVRTTGWTLGGY

SEQ ID NO: 14831 - protein, 9 aa, Homo sapiens
  light chain complementarity determining region 3 for antibody 7416
QQYDRYAHT

SEQ ID NO: 14832 - protein, 14 aa, Homo sapiens
  heavy chain complementarity determining region 3 for antibody 7416
ARDVQTTGWTLGGY

SEQ ID NO: 14833 - protein, 9 aa, Homo sapiens
  light chain complementarity determining region 3 for antibody 7417
QQYDRYAHT

SEQ ID NO: 14834 - protein, 14 aa, Homo sapiens
  heavy chain complementarity determining region 3 for antibody 7417
ARDVHTTGWTVGGY

SEQ ID NO: 14835 - protein, 9 aa, Homo sapiens
  light chain complementarity determining region 3 for antibody 7418
QQYDRYAHT

SEQ ID NO: 14836 - protein, 14 aa, Homo sapiens
  heavy chain complementarity determining region 3 for antibody 7418
ARDVHTTGWTLVGY

SEQ ID NO: 14837 - protein, 9 aa, Homo sapiens
  light chain complementarity determining region 3 for antibody 7419
QQYDRYAHT

SEQ ID NO: 14838 - protein, 14 aa, Homo sapiens
  heavy chain complementarity determining region 3 for antibody 7419
ARDVHTTGCTLGGY

SEQ ID NO: 14839 - protein, 9 aa, Homo sapiens
  light chain complementarity determining region 3 for antibody 7420
QQYDRYAHT

SEQ ID NO: 14840 - protein, 14 aa, Homo sapiens
  heavy chain complementarity determining region 3 for antibody 7420
ARDGHTTGWTLGGY

SEQ ID NO: 14841 - protein, 9 aa, Homo sapiens
  light chain complementarity determining region 3 for antibody 7421
QQYDRYAHT

SEQ ID NO: 14842 - protein, 12 aa, Homo sapiens
  heavy chain complementarity determining region 3 for antibody 7421
AIVVPGRWDLDD

SEQ ID NO: 14843 - protein, 9 aa, Homo sapiens
  light chain complementarity determining region 3 for antibody 7422
QQYDRAPDT

SEQ ID NO: 14844 - protein, 14 aa, Homo sapiens
  heavy chain complementarity determining region 3 for antibody 7422
ARLHGSGLGRWLDP

SEQ ID NO: 14845 - protein, 9 aa, Homo sapiens
  light chain complementarity determining region 3 for antibody 7423
QQYDRAPDT

SEQ ID NO: 14846 - protein, 11 aa, Homo sapiens
  heavy chain complementarity determining region 3 for antibody 7423
AREATEATPGY

SEQ ID NO: 14847 - protein, 9 aa, Homo sapiens
  light chain complementarity determining region 3 for antibody 7424
QQYDRAPDT

SEQ ID NO: 14848 - protein, 11 aa, Homo sapiens
  heavy chain complementarity determining region 3 for antibody 7424
AKEATEATPGY

SEQ ID NO: 14849 - protein, 9 aa, Homo sapiens
  light chain complementarity determining region 3 for antibody 7425
QQYDRAPDT

SEQ ID NO: 14850 - protein, 11 aa, Homo sapiens
  heavy chain complementarity determining region 3 for antibody 7425
AKEAAETTPGY

SEQ ID NO: 14851 - protein, 9 aa, Homo sapiens
  light chain complementarity determining region 3 for antibody 7426
QQYDRAPAT

SEQ ID NO: 14852 - protein, 11 aa, Homo sapiens
  heavy chain complementarity determining region 3 for antibody 7426
AKEATETTPGY

SEQ ID NO: 14853 - protein, 8 aa, Homo sapiens
  light chain complementarity determining region 3 for antibody 7427
QQYDPSLT

SEQ ID NO: 14854 - protein, 14 aa, Homo sapiens
  heavy chain complementarity determining region 3 for antibody 7427
ARGTIGDYTDYFPY

SEQ ID NO: 14855 - protein, 9 aa, Homo sapiens
  light chain complementarity determining region 3 for antibody 7428
QQYDNYAHT

SEQ ID NO: 14856 - protein, 14 aa, Homo sapiens
  heavy chain complementarity determining region 3 for antibody 7428
ARDVHTTGWTLGGY

SEQ ID NO: 14857 - protein, 9 aa, Homo sapiens
  light chain complementarity determining region 3 for antibody 7429
QQYDNWSWT

SEQ ID NO: 14858 - protein, 17 aa, Homo sapiens
  heavy chain complementarity determining region 3 for antibody 7429
VTHYYHDSGIYHDFFNY

SEQ ID NO: 14859 - protein, 9 aa, Homo sapiens
  light chain complementarity determining region 3 for antibody 7430
QQYDNWPWT

SEQ ID NO: 14860 - protein, 17 aa, Homo sapiens
  heavy chain complementarity determining region 3 for antibody 7430
VTHYYHDSGTYHDFFNY

SEQ ID NO: 14861 - protein, 9 aa, Homo sapiens
  light chain complementarity determining region 3 for antibody 7431
QQYDNWPWT

SEQ ID NO: 14862 - protein, 17 aa, Homo sapiens
  heavy chain complementarity determining region 3 for antibody 7431
VTHYYHDSGIYYDCFNY

SEQ ID NO: 14863 - protein, 9 aa, Homo sapiens
  light chain complementarity determining region 3 for antibody 7432
QQYDNWPWT

SEQ ID NO: 14864 - protein, 17 aa, Homo sapiens
  heavy chain complementarity determining region 3 for antibody 7432
VTHYYHDSGIYHGFFNY

SEQ ID NO: 14865 - protein, 9 aa, Homo sapiens
  light chain complementarity determining region 3 for antibody 7433
QQYDNWPWT

SEQ ID NO: 14866 - protein, 17 aa, Homo sapiens
  heavy chain complementarity determining region 3 for antibody 7433
VTHYYHDSGIYHDFYNY

SEQ ID NO: 14867 - protein, 9 aa, Homo sapiens
  light chain complementarity determining region 3 for antibody 7434
QQYDNWPWT

SEQ ID NO: 14868 - protein, 17 aa, Homo sapiens
  heavy chain complementarity determining region 3 for antibody 7434
VTHYYHDSGIYHDFFNS

SEQ ID NO: 14869 - protein, 9 aa, Homo sapiens
  light chain complementarity determining region 3 for antibody 7435
QQYDNWPWT

SEQ ID NO: 14870 - protein, 17 aa, Homo sapiens
  heavy chain complementarity determining region 3 for antibody 7435
VTHYYHDSGIYHDFFNH

SEQ ID NO: 14871 - protein, 9 aa, Homo sapiens
  light chain complementarity determining region 3 for antibody 7436
QQYDNWPWT

SEQ ID NO: 14872 - protein, 17 aa, Homo sapiens
  heavy chain complementarity determining region 3 for antibody 7436
VTHYYHDSGIYHDFFND

SEQ ID NO: 14873 - protein, 9 aa, Homo sapiens
  light chain complementarity determining region 3 for antibody 7437
QQYDNWPWT

SEQ ID NO: 14874 - protein, 17 aa, Homo sapiens
  heavy chain complementarity determining region 3 for antibody 7437
VTHYYHDSGIYHAFFNY

SEQ ID NO: 14875 - protein, 9 aa, Homo sapiens
  light chain complementarity determining region 3 for antibody 7438
QQYDNWPWT

SEQ ID NO: 14876 - protein, 17 aa, Homo sapiens
  heavy chain complementarity determining region 3 for antibody 7438
VTHYYHDSDIYHDFFNY

SEQ ID NO: 14877 - protein, 9 aa, Homo sapiens
  light chain complementarity determining region 3 for antibody 7439
QQYDNWPWT

SEQ ID NO: 14878 - protein, 17 aa, Homo sapiens
  heavy chain complementarity determining region 3 for antibody 7439
VTHSYHDSGIYHDFFNY

SEQ ID NO: 14879 - protein, 9 aa, Homo sapiens
  light chain complementarity determining region 3 for antibody 7440
QQYDNWPWT

SEQ ID NO: 14880 - protein, 7 aa, Homo sapiens
  heavy chain complementarity determining region 3 for antibody 7440
TTGDLRN

SEQ ID NO: 14881 - protein, 9 aa, Homo sapiens
  light chain complementarity determining region 3 for antibody 7441
QQYDNWPWT

SEQ ID NO: 14882 - protein, 17 aa, Homo sapiens
  heavy chain complementarity determining region 3 for antibody 7441
ARNTMVHGWQRQGSVDH

SEQ ID NO: 14883 - protein, 9 aa, Homo sapiens
  light chain complementarity determining region 3 for antibody 7442
QQYDNWPWT

SEQ ID NO: 14884 - protein, 12 aa, Homo sapiens
  heavy chain complementarity determining region 3 for antibody 7442
ARLDWNYRAFDI

SEQ ID NO: 14885 - protein, 10 aa, Homo sapiens
  light chain complementarity determining region 3 for antibody 7443
QQYDNWPPWR

SEQ ID NO: 14886 - protein, 15 aa, Homo sapiens
  heavy chain complementarity determining region 3 for antibody 7443
ARDSRVGASKYYFDY

SEQ ID NO: 14887 - protein, 10 aa, Homo sapiens
  light chain complementarity determining region 3 for antibody 7444
QQYDNWPPWR

SEQ ID NO: 14888 - protein, 15 aa, Homo sapiens
  heavy chain complementarity determining region 3 for antibody 7444
ARDIRVGPSKYYFGY

SEQ ID NO: 14889 - protein, 10 aa, Homo sapiens
  light chain complementarity determining region 3 for antibody 7445
QQYDNWPPWR

SEQ ID NO: 14890 - protein, 15 aa, Homo sapiens
  heavy chain complementarity determining region 3 for antibody 7445
ARDIRVGASKYYLDY

SEQ ID NO: 14891 - protein, 10 aa, Homo sapiens
  light chain complementarity determining region 3 for antibody 7446
QQYDNWPPWR

SEQ ID NO: 14892 - protein, 15 aa, Homo sapiens
  heavy chain complementarity determining region 3 for antibody 7446
ARDIRVGASKYCFDY

SEQ ID NO: 14893 - protein, 10 aa, Homo sapiens
  light chain complementarity determining region 3 for antibody 7447
QQYDNWPPWR

SEQ ID NO: 14894 - protein, 15 aa, Homo sapiens
  heavy chain complementarity determining region 3 for antibody 7447
AIDIRVGPSKYYFDY

SEQ ID NO: 14895 - protein, 10 aa, Homo sapiens
  light chain complementarity determining region 3 for antibody 7448
QQYDNWPPRR

SEQ ID NO: 14896 - protein, 15 aa, Homo sapiens
  heavy chain complementarity determining region 3 for antibody 7448
ARDIRVGPSKYYFDY

SEQ ID NO: 14897 - protein, 9 aa, Homo sapiens
  light chain complementarity determining region 3 for antibody 7449
QQYDNWPGT

SEQ ID NO: 14898 - protein, 17 aa, Homo sapiens
  heavy chain complementarity determining region 3 for antibody 7449
VTHYYHDSGIYYDFFNY

SEQ ID NO: 14899 - protein, 8 aa, Homo sapiens
  light chain complementarity determining region 3 for antibody 7450
QQYDNVRT

SEQ ID NO: 14900 - protein, 18 aa, Homo sapiens
  heavy chain complementarity determining region 3 for antibody 7450
AKGKLPFCSGTRCYPDDL

SEQ ID NO: 14901 - protein, 6 aa, Homo sapiens
  light chain complementarity determining region 3 for antibody 7451
QQYDNT

SEQ ID NO: 14902 - protein, 12 aa, Homo sapiens
  heavy chain complementarity determining region 3 for antibody 7451
AIVVPGRWDLDD

SEQ ID NO: 14903 - protein, 9 aa, Homo sapiens
  light chain complementarity determining region 3 for antibody 7452
QQYDNSLRT

SEQ ID NO: 14904 - protein, 14 aa, Homo sapiens
  heavy chain complementarity determining region 3 for antibody 7452
AREGVLSRQPYRDY

SEQ ID NO: 14905 - protein, 9 aa, Homo sapiens
  light chain complementarity determining region 3 for antibody 7453
QQYDNSLRP

SEQ ID NO: 14906 - protein, 14 aa, Homo sapiens
  heavy chain complementarity determining region 3 for antibody 7453
AREGVLIRQPYRDY

SEQ ID NO: 14907 - protein, 9 aa, Homo sapiens
  light chain complementarity determining region 3 for antibody 7454
QQYDNPPYT

SEQ ID NO: 14908 - protein, 13 aa, Homo sapiens
  heavy chain complementarity determining region 3 for antibody 7454
AKEGSAPGPDFEY

SEQ ID NO: 14909 - protein, 8 aa, Homo sapiens
  light chain complementarity determining region 3 for antibody 7455
QQYDNPPT

SEQ ID NO: 14910 - protein, 17 aa, Homo sapiens
  heavy chain complementarity determining region 3 for antibody 7455
ARNTVVGTWQRQGNLDH

SEQ ID NO: 14911 - protein, 9 aa, Homo sapiens
  light chain complementarity determining region 3 for antibody 7456
QQYDNPPIT

SEQ ID NO: 14912 - protein, 13 aa, Homo sapiens
  heavy chain complementarity determining region 3 for antibody 7456
AKEGSSPGPDFEY

SEQ ID NO: 14913 - protein, 6 aa, Homo sapiens
  light chain complementarity determining region 3 for antibody 7457
QQYDNP

SEQ ID NO: 14914 - protein, 12 aa, Homo sapiens
  heavy chain complementarity determining region 3 for antibody 7457
AIVVPGRWDLDE

SEQ ID NO: 14915 - protein, 9 aa, Homo sapiens
  light chain complementarity determining region 3 for antibody 7458
QQYDNLQYT

SEQ ID NO: 14916 - protein, 13 aa, Homo sapiens
  heavy chain complementarity determining region 3 for antibody 7458
AKEGSAPGPDFEY

SEQ ID NO: 14917 - protein, 9 aa, Homo sapiens
  light chain complementarity determining region 3 for antibody 7459
QQYDNLPYT

SEQ ID NO: 14918 - protein, 13 aa, Homo sapiens
  heavy chain complementarity determining region 3 for antibody 7459
VKEGSAPGPDFEY

SEQ ID NO: 14919 - protein, 9 aa, Homo sapiens
  light chain complementarity determining region 3 for antibody 7460
QQYDNLPYT

SEQ ID NO: 14920 - protein, 13 aa, Homo sapiens
  heavy chain complementarity determining region 3 for antibody 7460
ARPYGDYGWAFNI

SEQ ID NO: 14921 - protein, 9 aa, Homo sapiens
  light chain complementarity determining region 3 for antibody 7461
QQYDNLPYT

SEQ ID NO: 14922 - protein, 14 aa, Homo sapiens
  heavy chain complementarity determining region 3 for antibody 7461
ARDVHTTGWTLGGY

SEQ ID NO: 14923 - protein, 9 aa, Homo sapiens
  light chain complementarity determining region 3 for antibody 7462
QQYDNLPYT

SEQ ID NO: 14924 - protein, 13 aa, Homo sapiens
  heavy chain complementarity determining region 3 for antibody 7462
AKEGSAPSPDFEY

SEQ ID NO: 14925 - protein, 9 aa, Homo sapiens
  light chain complementarity determining region 3 for antibody 7463
QQYDNLPYT

SEQ ID NO: 14926 - protein, 13 aa, Homo sapiens
  heavy chain complementarity determining region 3 for antibody 7463
AKEGSAPGPGFEY

SEQ ID NO: 14927 - protein, 9 aa, Homo sapiens
  light chain complementarity determining region 3 for antibody 7464
QQYDNLPYT

SEQ ID NO: 14928 - protein, 13 aa, Homo sapiens
  heavy chain complementarity determining region 3 for antibody 7464
AKEGSAPGPDLEY

SEQ ID NO: 14929 - protein, 9 aa, Homo sapiens
  light chain complementarity determining region 3 for antibody 7465
QQYDNLPYT

SEQ ID NO: 14930 - protein, 13 aa, Homo sapiens
  heavy chain complementarity determining region 3 for antibody 7465
AKEGSAPGPDFDY

SEQ ID NO: 14931 - protein, 9 aa, Homo sapiens
  light chain complementarity determining region 3 for antibody 7466
QQYDNLPYT

SEQ ID NO: 14932 - protein, 13 aa, Homo sapiens
  heavy chain complementarity determining region 3 for antibody 7466
AKEGSAPGHDFEY

SEQ ID NO: 14933 - protein, 9 aa, Homo sapiens
  light chain complementarity determining region 3 for antibody 7467
QQYDNLPYT

SEQ ID NO: 14934 - protein, 13 aa, Homo sapiens
  heavy chain complementarity determining region 3 for antibody 7467
AKEGSAPGADFEY

SEQ ID NO: 14935 - protein, 9 aa, Homo sapiens
  light chain complementarity determining region 3 for antibody 7468
QQYDNLPYT

SEQ ID NO: 14936 - protein, 13 aa, Homo sapiens
  heavy chain complementarity determining region 3 for antibody 7468
AKEGPAPGPDFEY

SEQ ID NO: 14937 - protein, 9 aa, Homo sapiens
  light chain complementarity determining region 3 for antibody 7469
QQYDNLPYT

SEQ ID NO: 14938 - protein, 13 aa, Homo sapiens
  heavy chain complementarity determining region 3 for antibody 7469
AKEGCAPGPDFEY

SEQ ID NO: 14939 - protein, 9 aa, Homo sapiens
  light chain complementarity determining region 3 for antibody 7470
QQYDNLPYA

SEQ ID NO: 14940 - protein, 13 aa, Homo sapiens
  heavy chain complementarity determining region 3 for antibody 7470
AKEGSAPGPDFEY

SEQ ID NO: 14941 - protein, 9 aa, Homo sapiens
  light chain complementarity determining region 3 for antibody 7471
QQYDNLPWT

SEQ ID NO: 14942 - protein, 17 aa, Homo sapiens
  heavy chain complementarity determining region 3 for antibody 7471
VTHYYHDSGIYYDFFNY

SEQ ID NO: 14943 - protein, 9 aa, Homo sapiens
  light chain complementarity determining region 3 for antibody 7472
QQYDNLPWT

SEQ ID NO: 14944 - protein, 17 aa, Homo sapiens
  heavy chain complementarity determining region 3 for antibody 7472
VTHYYHDSGIYHDFFNY

SEQ ID NO: 14945 - protein, 9 aa, Homo sapiens
  light chain complementarity determining region 3 for antibody 7473
QQYDNLPWT

SEQ ID NO: 14946 - protein, 17 aa, Homo sapiens
  heavy chain complementarity determining region 3 for antibody 7473
ARNAMVGTWQRQGNLDH

SEQ ID NO: 14947 - protein, 9 aa, Homo sapiens
  light chain complementarity determining region 3 for antibody 7474
QQYDNLPTT

SEQ ID NO: 14948 - protein, 8 aa, Homo sapiens
  heavy chain complementarity determining region 3 for antibody 7474
GSWGSWVV

SEQ ID NO: 14949 - protein, 8 aa, Homo sapiens
  light chain complementarity determining region 3 for antibody 7475
QQYDNLPT

SEQ ID NO: 14950 - protein, 13 aa, Homo sapiens
  heavy chain complementarity determining region 3 for antibody 7475
ARPYGDYGWAFNI

SEQ ID NO: 14951 - protein, 9 aa, Homo sapiens
  light chain complementarity determining region 3 for antibody 7476
QQYDNLPST

SEQ ID NO: 14952 - protein, 13 aa, Homo sapiens
  heavy chain complementarity determining region 3 for antibody 7476
AKEGSAPGPDFEY

SEQ ID NO: 14953 - protein, 9 aa, Homo sapiens
  light chain complementarity determining region 3 for antibody 7477
QQYDNLPRT

SEQ ID NO: 14954 - protein, 9 aa, Homo sapiens
  heavy chain complementarity determining region 3 for antibody 7477
ARGGSNFRH

SEQ ID NO: 14955 - protein, 10 aa, Homo sapiens
  light chain complementarity determining region 3 for antibody 7478
QQYDNLPRKT

SEQ ID NO: 14956 - protein, 14 aa, Homo sapiens
  heavy chain complementarity determining region 3 for antibody 7478
ARLHGSGLGRWLDP

SEQ ID NO: 14957 - protein, 10 aa, Homo sapiens
  light chain complementarity determining region 3 for antibody 7479
QQYDNLPPPT

SEQ ID NO: 14958 - protein, 15 aa, Homo sapiens
  heavy chain complementarity determining region 3 for antibody 7479
VHSRDGGPPGHWFDS

SEQ ID NO: 14959 - protein, 10 aa, Homo sapiens
  light chain complementarity determining region 3 for antibody 7480
QQYDNLPPLT

SEQ ID NO: 14960 - protein, 12 aa, Homo sapiens
  heavy chain complementarity determining region 3 for antibody 7480
VRDRGGRSGMDY

SEQ ID NO: 14961 - protein, 10 aa, Homo sapiens
  light chain complementarity determining region 3 for antibody 7481
QQYDNLPPLT

SEQ ID NO: 14962 - protein, 10 aa, Homo sapiens
  heavy chain complementarity determining region 3 for antibody 7481
ARGGLAGDTQ

SEQ ID NO: 14963 - protein, 9 aa, Homo sapiens
  light chain complementarity determining region 3 for antibody 7482
QQYDNLPPA

SEQ ID NO: 14964 - protein, 13 aa, Homo sapiens
  heavy chain complementarity determining region 3 for antibody 7482
TREGSSAGPDFVY

SEQ ID NO: 14965 - protein, 9 aa, Homo sapiens
  light chain complementarity determining region 3 for antibody 7483
QQYDNLPPA

SEQ ID NO: 14966 - protein, 13 aa, Homo sapiens
  heavy chain complementarity determining region 3 for antibody 7483
TKGGSSAGPDFVY

SEQ ID NO: 14967 - protein, 9 aa, Homo sapiens
  light chain complementarity determining region 3 for antibody 7484
QQYDNLPPA

SEQ ID NO: 14968 - protein, 13 aa, Homo sapiens
  heavy chain complementarity determining region 3 for antibody 7484
TKERSSAGPDFVY

SEQ ID NO: 14969 - protein, 9 aa, Homo sapiens
  light chain complementarity determining region 3 for antibody 7485
QQYDNLPPA

SEQ ID NO: 14970 - protein, 13 aa, Homo sapiens
  heavy chain complementarity determining region 3 for antibody 7485
TKEGSSVGPDFVY

SEQ ID NO: 14971 - protein, 9 aa, Homo sapiens
  light chain complementarity determining region 3 for antibody 7486
QQYDNLPPA

SEQ ID NO: 14972 - protein, 13 aa, Homo sapiens
  heavy chain complementarity determining region 3 for antibody 7486
TKEGSSTGPDFVY

SEQ ID NO: 14973 - protein, 9 aa, Homo sapiens
  light chain complementarity determining region 3 for antibody 7487
QQYDNLPPA

SEQ ID NO: 14974 - protein, 13 aa, Homo sapiens
  heavy chain complementarity determining region 3 for antibody 7487
TKEGSSAGPDVVY

SEQ ID NO: 14975 - protein, 9 aa, Homo sapiens
  light chain complementarity determining region 3 for antibody 7488
QQYDNLPPA

SEQ ID NO: 14976 - protein, 13 aa, Homo sapiens
  heavy chain complementarity determining region 3 for antibody 7488
TKEGSSAGPDFVF

SEQ ID NO: 14977 - protein, 9 aa, Homo sapiens
  light chain complementarity determining region 3 for antibody 7489
QQYDNLPPA

SEQ ID NO: 14978 - protein, 13 aa, Homo sapiens
  heavy chain complementarity determining region 3 for antibody 7489
TKEGSSAGPAFVY

SEQ ID NO: 14979 - protein, 9 aa, Homo sapiens
  light chain complementarity determining region 3 for antibody 7490
QQYDNLPPA

SEQ ID NO: 14980 - protein, 13 aa, Homo sapiens
  heavy chain complementarity determining region 3 for antibody 7490
TKEGSSAGHDFVY

SEQ ID NO: 14981 - protein, 9 aa, Homo sapiens
  light chain complementarity determining region 3 for antibody 7491
QQYDNLPPA

SEQ ID NO: 14982 - protein, 13 aa, Homo sapiens
  heavy chain complementarity determining region 3 for antibody 7491
TKEGPSAGPDFVY

SEQ ID NO: 14983 - protein, 9 aa, Homo sapiens
  light chain complementarity determining region 3 for antibody 7492
QQYDNLPPA

SEQ ID NO: 14984 - protein, 13 aa, Homo sapiens
  heavy chain complementarity determining region 3 for antibody 7492
TKEGCSAGPDFVY

SEQ ID NO: 14985 - protein, 9 aa, Homo sapiens
  light chain complementarity determining region 3 for antibody 7493
QQYDNLPPA

SEQ ID NO: 14986 - protein, 13 aa, Homo sapiens
  heavy chain complementarity determining region 3 for antibody 7493
TEEGSSAGPDFVY

SEQ ID NO: 14987 - protein, 9 aa, Homo sapiens
  light chain complementarity determining region 3 for antibody 7494
QQYDNLPPA

SEQ ID NO: 14988 - protein, 9 aa, Homo sapiens
  heavy chain complementarity determining region 3 for antibody 7494
GSRRPYFDS

SEQ ID NO: 14989 - protein, 9 aa, Homo sapiens
  light chain complementarity determining region 3 for antibody 7495
QQYDNLPPA

SEQ ID NO: 14990 - protein, 13 aa, Homo sapiens
  heavy chain complementarity determining region 3 for antibody 7495
AKEGSAAGPDFVY

SEQ ID NO: 14991 - protein, 9 aa, Homo sapiens
  light chain complementarity determining region 3 for antibody 7496
QQYDNLPPA

SEQ ID NO: 14992 - protein, 12 aa, Homo sapiens
  heavy chain complementarity determining region 3 for antibody 7496
AIVVPGRWDLDD

SEQ ID NO: 14993 - protein, 9 aa, Homo sapiens
  light chain complementarity determining region 3 for antibody 7497
QQYDNLPLT

SEQ ID NO: 14994 - protein, 12 aa, Homo sapiens
  heavy chain complementarity determining region 3 for antibody 7497
SIVVPGRWDLDD

SEQ ID NO: 14995 - protein, 9 aa, Homo sapiens
  light chain complementarity determining region 3 for antibody 7498
QQYDNLPLT

SEQ ID NO: 14996 - protein, 10 aa, Homo sapiens
  heavy chain complementarity determining region 3 for antibody 7498
CRDREGFGDV

SEQ ID NO: 14997 - protein, 9 aa, Homo sapiens
  light chain complementarity determining region 3 for antibody 7499
QQYDNLPLT

SEQ ID NO: 14998 - protein, 12 aa, Homo sapiens
  heavy chain complementarity determining region 3 for antibody 7499
AIVVPWRWDLDD

SEQ ID NO: 14999 - protein, 9 aa, Homo sapiens
  light chain complementarity determining region 3 for antibody 7500
QQYDNLPLT

SEQ ID NO: 15000 - protein, 12 aa, Homo sapiens
  heavy chain complementarity determining region 3 for antibody 7500
AIVVPVRWDLDD

SEQ ID NO: 15001 - protein, 9 aa, Homo sapiens
  light chain complementarity determining region 3 for antibody 7501
QQYDNLPLT

SEQ ID NO: 15002 - protein, 12 aa, Homo sapiens
  heavy chain complementarity determining region 3 for antibody 7501
AIVVPGRWDRDD

SEQ ID NO: 15003 - protein, 9 aa, Homo sapiens
  light chain complementarity determining region 3 for antibody 7502
QQYDNLPLT

SEQ ID NO: 15004 - protein, 12 aa, Homo sapiens
  heavy chain complementarity determining region 3 for antibody 7502
AIVVPGRWDLHD

SEQ ID NO: 15005 - protein, 9 aa, Homo sapiens
  light chain complementarity determining region 3 for antibody 7503
QQYDNLPLT

SEQ ID NO: 15006 - protein, 12 aa, Homo sapiens
  heavy chain complementarity determining region 3 for antibody 7503
AIVAPGRWDLDD

SEQ ID NO: 15007 - protein, 9 aa, Homo sapiens
  light chain complementarity determining region 3 for antibody 7504
QQYDNLPLP

SEQ ID NO: 15008 - protein, 12 aa, Homo sapiens
  heavy chain complementarity determining region 3 for antibody 7504
AIVVPGRWDLDD

SEQ ID NO: 15009 - protein, 9 aa, Homo sapiens
  light chain complementarity determining region 3 for antibody 7505
QQYDNLPLI

SEQ ID NO: 15010 - protein, 12 aa, Homo sapiens
  heavy chain complementarity determining region 3 for antibody 7505
AIVVPGRWDLDD

SEQ ID NO: 15011 - protein, 9 aa, Homo sapiens
  light chain complementarity determining region 3 for antibody 7506
QQYDNLPLA

SEQ ID NO: 15012 - protein, 14 aa, Homo sapiens
  heavy chain complementarity determining region 3 for antibody 7506
ARLKDTTMVGGMDV

SEQ ID NO: 15013 - protein, 9 aa, Homo sapiens
  light chain complementarity determining region 3 for antibody 7507
QQYDNLPIT

SEQ ID NO: 15014 - protein, 12 aa, Homo sapiens
  heavy chain complementarity determining region 3 for antibody 7507
AIVVPGRWDLDD

SEQ ID NO: 15015 - protein, 10 aa, Homo sapiens
  light chain complementarity determining region 3 for antibody 7508
QQYDNLPGLT

SEQ ID NO: 15016 - protein, 13 aa, Homo sapiens
  heavy chain complementarity determining region 3 for antibody 7508
AKEGSSPGPDFDY

SEQ ID NO: 15017 - protein, 9 aa, Homo sapiens
  light chain complementarity determining region 3 for antibody 7509
QQYDNLPFT

SEQ ID NO: 15018 - protein, 9 aa, Homo sapiens
  heavy chain complementarity determining region 3 for antibody 7509
ARSEYQLTY

SEQ ID NO: 15019 - protein, 9 aa, Homo sapiens
  light chain complementarity determining region 3 for antibody 7510
QQYDNLPFT

SEQ ID NO: 15020 - protein, 12 aa, Homo sapiens
  heavy chain complementarity determining region 3 for antibody 7510
AIVVPGRWDLDD

SEQ ID NO: 15021 - protein, 9 aa, Homo sapiens
  light chain complementarity determining region 3 for antibody 7511
QQYDNLPDT

SEQ ID NO: 15022 - protein, 13 aa, Homo sapiens
  heavy chain complementarity determining region 3 for antibody 7511
AKEGSAPGPDFEY

SEQ ID NO: 15023 - protein, 8 aa, Homo sapiens
  light chain complementarity determining region 3 for antibody 7512
QQYDNLLT

SEQ ID NO: 15024 - protein, 13 aa, Homo sapiens
  heavy chain complementarity determining region 3 for antibody 7512
ARPYGDYRWAFNI

SEQ ID NO: 15025 - protein, 8 aa, Homo sapiens
  light chain complementarity determining region 3 for antibody 7513
QQYDNLLT

SEQ ID NO: 15026 - protein, 13 aa, Homo sapiens
  heavy chain complementarity determining region 3 for antibody 7513
ARPYGDSGWAFNI

SEQ ID NO: 15027 - protein, 8 aa, Homo sapiens
  light chain complementarity determining region 3 for antibody 7514
QQYDNLLT

SEQ ID NO: 15028 - protein, 17 aa, Homo sapiens
  heavy chain complementarity determining region 3 for antibody 7514
ARNTMVGTWQRQGNLDH

SEQ ID NO: 15029 - protein, 8 aa, Homo sapiens
  light chain complementarity determining region 3 for antibody 7515
QQYDNLLT

SEQ ID NO: 15030 - protein, 25 aa, Homo sapiens
  heavy chain complementarity determining region 3 for antibody 7515
AREICHTAACYEILWFGQTPYYFDS

SEQ ID NO: 15031 - protein, 8 aa, Homo sapiens
  light chain complementarity determining region 3 for antibody 7516
QQYDNLLN

SEQ ID NO: 15032 - protein, 13 aa, Homo sapiens
  heavy chain complementarity determining region 3 for antibody 7516
ARPYGDYGWAFNI

SEQ ID NO: 15033 - protein, 9 aa, Homo sapiens
  light chain complementarity determining region 3 for antibody 7517
QQYDNLLIT

SEQ ID NO: 15034 - protein, 13 aa, Homo sapiens
  heavy chain complementarity determining region 3 for antibody 7517
AKEGSSPGPDFEY

SEQ ID NO: 15035 - protein, 9 aa, Homo sapiens
  light chain complementarity determining region 3 for antibody 7518
QQYDNLIFA

SEQ ID NO: 15036 - protein, 8 aa, Homo sapiens
  heavy chain complementarity determining region 3 for antibody 7518
TSIAVAGR

SEQ ID NO: 15037 - protein, 8 aa, Homo sapiens
  light chain complementarity determining region 3 for antibody 7519
QQYDNLFT

SEQ ID NO: 15038 - protein, 13 aa, Homo sapiens
  heavy chain complementarity determining region 3 for antibody 7519
ARPYGDYGWAFNI

SEQ ID NO: 15039 - protein, 10 aa, Homo sapiens
  light chain complementarity determining region 3 for antibody 7520
QQYDNLASLT

SEQ ID NO: 15040 - protein, 11 aa, Homo sapiens
  heavy chain complementarity determining region 3 for antibody 7520
VRVSTGWNFDY

SEQ ID NO: 15041 - protein, 10 aa, Homo sapiens
  light chain complementarity determining region 3 for antibody 7521
QQYDNLASLT

SEQ ID NO: 15042 - protein, 15 aa, Homo sapiens
  heavy chain complementarity determining region 3 for antibody 7521
VRDPGGLAYFYNMEV

SEQ ID NO: 15043 - protein, 10 aa, Homo sapiens
  light chain complementarity determining region 3 for antibody 7522
QQYDNLASLT

SEQ ID NO: 15044 - protein, 12 aa, Homo sapiens
  heavy chain complementarity determining region 3 for antibody 7522
TRDTIQATILGC

SEQ ID NO: 15045 - protein, 10 aa, Homo sapiens
  light chain complementarity determining region 3 for antibody 7523
QQYDNLASLT

SEQ ID NO: 15046 - protein, 12 aa, Homo sapiens
  heavy chain complementarity determining region 3 for antibody 7523
TRDPEGDEDFDY

SEQ ID NO: 15047 - protein, 10 aa, Homo sapiens
  light chain complementarity determining region 3 for antibody 7524
QQYDNLASLT

SEQ ID NO: 15048 - protein, 13 aa, Homo sapiens
  heavy chain complementarity determining region 3 for antibody 7524
TKEGSSPGPDFEY

SEQ ID NO: 15049 - protein, 10 aa, Homo sapiens
  light chain complementarity determining region 3 for antibody 7525
QQYDNLASLT

SEQ ID NO: 15050 - protein, 14 aa, Homo sapiens
  heavy chain complementarity determining region 3 for antibody 7525
GRDTTHDWSDGGIY

SEQ ID NO: 15051 - protein, 10 aa, Homo sapiens
  light chain complementarity determining region 3 for antibody 7526
QQYDNLASLT

SEQ ID NO: 15052 - protein, 20 aa, Homo sapiens
  heavy chain complementarity determining region 3 for antibody 7526
GRDSSRSYSNSWAHYYGTDV

SEQ ID NO: 15053 - protein, 10 aa, Homo sapiens
  light chain complementarity determining region 3 for antibody 7527
QQYDNLASLT

SEQ ID NO: 15054 - protein, 11 aa, Homo sapiens
  heavy chain complementarity determining region 3 for antibody 7527
ATFGQQWRLAH

SEQ ID NO: 15055 - protein, 10 aa, Homo sapiens
  light chain complementarity determining region 3 for antibody 7528
QQYDNLASLT

SEQ ID NO: 15056 - protein, 11 aa, Homo sapiens
  heavy chain complementarity determining region 3 for antibody 7528
ARRSLGGAFDY

SEQ ID NO: 15057 - protein, 10 aa, Homo sapiens
  light chain complementarity determining region 3 for antibody 7529
QQYDNLASLT

SEQ ID NO: 15058 - protein, 9 aa, Homo sapiens
  heavy chain complementarity determining region 3 for antibody 7529
ARGRSNFRF

SEQ ID NO: 15059 - protein, 10 aa, Homo sapiens
  light chain complementarity determining region 3 for antibody 7530
QQYDNLASLT

SEQ ID NO: 15060 - protein, 10 aa, Homo sapiens
  heavy chain complementarity determining region 3 for antibody 7530
ARETYWVFDL

SEQ ID NO: 15061 - protein, 10 aa, Homo sapiens
  light chain complementarity determining region 3 for antibody 7531
QQYDNLASLT

SEQ ID NO: 15062 - protein, 12 aa, Homo sapiens
  heavy chain complementarity determining region 3 for antibody 7531
ARDKGGRNGMDV

SEQ ID NO: 15063 - protein, 10 aa, Homo sapiens
  light chain complementarity determining region 3 for antibody 7532
QQYDNLASLT

SEQ ID NO: 15064 - protein, 13 aa, Homo sapiens
  heavy chain complementarity determining region 3 for antibody 7532
ANEGSSPGPDFEY

SEQ ID NO: 15065 - protein, 10 aa, Homo sapiens
  light chain complementarity determining region 3 for antibody 7533
QQYDNLASLT

SEQ ID NO: 15066 - protein, 13 aa, Homo sapiens
  heavy chain complementarity determining region 3 for antibody 7533
AKEGSTPGPDFEY

SEQ ID NO: 15067 - protein, 10 aa, Homo sapiens
  light chain complementarity determining region 3 for antibody 7534
QQYDNLASLT

SEQ ID NO: 15068 - protein, 13 aa, Homo sapiens
  heavy chain complementarity determining region 3 for antibody 7534
AKEGSSSGPDFEY

SEQ ID NO: 15069 - protein, 10 aa, Homo sapiens
  light chain complementarity determining region 3 for antibody 7535
QQYDNLASLT

SEQ ID NO: 15070 - protein, 13 aa, Homo sapiens
  heavy chain complementarity determining region 3 for antibody 7535
AKEGSSRGPDFEY

SEQ ID NO: 15071 - protein, 10 aa, Homo sapiens
  light chain complementarity determining region 3 for antibody 7536
QQYDNLASLT

SEQ ID NO: 15072 - protein, 13 aa, Homo sapiens
  heavy chain complementarity determining region 3 for antibody 7536
AKEGSSPGTDFEY

SEQ ID NO: 15073 - protein, 10 aa, Homo sapiens
  light chain complementarity determining region 3 for antibody 7537
QQYDNLASLT

SEQ ID NO: 15074 - protein, 13 aa, Homo sapiens
  heavy chain complementarity determining region 3 for antibody 7537
AKEGSSPGSDFEY

SEQ ID NO: 15075 - protein, 10 aa, Homo sapiens
  light chain complementarity determining region 3 for antibody 7538
QQYDNLASLT

SEQ ID NO: 15076 - protein, 13 aa, Homo sapiens
  heavy chain complementarity determining region 3 for antibody 7538
AKEGSSPGPEFEY

SEQ ID NO: 15077 - protein, 10 aa, Homo sapiens
  light chain complementarity determining region 3 for antibody 7539
QQYDNLASLT

SEQ ID NO: 15078 - protein, 13 aa, Homo sapiens
  heavy chain complementarity determining region 3 for antibody 7539
AKEGSSPCPDFEY

SEQ ID NO: 15079 - protein, 10 aa, Homo sapiens
  light chain complementarity determining region 3 for antibody 7540
QQYDNLASLT

SEQ ID NO: 15080 - protein, 13 aa, Homo sapiens
  heavy chain complementarity determining region 3 for antibody 7540
AKEGSSLGPDFEY

SEQ ID NO: 15081 - protein, 10 aa, Homo sapiens
  light chain complementarity determining region 3 for antibody 7541
QQYDNLASLT

SEQ ID NO: 15082 - protein, 13 aa, Homo sapiens
  heavy chain complementarity determining region 3 for antibody 7541
AKEGSAPGPDVEY

SEQ ID NO: 15083 - protein, 10 aa, Homo sapiens
  light chain complementarity determining region 3 for antibody 7542
QQYDNLASLT

SEQ ID NO: 15084 - protein, 13 aa, Homo sapiens
  heavy chain complementarity determining region 3 for antibody 7542
AKDGSSPGPDFEY

SEQ ID NO: 15085 - protein, 10 aa, Homo sapiens
  light chain complementarity determining region 3 for antibody 7543
QQYDNLASLT

SEQ ID NO: 15086 - protein, 8 aa, Homo sapiens
  heavy chain complementarity determining region 3 for antibody 7543
AGWGYGNY

SEQ ID NO: 15087 - protein, 10 aa, Homo sapiens
  light chain complementarity determining region 3 for antibody 7544
QQYDNLASLI

SEQ ID NO: 15088 - protein, 13 aa, Homo sapiens
  heavy chain complementarity determining region 3 for antibody 7544
AKEGSSPGPDFEY

SEQ ID NO: 15089 - protein, 10 aa, Homo sapiens
  light chain complementarity determining region 3 for antibody 7545
QQYDNLASFT

SEQ ID NO: 15090 - protein, 13 aa, Homo sapiens
  heavy chain complementarity determining region 3 for antibody 7545
AKEGSSPGPDFEY

SEQ ID NO: 15091 - protein, 9 aa, Homo sapiens
  light chain complementarity determining region 3 for antibody 7546
QQYDNIPYT

SEQ ID NO: 15092 - protein, 13 aa, Homo sapiens
  heavy chain complementarity determining region 3 for antibody 7546
AKEGSAPGPDFEY

SEQ ID NO: 15093 - protein, 10 aa, Homo sapiens
  light chain complementarity determining region 3 for antibody 7547
QQYDNHASLT

SEQ ID NO: 15094 - protein, 13 aa, Homo sapiens
  heavy chain complementarity determining region 3 for antibody 7547
AKEGSSPGPDFEY

SEQ ID NO: 15095 - protein, 8 aa, Homo sapiens
  light chain complementarity determining region 3 for antibody 7548
QQYDNART

SEQ ID NO: 15096 - protein, 16 aa, Homo sapiens
  heavy chain complementarity determining region 3 for antibody 7548
VRDLAGFTRGGSTFDY

SEQ ID NO: 15097 - protein, 8 aa, Homo sapiens
  light chain complementarity determining region 3 for antibody 7549
QQYDNART

SEQ ID NO: 15098 - protein, 15 aa, Homo sapiens
  heavy chain complementarity determining region 3 for antibody 7549
GKEGPGSSGWLTGHY

SEQ ID NO: 15099 - protein, 8 aa, Homo sapiens
  light chain complementarity determining region 3 for antibody 7550
QQYDNART

SEQ ID NO: 15100 - protein, 14 aa, Homo sapiens
  heavy chain complementarity determining region 3 for antibody 7550
ARGHFDSTGFRLDY

SEQ ID NO: 15101 - protein, 9 aa, Homo sapiens
  light chain complementarity determining region 3 for antibody 7551
QQYDMAPDT

SEQ ID NO: 15102 - protein, 11 aa, Homo sapiens
  heavy chain complementarity determining region 3 for antibody 7551
AREATETTPGY

SEQ ID NO: 15103 - protein, 8 aa, Homo sapiens
  light chain complementarity determining region 3 for antibody 7552
QQYDLSLT

SEQ ID NO: 15104 - protein, 14 aa, Homo sapiens
  heavy chain complementarity determining region 3 for antibody 7552
ARGTIGDYTDYFPS

SEQ ID NO: 15105 - protein, 8 aa, Homo sapiens
  light chain complementarity determining region 3 for antibody 7553
QQYDLSLT

SEQ ID NO: 15106 - protein, 14 aa, Homo sapiens
  heavy chain complementarity determining region 3 for antibody 7553
ARGTIGDYTDYFAY

SEQ ID NO: 15107 - protein, 8 aa, Homo sapiens
  light chain complementarity determining region 3 for antibody 7554
QQYDLSLT

SEQ ID NO: 15108 - protein, 14 aa, Homo sapiens
  heavy chain complementarity determining region 3 for antibody 7554
ARGTIGDYTDSFPY

SEQ ID NO: 15109 - protein, 10 aa, Homo sapiens
  light chain complementarity determining region 3 for antibody 7555
QQYDISPTWT

SEQ ID NO: 15110 - protein, 16 aa, Homo sapiens
  heavy chain complementarity determining region 3 for antibody 7555
ASPNTLGRLVGVAFDY

SEQ ID NO: 15111 - protein, 10 aa, Homo sapiens
  light chain complementarity determining region 3 for antibody 7556
QQYDISPPWT

SEQ ID NO: 15112 - protein, 9 aa, Homo sapiens
  heavy chain complementarity determining region 3 for antibody 7556
VKGVISLDY

SEQ ID NO: 15113 - protein, 10 aa, Homo sapiens
  light chain complementarity determining region 3 for antibody 7557
QQYDISPPWT

SEQ ID NO: 15114 - protein, 18 aa, Homo sapiens
  heavy chain complementarity determining region 3 for antibody 7557
TTVLSQLLAGDWHLYFQH

SEQ ID NO: 15115 - protein, 10 aa, Homo sapiens
  light chain complementarity determining region 3 for antibody 7558
QQYDISPPWT

SEQ ID NO: 15116 - protein, 12 aa, Homo sapiens
  heavy chain complementarity determining region 3 for antibody 7558
STDVETTFPSVS

SEQ ID NO: 15117 - protein, 10 aa, Homo sapiens
  light chain complementarity determining region 3 for antibody 7559
QQYDISPPWT

SEQ ID NO: 15118 - protein, 16 aa, Homo sapiens
  heavy chain complementarity determining region 3 for antibody 7559
ASTNTLGRLVGVAFDY

SEQ ID NO: 15119 - protein, 10 aa, Homo sapiens
  light chain complementarity determining region 3 for antibody 7560
QQYDISPPWT

SEQ ID NO: 15120 - protein, 16 aa, Homo sapiens
  heavy chain complementarity determining region 3 for antibody 7560
ASPNTLGRLVGVVFDY

SEQ ID NO: 15121 - protein, 10 aa, Homo sapiens
  light chain complementarity determining region 3 for antibody 7561
QQYDISPPWT

SEQ ID NO: 15122 - protein, 16 aa, Homo sapiens
  heavy chain complementarity determining region 3 for antibody 7561
ASPNTLGRLVGVAFGY

SEQ ID NO: 15123 - protein, 10 aa, Homo sapiens
  light chain complementarity determining region 3 for antibody 7562
QQYDISPPWT

SEQ ID NO: 15124 - protein, 16 aa, Homo sapiens
  heavy chain complementarity determining region 3 for antibody 7562
ASPNTLGRLGGVAFDY

SEQ ID NO: 15125 - protein, 10 aa, Homo sapiens
  light chain complementarity determining region 3 for antibody 7563
QQYDISPPWT

SEQ ID NO: 15126 - protein, 16 aa, Homo sapiens
  heavy chain complementarity determining region 3 for antibody 7563
ASPDTLGRLVGVAFDY

SEQ ID NO: 15127 - protein, 10 aa, Homo sapiens
  light chain complementarity determining region 3 for antibody 7564
QQYDISPPWT

SEQ ID NO: 15128 - protein, 16 aa, Homo sapiens
  heavy chain complementarity determining region 3 for antibody 7564
ASANTLGRLVGVAFDY

SEQ ID NO: 15129 - protein, 10 aa, Homo sapiens
  light chain complementarity determining region 3 for antibody 7565
QQYDISPPWT

SEQ ID NO: 15130 - protein, 16 aa, Homo sapiens
  heavy chain complementarity determining region 3 for antibody 7565
ARPNTLGRLVGVAFDY

SEQ ID NO: 15131 - protein, 10 aa, Homo sapiens
  light chain complementarity determining region 3 for antibody 7566
QQYDISPPWT

SEQ ID NO: 15132 - protein, 11 aa, Homo sapiens
  heavy chain complementarity determining region 3 for antibody 7566
ARIVARKPDDY

SEQ ID NO: 15133 - protein, 10 aa, Homo sapiens
  light chain complementarity determining region 3 for antibody 7567
QQYDISPPWT

SEQ ID NO: 15134 - protein, 12 aa, Homo sapiens
  heavy chain complementarity determining region 3 for antibody 7567
ARDKGGRNGMDV

SEQ ID NO: 15135 - protein, 10 aa, Homo sapiens
  light chain complementarity determining region 3 for antibody 7568
QQYDISPPLT

SEQ ID NO: 15136 - protein, 16 aa, Homo sapiens
  heavy chain complementarity determining region 3 for antibody 7568
ASPNTLGRLVGVAFDY

SEQ ID NO: 15137 - protein, 9 aa, Homo sapiens
  light chain complementarity determining region 3 for antibody 7569
QQYDHYAHT

SEQ ID NO: 15138 - protein, 14 aa, Homo sapiens
  heavy chain complementarity determining region 3 for antibody 7569
ARGVHTTGWTLGGY

SEQ ID NO: 15139 - protein, 9 aa, Homo sapiens
  light chain complementarity determining region 3 for antibody 7570
QQYDHYAHT

SEQ ID NO: 15140 - protein, 14 aa, Homo sapiens
  heavy chain complementarity determining region 3 for antibody 7570
ARDVHTTGWTWGGY

SEQ ID NO: 15141 - protein, 9 aa, Homo sapiens
  light chain complementarity determining region 3 for antibody 7571
QQYDHYAHT

SEQ ID NO: 15142 - protein, 14 aa, Homo sapiens
  heavy chain complementarity determining region 3 for antibody 7571
ARDVHTTGWTLVGY

SEQ ID NO: 15143 - protein, 9 aa, Homo sapiens
  light chain complementarity determining region 3 for antibody 7572
QQYDHYAHT

SEQ ID NO: 15144 - protein, 14 aa, Homo sapiens
  heavy chain complementarity determining region 3 for antibody 7572
ARDVHTTGWTLGGF

SEQ ID NO: 15145 - protein, 9 aa, Homo sapiens
  light chain complementarity determining region 3 for antibody 7573
QQYDHYAHT

SEQ ID NO: 15146 - protein, 14 aa, Homo sapiens
  heavy chain complementarity determining region 3 for antibody 7573
ARDVHTTGWTLGDY

SEQ ID NO: 15147 - protein, 9 aa, Homo sapiens
  light chain complementarity determining region 3 for antibody 7574
QQYDHYAHT

SEQ ID NO: 15148 - protein, 14 aa, Homo sapiens
  heavy chain complementarity determining region 3 for antibody 7574
ARDVHTTGWPLGGY

SEQ ID NO: 15149 - protein, 9 aa, Homo sapiens
  light chain complementarity determining region 3 for antibody 7575
QQYDHYAHT

SEQ ID NO: 15150 - protein, 14 aa, Homo sapiens
  heavy chain complementarity determining region 3 for antibody 7575
ARDVHTSGWTLGGY

SEQ ID NO: 15151 - protein, 9 aa, Homo sapiens
  light chain complementarity determining region 3 for antibody 7576
QQYDHYAHT

SEQ ID NO: 15152 - protein, 14 aa, Homo sapiens
  heavy chain complementarity determining region 3 for antibody 7576
ARDGHTTGWTLGGY

SEQ ID NO: 15153 - protein, 9 aa, Homo sapiens
  light chain complementarity determining region 3 for antibody 7577
QQYDHWPWT

SEQ ID NO: 15154 - protein, 17 aa, Homo sapiens
  heavy chain complementarity determining region 3 for antibody 7577
VTHYYHDSGIYHDFFNY

SEQ ID NO: 15155 - protein, 10 aa, Homo sapiens
  light chain complementarity determining region 3 for antibody 7578
QQYDHWPPWR

SEQ ID NO: 15156 - protein, 15 aa, Homo sapiens
  heavy chain complementarity determining region 3 for antibody 7578
ARDIRVGASKYYFDY

SEQ ID NO: 15157 - protein, 11 aa, Homo sapiens
  light chain complementarity determining region 3 for antibody 7579
QQYDGWPPFLT

SEQ ID NO: 15158 - protein, 13 aa, Homo sapiens
  heavy chain complementarity determining region 3 for antibody 7579
TKEGSSAGPDFVY

SEQ ID NO: 15159 - protein, 11 aa, Homo sapiens
  light chain complementarity determining region 3 for antibody 7580
QQYDGWPPFLT

SEQ ID NO: 15160 - protein, 15 aa, Homo sapiens
  heavy chain complementarity determining region 3 for antibody 7580
ATHGGPAAAGRVLDV

SEQ ID NO: 15161 - protein, 10 aa, Homo sapiens
  light chain complementarity determining region 3 for antibody 7581
QQYDGSPPWT

SEQ ID NO: 15162 - protein, 14 aa, Homo sapiens
  heavy chain complementarity determining region 3 for antibody 7581
SRPTRGARLPIFDY

SEQ ID NO: 15163 - protein, 10 aa, Homo sapiens
  light chain complementarity determining region 3 for antibody 7582
QQYDGSPPWT

SEQ ID NO: 15164 - protein, 14 aa, Homo sapiens
  heavy chain complementarity determining region 3 for antibody 7582
SPPTRGARLPIFDY

SEQ ID NO: 15165 - protein, 10 aa, Homo sapiens
  light chain complementarity determining region 3 for antibody 7583
QQYDGSPPWT

SEQ ID NO: 15166 - protein, 14 aa, Homo sapiens
  heavy chain complementarity determining region 3 for antibody 7583
SHPTRGARLPTFDY

SEQ ID NO: 15167 - protein, 10 aa, Homo sapiens
  light chain complementarity determining region 3 for antibody 7584
QQYDGSPPWT

SEQ ID NO: 15168 - protein, 14 aa, Homo sapiens
  heavy chain complementarity determining region 3 for antibody 7584
AHPTRGARLPIFDY

SEQ ID NO: 15169 - protein, 10 aa, Homo sapiens
  light chain complementarity determining region 3 for antibody 7585
QQYDGSPPRT

SEQ ID NO: 15170 - protein, 14 aa, Homo sapiens
  heavy chain complementarity determining region 3 for antibody 7585
SHPTRGARLPIFDY

SEQ ID NO: 15171 - protein, 10 aa, Homo sapiens
  light chain complementarity determining region 3 for antibody 7586
QQYDGSPPGT

SEQ ID NO: 15172 - protein, 14 aa, Homo sapiens
  heavy chain complementarity determining region 3 for antibody 7586
SHPTRGARLPIFDY

SEQ ID NO: 15173 - protein, 9 aa, Homo sapiens
  light chain complementarity determining region 3 for antibody 7587
QQYDDWPWT

SEQ ID NO: 15174 - protein, 17 aa, Homo sapiens
  heavy chain complementarity determining region 3 for antibody 7587
VTHYYHDSGIYHDFFNY

SEQ ID NO: 15175 - protein, 11 aa, Homo sapiens
  light chain complementarity determining region 3 for antibody 7588
QQYDDLPGALT

SEQ ID NO: 15176 - protein, 13 aa, Homo sapiens
  heavy chain complementarity determining region 3 for antibody 7588
AKEGSSPGPDFDY

SEQ ID NO: 15177 - protein, 10 aa, Homo sapiens
  light chain complementarity determining region 3 for antibody 7589
QQYAYSPPWT

SEQ ID NO: 15178 - protein, 14 aa, Homo sapiens
  heavy chain complementarity determining region 3 for antibody 7589
SHPTRAARLPIFDY

SEQ ID NO: 15179 - protein, 9 aa, Homo sapiens
  light chain complementarity determining region 3 for antibody 7590
QQYATSPLT

SEQ ID NO: 15180 - protein, 20 aa, Homo sapiens
  heavy chain complementarity determining region 3 for antibody 7590
TRDARGSSSYAYGGGGGLDV

SEQ ID NO: 15181 - protein, 9 aa, Homo sapiens
  light chain complementarity determining region 3 for antibody 7591
QQYATSPLT

SEQ ID NO: 15182 - protein, 15 aa, Homo sapiens
  heavy chain complementarity determining region 3 for antibody 7591
ARIWTSSTNCRYMDV

SEQ ID NO: 15183 - protein, 9 aa, Homo sapiens
  light chain complementarity determining region 3 for antibody 7592
QQYATSPLT

SEQ ID NO: 15184 - protein, 10 aa, Homo sapiens
  heavy chain complementarity determining region 3 for antibody 7592
ARETSGSYDI

SEQ ID NO: 15185 - protein, 9 aa, Homo sapiens
  light chain complementarity determining region 3 for antibody 7593
QQYATSPLT

SEQ ID NO: 15186 - protein, 14 aa, Homo sapiens
  heavy chain complementarity determining region 3 for antibody 7593
ARASGGDTDFLTDF

SEQ ID NO: 15187 - protein, 9 aa, Homo sapiens
  light chain complementarity determining region 3 for antibody 7594
QQYATSPLT

SEQ ID NO: 15188 - protein, 14 aa, Homo sapiens
  heavy chain complementarity determining region 3 for antibody 7594
ARASGGDTDFLIGF

SEQ ID NO: 15189 - protein, 9 aa, Homo sapiens
  light chain complementarity determining region 3 for antibody 7595
QQYATSPLT

SEQ ID NO: 15190 - protein, 14 aa, Homo sapiens
  heavy chain complementarity determining region 3 for antibody 7595
ARASGGDTDFLIDV

SEQ ID NO: 15191 - protein, 9 aa, Homo sapiens
  light chain complementarity determining region 3 for antibody 7596
QQYATSPLT

SEQ ID NO: 15192 - protein, 14 aa, Homo sapiens
  heavy chain complementarity determining region 3 for antibody 7596
ARASGGDADFLIDF

SEQ ID NO: 15193 - protein, 9 aa, Homo sapiens
  light chain complementarity determining region 3 for antibody 7597
QQYATSART

SEQ ID NO: 15194 - protein, 12 aa, Homo sapiens
  heavy chain complementarity determining region 3 for antibody 7597
QGGNWGRDGFDV

SEQ ID NO: 15195 - protein, 9 aa, Homo sapiens
  light chain complementarity determining region 3 for antibody 7598
QQYATDSYT

SEQ ID NO: 15196 - protein, 16 aa, Homo sapiens
  heavy chain complementarity determining region 3 for antibody 7598
ARDHCTTIKCPDAFDI

SEQ ID NO: 15197 - protein, 9 aa, Homo sapiens
  light chain complementarity determining region 3 for antibody 7599
QQYASEPFP

SEQ ID NO: 15198 - protein, 11 aa, Homo sapiens
  heavy chain complementarity determining region 3 for antibody 7599
ATGYDNVKVGY

SEQ ID NO: 15199 - protein, 9 aa, Homo sapiens
  light chain complementarity determining region 3 for antibody 7600
QQYASDSYT

SEQ ID NO: 15200 - protein, 14 aa, Homo sapiens
  heavy chain complementarity determining region 3 for antibody 7600
ARGHFDSTGFRLDY

SEQ ID NO: 15201 - protein, 9 aa, Homo sapiens
  light chain complementarity determining region 3 for antibody 7601
QQYASDSYT

SEQ ID NO: 15202 - protein, 16 aa, Homo sapiens
  heavy chain complementarity determining region 3 for antibody 7601
ARDRCTTIKCPDAFDI

SEQ ID NO: 15203 - protein, 9 aa, Homo sapiens
  light chain complementarity determining region 3 for antibody 7602
QQYASDSYT

SEQ ID NO: 15204 - protein, 12 aa, Homo sapiens
  heavy chain complementarity determining region 3 for antibody 7602
ARDKGGRNGMDV

SEQ ID NO: 15205 - protein, 9 aa, Homo sapiens
  light chain complementarity determining region 3 for antibody 7603
QQYASDSYT

SEQ ID NO: 15206 - protein, 16 aa, Homo sapiens
  heavy chain complementarity determining region 3 for antibody 7603
ARDHRTTIKCPDAFDI

SEQ ID NO: 15207 - protein, 9 aa, Homo sapiens
  light chain complementarity determining region 3 for antibody 7604
QQYASDSYT

SEQ ID NO: 15208 - protein, 16 aa, Homo sapiens
  heavy chain complementarity determining region 3 for antibody 7604
ARDHCTTIKCPDDFDI

SEQ ID NO: 15209 - protein, 9 aa, Homo sapiens
  light chain complementarity determining region 3 for antibody 7605
QQYASDSYT

SEQ ID NO: 15210 - protein, 16 aa, Homo sapiens
  heavy chain complementarity determining region 3 for antibody 7605
ARDHCATIKCPDAFDI

SEQ ID NO: 15211 - protein, 9 aa, Homo sapiens
  light chain complementarity determining region 3 for antibody 7606
QQYASDSST

SEQ ID NO: 15212 - protein, 16 aa, Homo sapiens
  heavy chain complementarity determining region 3 for antibody 7606
ARDHCTTIKCPDAFDI

SEQ ID NO: 15213 - protein, 9 aa, Homo sapiens
  light chain complementarity determining region 3 for antibody 7607
QQYASDSHT

SEQ ID NO: 15214 - protein, 16 aa, Homo sapiens
  heavy chain complementarity determining region 3 for antibody 7607
ARDHCTTIKCPDAFDI

SEQ ID NO: 15215 - protein, 9 aa, Homo sapiens
  light chain complementarity determining region 3 for antibody 7608
QQYANWPWT

SEQ ID NO: 15216 - protein, 17 aa, Homo sapiens
  heavy chain complementarity determining region 3 for antibody 7608
VTHYYHDSGIYYDFFNY

SEQ ID NO: 15217 - protein, 9 aa, Homo sapiens
  light chain complementarity determining region 3 for antibody 7609
QQYAKSPIT

SEQ ID NO: 15218 - protein, 14 aa, Homo sapiens
  heavy chain complementarity determining region 3 for antibody 7609
ARASSGDVDFLINF

SEQ ID NO: 15219 - protein, 9 aa, Homo sapiens
  light chain complementarity determining region 3 for antibody 7610
QQYAKSPIT

SEQ ID NO: 15220 - protein, 15 aa, Homo sapiens
  heavy chain complementarity determining region 3 for antibody 7610
ARASRGGYISFLIEL

SEQ ID NO: 15221 - protein, 9 aa, Homo sapiens
  light chain complementarity determining region 3 for antibody 7611
QQYAKSPIT

SEQ ID NO: 15222 - protein, 14 aa, Homo sapiens
  heavy chain complementarity determining region 3 for antibody 7611
ARASRGEIDCLIDS

SEQ ID NO: 15223 - protein, 9 aa, Homo sapiens
  light chain complementarity determining region 3 for antibody 7612
QQYAKSPIP

SEQ ID NO: 15224 - protein, 15 aa, Homo sapiens
  heavy chain complementarity determining region 3 for antibody 7612
ARASRGGYISFLIEF

SEQ ID NO: 15225 - protein, 9 aa, Homo sapiens
  light chain complementarity determining region 3 for antibody 7613
QQYAKAPPT

SEQ ID NO: 15226 - protein, 9 aa, Homo sapiens
  heavy chain complementarity determining region 3 for antibody 7613
VRADWLHDY

SEQ ID NO: 15227 - protein, 9 aa, Homo sapiens
  light chain complementarity determining region 3 for antibody 7614
QQYAKAPLT

SEQ ID NO: 15228 - protein, 9 aa, Homo sapiens
  heavy chain complementarity determining region 3 for antibody 7614
VRVDWLHDY

SEQ ID NO: 15229 - protein, 9 aa, Homo sapiens
  light chain complementarity determining region 3 for antibody 7615
QQYAKAPLT

SEQ ID NO: 15230 - protein, 9 aa, Homo sapiens
  heavy chain complementarity determining region 3 for antibody 7615
VRADWRHDY

SEQ ID NO: 15231 - protein, 9 aa, Homo sapiens
  light chain complementarity determining region 3 for antibody 7616
QQYAKAPLT

SEQ ID NO: 15232 - protein, 9 aa, Homo sapiens
  heavy chain complementarity determining region 3 for antibody 7616
VGADWLHDY

SEQ ID NO: 15233 - protein, 9 aa, Homo sapiens
  light chain complementarity determining region 3 for antibody 7617
QQYAKAPLT

SEQ ID NO: 15234 - protein, 12 aa, Homo sapiens
  heavy chain complementarity determining region 3 for antibody 7617
ARLDWNYRAFDI

SEQ ID NO: 15235 - protein, 9 aa, Homo sapiens
  light chain complementarity determining region 3 for antibody 7618
QQYAKAPLT

SEQ ID NO: 15236 - protein, 17 aa, Homo sapiens
  heavy chain complementarity determining region 3 for antibody 7618
AKGRGSVAMALIYYLDL

SEQ ID NO: 15237 - protein, 8 aa, Homo sapiens
  light chain complementarity determining region 3 for antibody 7619
QQYAGLWT

SEQ ID NO: 15238 - protein, 7 aa, Homo sapiens
  heavy chain complementarity determining region 3 for antibody 7619
TTGDLRN

SEQ ID NO: 15239 - protein, 9 aa, Homo sapiens
  light chain complementarity determining region 3 for antibody 7620
QQYAAAPLT

SEQ ID NO: 15240 - protein, 9 aa, Homo sapiens
  heavy chain complementarity determining region 3 for antibody 7620
ARADWIHDY

SEQ ID NO: 15241 - protein, 9 aa, Homo sapiens
  light chain complementarity determining region 3 for antibody 7621
QQWAHSPLT

SEQ ID NO: 15242 - protein, 13 aa, Homo sapiens
  heavy chain complementarity determining region 3 for antibody 7621
VGGLYSGTWYGGY

SEQ ID NO: 15243 - protein, 10 aa, Homo sapiens
  light chain complementarity determining region 3 for antibody 7622
QQVNSYPPST

SEQ ID NO: 15244 - protein, 9 aa, Homo sapiens
  heavy chain complementarity determining region 3 for antibody 7622
ARSEYQPTY

SEQ ID NO: 15245 - protein, 9 aa, Homo sapiens
  light chain complementarity determining region 3 for antibody 7623
QQTYSTPLT

SEQ ID NO: 15246 - protein, 10 aa, Homo sapiens
  heavy chain complementarity determining region 3 for antibody 7623
ARERSSSYDI

SEQ ID NO: 15247 - protein, 9 aa, Homo sapiens
  light chain complementarity determining region 3 for antibody 7624
QQTYSTPLT

SEQ ID NO: 15248 - protein, 11 aa, Homo sapiens
  heavy chain complementarity determining region 3 for antibody 7624
ANSGGDWYFVN

SEQ ID NO: 15249 - protein, 9 aa, Homo sapiens
  light chain complementarity determining region 3 for antibody 7625
QQTYSSTWT

SEQ ID NO: 15250 - protein, 15 aa, Homo sapiens
  heavy chain complementarity determining region 3 for antibody 7625
ARIWTSSTNCRYMDV

SEQ ID NO: 15251 - protein, 9 aa, Homo sapiens
  light chain complementarity determining region 3 for antibody 7626
QQTYSSRWT

SEQ ID NO: 15252 - protein, 15 aa, Homo sapiens
  heavy chain complementarity determining region 3 for antibody 7626
ARVPTLDSGTLGFDY

SEQ ID NO: 15253 - protein, 9 aa, Homo sapiens
  light chain complementarity determining region 3 for antibody 7627
QQTYSSPWT

SEQ ID NO: 15254 - protein, 16 aa, Homo sapiens
  heavy chain complementarity determining region 3 for antibody 7627
VRDLAGFTRGGSTFDY

SEQ ID NO: 15255 - protein, 9 aa, Homo sapiens
  light chain complementarity determining region 3 for antibody 7628
QQTYSSPWT

SEQ ID NO: 15256 - protein, 11 aa, Homo sapiens
  heavy chain complementarity determining region 3 for antibody 7628
TRGGYSVGFDY

SEQ ID NO: 15257 - protein, 9 aa, Homo sapiens
  light chain complementarity determining region 3 for antibody 7629
QQTYSSPWT

SEQ ID NO: 15258 - protein, 11 aa, Homo sapiens
  heavy chain complementarity determining region 3 for antibody 7629
TRGGYGVGYDY

SEQ ID NO: 15259 - protein, 9 aa, Homo sapiens
  light chain complementarity determining region 3 for antibody 7630
QQTYSSPWT

SEQ ID NO: 15260 - protein, 20 aa, Homo sapiens
  heavy chain complementarity determining region 3 for antibody 7630
TRDARGSISYAYGGGGGLDV

SEQ ID NO: 15261 - protein, 9 aa, Homo sapiens
  light chain complementarity determining region 3 for antibody 7631
QQTYSSPWT

SEQ ID NO: 15262 - protein, 15 aa, Homo sapiens
  heavy chain complementarity determining region 3 for antibody 7631
SRIWTSSTNCRYMDV

SEQ ID NO: 15263 - protein, 9 aa, Homo sapiens
  light chain complementarity determining region 3 for antibody 7632
QQTYSSPWT

SEQ ID NO: 15264 - protein, 9 aa, Homo sapiens
  heavy chain complementarity determining region 3 for antibody 7632
GSRRPYFDS

SEQ ID NO: 15265 - protein, 9 aa, Homo sapiens
  light chain complementarity determining region 3 for antibody 7633
QQTYSSPWT

SEQ ID NO: 15266 - protein, 15 aa, Homo sapiens
  heavy chain complementarity determining region 3 for antibody 7633
GRIWTSSTNCRYMDV

SEQ ID NO: 15267 - protein, 9 aa, Homo sapiens
  light chain complementarity determining region 3 for antibody 7634
QQTYSSPWT

SEQ ID NO: 15268 - protein, 10 aa, Homo sapiens
  heavy chain complementarity determining region 3 for antibody 7634
CRDRWGFGDV

SEQ ID NO: 15269 - protein, 9 aa, Homo sapiens
  light chain complementarity determining region 3 for antibody 7635
QQTYSSPWT

SEQ ID NO: 15270 - protein, 15 aa, Homo sapiens
  heavy chain complementarity determining region 3 for antibody 7635
ARVWTSSPNCRYMDV

SEQ ID NO: 15271 - protein, 9 aa, Homo sapiens
  light chain complementarity determining region 3 for antibody 7636
QQTYSSPWT

SEQ ID NO: 15272 - protein, 15 aa, Homo sapiens
  heavy chain complementarity determining region 3 for antibody 7636
ARSWTSSANCRYMDV

SEQ ID NO: 15273 - protein, 9 aa, Homo sapiens
  light chain complementarity determining region 3 for antibody 7637
QQTYSSPWT

SEQ ID NO: 15274 - protein, 15 aa, Homo sapiens
  heavy chain complementarity determining region 3 for antibody 7637
ARSWTRSTNCRYMDV

SEQ ID NO: 15275 - protein, 9 aa, Homo sapiens
  light chain complementarity determining region 3 for antibody 7638
QQTYSSPWT

SEQ ID NO: 15276 - protein, 15 aa, Homo sapiens
  heavy chain complementarity determining region 3 for antibody 7638
ARMWTSSTNCRYMDV

SEQ ID NO: 15277 - protein, 9 aa, Homo sapiens
  light chain complementarity determining region 3 for antibody 7639
QQTYSSPWT

SEQ ID NO: 15278 - protein, 14 aa, Homo sapiens
  heavy chain complementarity determining region 3 for antibody 7639
ARLHGSGLGRWLDP

SEQ ID NO: 15279 - protein, 9 aa, Homo sapiens
  light chain complementarity determining region 3 for antibody 7640
QQTYSSPWT

SEQ ID NO: 15280 - protein, 15 aa, Homo sapiens
  heavy chain complementarity determining region 3 for antibody 7640
ARIWTSSTYCRYMDV

SEQ ID NO: 15281 - protein, 9 aa, Homo sapiens
  light chain complementarity determining region 3 for antibody 7641
QQTYSSPWT

SEQ ID NO: 15282 - protein, 15 aa, Homo sapiens
  heavy chain complementarity determining region 3 for antibody 7641
ARIWTSSTNYRYMDV

SEQ ID NO: 15283 - protein, 9 aa, Homo sapiens
  light chain complementarity determining region 3 for antibody 7642
QQTYSSPWT

SEQ ID NO: 15284 - protein, 15 aa, Homo sapiens
  heavy chain complementarity determining region 3 for antibody 7642
ARIWTSSTNSRYMDV

SEQ ID NO: 15285 - protein, 9 aa, Homo sapiens
  light chain complementarity determining region 3 for antibody 7643
QQTYSSPWT

SEQ ID NO: 15286 - protein, 15 aa, Homo sapiens
  heavy chain complementarity determining region 3 for antibody 7643
ARIWTSSTNCRYMNV

SEQ ID NO: 15287 - protein, 9 aa, Homo sapiens
  light chain complementarity determining region 3 for antibody 7644
QQTYSSPWT

SEQ ID NO: 15288 - protein, 15 aa, Homo sapiens
  heavy chain complementarity determining region 3 for antibody 7644
ARIWTSSTNCRFMDV

SEQ ID NO: 15289 - protein, 9 aa, Homo sapiens
  light chain complementarity determining region 3 for antibody 7645
QQTYSSPWT

SEQ ID NO: 15290 - protein, 15 aa, Homo sapiens
  heavy chain complementarity determining region 3 for antibody 7645
ARIWTSSTKCRYMDV

SEQ ID NO: 15291 - protein, 9 aa, Homo sapiens
  light chain complementarity determining region 3 for antibody 7646
QQTYSSPWT

SEQ ID NO: 15292 - protein, 15 aa, Homo sapiens
  heavy chain complementarity determining region 3 for antibody 7646
ARIWTSSTICRYMDV

SEQ ID NO: 15293 - protein, 9 aa, Homo sapiens
  light chain complementarity determining region 3 for antibody 7647
QQTYSSPWT

SEQ ID NO: 15294 - protein, 15 aa, Homo sapiens
  heavy chain complementarity determining region 3 for antibody 7647
ARIWTSSTHCRYMDV

SEQ ID NO: 15295 - protein, 9 aa, Homo sapiens
  light chain complementarity determining region 3 for antibody 7648
QQTYSSPWT

SEQ ID NO: 15296 - protein, 15 aa, Homo sapiens
  heavy chain complementarity determining region 3 for antibody 7648
ARIWTSSTDCRYMDV

SEQ ID NO: 15297 - protein, 9 aa, Homo sapiens
  light chain complementarity determining region 3 for antibody 7649
QQTYSSPWT

SEQ ID NO: 15298 - protein, 15 aa, Homo sapiens
  heavy chain complementarity determining region 3 for antibody 7649
ARIWTSSNNCRYMDV

SEQ ID NO: 15299 - protein, 9 aa, Homo sapiens
  light chain complementarity determining region 3 for antibody 7650
QQTYSSPWT

SEQ ID NO: 15300 - protein, 15 aa, Homo sapiens
  heavy chain complementarity determining region 3 for antibody 7650
ARIWTSGTSCRYMDV

SEQ ID NO: 15301 - protein, 9 aa, Homo sapiens
  light chain complementarity determining region 3 for antibody 7651
QQTYSSPWT

SEQ ID NO: 15302 - protein, 15 aa, Homo sapiens
  heavy chain complementarity determining region 3 for antibody 7651
ARIWTSCTNCRYMDV

SEQ ID NO: 15303 - protein, 9 aa, Homo sapiens
  light chain complementarity determining region 3 for antibody 7652
QQTYSSPWT

SEQ ID NO: 15304 - protein, 15 aa, Homo sapiens
  heavy chain complementarity determining region 3 for antibody 7652
ARIWTRSANCRYMDV

SEQ ID NO: 15305 - protein, 9 aa, Homo sapiens
  light chain complementarity determining region 3 for antibody 7653
QQTYSSPWT

SEQ ID NO: 15306 - protein, 15 aa, Homo sapiens
  heavy chain complementarity determining region 3 for antibody 7653
ARIWTGSTNCRYMDV

SEQ ID NO: 15307 - protein, 9 aa, Homo sapiens
  light chain complementarity determining region 3 for antibody 7654
QQTYSSPWT

SEQ ID NO: 15308 - protein, 15 aa, Homo sapiens
  heavy chain complementarity determining region 3 for antibody 7654
ARIWSSSTNCRYMDV

SEQ ID NO: 15309 - protein, 9 aa, Homo sapiens
  light chain complementarity determining region 3 for antibody 7655
QQTYSSPWT

SEQ ID NO: 15310 - protein, 15 aa, Homo sapiens
  heavy chain complementarity determining region 3 for antibody 7655
ARIWPSSANCRYMDV

SEQ ID NO: 15311 - protein, 9 aa, Homo sapiens
  light chain complementarity determining region 3 for antibody 7656
QQTYSSPWT

SEQ ID NO: 15312 - protein, 6 aa, Homo sapiens
  heavy chain complementarity determining region 3 for antibody 7656
ARISAY

SEQ ID NO: 15313 - protein, 9 aa, Homo sapiens
  light chain complementarity determining region 3 for antibody 7657
QQTYSSPWT

SEQ ID NO: 15314 - protein, 15 aa, Homo sapiens
  heavy chain complementarity determining region 3 for antibody 7657
ARIGTSSTTCRYMDV

SEQ ID NO: 15315 - protein, 9 aa, Homo sapiens
  light chain complementarity determining region 3 for antibody 7658
QQTYSSPWT

SEQ ID NO: 15316 - protein, 15 aa, Homo sapiens
  heavy chain complementarity determining region 3 for antibody 7658
ARIGTSSPNCRYMDV

SEQ ID NO: 15317 - protein, 9 aa, Homo sapiens
  light chain complementarity determining region 3 for antibody 7659
QQTYSSPWT

SEQ ID NO: 15318 - protein, 15 aa, Homo sapiens
  heavy chain complementarity determining region 3 for antibody 7659
ARGPTLDSGTLGFDY

SEQ ID NO: 15319 - protein, 9 aa, Homo sapiens
  light chain complementarity determining region 3 for antibody 7660
QQTYSSPWT

SEQ ID NO: 15320 - protein, 10 aa, Homo sapiens
  heavy chain complementarity determining region 3 for antibody 7660
ARGGLARDVS

SEQ ID NO: 15321 - protein, 9 aa, Homo sapiens
  light chain complementarity determining region 3 for antibody 7661
QQTYSSPWT

SEQ ID NO: 15322 - protein, 10 aa, Homo sapiens
  heavy chain complementarity determining region 3 for antibody 7661
ARGGLAGYVS

SEQ ID NO: 15323 - protein, 9 aa, Homo sapiens
  light chain complementarity determining region 3 for antibody 7662
QQTYSSPWT

SEQ ID NO: 15324 - protein, 10 aa, Homo sapiens
  heavy chain complementarity determining region 3 for antibody 7662
ARGGLAEDVS

SEQ ID NO: 15325 - protein, 9 aa, Homo sapiens
  light chain complementarity determining region 3 for antibody 7663
QQTYSSPWT

SEQ ID NO: 15326 - protein, 10 aa, Homo sapiens
  heavy chain complementarity determining region 3 for antibody 7663
ARETSGSYDI

SEQ ID NO: 15327 - protein, 9 aa, Homo sapiens
  light chain complementarity determining region 3 for antibody 7664
QQTYSSPWT

SEQ ID NO: 15328 - protein, 11 aa, Homo sapiens
  heavy chain complementarity determining region 3 for antibody 7664
AREQHGQAPDY

SEQ ID NO: 15329 - protein, 9 aa, Homo sapiens
  light chain complementarity determining region 3 for antibody 7665
QQTYSSPWT

SEQ ID NO: 15330 - protein, 15 aa, Homo sapiens
  heavy chain complementarity determining region 3 for antibody 7665
ALIWTSSTNCRYMDV

SEQ ID NO: 15331 - protein, 9 aa, Homo sapiens
  light chain complementarity determining region 3 for antibody 7666
QQTYSSPWT

SEQ ID NO: 15332 - protein, 13 aa, Homo sapiens
  heavy chain complementarity determining region 3 for antibody 7666
AKEGSAPGPDFEY

SEQ ID NO: 15333 - protein, 9 aa, Homo sapiens
  light chain complementarity determining region 3 for antibody 7667
QQTYSSPWT

SEQ ID NO: 15334 - protein, 15 aa, Homo sapiens
  heavy chain complementarity determining region 3 for antibody 7667
AGIWTSGTNCRYMDV

SEQ ID NO: 15335 - protein, 9 aa, Homo sapiens
  light chain complementarity determining region 3 for antibody 7668
QQTYSSPWS

SEQ ID NO: 15336 - protein, 15 aa, Homo sapiens
  heavy chain complementarity determining region 3 for antibody 7668
ARIWTSSTNCRYMDV

SEQ ID NO: 15337 - protein, 9 aa, Homo sapiens
  light chain complementarity determining region 3 for antibody 7669
QQTYSSPWP

SEQ ID NO: 15338 - protein, 10 aa, Homo sapiens
  heavy chain complementarity determining region 3 for antibody 7669
ARGGLAGDVS

SEQ ID NO: 15339 - protein, 9 aa, Homo sapiens
  light chain complementarity determining region 3 for antibody 7670
QQTYSSPWM

SEQ ID NO: 15340 - protein, 15 aa, Homo sapiens
  heavy chain complementarity determining region 3 for antibody 7670
ARIWTSSTNCRYMDV

SEQ ID NO: 15341 - protein, 9 aa, Homo sapiens
  light chain complementarity determining region 3 for antibody 7671
QQTYSSPRT

SEQ ID NO: 15342 - protein, 15 aa, Homo sapiens
  heavy chain complementarity determining region 3 for antibody 7671
ARIWTSSPNCRYMDV

SEQ ID NO: 15343 - protein, 9 aa, Homo sapiens
  light chain complementarity determining region 3 for antibody 7672
QQTYSSPPT

SEQ ID NO: 15344 - protein, 15 aa, Homo sapiens
  heavy chain complementarity determining region 3 for antibody 7672
VRGIVLRRGVWGMDV

SEQ ID NO: 15345 - protein, 9 aa, Homo sapiens
  light chain complementarity determining region 3 for antibody 7673
QQTYSSPCT

SEQ ID NO: 15346 - protein, 15 aa, Homo sapiens
  heavy chain complementarity determining region 3 for antibody 7673
ARIWTSSTTCRYMDV

SEQ ID NO: 15347 - protein, 9 aa, Homo sapiens
  light chain complementarity determining region 3 for antibody 7674
QQTYSSLWT

SEQ ID NO: 15348 - protein, 15 aa, Homo sapiens
  heavy chain complementarity determining region 3 for antibody 7674
ARIWTSSTNCRYMDV

SEQ ID NO: 15349 - protein, 9 aa, Homo sapiens
  light chain complementarity determining region 3 for antibody 7675
QQTYSGPWT

SEQ ID NO: 15350 - protein, 15 aa, Homo sapiens
  heavy chain complementarity determining region 3 for antibody 7675
ARIWTSSTNCRYMDV

SEQ ID NO: 15351 - protein, 9 aa, Homo sapiens
  light chain complementarity determining region 3 for antibody 7676
QQTYRTQYT

SEQ ID NO: 15352 - protein, 14 aa, Homo sapiens
  heavy chain complementarity determining region 3 for antibody 7676
ARLHGSGLGRWLDP

SEQ ID NO: 15353 - protein, 9 aa, Homo sapiens
  light chain complementarity determining region 3 for antibody 7677
QQTYRTPYT

SEQ ID NO: 15354 - protein, 9 aa, Homo sapiens
  heavy chain complementarity determining region 3 for antibody 7677
VRNNYHMDV

SEQ ID NO: 15355 - protein, 9 aa, Homo sapiens
  light chain complementarity determining region 3 for antibody 7678
QQTYRTPYT

SEQ ID NO: 15356 - protein, 16 aa, Homo sapiens
  heavy chain complementarity determining region 3 for antibody 7678
VRDLAGFTRGGSTFDY

SEQ ID NO: 15357 - protein, 9 aa, Homo sapiens
  light chain complementarity determining region 3 for antibody 7679
QQTYRTPYT

SEQ ID NO: 15358 - protein, 12 aa, Homo sapiens
  heavy chain complementarity determining region 3 for antibody 7679
SRDKGGRNGMDV

SEQ ID NO: 15359 - protein, 9 aa, Homo sapiens
  light chain complementarity determining region 3 for antibody 7680
QQTYRTPYT

SEQ ID NO: 15360 - protein, 17 aa, Homo sapiens
  heavy chain complementarity determining region 3 for antibody 7680
SRDGRIEWPGSQGSLDS

SEQ ID NO: 15361 - protein, 9 aa, Homo sapiens
  light chain complementarity determining region 3 for antibody 7681
QQTYRTPYT

SEQ ID NO: 15362 - protein, 10 aa, Homo sapiens
  heavy chain complementarity determining region 3 for antibody 7681
CRDREGFGDV

SEQ ID NO: 15363 - protein, 9 aa, Homo sapiens
  light chain complementarity determining region 3 for antibody 7682
QQTYRTPYT

SEQ ID NO: 15364 - protein, 14 aa, Homo sapiens
  heavy chain complementarity determining region 3 for antibody 7682
ASLHGSGLGRWLDP

SEQ ID NO: 15365 - protein, 9 aa, Homo sapiens
  light chain complementarity determining region 3 for antibody 7683
QQTYRTPYT

SEQ ID NO: 15366 - protein, 10 aa, Homo sapiens
  heavy chain complementarity determining region 3 for antibody 7683
ARRINRAFDI

SEQ ID NO: 15367 - protein, 9 aa, Homo sapiens
  light chain complementarity determining region 3 for antibody 7684
QQTYRTPYT

SEQ ID NO: 15368 - protein, 14 aa, Homo sapiens
  heavy chain complementarity determining region 3 for antibody 7684
ARLNGSGLGRWLDP

SEQ ID NO: 15369 - protein, 9 aa, Homo sapiens
  light chain complementarity determining region 3 for antibody 7685
QQTYRTPYT

SEQ ID NO: 15370 - protein, 14 aa, Homo sapiens
  heavy chain complementarity determining region 3 for antibody 7685
ARLHVSGLGRWLDP

SEQ ID NO: 15371 - protein, 9 aa, Homo sapiens
  light chain complementarity determining region 3 for antibody 7686
QQTYRTPYT

SEQ ID NO: 15372 - protein, 14 aa, Homo sapiens
  heavy chain complementarity determining region 3 for antibody 7686
ARLHGTGLGRWLDP

SEQ ID NO: 15373 - protein, 9 aa, Homo sapiens
  light chain complementarity determining region 3 for antibody 7687
QQTYRTPYT

SEQ ID NO: 15374 - protein, 14 aa, Homo sapiens
  heavy chain complementarity determining region 3 for antibody 7687
ARLHGSGSGRWLDP

SEQ ID NO: 15375 - protein, 9 aa, Homo sapiens
  light chain complementarity determining region 3 for antibody 7688
QQTYRTPYT

SEQ ID NO: 15376 - protein, 14 aa, Homo sapiens
  heavy chain complementarity determining region 3 for antibody 7688
ARLHGSGLVRWLDP

SEQ ID NO: 15377 - protein, 9 aa, Homo sapiens
  light chain complementarity determining region 3 for antibody 7689
QQTYRTPYT

SEQ ID NO: 15378 - protein, 14 aa, Homo sapiens
  heavy chain complementarity determining region 3 for antibody 7689
ARLHGSGLRRWLDP

SEQ ID NO: 15379 - protein, 9 aa, Homo sapiens
  light chain complementarity determining region 3 for antibody 7690
QQTYRTPYT

SEQ ID NO: 15380 - protein, 14 aa, Homo sapiens
  heavy chain complementarity determining region 3 for antibody 7690
ARLHGSGLGRWRDP

SEQ ID NO: 15381 - protein, 9 aa, Homo sapiens
  light chain complementarity determining region 3 for antibody 7691
QQTYRTPYT

SEQ ID NO: 15382 - protein, 14 aa, Homo sapiens
  heavy chain complementarity determining region 3 for antibody 7691
ARLHGSGLGRWLYP

SEQ ID NO: 15383 - protein, 9 aa, Homo sapiens
  light chain complementarity determining region 3 for antibody 7692
QQTYRTPYT

SEQ ID NO: 15384 - protein, 14 aa, Homo sapiens
  heavy chain complementarity determining region 3 for antibody 7692
ARLHGSGLGRWLDT

SEQ ID NO: 15385 - protein, 9 aa, Homo sapiens
  light chain complementarity determining region 3 for antibody 7693
QQTYRTPYT

SEQ ID NO: 15386 - protein, 14 aa, Homo sapiens
  heavy chain complementarity determining region 3 for antibody 7693
ARLHGSGLGRWLDS

SEQ ID NO: 15387 - protein, 9 aa, Homo sapiens
  light chain complementarity determining region 3 for antibody 7694
QQTYRTPYT

SEQ ID NO: 15388 - protein, 14 aa, Homo sapiens
  heavy chain complementarity determining region 3 for antibody 7694
ARLHGSGLGRWLAP

SEQ ID NO: 15389 - protein, 9 aa, Homo sapiens
  light chain complementarity determining region 3 for antibody 7695
QQTYRTPYT

SEQ ID NO: 15390 - protein, 14 aa, Homo sapiens
  heavy chain complementarity determining region 3 for antibody 7695
ARLHGSGLGRRLDP

SEQ ID NO: 15391 - protein, 9 aa, Homo sapiens
  light chain complementarity determining region 3 for antibody 7696
QQTYRTPYT

SEQ ID NO: 15392 - protein, 14 aa, Homo sapiens
  heavy chain complementarity determining region 3 for antibody 7696
ARLHGSGLGRGLDP

SEQ ID NO: 15393 - protein, 9 aa, Homo sapiens
  light chain complementarity determining region 3 for antibody 7697
QQTYRTPYT

SEQ ID NO: 15394 - protein, 14 aa, Homo sapiens
  heavy chain complementarity determining region 3 for antibody 7697
ARLHGSGLGKWLDP

SEQ ID NO: 15395 - protein, 9 aa, Homo sapiens
  light chain complementarity determining region 3 for antibody 7698
QQTYRTPYT

SEQ ID NO: 15396 - protein, 14 aa, Homo sapiens
  heavy chain complementarity determining region 3 for antibody 7698
ARLHGSGLERWLDP

SEQ ID NO: 15397 - protein, 9 aa, Homo sapiens
  light chain complementarity determining region 3 for antibody 7699
QQTYRTPYT

SEQ ID NO: 15398 - protein, 14 aa, Homo sapiens
  heavy chain complementarity determining region 3 for antibody 7699
ARLHGPGLGRWLDP

SEQ ID NO: 15399 - protein, 9 aa, Homo sapiens
  light chain complementarity determining region 3 for antibody 7700
QQTYRTPYT

SEQ ID NO: 15400 - protein, 14 aa, Homo sapiens
  heavy chain complementarity determining region 3 for antibody 7700
ARLHGAGLGRWLDP

SEQ ID NO: 15401 - protein, 9 aa, Homo sapiens
  light chain complementarity determining region 3 for antibody 7701
QQTYRTPYT

SEQ ID NO: 15402 - protein, 14 aa, Homo sapiens
  heavy chain complementarity determining region 3 for antibody 7701
ARLHDSGLGRWLDP

SEQ ID NO: 15403 - protein, 9 aa, Homo sapiens
  light chain complementarity determining region 3 for antibody 7702
QQTYRTPYT

SEQ ID NO: 15404 - protein, 15 aa, Homo sapiens
  heavy chain complementarity determining region 3 for antibody 7702
ARLGLLAGGPNWFDP

SEQ ID NO: 15405 - protein, 9 aa, Homo sapiens
  light chain complementarity determining region 3 for antibody 7703
QQTYRTPYT

SEQ ID NO: 15406 - protein, 12 aa, Homo sapiens
  heavy chain complementarity determining region 3 for antibody 7703
ARLDWNYRAFDI

SEQ ID NO: 15407 - protein, 9 aa, Homo sapiens
  light chain complementarity determining region 3 for antibody 7704
QQTYRTPYT

SEQ ID NO: 15408 - protein, 15 aa, Homo sapiens
  heavy chain complementarity determining region 3 for antibody 7704
ARIWTSSTNCRYMDV

SEQ ID NO: 15409 - protein, 9 aa, Homo sapiens
  light chain complementarity determining region 3 for antibody 7705
QQTYRTPYT

SEQ ID NO: 15410 - protein, 14 aa, Homo sapiens
  heavy chain complementarity determining region 3 for antibody 7705
ARIHGSGLGRWLDP

SEQ ID NO: 15411 - protein, 9 aa, Homo sapiens
  light chain complementarity determining region 3 for antibody 7706
QQTYRTPYT

SEQ ID NO: 15412 - protein, 9 aa, Homo sapiens
  heavy chain complementarity determining region 3 for antibody 7706
ARGRNNFRY

SEQ ID NO: 15413 - protein, 9 aa, Homo sapiens
  light chain complementarity determining region 3 for antibody 7707
QQTYRTPYT

SEQ ID NO: 15414 - protein, 13 aa, Homo sapiens
  heavy chain complementarity determining region 3 for antibody 7707
ARGATATSWNIDY

SEQ ID NO: 15415 - protein, 9 aa, Homo sapiens
  light chain complementarity determining region 3 for antibody 7708
QQTYRTPYT

SEQ ID NO: 15416 - protein, 10 aa, Homo sapiens
  heavy chain complementarity determining region 3 for antibody 7708
ARETSGAYDI

SEQ ID NO: 15417 - protein, 9 aa, Homo sapiens
  light chain complementarity determining region 3 for antibody 7709
QQTYRTPYT

SEQ ID NO: 15418 - protein, 10 aa, Homo sapiens
  heavy chain complementarity determining region 3 for antibody 7709
ARERSGSYDI

SEQ ID NO: 15419 - protein, 9 aa, Homo sapiens
  light chain complementarity determining region 3 for antibody 7710
QQTYRTPYT

SEQ ID NO: 15420 - protein, 11 aa, Homo sapiens
  heavy chain complementarity determining region 3 for antibody 7710
AREQHGQAPDY

SEQ ID NO: 15421 - protein, 9 aa, Homo sapiens
  light chain complementarity determining region 3 for antibody 7711
QQTYRTPYT

SEQ ID NO: 15422 - protein, 12 aa, Homo sapiens
  heavy chain complementarity determining region 3 for antibody 7711
ARDKGGRNGMDV

SEQ ID NO: 15423 - protein, 9 aa, Homo sapiens
  light chain complementarity determining region 3 for antibody 7712
QQTYRTPYT

SEQ ID NO: 15424 - protein, 10 aa, Homo sapiens
  heavy chain complementarity determining region 3 for antibody 7712
ANRINRAFDI

SEQ ID NO: 15425 - protein, 9 aa, Homo sapiens
  light chain complementarity determining region 3 for antibody 7713
QQTYRTPYT

SEQ ID NO: 15426 - protein, 14 aa, Homo sapiens
  heavy chain complementarity determining region 3 for antibody 7713
AKHTHNWYLGVLDC

SEQ ID NO: 15427 - protein, 9 aa, Homo sapiens
  light chain complementarity determining region 3 for antibody 7714
QQTYRTPYT

SEQ ID NO: 15428 - protein, 13 aa, Homo sapiens
  heavy chain complementarity determining region 3 for antibody 7714
AKEGSSAGPDFDY

SEQ ID NO: 15429 - protein, 9 aa, Homo sapiens
  light chain complementarity determining region 3 for antibody 7715
QQTYRTPYT

SEQ ID NO: 15430 - protein, 12 aa, Homo sapiens
  heavy chain complementarity determining region 3 for antibody 7715
AKDKGGRSGMDV

SEQ ID NO: 15431 - protein, 9 aa, Homo sapiens
  light chain complementarity determining region 3 for antibody 7716
QQTYRTPYT

SEQ ID NO: 15432 - protein, 10 aa, Homo sapiens
  heavy chain complementarity determining region 3 for antibody 7716
AHRINCAFDI

SEQ ID NO: 15433 - protein, 9 aa, Homo sapiens
  light chain complementarity determining region 3 for antibody 7717
QQTYRTPYT

SEQ ID NO: 15434 - protein, 10 aa, Homo sapiens
  heavy chain complementarity determining region 3 for antibody 7717
AHGINRAFDI

SEQ ID NO: 15435 - protein, 9 aa, Homo sapiens
  light chain complementarity determining region 3 for antibody 7718
QQTYRTPYT

SEQ ID NO: 15436 - protein, 9 aa, Homo sapiens
  heavy chain complementarity determining region 3 for antibody 7718
AGWGGLSNY

SEQ ID NO: 15437 - protein, 9 aa, Homo sapiens
  light chain complementarity determining region 3 for antibody 7719
QQTYRTPST

SEQ ID NO: 15438 - protein, 10 aa, Homo sapiens
  heavy chain complementarity determining region 3 for antibody 7719
AHRINRAFDI

SEQ ID NO: 15439 - protein, 9 aa, Homo sapiens
  light chain complementarity determining region 3 for antibody 7720
QQTYRTPSP

SEQ ID NO: 15440 - protein, 14 aa, Homo sapiens
  heavy chain complementarity determining region 3 for antibody 7720
ARLHGSGLGRWLDP

SEQ ID NO: 15441 - protein, 9 aa, Homo sapiens
  light chain complementarity determining region 3 for antibody 7721
QQTYRTPNT

SEQ ID NO: 15442 - protein, 14 aa, Homo sapiens
  heavy chain complementarity determining region 3 for antibody 7721
ARLHGSGLGRWLDP

SEQ ID NO: 15443 - protein, 9 aa, Homo sapiens
  light chain complementarity determining region 3 for antibody 7722
QQTYRTPHT

SEQ ID NO: 15444 - protein, 14 aa, Homo sapiens
  heavy chain complementarity determining region 3 for antibody 7722
ARLHGSDLGRWLDP

SEQ ID NO: 15445 - protein, 9 aa, Homo sapiens
  light chain complementarity determining region 3 for antibody 7723
QQTYRTPHT

SEQ ID NO: 15446 - protein, 10 aa, Homo sapiens
  heavy chain complementarity determining region 3 for antibody 7723
AHRINRAFDI

SEQ ID NO: 15447 - protein, 9 aa, Homo sapiens
  light chain complementarity determining region 3 for antibody 7724
QQTYRTPFT

SEQ ID NO: 15448 - protein, 16 aa, Homo sapiens
  heavy chain complementarity determining region 3 for antibody 7724
VRDLAGFTRGGSTFDY

SEQ ID NO: 15449 - protein, 9 aa, Homo sapiens
  light chain complementarity determining region 3 for antibody 7725
QQTYRTPCT

SEQ ID NO: 15450 - protein, 14 aa, Homo sapiens
  heavy chain complementarity determining region 3 for antibody 7725
ARLHGSGLGRWLDP

SEQ ID NO: 15451 - protein, 9 aa, Homo sapiens
  light chain complementarity determining region 3 for antibody 7726
QQTYRSPYT

SEQ ID NO: 15452 - protein, 14 aa, Homo sapiens
  heavy chain complementarity determining region 3 for antibody 7726
ARLHGSGLGRWLDP

SEQ ID NO: 15453 - protein, 9 aa, Homo sapiens
  light chain complementarity determining region 3 for antibody 7727
QQTYRNPYT

SEQ ID NO: 15454 - protein, 10 aa, Homo sapiens
  heavy chain complementarity determining region 3 for antibody 7727
AHRINRAFDI

SEQ ID NO: 15455 - protein, 9 aa, Homo sapiens
  light chain complementarity determining region 3 for antibody 7728
QQTYPTPYT

SEQ ID NO: 15456 - protein, 14 aa, Homo sapiens
  heavy chain complementarity determining region 3 for antibody 7728
ARLHGSGLGRWLDP

SEQ ID NO: 15457 - protein, 9 aa, Homo sapiens
  light chain complementarity determining region 3 for antibody 7729
QQTYLTPYT

SEQ ID NO: 15458 - protein, 14 aa, Homo sapiens
  heavy chain complementarity determining region 3 for antibody 7729
ARLHGSGLGRWLDP

SEQ ID NO: 15459 - protein, 9 aa, Homo sapiens
  light chain complementarity determining region 3 for antibody 7730
QQTYGTPYT

SEQ ID NO: 15460 - protein, 14 aa, Homo sapiens
  heavy chain complementarity determining region 3 for antibody 7730
ARRHGSGLGRWLDP

SEQ ID NO: 15461 - protein, 9 aa, Homo sapiens
  light chain complementarity determining region 3 for antibody 7731
QQTYCSPWT

SEQ ID NO: 15462 - protein, 15 aa, Homo sapiens
  heavy chain complementarity determining region 3 for antibody 7731
ARIWTSSTNCRYMDV

SEQ ID NO: 15463 - protein, 9 aa, Homo sapiens
  light chain complementarity determining region 3 for antibody 7732
QQTTNLPFT

SEQ ID NO: 15464 - protein, 13 aa, Homo sapiens
  heavy chain complementarity determining region 3 for antibody 7732
AKEGPYPGLDLDY

SEQ ID NO: 15465 - protein, 9 aa, Homo sapiens
  light chain complementarity determining region 3 for antibody 7733
QQTSRTPYT

SEQ ID NO: 15466 - protein, 14 aa, Homo sapiens
  heavy chain complementarity determining region 3 for antibody 7733
ARLHGSGVGRWFDP

SEQ ID NO: 15467 - protein, 9 aa, Homo sapiens
  light chain complementarity determining region 3 for antibody 7734
QQTSRTPST

SEQ ID NO: 15468 - protein, 14 aa, Homo sapiens
  heavy chain complementarity determining region 3 for antibody 7734
ARLHGSGLGRWFDP

SEQ ID NO: 15469 - protein, 9 aa, Homo sapiens
  light chain complementarity determining region 3 for antibody 7735
QQTNNIPWT

SEQ ID NO: 15470 - protein, 12 aa, Homo sapiens
  heavy chain complementarity determining region 3 for antibody 7735
ARLTWSPKGMDV

SEQ ID NO: 15471 - protein, 9 aa, Homo sapiens
  light chain complementarity determining region 3 for antibody 7736
QQTFRTPST

SEQ ID NO: 15472 - protein, 14 aa, Homo sapiens
  heavy chain complementarity determining region 3 for antibody 7736
ARLHGSGLGRWLDP

SEQ ID NO: 15473 - protein, 9 aa, Homo sapiens
  light chain complementarity determining region 3 for antibody 7737
QQTDRTPYT

SEQ ID NO: 15474 - protein, 14 aa, Homo sapiens
  heavy chain complementarity determining region 3 for antibody 7737
ARLHGAGSGRWLDP

SEQ ID NO: 15475 - protein, 9 aa, Homo sapiens
  light chain complementarity determining region 3 for antibody 7738
QQTCSSPWT

SEQ ID NO: 15476 - protein, 15 aa, Homo sapiens
  heavy chain complementarity determining region 3 for antibody 7738
ARIWTSSTNCRYMDV

SEQ ID NO: 15477 - protein, 8 aa, Homo sapiens
  light chain complementarity determining region 3 for antibody 7739
QQSYTTTT

SEQ ID NO: 15478 - protein, 12 aa, Homo sapiens
  heavy chain complementarity determining region 3 for antibody 7739
ARLDWNYRAFDI

SEQ ID NO: 15479 - protein, 9 aa, Homo sapiens
  light chain complementarity determining region 3 for antibody 7740
QQSYTTPYT

SEQ ID NO: 15480 - protein, 21 aa, Homo sapiens
  heavy chain complementarity determining region 3 for antibody 7740
ARVKVVPAPTRGYQYYTYVDV

SEQ ID NO: 15481 - protein, 9 aa, Homo sapiens
  light chain complementarity determining region 3 for antibody 7741
QQSYTTPYT

SEQ ID NO: 15482 - protein, 15 aa, Homo sapiens
  heavy chain complementarity determining region 3 for antibody 7741
ARVGRPYHNAWYFDN

SEQ ID NO: 15483 - protein, 9 aa, Homo sapiens
  light chain complementarity determining region 3 for antibody 7742
QQSYTTPYT

SEQ ID NO: 15484 - protein, 9 aa, Homo sapiens
  heavy chain complementarity determining region 3 for antibody 7742
ARSEYQPTY

SEQ ID NO: 15485 - protein, 9 aa, Homo sapiens
  light chain complementarity determining region 3 for antibody 7743
QQSYTTPYT

SEQ ID NO: 15486 - protein, 14 aa, Homo sapiens
  heavy chain complementarity determining region 3 for antibody 7743
ARLHGSGLGRWLDP

SEQ ID NO: 15487 - protein, 9 aa, Homo sapiens
  light chain complementarity determining region 3 for antibody 7744
QQSYTTPYT

SEQ ID NO: 15488 - protein, 15 aa, Homo sapiens
  heavy chain complementarity determining region 3 for antibody 7744
ARIWTSSTNCRYMDV

SEQ ID NO: 15489 - protein, 9 aa, Homo sapiens
  light chain complementarity determining region 3 for antibody 7745
QQSYTTPYT

SEQ ID NO: 15490 - protein, 11 aa, Homo sapiens
  heavy chain complementarity determining region 3 for antibody 7745
ARIVARKPDDY

SEQ ID NO: 15491 - protein, 9 aa, Homo sapiens
  light chain complementarity determining region 3 for antibody 7746
QQSYTTPYT

SEQ ID NO: 15492 - protein, 23 aa, Homo sapiens
  heavy chain complementarity determining region 3 for antibody 7746
ARHFPKGGSAITGMQSLYYYIDV

SEQ ID NO: 15493 - protein, 9 aa, Homo sapiens
  light chain complementarity determining region 3 for antibody 7747
QQSYTTPYT

SEQ ID NO: 15494 - protein, 14 aa, Homo sapiens
  heavy chain complementarity determining region 3 for antibody 7747
ARDPGYTNGHAFDI

SEQ ID NO: 15495 - protein, 9 aa, Homo sapiens
  light chain complementarity determining region 3 for antibody 7748
QQSYTTPYT

SEQ ID NO: 15496 - protein, 16 aa, Homo sapiens
  heavy chain complementarity determining region 3 for antibody 7748
AKSLNIEVSHSGQFDF

SEQ ID NO: 15497 - protein, 9 aa, Homo sapiens
  light chain complementarity determining region 3 for antibody 7749
QQSYTTPYT

SEQ ID NO: 15498 - protein, 16 aa, Homo sapiens
  heavy chain complementarity determining region 3 for antibody 7749
AKSLNIEVSHSGPFDV

SEQ ID NO: 15499 - protein, 9 aa, Homo sapiens
  light chain complementarity determining region 3 for antibody 7750
QQSYTTPYT

SEQ ID NO: 15500 - protein, 13 aa, Homo sapiens
  heavy chain complementarity determining region 3 for antibody 7750
AKEGSAPGRDFEY

SEQ ID NO: 15501 - protein, 9 aa, Homo sapiens
  light chain complementarity determining region 3 for antibody 7751
QQSYTTPYT

SEQ ID NO: 15502 - protein, 13 aa, Homo sapiens
  heavy chain complementarity determining region 3 for antibody 7751
AKEGSAPGPVFEY

SEQ ID NO: 15503 - protein, 9 aa, Homo sapiens
  light chain complementarity determining region 3 for antibody 7752
QQSYTTPYT

SEQ ID NO: 15504 - protein, 13 aa, Homo sapiens
  heavy chain complementarity determining region 3 for antibody 7752
AKEGSAPGHDFEY

SEQ ID NO: 15505 - protein, 9 aa, Homo sapiens
  light chain complementarity determining region 3 for antibody 7753
QQSYTTPYT

SEQ ID NO: 15506 - protein, 13 aa, Homo sapiens
  heavy chain complementarity determining region 3 for antibody 7753
AEEGSAPGPDFEY

SEQ ID NO: 15507 - protein, 9 aa, Homo sapiens
  light chain complementarity determining region 3 for antibody 7754
QQSYTTPYP

SEQ ID NO: 15508 - protein, 13 aa, Homo sapiens
  heavy chain complementarity determining region 3 for antibody 7754
AKEGSAPGPDFEY

SEQ ID NO: 15509 - protein, 8 aa, Homo sapiens
  light chain complementarity determining region 3 for antibody 7755
QQSYTTPT

SEQ ID NO: 15510 - protein, 16 aa, Homo sapiens
  heavy chain complementarity determining region 3 for antibody 7755
VRDLAGFTRGGSTFDY

SEQ ID NO: 15511 - protein, 8 aa, Homo sapiens
  light chain complementarity determining region 3 for antibody 7756
QQSYTTPT

SEQ ID NO: 15512 - protein, 15 aa, Homo sapiens
  heavy chain complementarity determining region 3 for antibody 7756
TTSRTASDWYNAFDI

SEQ ID NO: 15513 - protein, 8 aa, Homo sapiens
  light chain complementarity determining region 3 for antibody 7757
QQSYTTPT

SEQ ID NO: 15514 - protein, 13 aa, Homo sapiens
  heavy chain complementarity determining region 3 for antibody 7757
TREGDSSGPDFHL

SEQ ID NO: 15515 - protein, 8 aa, Homo sapiens
  light chain complementarity determining region 3 for antibody 7758
QQSYTTPT

SEQ ID NO: 15516 - protein, 9 aa, Homo sapiens
  heavy chain complementarity determining region 3 for antibody 7758
GSRRPYFDS

SEQ ID NO: 15517 - protein, 8 aa, Homo sapiens
  light chain complementarity determining region 3 for antibody 7759
QQSYTTPT

SEQ ID NO: 15518 - protein, 17 aa, Homo sapiens
  heavy chain complementarity determining region 3 for antibody 7759
ARNTMVGSWQRQGNLDH

SEQ ID NO: 15519 - protein, 8 aa, Homo sapiens
  light chain complementarity determining region 3 for antibody 7760
QQSYTTPT

SEQ ID NO: 15520 - protein, 14 aa, Homo sapiens
  heavy chain complementarity determining region 3 for antibody 7760
ARLHGSGLGRWLDP

SEQ ID NO: 15521 - protein, 8 aa, Homo sapiens
  light chain complementarity determining region 3 for antibody 7761
QQSYTTPT

SEQ ID NO: 15522 - protein, 12 aa, Homo sapiens
  heavy chain complementarity determining region 3 for antibody 7761
ARLDWNYRTFDI

SEQ ID NO: 15523 - protein, 8 aa, Homo sapiens
  light chain complementarity determining region 3 for antibody 7762
QQSYTTPT

SEQ ID NO: 15524 - protein, 12 aa, Homo sapiens
  heavy chain complementarity determining region 3 for antibody 7762
ARLDWNYRSFDI

SEQ ID NO: 15525 - protein, 8 aa, Homo sapiens
  light chain complementarity determining region 3 for antibody 7763
QQSYTTPT

SEQ ID NO: 15526 - protein, 12 aa, Homo sapiens
  heavy chain complementarity determining region 3 for antibody 7763
ARLDWNYRALDI

SEQ ID NO: 15527 - protein, 8 aa, Homo sapiens
  light chain complementarity determining region 3 for antibody 7764
QQSYTTPT

SEQ ID NO: 15528 - protein, 12 aa, Homo sapiens
  heavy chain complementarity determining region 3 for antibody 7764
ARLDWDYRAFDI

SEQ ID NO: 15529 - protein, 8 aa, Homo sapiens
  light chain complementarity determining region 3 for antibody 7765
QQSYTTPT

SEQ ID NO: 15530 - protein, 12 aa, Homo sapiens
  heavy chain complementarity determining region 3 for antibody 7765
ARGPLKMAGGSS

SEQ ID NO: 15531 - protein, 8 aa, Homo sapiens
  light chain complementarity determining region 3 for antibody 7766
QQSYTTPT

SEQ ID NO: 15532 - protein, 26 aa, Homo sapiens
  heavy chain complementarity determining region 3 for antibody 7766
ARGFPKGGSYSSGWYGSVGGKYYMDV

SEQ ID NO: 15533 - protein, 8 aa, Homo sapiens
  light chain complementarity determining region 3 for antibody 7767
QQSYTTPT

SEQ ID NO: 15534 - protein, 14 aa, Homo sapiens
  heavy chain complementarity determining region 3 for antibody 7767
ARDVHTTGWTLGGY

SEQ ID NO: 15535 - protein, 8 aa, Homo sapiens
  light chain complementarity determining region 3 for antibody 7768
QQSYTTPT

SEQ ID NO: 15536 - protein, 15 aa, Homo sapiens
  heavy chain complementarity determining region 3 for antibody 7768
ARDIRVGASKYYFDY

SEQ ID NO: 15537 - protein, 8 aa, Homo sapiens
  light chain complementarity determining region 3 for antibody 7769
QQSYTTPT

SEQ ID NO: 15538 - protein, 26 aa, Homo sapiens
  heavy chain complementarity determining region 3 for antibody 7769
ARDFPKGGSYSSGWYGSVGGKYYIDV

SEQ ID NO: 15539 - protein, 8 aa, Homo sapiens
  light chain complementarity determining region 3 for antibody 7770
QQSYTTPT

SEQ ID NO: 15540 - protein, 17 aa, Homo sapiens
  heavy chain complementarity determining region 3 for antibody 7770
AKRLPDLLGGGHHYIDV

SEQ ID NO: 15541 - protein, 8 aa, Homo sapiens
  light chain complementarity determining region 3 for antibody 7771
QQSYTTPT

SEQ ID NO: 15542 - protein, 13 aa, Homo sapiens
  heavy chain complementarity determining region 3 for antibody 7771
AKEGSSPGPDFDY

SEQ ID NO: 15543 - protein, 8 aa, Homo sapiens
  light chain complementarity determining region 3 for antibody 7772
QQSYTTPT

SEQ ID NO: 15544 - protein, 12 aa, Homo sapiens
  heavy chain complementarity determining region 3 for antibody 7772
AIVVPGRWDLDD

SEQ ID NO: 15545 - protein, 9 aa, Homo sapiens
  light chain complementarity determining region 3 for antibody 7773
QQSYTTPST

SEQ ID NO: 15546 - protein, 16 aa, Homo sapiens
  heavy chain complementarity determining region 3 for antibody 7773
AKSLNIEVSHSGPFDF

SEQ ID NO: 15547 - protein, 9 aa, Homo sapiens
  light chain complementarity determining region 3 for antibody 7774
QQSYTTPRT

SEQ ID NO: 15548 - protein, 16 aa, Homo sapiens
  heavy chain complementarity determining region 3 for antibody 7774
VGPHLTYNSGWRYFDY

SEQ ID NO: 15549 - protein, 9 aa, Homo sapiens
  light chain complementarity determining region 3 for antibody 7775
QQSYTTPRT

SEQ ID NO: 15550 - protein, 16 aa, Homo sapiens
  heavy chain complementarity determining region 3 for antibody 7775
AREFPYSSTSGWYFDV

SEQ ID NO: 15551 - protein, 9 aa, Homo sapiens
  light chain complementarity determining region 3 for antibody 7776
QQSYTTPRT

SEQ ID NO: 15552 - protein, 16 aa, Homo sapiens
  heavy chain complementarity determining region 3 for antibody 7776
AREFPYSSASVWYFDV

SEQ ID NO: 15553 - protein, 9 aa, Homo sapiens
  light chain complementarity determining region 3 for antibody 7777
QQSYTTPQT

SEQ ID NO: 15554 - protein, 16 aa, Homo sapiens
  heavy chain complementarity determining region 3 for antibody 7777
AREFPYSSTSVWYFDV

SEQ ID NO: 15555 - protein, 8 aa, Homo sapiens
  light chain complementarity determining region 3 for antibody 7778
QQSYTTPP

SEQ ID NO: 15556 - protein, 12 aa, Homo sapiens
  heavy chain complementarity determining region 3 for antibody 7778
AKWRGDQSEFDF

SEQ ID NO: 15557 - protein, 9 aa, Homo sapiens
  light chain complementarity determining region 3 for antibody 7779
QQSYTTPHT

SEQ ID NO: 15558 - protein, 13 aa, Homo sapiens
  heavy chain complementarity determining region 3 for antibody 7779
AKEGSAPGPDFEY

SEQ ID NO: 15559 - protein, 8 aa, Homo sapiens
  light chain complementarity determining region 3 for antibody 7780
QQSYTRPP

SEQ ID NO: 15560 - protein, 12 aa, Homo sapiens
  heavy chain complementarity determining region 3 for antibody 7780
ARWRGDQSEFEY

SEQ ID NO: 15561 - protein, 9 aa, Homo sapiens
  light chain complementarity determining region 3 for antibody 7781
QQSYTMPRT

SEQ ID NO: 15562 - protein, 9 aa, Homo sapiens
  heavy chain complementarity determining region 3 for antibody 7781
VKGERGVDY

SEQ ID NO: 15563 - protein, 9 aa, Homo sapiens
  light chain complementarity determining region 3 for antibody 7782
QQSYTMPRT

SEQ ID NO: 15564 - protein, 18 aa, Homo sapiens
  heavy chain complementarity determining region 3 for antibody 7782
TTVVSHLLAGDWHLYFQH

SEQ ID NO: 15565 - protein, 9 aa, Homo sapiens
  light chain complementarity determining region 3 for antibody 7783
QQSYTMPRT

SEQ ID NO: 15566 - protein, 18 aa, Homo sapiens
  heavy chain complementarity determining region 3 for antibody 7783
TTVLSRLLAGGWHLYFQH

SEQ ID NO: 15567 - protein, 9 aa, Homo sapiens
  light chain complementarity determining region 3 for antibody 7784
QQSYTMPRT

SEQ ID NO: 15568 - protein, 18 aa, Homo sapiens
  heavy chain complementarity determining region 3 for antibody 7784
TTVLSRLLAGDWHLYFQH

SEQ ID NO: 15569 - protein, 9 aa, Homo sapiens
  light chain complementarity determining region 3 for antibody 7785
QQSYTMPRT

SEQ ID NO: 15570 - protein, 18 aa, Homo sapiens
  heavy chain complementarity determining region 3 for antibody 7785
TTVLSQRLAGDWHLYFQH

SEQ ID NO: 15571 - protein, 9 aa, Homo sapiens
  light chain complementarity determining region 3 for antibody 7786
QQSYTMPRT

SEQ ID NO: 15572 - protein, 18 aa, Homo sapiens
  heavy chain complementarity determining region 3 for antibody 7786
TTVLSQQLAGDWHLYFQH

SEQ ID NO: 15573 - protein, 9 aa, Homo sapiens
  light chain complementarity determining region 3 for antibody 7787
QQSYTMPRT

SEQ ID NO: 15574 - protein, 18 aa, Homo sapiens
  heavy chain complementarity determining region 3 for antibody 7787
TTVLSQLLTGDWHLYFQH

SEQ ID NO: 15575 - protein, 9 aa, Homo sapiens
  light chain complementarity determining region 3 for antibody 7788
QQSYTMPRT

SEQ ID NO: 15576 - protein, 18 aa, Homo sapiens
  heavy chain complementarity determining region 3 for antibody 7788
TTVLSQLLGGDWHLYFQH

SEQ ID NO: 15577 - protein, 9 aa, Homo sapiens
  light chain complementarity determining region 3 for antibody 7789
QQSYTMPRT

SEQ ID NO: 15578 - protein, 18 aa, Homo sapiens
  heavy chain complementarity determining region 3 for antibody 7789
TTVLSQLLAGDWYLYFQH

SEQ ID NO: 15579 - protein, 9 aa, Homo sapiens
  light chain complementarity determining region 3 for antibody 7790
QQSYTMPRT

SEQ ID NO: 15580 - protein, 18 aa, Homo sapiens
  heavy chain complementarity determining region 3 for antibody 7790
TTVLSQLLAGDWRLYFHH

SEQ ID NO: 15581 - protein, 9 aa, Homo sapiens
  light chain complementarity determining region 3 for antibody 7791
QQSYTMPRT

SEQ ID NO: 15582 - protein, 18 aa, Homo sapiens
  heavy chain complementarity determining region 3 for antibody 7791
TTVLSQLLAGDWNLYFQH

SEQ ID NO: 15583 - protein, 9 aa, Homo sapiens
  light chain complementarity determining region 3 for antibody 7792
QQSYTMPRT

SEQ ID NO: 15584 - protein, 18 aa, Homo sapiens
  heavy chain complementarity determining region 3 for antibody 7792
TTVLSQLLAGDWLLYFQH

SEQ ID NO: 15585 - protein, 9 aa, Homo sapiens
  light chain complementarity determining region 3 for antibody 7793
QQSYTMPRT

SEQ ID NO: 15586 - protein, 18 aa, Homo sapiens
  heavy chain complementarity determining region 3 for antibody 7793
TTVLSQLLAGDWHLYFQR

SEQ ID NO: 15587 - protein, 9 aa, Homo sapiens
  light chain complementarity determining region 3 for antibody 7794
QQSYTMPRT

SEQ ID NO: 15588 - protein, 18 aa, Homo sapiens
  heavy chain complementarity determining region 3 for antibody 7794
TTVLSQLLAGDWHLYFQP

SEQ ID NO: 15589 - protein, 9 aa, Homo sapiens
  light chain complementarity determining region 3 for antibody 7795
QQSYTMPRT

SEQ ID NO: 15590 - protein, 18 aa, Homo sapiens
  heavy chain complementarity determining region 3 for antibody 7795
TTVLSQLLAGDWHLSFHH

SEQ ID NO: 15591 - protein, 9 aa, Homo sapiens
  light chain complementarity determining region 3 for antibody 7796
QQSYTMPRT

SEQ ID NO: 15592 - protein, 18 aa, Homo sapiens
  heavy chain complementarity determining region 3 for antibody 7796
TTVLSQLLAGDWHIYFQH

SEQ ID NO: 15593 - protein, 9 aa, Homo sapiens
  light chain complementarity determining region 3 for antibody 7797
QQSYTMPRT

SEQ ID NO: 15594 - protein, 18 aa, Homo sapiens
  heavy chain complementarity determining region 3 for antibody 7797
TTVLSQLLAADWHLYFQH

SEQ ID NO: 15595 - protein, 9 aa, Homo sapiens
  light chain complementarity determining region 3 for antibody 7798
QQSYTMPRT

SEQ ID NO: 15596 - protein, 18 aa, Homo sapiens
  heavy chain complementarity determining region 3 for antibody 7798
TTVLGQLLAGDWHLYFQH

SEQ ID NO: 15597 - protein, 9 aa, Homo sapiens
  light chain complementarity determining region 3 for antibody 7799
QQSYTMPRT

SEQ ID NO: 15598 - protein, 18 aa, Homo sapiens
  heavy chain complementarity determining region 3 for antibody 7799
TTILSQLLAGDWHLYFQH

SEQ ID NO: 15599 - protein, 9 aa, Homo sapiens
  light chain complementarity determining region 3 for antibody 7800
QQSYTMPRT

SEQ ID NO: 15600 - protein, 18 aa, Homo sapiens
  heavy chain complementarity determining region 3 for antibody 7800
TTGLSQLVAGDWHLYFQH

SEQ ID NO: 15601 - protein, 9 aa, Homo sapiens
  light chain complementarity determining region 3 for antibody 7801
QQSYTMPRT

SEQ ID NO: 15602 - protein, 15 aa, Homo sapiens
  heavy chain complementarity determining region 3 for antibody 7801
GKEGPGSSGWLTGHY

SEQ ID NO: 15603 - protein, 9 aa, Homo sapiens
  light chain complementarity determining region 3 for antibody 7802
QQSYTMPRT

SEQ ID NO: 15604 - protein, 15 aa, Homo sapiens
  heavy chain complementarity determining region 3 for antibody 7802
ARVGRPYHNAWYFDN

SEQ ID NO: 15605 - protein, 9 aa, Homo sapiens
  light chain complementarity determining region 3 for antibody 7803
QQSYTMPRT

SEQ ID NO: 15606 - protein, 12 aa, Homo sapiens
  heavy chain complementarity determining region 3 for antibody 7803
ARLDWNYRAFDI

SEQ ID NO: 15607 - protein, 9 aa, Homo sapiens
  light chain complementarity determining region 3 for antibody 7804
QQSYTMPRT

SEQ ID NO: 15608 - protein, 10 aa, Homo sapiens
  heavy chain complementarity determining region 3 for antibody 7804
ARETSGSYDI

SEQ ID NO: 15609 - protein, 9 aa, Homo sapiens
  light chain complementarity determining region 3 for antibody 7805
QQSYTMPRT

SEQ ID NO: 15610 - protein, 11 aa, Homo sapiens
  heavy chain complementarity determining region 3 for antibody 7805
AREQRGQAPDY

SEQ ID NO: 15611 - protein, 9 aa, Homo sapiens
  light chain complementarity determining region 3 for antibody 7806
QQSYTMPRT

SEQ ID NO: 15612 - protein, 14 aa, Homo sapiens
  heavy chain complementarity determining region 3 for antibody 7806
AKPTRGPGSFLIDY

SEQ ID NO: 15613 - protein, 9 aa, Homo sapiens
  light chain complementarity determining region 3 for antibody 7807
QQSYTMPRT

SEQ ID NO: 15614 - protein, 13 aa, Homo sapiens
  heavy chain complementarity determining region 3 for antibody 7807
AKEGSSPGPDFDY

SEQ ID NO: 15615 - protein, 9 aa, Homo sapiens
  light chain complementarity determining region 3 for antibody 7808
QQSYTMPRT

SEQ ID NO: 15616 - protein, 12 aa, Homo sapiens
  heavy chain complementarity determining region 3 for antibody 7808
AIVVPGRWDLDD

SEQ ID NO: 15617 - protein, 9 aa, Homo sapiens
  light chain complementarity determining region 3 for antibody 7809
QQSYTMPQT

SEQ ID NO: 15618 - protein, 18 aa, Homo sapiens
  heavy chain complementarity determining region 3 for antibody 7809
TTVLSQLLAGDWHLYFQH

SEQ ID NO: 15619 - protein, 9 aa, Homo sapiens
  light chain complementarity determining region 3 for antibody 7810
QQSYTLPRT

SEQ ID NO: 15620 - protein, 18 aa, Homo sapiens
  heavy chain complementarity determining region 3 for antibody 7810
TTVLSQLLAGDWHLYFQH

SEQ ID NO: 15621 - protein, 8 aa, Homo sapiens
  light chain complementarity determining region 3 for antibody 7811
QQSYTKAT

SEQ ID NO: 15622 - protein, 12 aa, Homo sapiens
  heavy chain complementarity determining region 3 for antibody 7811
ASVVPGRWDFDD

SEQ ID NO: 15623 - protein, 8 aa, Homo sapiens
  light chain complementarity determining region 3 for antibody 7812
QQSYTKAT

SEQ ID NO: 15624 - protein, 13 aa, Homo sapiens
  heavy chain complementarity determining region 3 for antibody 7812
AKEGSSPGPDFEY

SEQ ID NO: 15625 - protein, 8 aa, Homo sapiens
  light chain complementarity determining region 3 for antibody 7813
QQSYTKAT

SEQ ID NO: 15626 - protein, 12 aa, Homo sapiens
  heavy chain complementarity determining region 3 for antibody 7813
AIVVPGRWGLDD

SEQ ID NO: 15627 - protein, 8 aa, Homo sapiens
  light chain complementarity determining region 3 for antibody 7814
QQSYTKAT

SEQ ID NO: 15628 - protein, 12 aa, Homo sapiens
  heavy chain complementarity determining region 3 for antibody 7814
AIVVPGRWDPDD

SEQ ID NO: 15629 - protein, 8 aa, Homo sapiens
  light chain complementarity determining region 3 for antibody 7815
QQSYTKAT

SEQ ID NO: 15630 - protein, 12 aa, Homo sapiens
  heavy chain complementarity determining region 3 for antibody 7815
AIVVPGRWDIDD

SEQ ID NO: 15631 - protein, 8 aa, Homo sapiens
  light chain complementarity determining region 3 for antibody 7816
QQSYTKAT

SEQ ID NO: 15632 - protein, 12 aa, Homo sapiens
  heavy chain complementarity determining region 3 for antibody 7816
AIVVPGRWALDD

SEQ ID NO: 15633 - protein, 8 aa, Homo sapiens
  light chain complementarity determining region 3 for antibody 7817
QQSYTKAT

SEQ ID NO: 15634 - protein, 12 aa, Homo sapiens
  heavy chain complementarity determining region 3 for antibody 7817
AIVVPGRRDLDD

SEQ ID NO: 15635 - protein, 8 aa, Homo sapiens
  light chain complementarity determining region 3 for antibody 7818
QQSYTKAT

SEQ ID NO: 15636 - protein, 12 aa, Homo sapiens
  heavy chain complementarity determining region 3 for antibody 7818
AIGVPGRWDLDD

SEQ ID NO: 15637 - protein, 8 aa, Homo sapiens
  light chain complementarity determining region 3 for antibody 7819
QQSYTKAP

SEQ ID NO: 15638 - protein, 12 aa, Homo sapiens
  heavy chain complementarity determining region 3 for antibody 7819
AIVVPGRWDLDD

SEQ ID NO: 15639 - protein, 9 aa, Homo sapiens
  light chain complementarity determining region 3 for antibody 7820
QQSYTIPRT

SEQ ID NO: 15640 - protein, 18 aa, Homo sapiens
  heavy chain complementarity determining region 3 for antibody 7820
TTVLSQLLAGDWHLYFHH

SEQ ID NO: 15641 - protein, 9 aa, Homo sapiens
  light chain complementarity determining region 3 for antibody 7821
QQSYTIPRT

SEQ ID NO: 15642 - protein, 18 aa, Homo sapiens
  heavy chain complementarity determining region 3 for antibody 7821
TTVLSHLLAGDWHLYFHH

SEQ ID NO: 15643 - protein, 9 aa, Homo sapiens
  light chain complementarity determining region 3 for antibody 7822
QQSYTIPLT

SEQ ID NO: 15644 - protein, 20 aa, Homo sapiens
  heavy chain complementarity determining region 3 for antibody 7822
AGGREGGKYLPVFDRYFFDS

SEQ ID NO: 15645 - protein, 10 aa, Homo sapiens
  light chain complementarity determining region 3 for antibody 7823
QQSYTDPALT

SEQ ID NO: 15646 - protein, 13 aa, Homo sapiens
  heavy chain complementarity determining region 3 for antibody 7823
ARYGYGYARPFDF

SEQ ID NO: 15647 - protein, 9 aa, Homo sapiens
  light chain complementarity determining region 3 for antibody 7824
QQSYSVPLT

SEQ ID NO: 15648 - protein, 18 aa, Homo sapiens
  heavy chain complementarity determining region 3 for antibody 7824
AKVHLQAPLPTPNYYFDY

SEQ ID NO: 15649 - protein, 9 aa, Homo sapiens
  light chain complementarity determining region 3 for antibody 7825
QQSYSTTST

SEQ ID NO: 15650 - protein, 16 aa, Homo sapiens
  heavy chain complementarity determining region 3 for antibody 7825
ARWFSRSSTGVSYMDV

SEQ ID NO: 15651 - protein, 9 aa, Homo sapiens
  light chain complementarity determining region 3 for antibody 7826
QQSYSTSST

SEQ ID NO: 15652 - protein, 16 aa, Homo sapiens
  heavy chain complementarity determining region 3 for antibody 7826
ARWFSRSSTGVSYMDV

SEQ ID NO: 15653 - protein, 9 aa, Homo sapiens
  light chain complementarity determining region 3 for antibody 7827
QQSYSTQLT

SEQ ID NO: 15654 - protein, 13 aa, Homo sapiens
  heavy chain complementarity determining region 3 for antibody 7827
AKEGSSAGPDFDY

SEQ ID NO: 15655 - protein, 9 aa, Homo sapiens
  light chain complementarity determining region 3 for antibody 7828
QQSYSTPYT

SEQ ID NO: 15656 - protein, 17 aa, Homo sapiens
  heavy chain complementarity determining region 3 for antibody 7828
SRDGRIIWPGYQGSLDS

SEQ ID NO: 15657 - protein, 9 aa, Homo sapiens
  light chain complementarity determining region 3 for antibody 7829
QQSYSTPYT

SEQ ID NO: 15658 - protein, 16 aa, Homo sapiens
  heavy chain complementarity determining region 3 for antibody 7829
ARWFSRSSTGVSYMDV

SEQ ID NO: 15659 - protein, 9 aa, Homo sapiens
  light chain complementarity determining region 3 for antibody 7830
QQSYSTPYT

SEQ ID NO: 15660 - protein, 17 aa, Homo sapiens
  heavy chain complementarity determining region 3 for antibody 7830
ARNTMVGTWQRQGNLDH

SEQ ID NO: 15661 - protein, 9 aa, Homo sapiens
  light chain complementarity determining region 3 for antibody 7831
QQSYSTPYT

SEQ ID NO: 15662 - protein, 13 aa, Homo sapiens
  heavy chain complementarity determining region 3 for antibody 7831
AKEGSSPGPDFDS

SEQ ID NO: 15663 - protein, 9 aa, Homo sapiens
  light chain complementarity determining region 3 for antibody 7832
QQSYSTPYT

SEQ ID NO: 15664 - protein, 13 aa, Homo sapiens
  heavy chain complementarity determining region 3 for antibody 7832
AKEGSSAGPSSQS

SEQ ID NO: 15665 - protein, 9 aa, Homo sapiens
  light chain complementarity determining region 3 for antibody 7833
QQSYSTPYT

SEQ ID NO: 15666 - protein, 13 aa, Homo sapiens
  heavy chain complementarity determining region 3 for antibody 7833
AKEGSSAGPDLDY

SEQ ID NO: 15667 - protein, 9 aa, Homo sapiens
  light chain complementarity determining region 3 for antibody 7834
QQSYSTPYT

SEQ ID NO: 15668 - protein, 13 aa, Homo sapiens
  heavy chain complementarity determining region 3 for antibody 7834
AKEGSSAGPDFDD

SEQ ID NO: 15669 - protein, 9 aa, Homo sapiens
  light chain complementarity determining region 3 for antibody 7835
QQSYSTPWT

SEQ ID NO: 15670 - protein, 15 aa, Homo sapiens
  heavy chain complementarity determining region 3 for antibody 7835
GKEGPGSSGWLTGHY

SEQ ID NO: 15671 - protein, 9 aa, Homo sapiens
  light chain complementarity determining region 3 for antibody 7836
QQSYSTPWT

SEQ ID NO: 15672 - protein, 15 aa, Homo sapiens
  heavy chain complementarity determining region 3 for antibody 7836
ARVGRPYHNAWYFDN

SEQ ID NO: 15673 - protein, 9 aa, Homo sapiens
  light chain complementarity determining region 3 for antibody 7837
QQSYSTPWT

SEQ ID NO: 15674 - protein, 14 aa, Homo sapiens
  heavy chain complementarity determining region 3 for antibody 7837
ARLHGSGLGRWLDS

SEQ ID NO: 15675 - protein, 9 aa, Homo sapiens
  light chain complementarity determining region 3 for antibody 7838
QQSYSTPWT

SEQ ID NO: 15676 - protein, 15 aa, Homo sapiens
  heavy chain complementarity determining region 3 for antibody 7838
ARIWTSSTICRYMDV

SEQ ID NO: 15677 - protein, 9 aa, Homo sapiens
  light chain complementarity determining region 3 for antibody 7839
QQSYSTPWT

SEQ ID NO: 15678 - protein, 15 aa, Homo sapiens
  heavy chain complementarity determining region 3 for antibody 7839
ARIRTSSTNCRYMDV

SEQ ID NO: 15679 - protein, 9 aa, Homo sapiens
  light chain complementarity determining region 3 for antibody 7840
QQSYSTPWT

SEQ ID NO: 15680 - protein, 15 aa, Homo sapiens
  heavy chain complementarity determining region 3 for antibody 7840
ARIGTSSTNCRYMDV

SEQ ID NO: 15681 - protein, 9 aa, Homo sapiens
  light chain complementarity determining region 3 for antibody 7841
QQSYSTPWT

SEQ ID NO: 15682 - protein, 18 aa, Homo sapiens
  heavy chain complementarity determining region 3 for antibody 7841
ARGLHQLRLGGYFYGLDV

SEQ ID NO: 15683 - protein, 9 aa, Homo sapiens
  light chain complementarity determining region 3 for antibody 7842
QQSYSTPWT

SEQ ID NO: 15684 - protein, 11 aa, Homo sapiens
  heavy chain complementarity determining region 3 for antibody 7842
APNSRGQGYEY

SEQ ID NO: 15685 - protein, 9 aa, Homo sapiens
  light chain complementarity determining region 3 for antibody 7843
QQSYSTPWT

SEQ ID NO: 15686 - protein, 13 aa, Homo sapiens
  heavy chain complementarity determining region 3 for antibody 7843
AADGPYGSSAFDY

SEQ ID NO: 15687 - protein, 9 aa, Homo sapiens
  light chain complementarity determining region 3 for antibody 7844
QQSYSTPWR

SEQ ID NO: 15688 - protein, 15 aa, Homo sapiens
  heavy chain complementarity determining region 3 for antibody 7844
ARIWTSSKGVRYFDH

SEQ ID NO: 15689 - protein, 8 aa, Homo sapiens
  light chain complementarity determining region 3 for antibody 7845
QQSYSTPT

SEQ ID NO: 15690 - protein, 14 aa, Homo sapiens
  heavy chain complementarity determining region 3 for antibody 7845
CRGWLDPATPHYDF

SEQ ID NO: 15691 - protein, 8 aa, Homo sapiens
  light chain complementarity determining region 3 for antibody 7846
QQSYSTPT

SEQ ID NO: 15692 - protein, 16 aa, Homo sapiens
  heavy chain complementarity determining region 3 for antibody 7846
ARSYDRSNTKVWYFDL

SEQ ID NO: 15693 - protein, 8 aa, Homo sapiens
  light chain complementarity determining region 3 for antibody 7847
QQSYSTPT

SEQ ID NO: 15694 - protein, 12 aa, Homo sapiens
  heavy chain complementarity determining region 3 for antibody 7847
ARELGASTPLDP

SEQ ID NO: 15695 - protein, 8 aa, Homo sapiens
  light chain complementarity determining region 3 for antibody 7848
QQSYSTPT

SEQ ID NO: 15696 - protein, 12 aa, Homo sapiens
  heavy chain complementarity determining region 3 for antibody 7848
ARDKGGRNGVDV

SEQ ID NO: 15697 - protein, 8 aa, Homo sapiens
  light chain complementarity determining region 3 for antibody 7849
QQSYSTPT

SEQ ID NO: 15698 - protein, 12 aa, Homo sapiens
  heavy chain complementarity determining region 3 for antibody 7849
AKWRGDQSEFDF

SEQ ID NO: 15699 - protein, 9 aa, Homo sapiens
  light chain complementarity determining region 3 for antibody 7850
QQSYSTPST

SEQ ID NO: 15700 - protein, 16 aa, Homo sapiens
  heavy chain complementarity determining region 3 for antibody 7850
VGPHLTYNSGWRYFDY

SEQ ID NO: 15701 - protein, 9 aa, Homo sapiens
  light chain complementarity determining region 3 for antibody 7851
QQSYSTPST

SEQ ID NO: 15702 - protein, 17 aa, Homo sapiens
  heavy chain complementarity determining region 3 for antibody 7851
SRDGRIIWPGSQGSLDS

SEQ ID NO: 15703 - protein, 9 aa, Homo sapiens
  light chain complementarity determining region 3 for antibody 7852
QQSYSTPST

SEQ ID NO: 15704 - protein, 15 aa, Homo sapiens
  heavy chain complementarity determining region 3 for antibody 7852
GKEGPGSSGWLTGHY

SEQ ID NO: 15705 - protein, 9 aa, Homo sapiens
  light chain complementarity determining region 3 for antibody 7853
QQSYSTPST

SEQ ID NO: 15706 - protein, 16 aa, Homo sapiens
  heavy chain complementarity determining region 3 for antibody 7853
ARWFSRSSTGVSYMGV

SEQ ID NO: 15707 - protein, 9 aa, Homo sapiens
  light chain complementarity determining region 3 for antibody 7854
QQSYSTPST

SEQ ID NO: 15708 - protein, 16 aa, Homo sapiens
  heavy chain complementarity determining region 3 for antibody 7854
ARWFSRSSTGVSYMDA

SEQ ID NO: 15709 - protein, 9 aa, Homo sapiens
  light chain complementarity determining region 3 for antibody 7855
QQSYSTPST

SEQ ID NO: 15710 - protein, 16 aa, Homo sapiens
  heavy chain complementarity determining region 3 for antibody 7855
ARWFSRSSTGVSYMAV

SEQ ID NO: 15711 - protein, 9 aa, Homo sapiens
  light chain complementarity determining region 3 for antibody 7856
QQSYSTPST

SEQ ID NO: 15712 - protein, 16 aa, Homo sapiens
  heavy chain complementarity determining region 3 for antibody 7856
ARWFSRSSTGVSYLDV

SEQ ID NO: 15713 - protein, 9 aa, Homo sapiens
  light chain complementarity determining region 3 for antibody 7857
QQSYSTPST

SEQ ID NO: 15714 - protein, 16 aa, Homo sapiens
  heavy chain complementarity determining region 3 for antibody 7857
ARWFSRSSTGVSYIDV

SEQ ID NO: 15715 - protein, 9 aa, Homo sapiens
  light chain complementarity determining region 3 for antibody 7858
QQSYSTPST

SEQ ID NO: 15716 - protein, 16 aa, Homo sapiens
  heavy chain complementarity determining region 3 for antibody 7858
ARWFSRSSTGVSDMDV

SEQ ID NO: 15717 - protein, 9 aa, Homo sapiens
  light chain complementarity determining region 3 for antibody 7859
QQSYSTPST

SEQ ID NO: 15718 - protein, 16 aa, Homo sapiens
  heavy chain complementarity determining region 3 for antibody 7859
ARWFSRSSTGVSCMDV

SEQ ID NO: 15719 - protein, 9 aa, Homo sapiens
  light chain complementarity determining region 3 for antibody 7860
QQSYSTPST

SEQ ID NO: 15720 - protein, 16 aa, Homo sapiens
  heavy chain complementarity determining region 3 for antibody 7860
ARWFSRSSTGVPYMDV

SEQ ID NO: 15721 - protein, 9 aa, Homo sapiens
  light chain complementarity determining region 3 for antibody 7861
QQSYSTPST

SEQ ID NO: 15722 - protein, 16 aa, Homo sapiens
  heavy chain complementarity determining region 3 for antibody 7861
ARWFSRSSTGGSYMDV

SEQ ID NO: 15723 - protein, 9 aa, Homo sapiens
  light chain complementarity determining region 3 for antibody 7862
QQSYSTPST

SEQ ID NO: 15724 - protein, 16 aa, Homo sapiens
  heavy chain complementarity determining region 3 for antibody 7862
ARWFSRSSSGVSYMDV

SEQ ID NO: 15725 - protein, 9 aa, Homo sapiens
  light chain complementarity determining region 3 for antibody 7863
QQSYSTPST

SEQ ID NO: 15726 - protein, 16 aa, Homo sapiens
  heavy chain complementarity determining region 3 for antibody 7863
ARWFSRSSIGVSYMDV

SEQ ID NO: 15727 - protein, 9 aa, Homo sapiens
  light chain complementarity determining region 3 for antibody 7864
QQSYSTPST

SEQ ID NO: 15728 - protein, 16 aa, Homo sapiens
  heavy chain complementarity determining region 3 for antibody 7864
ARWFSRGSTGVSYMDV

SEQ ID NO: 15729 - protein, 9 aa, Homo sapiens
  light chain complementarity determining region 3 for antibody 7865
QQSYSTPST

SEQ ID NO: 15730 - protein, 16 aa, Homo sapiens
  heavy chain complementarity determining region 3 for antibody 7865
ARWFFRSSTGVSYMDV

SEQ ID NO: 15731 - protein, 9 aa, Homo sapiens
  light chain complementarity determining region 3 for antibody 7866
QQSYSTPST

SEQ ID NO: 15732 - protein, 17 aa, Homo sapiens
  heavy chain complementarity determining region 3 for antibody 7866
ARNTMVHGWQRQGSVDH

SEQ ID NO: 15733 - protein, 9 aa, Homo sapiens
  light chain complementarity determining region 3 for antibody 7867
QQSYSTPST

SEQ ID NO: 15734 - protein, 15 aa, Homo sapiens
  heavy chain complementarity determining region 3 for antibody 7867
ARIWTSSTNCRYMDV

SEQ ID NO: 15735 - protein, 9 aa, Homo sapiens
  light chain complementarity determining region 3 for antibody 7868
QQSYSTPST

SEQ ID NO: 15736 - protein, 11 aa, Homo sapiens
  heavy chain complementarity determining region 3 for antibody 7868
ARIVARKPDDY

SEQ ID NO: 15737 - protein, 9 aa, Homo sapiens
  light chain complementarity determining region 3 for antibody 7869
QQSYSTPST

SEQ ID NO: 15738 - protein, 9 aa, Homo sapiens
  heavy chain complementarity determining region 3 for antibody 7869
ARGRNNFRY

SEQ ID NO: 15739 - protein, 9 aa, Homo sapiens
  light chain complementarity determining region 3 for antibody 7870
QQSYSTPST

SEQ ID NO: 15740 - protein, 11 aa, Homo sapiens
  heavy chain complementarity determining region 3 for antibody 7870
AREQHGQAPDY

SEQ ID NO: 15741 - protein, 9 aa, Homo sapiens
  light chain complementarity determining region 3 for antibody 7871
QQSYSTPST

SEQ ID NO: 15742 - protein, 10 aa, Homo sapiens
  heavy chain complementarity determining region 3 for antibody 7871
AREASGSYDI

SEQ ID NO: 15743 - protein, 9 aa, Homo sapiens
  light chain complementarity determining region 3 for antibody 7872
QQSYSTPST

SEQ ID NO: 15744 - protein, 13 aa, Homo sapiens
  heavy chain complementarity determining region 3 for antibody 7872
AKEGSSPGPDFDY

SEQ ID NO: 15745 - protein, 9 aa, Homo sapiens
  light chain complementarity determining region 3 for antibody 7873
QQSYSTPST

SEQ ID NO: 15746 - protein, 13 aa, Homo sapiens
  heavy chain complementarity determining region 3 for antibody 7873
AKEGSSPGPDFDS

SEQ ID NO: 15747 - protein, 10 aa, Homo sapiens
  light chain complementarity determining region 3 for antibody 7874
QQSYSTPSFT

SEQ ID NO: 15748 - protein, 23 aa, Homo sapiens
  heavy chain complementarity determining region 3 for antibody 7874
ARHFPKGGSGVTGTQSLLYYMDV

SEQ ID NO: 15749 - protein, 9 aa, Homo sapiens
  light chain complementarity determining region 3 for antibody 7875
QQSYSTPRT

SEQ ID NO: 15750 - protein, 16 aa, Homo sapiens
  heavy chain complementarity determining region 3 for antibody 7875
VRDLAGLTRGGSTFDY

SEQ ID NO: 15751 - protein, 9 aa, Homo sapiens
  light chain complementarity determining region 3 for antibody 7876
QQSYSTPRT

SEQ ID NO: 15752 - protein, 14 aa, Homo sapiens
  heavy chain complementarity determining region 3 for antibody 7876
GRDVHTTGWTLGGY

SEQ ID NO: 15753 - protein, 9 aa, Homo sapiens
  light chain complementarity determining region 3 for antibody 7877
QQSYSTPRT

SEQ ID NO: 15754 - protein, 18 aa, Homo sapiens
  heavy chain complementarity determining region 3 for antibody 7877
ATPAARASCYSDGCYFDF

SEQ ID NO: 15755 - protein, 9 aa, Homo sapiens
  light chain complementarity determining region 3 for antibody 7878
QQSYSTPRT

SEQ ID NO: 15756 - protein, 16 aa, Homo sapiens
  heavy chain complementarity determining region 3 for antibody 7878
ARSYDRSNTNVWYFDL

SEQ ID NO: 15757 - protein, 9 aa, Homo sapiens
  light chain complementarity determining region 3 for antibody 7879
QQSYSTPRT

SEQ ID NO: 15758 - protein, 16 aa, Homo sapiens
  heavy chain complementarity determining region 3 for antibody 7879
ARSYDRSNTKVWHFDL

SEQ ID NO: 15759 - protein, 9 aa, Homo sapiens
  light chain complementarity determining region 3 for antibody 7880
QQSYSTPRT

SEQ ID NO: 15760 - protein, 16 aa, Homo sapiens
  heavy chain complementarity determining region 3 for antibody 7880
ARSYDRSNTKDWYFDL

SEQ ID NO: 15761 - protein, 9 aa, Homo sapiens
  light chain complementarity determining region 3 for antibody 7881
QQSYSTPRT

SEQ ID NO: 15762 - protein, 16 aa, Homo sapiens
  heavy chain complementarity determining region 3 for antibody 7881
ARSYDRSNTKAWYFDL

SEQ ID NO: 15763 - protein, 9 aa, Homo sapiens
  light chain complementarity determining region 3 for antibody 7882
QQSYSTPRT

SEQ ID NO: 15764 - protein, 14 aa, Homo sapiens
  heavy chain complementarity determining region 3 for antibody 7882
ARLHGSGLGRWLDP

SEQ ID NO: 15765 - protein, 9 aa, Homo sapiens
  light chain complementarity determining region 3 for antibody 7883
QQSYSTPRT

SEQ ID NO: 15766 - protein, 15 aa, Homo sapiens
  heavy chain complementarity determining region 3 for antibody 7883
ARIWTSSTNCRYMDV

SEQ ID NO: 15767 - protein, 9 aa, Homo sapiens
  light chain complementarity determining region 3 for antibody 7884
QQSYSTPRT

SEQ ID NO: 15768 - protein, 11 aa, Homo sapiens
  heavy chain complementarity determining region 3 for antibody 7884
ARGQHGQAPDY

SEQ ID NO: 15769 - protein, 9 aa, Homo sapiens
  light chain complementarity determining region 3 for antibody 7885
QQSYSTPRT

SEQ ID NO: 15770 - protein, 18 aa, Homo sapiens
  heavy chain complementarity determining region 3 for antibody 7885
ARGDYPEARTGYFLDFDY

SEQ ID NO: 15771 - protein, 9 aa, Homo sapiens
  light chain complementarity determining region 3 for antibody 7886
QQSYSTPRT

SEQ ID NO: 15772 - protein, 10 aa, Homo sapiens
  heavy chain complementarity determining region 3 for antibody 7886
ARETSGSYDI

SEQ ID NO: 15773 - protein, 9 aa, Homo sapiens
  light chain complementarity determining region 3 for antibody 7887
QQSYSTPRT

SEQ ID NO: 15774 - protein, 11 aa, Homo sapiens
  heavy chain complementarity determining region 3 for antibody 7887
AREQRGQAPDY

SEQ ID NO: 15775 - protein, 9 aa, Homo sapiens
  light chain complementarity determining region 3 for antibody 7888
QQSYSTPRT

SEQ ID NO: 15776 - protein, 11 aa, Homo sapiens
  heavy chain complementarity determining region 3 for antibody 7888
AREQQGQAPDY

SEQ ID NO: 15777 - protein, 9 aa, Homo sapiens
  light chain complementarity determining region 3 for antibody 7889
QQSYSTPRT

SEQ ID NO: 15778 - protein, 11 aa, Homo sapiens
  heavy chain complementarity determining region 3 for antibody 7889
AREQHGQDPDY

SEQ ID NO: 15779 - protein, 9 aa, Homo sapiens
  light chain complementarity determining region 3 for antibody 7890
QQSYSTPRT

SEQ ID NO: 15780 - protein, 13 aa, Homo sapiens
  heavy chain complementarity determining region 3 for antibody 7890
AKEGSSPGPDFEY

SEQ ID NO: 15781 - protein, 9 aa, Homo sapiens
  light chain complementarity determining region 3 for antibody 7891
QQSYSTPRT

SEQ ID NO: 15782 - protein, 13 aa, Homo sapiens
  heavy chain complementarity determining region 3 for antibody 7891
AKEGSSPGPDFDY

SEQ ID NO: 15783 - protein, 9 aa, Homo sapiens
  light chain complementarity determining region 3 for antibody 7892
QQSYSTPRT

SEQ ID NO: 15784 - protein, 13 aa, Homo sapiens
  heavy chain complementarity determining region 3 for antibody 7892
AKEGSSAGPDFDY

SEQ ID NO: 15785 - protein, 9 aa, Homo sapiens
  light chain complementarity determining region 3 for antibody 7893
QQSYSTPRT

SEQ ID NO: 15786 - protein, 12 aa, Homo sapiens
  heavy chain complementarity determining region 3 for antibody 7893
AIVVPGRWDLDD

SEQ ID NO: 15787 - protein, 9 aa, Homo sapiens
  light chain complementarity determining region 3 for antibody 7894
QQSYSTPRT

SEQ ID NO: 15788 - protein, 10 aa, Homo sapiens
  heavy chain complementarity determining region 3 for antibody 7894
AHRINRAFDI

SEQ ID NO: 15789 - protein, 9 aa, Homo sapiens
  light chain complementarity determining region 3 for antibody 7895
QQSYSTPRT

SEQ ID NO: 15790 - protein, 11 aa, Homo sapiens
  heavy chain complementarity determining region 3 for antibody 7895
AGEQHGQAPDY

SEQ ID NO: 15791 - protein, 9 aa, Homo sapiens
  light chain complementarity determining region 3 for antibody 7896
QQSYSTPQT

SEQ ID NO: 15792 - protein, 11 aa, Homo sapiens
  heavy chain complementarity determining region 3 for antibody 7896
AREQHGQAPDY

SEQ ID NO: 15793 - protein, 10 aa, Homo sapiens
  light chain complementarity determining region 3 for antibody 7897
QQSYSTPQFT

SEQ ID NO: 15794 - protein, 11 aa, Homo sapiens
  heavy chain complementarity determining region 3 for antibody 7897
VGVSTGWYFDY

SEQ ID NO: 15795 - protein, 9 aa, Homo sapiens
  light chain complementarity determining region 3 for antibody 7898
QQSYSTPPT

SEQ ID NO: 15796 - protein, 13 aa, Homo sapiens
  heavy chain complementarity determining region 3 for antibody 7898
AKEGSSAGPDFDY

SEQ ID NO: 15797 - protein, 11 aa, Homo sapiens
  light chain complementarity determining region 3 for antibody 7899
QQSYSTPPRLT

SEQ ID NO: 15798 - protein, 13 aa, Homo sapiens
  heavy chain complementarity determining region 3 for antibody 7899
TKEVSSAGPDFVY

SEQ ID NO: 15799 - protein, 11 aa, Homo sapiens
  light chain complementarity determining region 3 for antibody 7900
QQSYSTPPRLT

SEQ ID NO: 15800 - protein, 13 aa, Homo sapiens
  heavy chain complementarity determining region 3 for antibody 7900
TKEGSSAGPDFVS

SEQ ID NO: 15801 - protein, 11 aa, Homo sapiens
  light chain complementarity determining region 3 for antibody 7901
QQSYSTPPRLT

SEQ ID NO: 15802 - protein, 13 aa, Homo sapiens
  heavy chain complementarity determining region 3 for antibody 7901
TKEGPSAGPDFVY

SEQ ID NO: 15803 - protein, 11 aa, Homo sapiens
  light chain complementarity determining region 3 for antibody 7902
QQSYSTPPRLT

SEQ ID NO: 15804 - protein, 13 aa, Homo sapiens
  heavy chain complementarity determining region 3 for antibody 7902
TKEGCSAGPDFVY

SEQ ID NO: 15805 - protein, 11 aa, Homo sapiens
  light chain complementarity determining region 3 for antibody 7903
QQSYSTPPRLT

SEQ ID NO: 15806 - protein, 13 aa, Homo sapiens
  heavy chain complementarity determining region 3 for antibody 7903
SKEGSSAGPDFVY

SEQ ID NO: 15807 - protein, 11 aa, Homo sapiens
  light chain complementarity determining region 3 for antibody 7904
QQSYSTPPRLT

SEQ ID NO: 15808 - protein, 10 aa, Homo sapiens
  heavy chain complementarity determining region 3 for antibody 7904
CRDREGFGDV

SEQ ID NO: 15809 - protein, 11 aa, Homo sapiens
  light chain complementarity determining region 3 for antibody 7905
QQSYSTPPRLT

SEQ ID NO: 15810 - protein, 13 aa, Homo sapiens
  heavy chain complementarity determining region 3 for antibody 7905
AKEGSAPGPDFEY

SEQ ID NO: 15811 - protein, 10 aa, Homo sapiens
  light chain complementarity determining region 3 for antibody 7906
QQSYSTPPLT

SEQ ID NO: 15812 - protein, 17 aa, Homo sapiens
  heavy chain complementarity determining region 3 for antibody 7906
VSERYGSGLYHCCAFEI

SEQ ID NO: 15813 - protein, 10 aa, Homo sapiens
  light chain complementarity determining region 3 for antibody 7907
QQSYSTPPLT

SEQ ID NO: 15814 - protein, 15 aa, Homo sapiens
  heavy chain complementarity determining region 3 for antibody 7907
ARDWRYTYGQEGMNV

SEQ ID NO: 15815 - protein, 10 aa, Homo sapiens
  light chain complementarity determining region 3 for antibody 7908
QQSYSTPPGT

SEQ ID NO: 15816 - protein, 12 aa, Homo sapiens
  heavy chain complementarity determining region 3 for antibody 7908
AGSRSGGGSIDY

SEQ ID NO: 15817 - protein, 11 aa, Homo sapiens
  light chain complementarity determining region 3 for antibody 7909
QQSYSTPPGLT

SEQ ID NO: 15818 - protein, 13 aa, Homo sapiens
  heavy chain complementarity determining region 3 for antibody 7909
TKEGSSAGPDFVY

SEQ ID NO: 15819 - protein, 9 aa, Homo sapiens
  light chain complementarity determining region 3 for antibody 7910
QQSYSTPPA

SEQ ID NO: 15820 - protein, 13 aa, Homo sapiens
  heavy chain complementarity determining region 3 for antibody 7910
AKDGLYGSGRPLD

SEQ ID NO: 15821 - protein, 10 aa, Homo sapiens
  light chain complementarity determining region 3 for antibody 7911
QQSYSTPLYT

SEQ ID NO: 15822 - protein, 17 aa, Homo sapiens
  heavy chain complementarity determining region 3 for antibody 7911
ARNTMVGTWQRQGNLDH

SEQ ID NO: 15823 - protein, 9 aa, Homo sapiens
  light chain complementarity determining region 3 for antibody 7912
QQSYSTPLT

SEQ ID NO: 15824 - protein, 10 aa, Homo sapiens
  heavy chain complementarity determining region 3 for antibody 7912
CRDREGFGDV

SEQ ID NO: 15825 - protein, 9 aa, Homo sapiens
  light chain complementarity determining region 3 for antibody 7913
QQSYSTPLT

SEQ ID NO: 15826 - protein, 14 aa, Homo sapiens
  heavy chain complementarity determining region 3 for antibody 7913
ARLHGSGLGRWLDP

SEQ ID NO: 15827 - protein, 9 aa, Homo sapiens
  light chain complementarity determining region 3 for antibody 7914
QQSYSTPLT

SEQ ID NO: 15828 - protein, 15 aa, Homo sapiens
  heavy chain complementarity determining region 3 for antibody 7914
ARDSYVGSGGYQTDS

SEQ ID NO: 15829 - protein, 9 aa, Homo sapiens
  light chain complementarity determining region 3 for antibody 7915
QQSYSTPLT

SEQ ID NO: 15830 - protein, 13 aa, Homo sapiens
  heavy chain complementarity determining region 3 for antibody 7915
AKEGSSVGPDFDY

SEQ ID NO: 15831 - protein, 9 aa, Homo sapiens
  light chain complementarity determining region 3 for antibody 7916
QQSYSTPLT

SEQ ID NO: 15832 - protein, 13 aa, Homo sapiens
  heavy chain complementarity determining region 3 for antibody 7916
AKEGSSAVPDFDY

SEQ ID NO: 15833 - protein, 9 aa, Homo sapiens
  light chain complementarity determining region 3 for antibody 7917
QQSYSTPLT

SEQ ID NO: 15834 - protein, 13 aa, Homo sapiens
  heavy chain complementarity determining region 3 for antibody 7917
AKEGSSAGPDVDY

SEQ ID NO: 15835 - protein, 9 aa, Homo sapiens
  light chain complementarity determining region 3 for antibody 7918
QQSYSTPLT

SEQ ID NO: 15836 - protein, 13 aa, Homo sapiens
  heavy chain complementarity determining region 3 for antibody 7918
AKEGSSAGPDSDY

SEQ ID NO: 15837 - protein, 9 aa, Homo sapiens
  light chain complementarity determining region 3 for antibody 7919
QQSYSTPLT

SEQ ID NO: 15838 - protein, 13 aa, Homo sapiens
  heavy chain complementarity determining region 3 for antibody 7919
AKEGSSAGPDLDY

SEQ ID NO: 15839 - protein, 9 aa, Homo sapiens
  light chain complementarity determining region 3 for antibody 7920
QQSYSTPLT

SEQ ID NO: 15840 - protein, 13 aa, Homo sapiens
  heavy chain complementarity determining region 3 for antibody 7920
AKEGSSAGPDIDY

SEQ ID NO: 15841 - protein, 9 aa, Homo sapiens
  light chain complementarity determining region 3 for antibody 7921
QQSYSTPLT

SEQ ID NO: 15842 - protein, 13 aa, Homo sapiens
  heavy chain complementarity determining region 3 for antibody 7921
AKEGSSAGPDFDS

SEQ ID NO: 15843 - protein, 9 aa, Homo sapiens
  light chain complementarity determining region 3 for antibody 7922
QQSYSTPLT

SEQ ID NO: 15844 - protein, 13 aa, Homo sapiens
  heavy chain complementarity determining region 3 for antibody 7922
AKEGPSAGPDFDY

SEQ ID NO: 15845 - protein, 9 aa, Homo sapiens
  light chain complementarity determining region 3 for antibody 7923
QQSYSTPLT

SEQ ID NO: 15846 - protein, 13 aa, Homo sapiens
  heavy chain complementarity determining region 3 for antibody 7923
AKEESSAGPDFDY

SEQ ID NO: 15847 - protein, 9 aa, Homo sapiens
  light chain complementarity determining region 3 for antibody 7924
QQSYSTPLT

SEQ ID NO: 15848 - protein, 9 aa, Homo sapiens
  heavy chain complementarity determining region 3 for antibody 7924
AGWGGLSNY

SEQ ID NO: 15849 - protein, 9 aa, Homo sapiens
  light chain complementarity determining region 3 for antibody 7925
QQSYSTPLT

SEQ ID NO: 15850 - protein, 11 aa, Homo sapiens
  heavy chain complementarity determining region 3 for antibody 7925
AAFGQQWRLAH

SEQ ID NO: 15851 - protein, 10 aa, Homo sapiens
  light chain complementarity determining region 3 for antibody 7926
QQSYSTPLST

SEQ ID NO: 15852 - protein, 15 aa, Homo sapiens
  heavy chain complementarity determining region 3 for antibody 7926
ARVGRPYHNAWYFDN

SEQ ID NO: 15853 - protein, 10 aa, Homo sapiens
  light chain complementarity determining region 3 for antibody 7927
QQSYSTPLST

SEQ ID NO: 15854 - protein, 23 aa, Homo sapiens
  heavy chain complementarity determining region 3 for antibody 7927
ARHFPKGGSGVTGTQSLLYYMDV

SEQ ID NO: 15855 - protein, 9 aa, Homo sapiens
  light chain complementarity determining region 3 for antibody 7928
QQSYSTPLP

SEQ ID NO: 15856 - protein, 13 aa, Homo sapiens
  heavy chain complementarity determining region 3 for antibody 7928
AKEGSSPGPDFDY

SEQ ID NO: 15857 - protein, 10 aa, Homo sapiens
  light chain complementarity determining region 3 for antibody 7929
QQSYSTPLLT

SEQ ID NO: 15858 - protein, 17 aa, Homo sapiens
  heavy chain complementarity determining region 3 for antibody 7929
ARNTMVGTWQRQGNLDH

SEQ ID NO: 15859 - protein, 10 aa, Homo sapiens
  light chain complementarity determining region 3 for antibody 7930
QQSYSTPLLT

SEQ ID NO: 15860 - protein, 23 aa, Homo sapiens
  heavy chain complementarity determining region 3 for antibody 7930
ARHFPKGGSGVTGTQSLLYYMDV

SEQ ID NO: 15861 - protein, 10 aa, Homo sapiens
  light chain complementarity determining region 3 for antibody 7931
QQSYSTPLFT

SEQ ID NO: 15862 - protein, 18 aa, Homo sapiens
  heavy chain complementarity determining region 3 for antibody 7931
TTVLSQLLAGDWHLYFQH

SEQ ID NO: 15863 - protein, 10 aa, Homo sapiens
  light chain complementarity determining region 3 for antibody 7932
QQSYSTPLFT

SEQ ID NO: 15864 - protein, 23 aa, Homo sapiens
  heavy chain complementarity determining region 3 for antibody 7932
TRHFPMGGSTVTGTQSLLYYMDV

SEQ ID NO: 15865 - protein, 10 aa, Homo sapiens
  light chain complementarity determining region 3 for antibody 7933
QQSYSTPLFT

SEQ ID NO: 15866 - protein, 13 aa, Homo sapiens
  heavy chain complementarity determining region 3 for antibody 7933
TREGDSSGPDFHL

SEQ ID NO: 15867 - protein, 10 aa, Homo sapiens
  light chain complementarity determining region 3 for antibody 7934
QQSYSTPLFT

SEQ ID NO: 15868 - protein, 15 aa, Homo sapiens
  heavy chain complementarity determining region 3 for antibody 7934
SRVGRPYHNAWYFDN

SEQ ID NO: 15869 - protein, 10 aa, Homo sapiens
  light chain complementarity determining region 3 for antibody 7935
QQSYSTPLFT

SEQ ID NO: 15870 - protein, 9 aa, Homo sapiens
  heavy chain complementarity determining region 3 for antibody 7935
GSRRPYFDS

SEQ ID NO: 15871 - protein, 10 aa, Homo sapiens
  light chain complementarity determining region 3 for antibody 7936
QQSYSTPLFT

SEQ ID NO: 15872 - protein, 11 aa, Homo sapiens
  heavy chain complementarity determining region 3 for antibody 7936
ATFGQKWRLAH

SEQ ID NO: 15873 - protein, 10 aa, Homo sapiens
  light chain complementarity determining region 3 for antibody 7937
QQSYSTPLFT

SEQ ID NO: 15874 - protein, 19 aa, Homo sapiens
  heavy chain complementarity determining region 3 for antibody 7937
ARWNGIRSQNNFWSGPFGH

SEQ ID NO: 15875 - protein, 10 aa, Homo sapiens
  light chain complementarity determining region 3 for antibody 7938
QQSYSTPLFT

SEQ ID NO: 15876 - protein, 19 aa, Homo sapiens
  heavy chain complementarity determining region 3 for antibody 7938
ARWNGIRSQNNCWSGPFDH

SEQ ID NO: 15877 - protein, 10 aa, Homo sapiens
  light chain complementarity determining region 3 for antibody 7939
QQSYSTPLFT

SEQ ID NO: 15878 - protein, 15 aa, Homo sapiens
  heavy chain complementarity determining region 3 for antibody 7939
ARVVRPYHNAWYFDN

SEQ ID NO: 15879 - protein, 10 aa, Homo sapiens
  light chain complementarity determining region 3 for antibody 7940
QQSYSTPLFT

SEQ ID NO: 15880 - protein, 15 aa, Homo sapiens
  heavy chain complementarity determining region 3 for antibody 7940
ARVGRPYQNAWYFDN

SEQ ID NO: 15881 - protein, 10 aa, Homo sapiens
  light chain complementarity determining region 3 for antibody 7941
QQSYSTPLFT

SEQ ID NO: 15882 - protein, 15 aa, Homo sapiens
  heavy chain complementarity determining region 3 for antibody 7941
ARVGRPYHTAWYFDN

SEQ ID NO: 15883 - protein, 10 aa, Homo sapiens
  light chain complementarity determining region 3 for antibody 7942
QQSYSTPLFT

SEQ ID NO: 15884 - protein, 15 aa, Homo sapiens
  heavy chain complementarity determining region 3 for antibody 7942
ARVGRPYHTAGYFDN

SEQ ID NO: 15885 - protein, 10 aa, Homo sapiens
  light chain complementarity determining region 3 for antibody 7943
QQSYSTPLFT

SEQ ID NO: 15886 - protein, 15 aa, Homo sapiens
  heavy chain complementarity determining region 3 for antibody 7943
ARVGRPYHNDWYFDN

SEQ ID NO: 15887 - protein, 10 aa, Homo sapiens
  light chain complementarity determining region 3 for antibody 7944
QQSYSTPLFT

SEQ ID NO: 15888 - protein, 15 aa, Homo sapiens
  heavy chain complementarity determining region 3 for antibody 7944
ARVGRPYHNAWYVDN

SEQ ID NO: 15889 - protein, 10 aa, Homo sapiens
  light chain complementarity determining region 3 for antibody 7945
QQSYSTPLFT

SEQ ID NO: 15890 - protein, 15 aa, Homo sapiens
  heavy chain complementarity determining region 3 for antibody 7945
ARVGRPYHNAWYSDN

SEQ ID NO: 15891 - protein, 10 aa, Homo sapiens
  light chain complementarity determining region 3 for antibody 7946
QQSYSTPLFT

SEQ ID NO: 15892 - protein, 15 aa, Homo sapiens
  heavy chain complementarity determining region 3 for antibody 7946
ARVGRPYHNAWYFVH

SEQ ID NO: 15893 - protein, 10 aa, Homo sapiens
  light chain complementarity determining region 3 for antibody 7947
QQSYSTPLFT

SEQ ID NO: 15894 - protein, 15 aa, Homo sapiens
  heavy chain complementarity determining region 3 for antibody 7947
ARVGRPYHNAWYFDY

SEQ ID NO: 15895 - protein, 10 aa, Homo sapiens
  light chain complementarity determining region 3 for antibody 7948
QQSYSTPLFT

SEQ ID NO: 15896 - protein, 15 aa, Homo sapiens
  heavy chain complementarity determining region 3 for antibody 7948
ARVGRPYHNAWYFDS

SEQ ID NO: 15897 - protein, 10 aa, Homo sapiens
  light chain complementarity determining region 3 for antibody 7949
QQSYSTPLFT

SEQ ID NO: 15898 - protein, 15 aa, Homo sapiens
  heavy chain complementarity determining region 3 for antibody 7949
ARVGRPYHNAWYFAN

SEQ ID NO: 15899 - protein, 10 aa, Homo sapiens
  light chain complementarity determining region 3 for antibody 7950
QQSYSTPLFT

SEQ ID NO: 15900 - protein, 15 aa, Homo sapiens
  heavy chain complementarity determining region 3 for antibody 7950
ARVGRPYHNAWHFDN

SEQ ID NO: 15901 - protein, 10 aa, Homo sapiens
  light chain complementarity determining region 3 for antibody 7951
QQSYSTPLFT

SEQ ID NO: 15902 - protein, 15 aa, Homo sapiens
  heavy chain complementarity determining region 3 for antibody 7951
ARVGRPYHNALYFDN

SEQ ID NO: 15903 - protein, 10 aa, Homo sapiens
  light chain complementarity determining region 3 for antibody 7952
QQSYSTPLFT

SEQ ID NO: 15904 - protein, 15 aa, Homo sapiens
  heavy chain complementarity determining region 3 for antibody 7952
ARVGRPYHNAGYCDN

SEQ ID NO: 15905 - protein, 10 aa, Homo sapiens
  light chain complementarity determining region 3 for antibody 7953
QQSYSTPLFT

SEQ ID NO: 15906 - protein, 15 aa, Homo sapiens
  heavy chain complementarity determining region 3 for antibody 7953
ARVGRPYHDAWYFDN

SEQ ID NO: 15907 - protein, 10 aa, Homo sapiens
  light chain complementarity determining region 3 for antibody 7954
QQSYSTPLFT

SEQ ID NO: 15908 - protein, 15 aa, Homo sapiens
  heavy chain complementarity determining region 3 for antibody 7954
ARVGRPSHNAWYFDN

SEQ ID NO: 15909 - protein, 10 aa, Homo sapiens
  light chain complementarity determining region 3 for antibody 7955
QQSYSTPLFT

SEQ ID NO: 15910 - protein, 15 aa, Homo sapiens
  heavy chain complementarity determining region 3 for antibody 7955
ARVGRHYHNAWYFDN

SEQ ID NO: 15911 - protein, 10 aa, Homo sapiens
  light chain complementarity determining region 3 for antibody 7956
QQSYSTPLFT

SEQ ID NO: 15912 - protein, 15 aa, Homo sapiens
  heavy chain complementarity determining region 3 for antibody 7956
ARVDRPYHNAWYFDN

SEQ ID NO: 15913 - protein, 10 aa, Homo sapiens
  light chain complementarity determining region 3 for antibody 7957
QQSYSTPLFT

SEQ ID NO: 15914 - protein, 9 aa, Homo sapiens
  heavy chain complementarity determining region 3 for antibody 7957
ARSEYQPTY

SEQ ID NO: 15915 - protein, 10 aa, Homo sapiens
  light chain complementarity determining region 3 for antibody 7958
QQSYSTPLFT

SEQ ID NO: 15916 - protein, 23 aa, Homo sapiens
  heavy chain complementarity determining region 3 for antibody 7958
ARQFPKGGSGVTGTQSLLYYMDV

SEQ ID NO: 15917 - protein, 10 aa, Homo sapiens
  light chain complementarity determining region 3 for antibody 7959
QQSYSTPLFT

SEQ ID NO: 15918 - protein, 17 aa, Homo sapiens
  heavy chain complementarity determining region 3 for antibody 7959
ARNTMVGTWQRQGNPDH

SEQ ID NO: 15919 - protein, 10 aa, Homo sapiens
  light chain complementarity determining region 3 for antibody 7960
QQSYSTPLFT

SEQ ID NO: 15920 - protein, 17 aa, Homo sapiens
  heavy chain complementarity determining region 3 for antibody 7960
ARNTMVDGWQRQGSVDH

SEQ ID NO: 15921 - protein, 10 aa, Homo sapiens
  light chain complementarity determining region 3 for antibody 7961
QQSYSTPLFT

SEQ ID NO: 15922 - protein, 17 aa, Homo sapiens
  heavy chain complementarity determining region 3 for antibody 7961
ARNPMVGTWQRQGNLDH

SEQ ID NO: 15923 - protein, 10 aa, Homo sapiens
  light chain complementarity determining region 3 for antibody 7962
QQSYSTPLFT

SEQ ID NO: 15924 - protein, 15 aa, Homo sapiens
  heavy chain complementarity determining region 3 for antibody 7962
ARIWTSSTNCRYMDV

SEQ ID NO: 15925 - protein, 10 aa, Homo sapiens
  light chain complementarity determining region 3 for antibody 7963
QQSYSTPLFT

SEQ ID NO: 15926 - protein, 11 aa, Homo sapiens
  heavy chain complementarity determining region 3 for antibody 7963
ARIVARKPDDY

SEQ ID NO: 15927 - protein, 10 aa, Homo sapiens
  light chain complementarity determining region 3 for antibody 7964
QQSYSTPLFT

SEQ ID NO: 15928 - protein, 23 aa, Homo sapiens
  heavy chain complementarity determining region 3 for antibody 7964
ARHSPMGGSTVTGTQSLLYYMDV

SEQ ID NO: 15929 - protein, 10 aa, Homo sapiens
  light chain complementarity determining region 3 for antibody 7965
QQSYSTPLFT

SEQ ID NO: 15930 - protein, 23 aa, Homo sapiens
  heavy chain complementarity determining region 3 for antibody 7965
ARHSPKGGSGVTGTQSLLYYMDV

SEQ ID NO: 15931 - protein, 10 aa, Homo sapiens
  light chain complementarity determining region 3 for antibody 7966
QQSYSTPLFT

SEQ ID NO: 15932 - protein, 23 aa, Homo sapiens
  heavy chain complementarity determining region 3 for antibody 7966
ARHFPMRGSTVTGTQSLLYYMDV

SEQ ID NO: 15933 - protein, 10 aa, Homo sapiens
  light chain complementarity determining region 3 for antibody 7967
QQSYSTPLFT

SEQ ID NO: 15934 - protein, 23 aa, Homo sapiens
  heavy chain complementarity determining region 3 for antibody 7967
ARHFPMGGSTVTGTQSLLYYMDF

SEQ ID NO: 15935 - protein, 10 aa, Homo sapiens
  light chain complementarity determining region 3 for antibody 7968
QQSYSTPLFT

SEQ ID NO: 15936 - protein, 23 aa, Homo sapiens
  heavy chain complementarity determining region 3 for antibody 7968
ARHFPMGGSTVTGTQSLLYYMDA

SEQ ID NO: 15937 - protein, 10 aa, Homo sapiens
  light chain complementarity determining region 3 for antibody 7969
QQSYSTPLFT

SEQ ID NO: 15938 - protein, 23 aa, Homo sapiens
  heavy chain complementarity determining region 3 for antibody 7969
ARHFPMGGSTVTGTQSLLYDMDV

SEQ ID NO: 15939 - protein, 10 aa, Homo sapiens
  light chain complementarity determining region 3 for antibody 7970
QQSYSTPLFT

SEQ ID NO: 15940 - protein, 23 aa, Homo sapiens
  heavy chain complementarity determining region 3 for antibody 7970
ARHFPMGGSTVTGTQSLLFYMDV

SEQ ID NO: 15941 - protein, 10 aa, Homo sapiens
  light chain complementarity determining region 3 for antibody 7971
QQSYSTPLFT

SEQ ID NO: 15942 - protein, 23 aa, Homo sapiens
  heavy chain complementarity determining region 3 for antibody 7971
ARHFPMGGSTVTGTQSLLCYMDV

SEQ ID NO: 15943 - protein, 10 aa, Homo sapiens
  light chain complementarity determining region 3 for antibody 7972
QQSYSTPLFT

SEQ ID NO: 15944 - protein, 23 aa, Homo sapiens
  heavy chain complementarity determining region 3 for antibody 7972
ARHFPMGGSTVTGTQALLYYMDV

SEQ ID NO: 15945 - protein, 10 aa, Homo sapiens
  light chain complementarity determining region 3 for antibody 7973
QQSYSTPLFT

SEQ ID NO: 15946 - protein, 23 aa, Homo sapiens
  heavy chain complementarity determining region 3 for antibody 7973
ARHFPMGGSTVTGTHSLLYYMDV

SEQ ID NO: 15947 - protein, 10 aa, Homo sapiens
  light chain complementarity determining region 3 for antibody 7974
QQSYSTPLFT

SEQ ID NO: 15948 - protein, 23 aa, Homo sapiens
  heavy chain complementarity determining region 3 for antibody 7974
ARHFPMGGSTVTGNQSLLYYMDV

SEQ ID NO: 15949 - protein, 10 aa, Homo sapiens
  light chain complementarity determining region 3 for antibody 7975
QQSYSTPLFT

SEQ ID NO: 15950 - protein, 23 aa, Homo sapiens
  heavy chain complementarity determining region 3 for antibody 7975
ARHFPMGGSTVNGTQSLLYYMDV

SEQ ID NO: 15951 - protein, 10 aa, Homo sapiens
  light chain complementarity determining region 3 for antibody 7976
QQSYSTPLFT

SEQ ID NO: 15952 - protein, 23 aa, Homo sapiens
  heavy chain complementarity determining region 3 for antibody 7976
ARHFPMGGSTGTGTQSLLYYMDV

SEQ ID NO: 15953 - protein, 10 aa, Homo sapiens
  light chain complementarity determining region 3 for antibody 7977
QQSYSTPLFT

SEQ ID NO: 15954 - protein, 23 aa, Homo sapiens
  heavy chain complementarity determining region 3 for antibody 7977
ARHFPMGGSSVTGTQSLLYYMDV

SEQ ID NO: 15955 - protein, 10 aa, Homo sapiens
  light chain complementarity determining region 3 for antibody 7978
QQSYSTPLFT

SEQ ID NO: 15956 - protein, 23 aa, Homo sapiens
  heavy chain complementarity determining region 3 for antibody 7978
ARHFPMGGSIVTGTQSLLYYMDV

SEQ ID NO: 15957 - protein, 10 aa, Homo sapiens
  light chain complementarity determining region 3 for antibody 7979
QQSYSTPLFT

SEQ ID NO: 15958 - protein, 23 aa, Homo sapiens
  heavy chain complementarity determining region 3 for antibody 7979
ARHFPKGGSTVTGTQSRLYYMDV

SEQ ID NO: 15959 - protein, 10 aa, Homo sapiens
  light chain complementarity determining region 3 for antibody 7980
QQSYSTPLFT

SEQ ID NO: 15960 - protein, 23 aa, Homo sapiens
  heavy chain complementarity determining region 3 for antibody 7980
ARHFPKGGSTVTGTQPLLYYMDV

SEQ ID NO: 15961 - protein, 10 aa, Homo sapiens
  light chain complementarity determining region 3 for antibody 7981
QQSYSTPLFT

SEQ ID NO: 15962 - protein, 23 aa, Homo sapiens
  heavy chain complementarity determining region 3 for antibody 7981
ARHFPKGGSTVTGTQALLYYMDV

SEQ ID NO: 15963 - protein, 10 aa, Homo sapiens
  light chain complementarity determining region 3 for antibody 7982
QQSYSTPLFT

SEQ ID NO: 15964 - protein, 23 aa, Homo sapiens
  heavy chain complementarity determining region 3 for antibody 7982
ARHFPKGGSTVTGTESLLYYMDV

SEQ ID NO: 15965 - protein, 10 aa, Homo sapiens
  light chain complementarity determining region 3 for antibody 7983
QQSYSTPLFT

SEQ ID NO: 15966 - protein, 23 aa, Homo sapiens
  heavy chain complementarity determining region 3 for antibody 7983
ARHFPKGGSGVTGTQSRIYYMDV

SEQ ID NO: 15967 - protein, 10 aa, Homo sapiens
  light chain complementarity determining region 3 for antibody 7984
QQSYSTPLFT

SEQ ID NO: 15968 - protein, 23 aa, Homo sapiens
  heavy chain complementarity determining region 3 for antibody 7984
ARHFPKGGSGVTGTQSLRYYMDV

SEQ ID NO: 15969 - protein, 10 aa, Homo sapiens
  light chain complementarity determining region 3 for antibody 7985
QQSYSTPLFT

SEQ ID NO: 15970 - protein, 23 aa, Homo sapiens
  heavy chain complementarity determining region 3 for antibody 7985
ARHFPKGGSGVTGTQCLLYYMDV

SEQ ID NO: 15971 - protein, 10 aa, Homo sapiens
  light chain complementarity determining region 3 for antibody 7986
QQSYSTPLFT

SEQ ID NO: 15972 - protein, 23 aa, Homo sapiens
  heavy chain complementarity determining region 3 for antibody 7986
ARHFPKGGSGVTGTHSLLYYMDV

SEQ ID NO: 15973 - protein, 10 aa, Homo sapiens
  light chain complementarity determining region 3 for antibody 7987
QQSYSTPLFT

SEQ ID NO: 15974 - protein, 23 aa, Homo sapiens
  heavy chain complementarity determining region 3 for antibody 7987
ARHFPKGGSGVTGAQSLLYYMDV

SEQ ID NO: 15975 - protein, 10 aa, Homo sapiens
  light chain complementarity determining region 3 for antibody 7988
QQSYSTPLFT

SEQ ID NO: 15976 - protein, 23 aa, Homo sapiens
  heavy chain complementarity determining region 3 for antibody 7988
ARHFPKGGSGVAGTQSLLYYMDV

SEQ ID NO: 15977 - protein, 10 aa, Homo sapiens
  light chain complementarity determining region 3 for antibody 7989
QQSYSTPLFT

SEQ ID NO: 15978 - protein, 23 aa, Homo sapiens
  heavy chain complementarity determining region 3 for antibody 7989
ARHFPKGGSGVAGTQSLIYYMDV

SEQ ID NO: 15979 - protein, 10 aa, Homo sapiens
  light chain complementarity determining region 3 for antibody 7990
QQSYSTPLFT

SEQ ID NO: 15980 - protein, 23 aa, Homo sapiens
  heavy chain complementarity determining region 3 for antibody 7990
ARHFPKGGSGGTGTQSLLYYMDV

SEQ ID NO: 15981 - protein, 10 aa, Homo sapiens
  light chain complementarity determining region 3 for antibody 7991
QQSYSTPLFT

SEQ ID NO: 15982 - protein, 23 aa, Homo sapiens
  heavy chain complementarity determining region 3 for antibody 7991
ARHFPKGGAGVTGTQSLLYYMDV

SEQ ID NO: 15983 - protein, 10 aa, Homo sapiens
  light chain complementarity determining region 3 for antibody 7992
QQSYSTPLFT

SEQ ID NO: 15984 - protein, 23 aa, Homo sapiens
  heavy chain complementarity determining region 3 for antibody 7992
ARHFPKGGAGVTGTQSLIYYMDV

SEQ ID NO: 15985 - protein, 10 aa, Homo sapiens
  light chain complementarity determining region 3 for antibody 7993
QQSYSTPLFT

SEQ ID NO: 15986 - protein, 12 aa, Homo sapiens
  heavy chain complementarity determining region 3 for antibody 7993
ARGPLKMAGGSS

SEQ ID NO: 15987 - protein, 10 aa, Homo sapiens
  light chain complementarity determining region 3 for antibody 7994
QQSYSTPLFT

SEQ ID NO: 15988 - protein, 10 aa, Homo sapiens
  heavy chain complementarity determining region 3 for antibody 7994
ARETSGSYDI

SEQ ID NO: 15989 - protein, 10 aa, Homo sapiens
  light chain complementarity determining region 3 for antibody 7995
QQSYSTPLFT

SEQ ID NO: 15990 - protein, 19 aa, Homo sapiens
  heavy chain complementarity determining region 3 for antibody 7995
AREIVVPTADNGNKDAFDL

SEQ ID NO: 15991 - protein, 10 aa, Homo sapiens
  light chain complementarity determining region 3 for antibody 7996
QQSYSTPLFT

SEQ ID NO: 15992 - protein, 14 aa, Homo sapiens
  heavy chain complementarity determining region 3 for antibody 7996
ARASGGDTDFLIDF

SEQ ID NO: 15993 - protein, 10 aa, Homo sapiens
  light chain complementarity determining region 3 for antibody 7997
QQSYSTPLFT

SEQ ID NO: 15994 - protein, 15 aa, Homo sapiens
  heavy chain complementarity determining region 3 for antibody 7997
ARAGRPYHNAWYFDN

SEQ ID NO: 15995 - protein, 10 aa, Homo sapiens
  light chain complementarity determining region 3 for antibody 7998
QQSYSTPLFT

SEQ ID NO: 15996 - protein, 12 aa, Homo sapiens
  heavy chain complementarity determining region 3 for antibody 7998
ALDEWHPSWYKY

SEQ ID NO: 15997 - protein, 10 aa, Homo sapiens
  light chain complementarity determining region 3 for antibody 7999
QQSYSTPLFT

SEQ ID NO: 15998 - protein, 13 aa, Homo sapiens
  heavy chain complementarity determining region 3 for antibody 7999
AKEGSSPGPDFDY

SEQ ID NO: 15999 - protein, 10 aa, Homo sapiens
  light chain complementarity determining region 3 for antibody 8000
QQSYSTPLFT

SEQ ID NO: 16000 - protein, 12 aa, Homo sapiens
  heavy chain complementarity determining region 3 for antibody 8000
AIVVPGRWDLDD

SEQ ID NO: 16001 - protein, 10 aa, Homo sapiens
  light chain complementarity determining region 3 for antibody 8001
QQSYSTPLFT

SEQ ID NO: 16002 - protein, 15 aa, Homo sapiens
  heavy chain complementarity determining region 3 for antibody 8001
AIVGRPYHNAWYFDN

SEQ ID NO: 16003 - protein, 10 aa, Homo sapiens
  light chain complementarity determining region 3 for antibody 8002
QQSYSTPLFT

SEQ ID NO: 16004 - protein, 9 aa, Homo sapiens
  heavy chain complementarity determining region 3 for antibody 8002
AGWGGASNY

SEQ ID NO: 16005 - protein, 10 aa, Homo sapiens
  light chain complementarity determining region 3 for antibody 8003
QQSYSTPLFT

SEQ ID NO: 16006 - protein, 23 aa, Homo sapiens
  heavy chain complementarity determining region 3 for antibody 8003
AGHFPMGGSTVTGTQSLLYYMDV

SEQ ID NO: 16007 - protein, 10 aa, Homo sapiens
  light chain complementarity determining region 3 for antibody 8004
QQSYSTPLFN

SEQ ID NO: 16008 - protein, 23 aa, Homo sapiens
  heavy chain complementarity determining region 3 for antibody 8004
ARHFPMGGSTVTGTQSLLYYMDV

SEQ ID NO: 16009 - protein, 9 aa, Homo sapiens
  light chain complementarity determining region 3 for antibody 8005
QQSYSTPIT

SEQ ID NO: 16010 - protein, 17 aa, Homo sapiens
  heavy chain complementarity determining region 3 for antibody 8005
ARTTMVGTWQRQGNLDH

SEQ ID NO: 16011 - protein, 9 aa, Homo sapiens
  light chain complementarity determining region 3 for antibody 8006
QQSYSTPIT

SEQ ID NO: 16012 - protein, 17 aa, Homo sapiens
  heavy chain complementarity determining region 3 for antibody 8006
ARNTVVGTWQRQGNLDH

SEQ ID NO: 16013 - protein, 9 aa, Homo sapiens
  light chain complementarity determining region 3 for antibody 8007
QQSYSTPIT

SEQ ID NO: 16014 - protein, 17 aa, Homo sapiens
  heavy chain complementarity determining region 3 for antibody 8007
ARNTMVGTWQRRGNLDH

SEQ ID NO: 16015 - protein, 9 aa, Homo sapiens
  light chain complementarity determining region 3 for antibody 8008
QQSYSTPIT

SEQ ID NO: 16016 - protein, 17 aa, Homo sapiens
  heavy chain complementarity determining region 3 for antibody 8008
ARNTMVGTWQRQGSLDH

SEQ ID NO: 16017 - protein, 9 aa, Homo sapiens
  light chain complementarity determining region 3 for antibody 8009
QQSYSTPIT

SEQ ID NO: 16018 - protein, 17 aa, Homo sapiens
  heavy chain complementarity determining region 3 for antibody 8009
ARNTMVGTWQRQGNLDN

SEQ ID NO: 16019 - protein, 9 aa, Homo sapiens
  light chain complementarity determining region 3 for antibody 8010
QQSYSTPIT

SEQ ID NO: 16020 - protein, 17 aa, Homo sapiens
  heavy chain complementarity determining region 3 for antibody 8010
ARNTMVGTWQRQGNFDH

SEQ ID NO: 16021 - protein, 9 aa, Homo sapiens
  light chain complementarity determining region 3 for antibody 8011
QQSYSTPIT

SEQ ID NO: 16022 - protein, 17 aa, Homo sapiens
  heavy chain complementarity determining region 3 for antibody 8011
ARNTMVGTWQRHGNLDH

SEQ ID NO: 16023 - protein, 9 aa, Homo sapiens
  light chain complementarity determining region 3 for antibody 8012
QQSYSTPIT

SEQ ID NO: 16024 - protein, 17 aa, Homo sapiens
  heavy chain complementarity determining region 3 for antibody 8012
ARNPMVGTWQRQGNLDH

SEQ ID NO: 16025 - protein, 9 aa, Homo sapiens
  light chain complementarity determining region 3 for antibody 8013
QQSYSTPIT

SEQ ID NO: 16026 - protein, 12 aa, Homo sapiens
  heavy chain complementarity determining region 3 for antibody 8013
AIVVPGRWDLDD

SEQ ID NO: 16027 - protein, 11 aa, Homo sapiens
  light chain complementarity determining region 3 for antibody 8014
QQSYSTPHRLT

SEQ ID NO: 16028 - protein, 20 aa, Homo sapiens
  heavy chain complementarity determining region 3 for antibody 8014
ARRGKNYGPRGSYSYYYMDV

SEQ ID NO: 16029 - protein, 9 aa, Homo sapiens
  light chain complementarity determining region 3 for antibody 8015
QQSYSTPFT

SEQ ID NO: 16030 - protein, 15 aa, Homo sapiens
  heavy chain complementarity determining region 3 for antibody 8015
ARFEYSSCRMGYMDV

SEQ ID NO: 16031 - protein, 10 aa, Homo sapiens
  light chain complementarity determining region 3 for antibody 8016
QQSYSTPFFT

SEQ ID NO: 16032 - protein, 23 aa, Homo sapiens
  heavy chain complementarity determining region 3 for antibody 8016
ARHFPKGGSGVTGTQSLIYYMDV

SEQ ID NO: 16033 - protein, 9 aa, Homo sapiens
  light chain complementarity determining region 3 for antibody 8017
QQSYSTPDT

SEQ ID NO: 16034 - protein, 12 aa, Homo sapiens
  heavy chain complementarity determining region 3 for antibody 8017
ARDFTASYCPDY

SEQ ID NO: 16035 - protein, 9 aa, Homo sapiens
  light chain complementarity determining region 3 for antibody 8018
QQSYSTPDT

SEQ ID NO: 16036 - protein, 12 aa, Homo sapiens
  heavy chain complementarity determining region 3 for antibody 8018
ARDFAANYCPDY

SEQ ID NO: 16037 - protein, 9 aa, Homo sapiens
  light chain complementarity determining region 3 for antibody 8019
QQSYSTPDT

SEQ ID NO: 16038 - protein, 17 aa, Homo sapiens
  heavy chain complementarity determining region 3 for antibody 8019
AKRLPDLLGGGHHYIDV

SEQ ID NO: 16039 - protein, 9 aa, Homo sapiens
  light chain complementarity determining region 3 for antibody 8020
QQSYSTLYT

SEQ ID NO: 16040 - protein, 14 aa, Homo sapiens
  heavy chain complementarity determining region 3 for antibody 8020
ARPGRTGTTFAFDI

SEQ ID NO: 16041 - protein, 10 aa, Homo sapiens
  light chain complementarity determining region 3 for antibody 8021
QQSYSTLPYT

SEQ ID NO: 16042 - protein, 18 aa, Homo sapiens
  heavy chain complementarity determining region 3 for antibody 8021
ARGVVVPVATPVPYFFDS

SEQ ID NO: 16043 - protein, 10 aa, Homo sapiens
  light chain complementarity determining region 3 for antibody 8022
QQSYSTLPYT

SEQ ID NO: 16044 - protein, 18 aa, Homo sapiens
  heavy chain complementarity determining region 3 for antibody 8022
ARGVVVPVATPVPYCFDF

SEQ ID NO: 16045 - protein, 10 aa, Homo sapiens
  light chain complementarity determining region 3 for antibody 8023
QQSYSTLPYP

SEQ ID NO: 16046 - protein, 18 aa, Homo sapiens
  heavy chain complementarity determining region 3 for antibody 8023
ARGVVVPVATPVPYFFDF

SEQ ID NO: 16047 - protein, 10 aa, Homo sapiens
  light chain complementarity determining region 3 for antibody 8024
QQSYSTLPWT

SEQ ID NO: 16048 - protein, 11 aa, Homo sapiens
  heavy chain complementarity determining region 3 for antibody 8024
AGSSGYYAIDN

SEQ ID NO: 16049 - protein, 10 aa, Homo sapiens
  light chain complementarity determining region 3 for antibody 8025
QQSYSTLLFT

SEQ ID NO: 16050 - protein, 15 aa, Homo sapiens
  heavy chain complementarity determining region 3 for antibody 8025
ARVGRPYHNAWYFDN

SEQ ID NO: 16051 - protein, 10 aa, Homo sapiens
  light chain complementarity determining region 3 for antibody 8026
QQSYSTLLFT

SEQ ID NO: 16052 - protein, 23 aa, Homo sapiens
  heavy chain complementarity determining region 3 for antibody 8026
ARHFPKGGSGVTGTQSLIYYMDV

SEQ ID NO: 16053 - protein, 10 aa, Homo sapiens
  light chain complementarity determining region 3 for antibody 8027
QQSYSTLIFT

SEQ ID NO: 16054 - protein, 17 aa, Homo sapiens
  heavy chain complementarity determining region 3 for antibody 8027
ARTTMVGTWQRQGNLDH

SEQ ID NO: 16055 - protein, 10 aa, Homo sapiens
  light chain complementarity determining region 3 for antibody 8028
QQSYSTLIFT

SEQ ID NO: 16056 - protein, 17 aa, Homo sapiens
  heavy chain complementarity determining region 3 for antibody 8028
ARNAMVGTWQRQGNLDH

SEQ ID NO: 16057 - protein, 10 aa, Homo sapiens
  light chain complementarity determining region 3 for antibody 8029
QQSYSTLIFP

SEQ ID NO: 16058 - protein, 17 aa, Homo sapiens
  heavy chain complementarity determining region 3 for antibody 8029
ARNTMVGTWQRQGNLDH

SEQ ID NO: 16059 - protein, 10 aa, Homo sapiens
  light chain complementarity determining region 3 for antibody 8030
QQSYSTHLFT

SEQ ID NO: 16060 - protein, 23 aa, Homo sapiens
  heavy chain complementarity determining region 3 for antibody 8030
ARHFPMGGSTVTGTQSLLYYMDV

SEQ ID NO: 16061 - protein, 9 aa, Homo sapiens
  light chain complementarity determining region 3 for antibody 8031
QQSYSSPWT

SEQ ID NO: 16062 - protein, 15 aa, Homo sapiens
  heavy chain complementarity determining region 3 for antibody 8031
ARIWTSSPNCRYMDV

SEQ ID NO: 16063 - protein, 8 aa, Homo sapiens
  light chain complementarity determining region 3 for antibody 8032
QQSYSSPT

SEQ ID NO: 16064 - protein, 10 aa, Homo sapiens
  heavy chain complementarity determining region 3 for antibody 8032
CRDRWGFGDV

SEQ ID NO: 16065 - protein, 8 aa, Homo sapiens
  light chain complementarity determining region 3 for antibody 8033
QQSYSSPT

SEQ ID NO: 16066 - protein, 12 aa, Homo sapiens
  heavy chain complementarity determining region 3 for antibody 8033
ARWGWQQSEFDY

SEQ ID NO: 16067 - protein, 8 aa, Homo sapiens
  light chain complementarity determining region 3 for antibody 8034
QQSYSSPT

SEQ ID NO: 16068 - protein, 12 aa, Homo sapiens
  heavy chain complementarity determining region 3 for antibody 8034
AKWRWQQSEFDY

SEQ ID NO: 16069 - protein, 8 aa, Homo sapiens
  light chain complementarity determining region 3 for antibody 8035
QQSYSSPT

SEQ ID NO: 16070 - protein, 17 aa, Homo sapiens
  heavy chain complementarity determining region 3 for antibody 8035
AKGRGSVEMALIYYLDL

SEQ ID NO: 16071 - protein, 8 aa, Homo sapiens
  light chain complementarity determining region 3 for antibody 8036
QQSYSSPT

SEQ ID NO: 16072 - protein, 17 aa, Homo sapiens
  heavy chain complementarity determining region 3 for antibody 8036
AKGRGSVAVALIYYLDL

SEQ ID NO: 16073 - protein, 8 aa, Homo sapiens
  light chain complementarity determining region 3 for antibody 8037
QQSYSSPT

SEQ ID NO: 16074 - protein, 17 aa, Homo sapiens
  heavy chain complementarity determining region 3 for antibody 8037
AKGRGSVARALIYYLDL

SEQ ID NO: 16075 - protein, 8 aa, Homo sapiens
  light chain complementarity determining region 3 for antibody 8038
QQSYSSPT

SEQ ID NO: 16076 - protein, 17 aa, Homo sapiens
  heavy chain complementarity determining region 3 for antibody 8038
AKGRGSVAMALLYYLDL

SEQ ID NO: 16077 - protein, 8 aa, Homo sapiens
  light chain complementarity determining region 3 for antibody 8039
QQSYSSPT

SEQ ID NO: 16078 - protein, 17 aa, Homo sapiens
  heavy chain complementarity determining region 3 for antibody 8039
AKGRGSVAMALIYYFDL

SEQ ID NO: 16079 - protein, 8 aa, Homo sapiens
  light chain complementarity determining region 3 for antibody 8040
QQSYSSPT

SEQ ID NO: 16080 - protein, 17 aa, Homo sapiens
  heavy chain complementarity determining region 3 for antibody 8040
AKGRGSVAMALIYHLDL

SEQ ID NO: 16081 - protein, 8 aa, Homo sapiens
  light chain complementarity determining region 3 for antibody 8041
QQSYSSPT

SEQ ID NO: 16082 - protein, 17 aa, Homo sapiens
  heavy chain complementarity determining region 3 for antibody 8041
AKGRGSVAMALIYFLDL

SEQ ID NO: 16083 - protein, 8 aa, Homo sapiens
  light chain complementarity determining region 3 for antibody 8042
QQSYSSPT

SEQ ID NO: 16084 - protein, 17 aa, Homo sapiens
  heavy chain complementarity determining region 3 for antibody 8042
AKGRGSVAMALIYCLDL

SEQ ID NO: 16085 - protein, 8 aa, Homo sapiens
  light chain complementarity determining region 3 for antibody 8043
QQSYSSPT

SEQ ID NO: 16086 - protein, 17 aa, Homo sapiens
  heavy chain complementarity determining region 3 for antibody 8043
AKGRGSVAMALIDYLDL

SEQ ID NO: 16087 - protein, 8 aa, Homo sapiens
  light chain complementarity determining region 3 for antibody 8044
QQSYSSPT

SEQ ID NO: 16088 - protein, 17 aa, Homo sapiens
  heavy chain complementarity determining region 3 for antibody 8044
AKGRGRVAMALIYYLDL

SEQ ID NO: 16089 - protein, 8 aa, Homo sapiens
  light chain complementarity determining region 3 for antibody 8045
QQSYSSPT

SEQ ID NO: 16090 - protein, 17 aa, Homo sapiens
  heavy chain complementarity determining region 3 for antibody 8045
AKGRGGVAMALIYYLDL

SEQ ID NO: 16091 - protein, 8 aa, Homo sapiens
  light chain complementarity determining region 3 for antibody 8046
QQSYSSPT

SEQ ID NO: 16092 - protein, 17 aa, Homo sapiens
  heavy chain complementarity determining region 3 for antibody 8046
AKGLGSVAMALIYYLDL

SEQ ID NO: 16093 - protein, 8 aa, Homo sapiens
  light chain complementarity determining region 3 for antibody 8047
QQSYSSPT

SEQ ID NO: 16094 - protein, 13 aa, Homo sapiens
  heavy chain complementarity determining region 3 for antibody 8047
AKEGSSPGPDFEY

SEQ ID NO: 16095 - protein, 8 aa, Homo sapiens
  light chain complementarity determining region 3 for antibody 8048
QQSYSSPT

SEQ ID NO: 16096 - protein, 17 aa, Homo sapiens
  heavy chain complementarity determining region 3 for antibody 8048
AKCRGSVAMALIYYLDL

SEQ ID NO: 16097 - protein, 8 aa, Homo sapiens
  light chain complementarity determining region 3 for antibody 8049
QQSYSSPT

SEQ ID NO: 16098 - protein, 17 aa, Homo sapiens
  heavy chain complementarity determining region 3 for antibody 8049
AEGRGSVAMALIYYLDL

SEQ ID NO: 16099 - protein, 9 aa, Homo sapiens
  light chain complementarity determining region 3 for antibody 8050
QQSYSSPRT

SEQ ID NO: 16100 - protein, 16 aa, Homo sapiens
  heavy chain complementarity determining region 3 for antibody 8050
VGPHLTYNSGWRYFDY

SEQ ID NO: 16101 - protein, 9 aa, Homo sapiens
  light chain complementarity determining region 3 for antibody 8051
QQSYSSPRT

SEQ ID NO: 16102 - protein, 12 aa, Homo sapiens
  heavy chain complementarity determining region 3 for antibody 8051
NADQGYVDGFDI

SEQ ID NO: 16103 - protein, 9 aa, Homo sapiens
  light chain complementarity determining region 3 for antibody 8052
QQSYSSPRT

SEQ ID NO: 16104 - protein, 12 aa, Homo sapiens
  heavy chain complementarity determining region 3 for antibody 8052
NADHGYADGFDI

SEQ ID NO: 16105 - protein, 9 aa, Homo sapiens
  light chain complementarity determining region 3 for antibody 8053
QQSYSSPRT

SEQ ID NO: 16106 - protein, 10 aa, Homo sapiens
  heavy chain complementarity determining region 3 for antibody 8053
CRDREGFGDV

SEQ ID NO: 16107 - protein, 9 aa, Homo sapiens
  light chain complementarity determining region 3 for antibody 8054
QQSYSSPRT

SEQ ID NO: 16108 - protein, 17 aa, Homo sapiens
  heavy chain complementarity determining region 3 for antibody 8054
ARNTMVGTWQRQGNLDH

SEQ ID NO: 16109 - protein, 9 aa, Homo sapiens
  light chain complementarity determining region 3 for antibody 8055
QQSYSSPRT

SEQ ID NO: 16110 - protein, 19 aa, Homo sapiens
  heavy chain complementarity determining region 3 for antibody 8055
ARERVRCRSGICYDATFDI

SEQ ID NO: 16111 - protein, 9 aa, Homo sapiens
  light chain complementarity determining region 3 for antibody 8056
QQSYSSPRT

SEQ ID NO: 16112 - protein, 16 aa, Homo sapiens
  heavy chain complementarity determining region 3 for antibody 8056
ARDLSYSSTSVWYFDV

SEQ ID NO: 16113 - protein, 9 aa, Homo sapiens
  light chain complementarity determining region 3 for antibody 8057
QQSYSSPRT

SEQ ID NO: 16114 - protein, 16 aa, Homo sapiens
  heavy chain complementarity determining region 3 for antibody 8057
ARDFSYSSTSVWYCDV

SEQ ID NO: 16115 - protein, 9 aa, Homo sapiens
  light chain complementarity determining region 3 for antibody 8058
QQSYSSPRT

SEQ ID NO: 16116 - protein, 16 aa, Homo sapiens
  heavy chain complementarity determining region 3 for antibody 8058
ARDFSYSSTSVRYFDV

SEQ ID NO: 16117 - protein, 9 aa, Homo sapiens
  light chain complementarity determining region 3 for antibody 8059
QQSYSSPRT

SEQ ID NO: 16118 - protein, 16 aa, Homo sapiens
  heavy chain complementarity determining region 3 for antibody 8059
ARDCSYSSTSVWYFDV

SEQ ID NO: 16119 - protein, 9 aa, Homo sapiens
  light chain complementarity determining region 3 for antibody 8060
QQSYSSPRP

SEQ ID NO: 16120 - protein, 12 aa, Homo sapiens
  heavy chain complementarity determining region 3 for antibody 8060
NADHGYVDGFDI

SEQ ID NO: 16121 - protein, 8 aa, Homo sapiens
  light chain complementarity determining region 3 for antibody 8061
QQSYSSPP

SEQ ID NO: 16122 - protein, 17 aa, Homo sapiens
  heavy chain complementarity determining region 3 for antibody 8061
AKGRGSVAMALIYDLDL

SEQ ID NO: 16123 - protein, 9 aa, Homo sapiens
  light chain complementarity determining region 3 for antibody 8062
QQSYSSPFT

SEQ ID NO: 16124 - protein, 14 aa, Homo sapiens
  heavy chain complementarity determining region 3 for antibody 8062
AASYSSGWLEYFQY

SEQ ID NO: 16125 - protein, 10 aa, Homo sapiens
  light chain complementarity determining region 3 for antibody 8063
QQSYSSLGGT

SEQ ID NO: 16126 - protein, 13 aa, Homo sapiens
  heavy chain complementarity determining region 3 for antibody 8063
AKEGSSPGPDFEY

SEQ ID NO: 16127 - protein, 9 aa, Homo sapiens
  light chain complementarity determining region 3 for antibody 8064
QQSYSRPRT

SEQ ID NO: 16128 - protein, 12 aa, Homo sapiens
  heavy chain complementarity determining region 3 for antibody 8064
NADHGYVDGFDI

SEQ ID NO: 16129 - protein, 9 aa, Homo sapiens
  light chain complementarity determining region 3 for antibody 8065
QQSYSPPST

SEQ ID NO: 16130 - protein, 16 aa, Homo sapiens
  heavy chain complementarity determining region 3 for antibody 8065
ARWFSRSSTGVSYMDV

SEQ ID NO: 16131 - protein, 9 aa, Homo sapiens
  light chain complementarity determining region 3 for antibody 8066
QQSYSNPRT

SEQ ID NO: 16132 - protein, 16 aa, Homo sapiens
  heavy chain complementarity determining region 3 for antibody 8066
VRDLAGFTRGGSTFDY

SEQ ID NO: 16133 - protein, 9 aa, Homo sapiens
  light chain complementarity determining region 3 for antibody 8067
QQSYSNPRT

SEQ ID NO: 16134 - protein, 16 aa, Homo sapiens
  heavy chain complementarity determining region 3 for antibody 8067
ARSYDRSNTKVWYFDL

SEQ ID NO: 16135 - protein, 9 aa, Homo sapiens
  light chain complementarity determining region 3 for antibody 8068
QQSYSNPRT

SEQ ID NO: 16136 - protein, 11 aa, Homo sapiens
  heavy chain complementarity determining region 3 for antibody 8068
AREQHGQAPDY

SEQ ID NO: 16137 - protein, 10 aa, Homo sapiens
  light chain complementarity determining region 3 for antibody 8069
QQSYSNPPYP

SEQ ID NO: 16138 - protein, 20 aa, Homo sapiens
  heavy chain complementarity determining region 3 for antibody 8069
ARARSSGPGLYYDILTAFDC

SEQ ID NO: 16139 - protein, 10 aa, Homo sapiens
  light chain complementarity determining region 3 for antibody 8070
QQSYSNPPST

SEQ ID NO: 16140 - protein, 20 aa, Homo sapiens
  heavy chain complementarity determining region 3 for antibody 8070
ARARSSGPGLYYDILTAFDC

SEQ ID NO: 16141 - protein, 10 aa, Homo sapiens
  light chain complementarity determining region 3 for antibody 8071
QQSYSNPLFT

SEQ ID NO: 16142 - protein, 15 aa, Homo sapiens
  heavy chain complementarity determining region 3 for antibody 8071
ARVGRPYHNAWYFDN

SEQ ID NO: 16143 - protein, 9 aa, Homo sapiens
  light chain complementarity determining region 3 for antibody 8072
QQSYSMPRT

SEQ ID NO: 16144 - protein, 11 aa, Homo sapiens
  heavy chain complementarity determining region 3 for antibody 8072
ARIVARKPDDY

SEQ ID NO: 16145 - protein, 9 aa, Homo sapiens
  light chain complementarity determining region 3 for antibody 8073
QQSYSMHRT

SEQ ID NO: 16146 - protein, 18 aa, Homo sapiens
  heavy chain complementarity determining region 3 for antibody 8073
VTVLSQLLTGNWYLYFQH

SEQ ID NO: 16147 - protein, 9 aa, Homo sapiens
  light chain complementarity determining region 3 for antibody 8074
QQSYSIPRT

SEQ ID NO: 16148 - protein, 12 aa, Homo sapiens
  heavy chain complementarity determining region 3 for antibody 8074
NADHGYVDGFDI

SEQ ID NO: 16149 - protein, 9 aa, Homo sapiens
  light chain complementarity determining region 3 for antibody 8075
QQSYSIPDT

SEQ ID NO: 16150 - protein, 10 aa, Homo sapiens
  heavy chain complementarity determining region 3 for antibody 8075
ARSLYSGFDY

SEQ ID NO: 16151 - protein, 9 aa, Homo sapiens
  light chain complementarity determining region 3 for antibody 8076
QQSYSIPCT

SEQ ID NO: 16152 - protein, 16 aa, Homo sapiens
  heavy chain complementarity determining region 3 for antibody 8076
ARAGLRYGYNPVYFDY

SEQ ID NO: 16153 - protein, 9 aa, Homo sapiens
  light chain complementarity determining region 3 for antibody 8077
QQSYSAPWT

SEQ ID NO: 16154 - protein, 11 aa, Homo sapiens
  heavy chain complementarity determining region 3 for antibody 8077
ATNSRGQGYEY

SEQ ID NO: 16155 - protein, 9 aa, Homo sapiens
  light chain complementarity determining region 3 for antibody 8078
QQSYRVPLT

SEQ ID NO: 16156 - protein, 18 aa, Homo sapiens
  heavy chain complementarity determining region 3 for antibody 8078
AKVHLQAPLPTPNYCFDY

SEQ ID NO: 16157 - protein, 9 aa, Homo sapiens
  light chain complementarity determining region 3 for antibody 8079
QQSYRVPLT

SEQ ID NO: 16158 - protein, 18 aa, Homo sapiens
  heavy chain complementarity determining region 3 for antibody 8079
AKVHLQAPLPTPNCYFDY

SEQ ID NO: 16159 - protein, 9 aa, Homo sapiens
  light chain complementarity determining region 3 for antibody 8080
QQSYRTPST

SEQ ID NO: 16160 - protein, 16 aa, Homo sapiens
  heavy chain complementarity determining region 3 for antibody 8080
ARWFSRSSTGVSYMDV

SEQ ID NO: 16161 - protein, 10 aa, Homo sapiens
  light chain complementarity determining region 3 for antibody 8081
QQSYRTPLFT

SEQ ID NO: 16162 - protein, 15 aa, Homo sapiens
  heavy chain complementarity determining region 3 for antibody 8081
ARVGRPYHNAWYFDN

SEQ ID NO: 16163 - protein, 9 aa, Homo sapiens
  light chain complementarity determining region 3 for antibody 8082
QQSYPTPRT

SEQ ID NO: 16164 - protein, 16 aa, Homo sapiens
  heavy chain complementarity determining region 3 for antibody 8082
AREFPYSSTSVWYFDV

SEQ ID NO: 16165 - protein, 9 aa, Homo sapiens
  light chain complementarity determining region 3 for antibody 8083
QQSYNYPLT

SEQ ID NO: 16166 - protein, 11 aa, Homo sapiens
  heavy chain complementarity determining region 3 for antibody 8083
ARGGALTWLDP

SEQ ID NO: 16167 - protein, 9 aa, Homo sapiens
  light chain complementarity determining region 3 for antibody 8084
QQSYNTPYT

SEQ ID NO: 16168 - protein, 13 aa, Homo sapiens
  heavy chain complementarity determining region 3 for antibody 8084
AKEGSAPGPDFEY

SEQ ID NO: 16169 - protein, 9 aa, Homo sapiens
  light chain complementarity determining region 3 for antibody 8085
QQSYNTPWT

SEQ ID NO: 16170 - protein, 14 aa, Homo sapiens
  heavy chain complementarity determining region 3 for antibody 8085
AWIDCRSSRCFEAS

SEQ ID NO: 16171 - protein, 9 aa, Homo sapiens
  light chain complementarity determining region 3 for antibody 8086
QQSYNTPRT

SEQ ID NO: 16172 - protein, 7 aa, Homo sapiens
  heavy chain complementarity determining region 3 for antibody 8086
TTGDLRN

SEQ ID NO: 16173 - protein, 9 aa, Homo sapiens
  light chain complementarity determining region 3 for antibody 8087
QQSYNTPRT

SEQ ID NO: 16174 - protein, 21 aa, Homo sapiens
  heavy chain complementarity determining region 3 for antibody 8087
ARELNILPVVGTAYYYYGMDV

SEQ ID NO: 16175 - protein, 9 aa, Homo sapiens
  light chain complementarity determining region 3 for antibody 8088
QQSYNTPRT

SEQ ID NO: 16176 - protein, 15 aa, Homo sapiens
  heavy chain complementarity determining region 3 for antibody 8088
AKGHRSSRGYYYMDV

SEQ ID NO: 16177 - protein, 9 aa, Homo sapiens
  light chain complementarity determining region 3 for antibody 8089
QQSYNTPLT

SEQ ID NO: 16178 - protein, 16 aa, Homo sapiens
  heavy chain complementarity determining region 3 for antibody 8089
VRDLAGFTRGGSSFDY

SEQ ID NO: 16179 - protein, 9 aa, Homo sapiens
  light chain complementarity determining region 3 for antibody 8090
QQSYNTPLT

SEQ ID NO: 16180 - protein, 16 aa, Homo sapiens
  heavy chain complementarity determining region 3 for antibody 8090
VRDLAGCTRGGSTFDY

SEQ ID NO: 16181 - protein, 9 aa, Homo sapiens
  light chain complementarity determining region 3 for antibody 8091
QQSYNSPLT

SEQ ID NO: 16182 - protein, 14 aa, Homo sapiens
  heavy chain complementarity determining region 3 for antibody 8091
AKANSGDVSFLIDY

SEQ ID NO: 16183 - protein, 9 aa, Homo sapiens
  light chain complementarity determining region 3 for antibody 8092
QQSYNSHPT

SEQ ID NO: 16184 - protein, 17 aa, Homo sapiens
  heavy chain complementarity determining region 3 for antibody 8092
ARNTMVHGWQRQGSVDH

SEQ ID NO: 16185 - protein, 9 aa, Homo sapiens
  light chain complementarity determining region 3 for antibody 8093
QQSYNSHPT

SEQ ID NO: 16186 - protein, 19 aa, Homo sapiens
  heavy chain complementarity determining region 3 for antibody 8093
AHTKYFYDSTGYDYADFDY

SEQ ID NO: 16187 - protein, 9 aa, Homo sapiens
  light chain complementarity determining region 3 for antibody 8094
QQSYNPPRA

SEQ ID NO: 16188 - protein, 17 aa, Homo sapiens
  heavy chain complementarity determining region 3 for antibody 8094
ARNTMVGTWQRQGNLDH

SEQ ID NO: 16189 - protein, 9 aa, Homo sapiens
  light chain complementarity determining region 3 for antibody 8095
QQSYNMPRT

SEQ ID NO: 16190 - protein, 18 aa, Homo sapiens
  heavy chain complementarity determining region 3 for antibody 8095
TTVLSQLLAGDWHLYFQH

SEQ ID NO: 16191 - protein, 9 aa, Homo sapiens
  light chain complementarity determining region 3 for antibody 8096
QQSYITPIT

SEQ ID NO: 16192 - protein, 11 aa, Homo sapiens
  heavy chain complementarity determining region 3 for antibody 8096
ARGDHLNWFDP

SEQ ID NO: 16193 - protein, 9 aa, Homo sapiens
  light chain complementarity determining region 3 for antibody 8097
QQSYITLFT

SEQ ID NO: 16194 - protein, 12 aa, Homo sapiens
  heavy chain complementarity determining region 3 for antibody 8097
ARVGSSSWYFDY

SEQ ID NO: 16195 - protein, 10 aa, Homo sapiens
  light chain complementarity determining region 3 for antibody 8098
QQSYGTPLFT

SEQ ID NO: 16196 - protein, 23 aa, Homo sapiens
  heavy chain complementarity determining region 3 for antibody 8098
ARHFPMGGSTVTGTQSLLYYMDV

SEQ ID NO: 16197 - protein, 8 aa, Homo sapiens
  light chain complementarity determining region 3 for antibody 8099
QQSYGRPT

SEQ ID NO: 16198 - protein, 12 aa, Homo sapiens
  heavy chain complementarity determining region 3 for antibody 8099
AKWRGGQSEFEH

SEQ ID NO: 16199 - protein, 9 aa, Homo sapiens
  light chain complementarity determining region 3 for antibody 8100
QQSYATPYT

SEQ ID NO: 16200 - protein, 16 aa, Homo sapiens
  heavy chain complementarity determining region 3 for antibody 8100
AKSLNIEVSHSGPFDF

SEQ ID NO: 16201 - protein, 9 aa, Homo sapiens
  light chain complementarity determining region 3 for antibody 8101
QQSSTYPWT

SEQ ID NO: 16202 - protein, 10 aa, Homo sapiens
  heavy chain complementarity determining region 3 for antibody 8101
AHRINRAFDI

SEQ ID NO: 16203 - protein, 10 aa, Homo sapiens
  light chain complementarity determining region 3 for antibody 8102
QQSSSTPLFT

SEQ ID NO: 16204 - protein, 15 aa, Homo sapiens
  heavy chain complementarity determining region 3 for antibody 8102
ARVGRPYHNAWYFDN

SEQ ID NO: 16205 - protein, 10 aa, Homo sapiens
  light chain complementarity determining region 3 for antibody 8103
QQSSSTPLFT

SEQ ID NO: 16206 - protein, 23 aa, Homo sapiens
  heavy chain complementarity determining region 3 for antibody 8103
ARHFPMGGSTVTGTQSLLYYMDV

SEQ ID NO: 16207 - protein, 9 aa, Homo sapiens
  light chain complementarity determining region 3 for antibody 8104
QQSSNTSLT

SEQ ID NO: 16208 - protein, 16 aa, Homo sapiens
  heavy chain complementarity determining region 3 for antibody 8104
VRDLAGFTRGGSTFDY

SEQ ID NO: 16209 - protein, 9 aa, Homo sapiens
  light chain complementarity determining region 3 for antibody 8105
QQSSNTPLT

SEQ ID NO: 16210 - protein, 16 aa, Homo sapiens
  heavy chain complementarity determining region 3 for antibody 8105
VRDVAGFTRGGSPFDY

SEQ ID NO: 16211 - protein, 9 aa, Homo sapiens
  light chain complementarity determining region 3 for antibody 8106
QQSSNTPLT

SEQ ID NO: 16212 - protein, 16 aa, Homo sapiens
  heavy chain complementarity determining region 3 for antibody 8106
VRDLAGFTRSGSTFDY

SEQ ID NO: 16213 - protein, 9 aa, Homo sapiens
  light chain complementarity determining region 3 for antibody 8107
QQSSNTPLT

SEQ ID NO: 16214 - protein, 16 aa, Homo sapiens
  heavy chain complementarity determining region 3 for antibody 8107
VRDLAGFTRGGSTFDH

SEQ ID NO: 16215 - protein, 9 aa, Homo sapiens
  light chain complementarity determining region 3 for antibody 8108
QQSSNTPLT

SEQ ID NO: 16216 - protein, 16 aa, Homo sapiens
  heavy chain complementarity determining region 3 for antibody 8108
VRDLAGFTRGGSTFDF

SEQ ID NO: 16217 - protein, 9 aa, Homo sapiens
  light chain complementarity determining region 3 for antibody 8109
QQSSNTPLT

SEQ ID NO: 16218 - protein, 16 aa, Homo sapiens
  heavy chain complementarity determining region 3 for antibody 8109
VRDLAGFTRGGLTFDY

SEQ ID NO: 16219 - protein, 9 aa, Homo sapiens
  light chain complementarity determining region 3 for antibody 8110
QQSSNTPLT

SEQ ID NO: 16220 - protein, 16 aa, Homo sapiens
  heavy chain complementarity determining region 3 for antibody 8110
VRDLAGFTRGESTFDY

SEQ ID NO: 16221 - protein, 9 aa, Homo sapiens
  light chain complementarity determining region 3 for antibody 8111
QQSSNTPLT

SEQ ID NO: 16222 - protein, 16 aa, Homo sapiens
  heavy chain complementarity determining region 3 for antibody 8111
VRDLAGFTQGGSTFDY

SEQ ID NO: 16223 - protein, 9 aa, Homo sapiens
  light chain complementarity determining region 3 for antibody 8112
QQSSNTPLT

SEQ ID NO: 16224 - protein, 16 aa, Homo sapiens
  heavy chain complementarity determining region 3 for antibody 8112
VRDLAGFTLGGSTFDY

SEQ ID NO: 16225 - protein, 9 aa, Homo sapiens
  light chain complementarity determining region 3 for antibody 8113
QQSSNTPLT

SEQ ID NO: 16226 - protein, 16 aa, Homo sapiens
  heavy chain complementarity determining region 3 for antibody 8113
VGPHLTYNSGWRYFDY

SEQ ID NO: 16227 - protein, 9 aa, Homo sapiens
  light chain complementarity determining region 3 for antibody 8114
QQSSNTPLT

SEQ ID NO: 16228 - protein, 7 aa, Homo sapiens
  heavy chain complementarity determining region 3 for antibody 8114
TTGDLRN

SEQ ID NO: 16229 - protein, 9 aa, Homo sapiens
  light chain complementarity determining region 3 for antibody 8115
QQSSNTPLT

SEQ ID NO: 16230 - protein, 13 aa, Homo sapiens
  heavy chain complementarity determining region 3 for antibody 8115
TSGCSGWCEWFDS

SEQ ID NO: 16231 - protein, 9 aa, Homo sapiens
  light chain complementarity determining region 3 for antibody 8116
QQSSNTPLT

SEQ ID NO: 16232 - protein, 13 aa, Homo sapiens
  heavy chain complementarity determining region 3 for antibody 8116
TKEGSSAGPDFVY

SEQ ID NO: 16233 - protein, 9 aa, Homo sapiens
  light chain complementarity determining region 3 for antibody 8117
QQSSNTPLT

SEQ ID NO: 16234 - protein, 14 aa, Homo sapiens
  heavy chain complementarity determining region 3 for antibody 8117
GRDVHTTGWTLGGY

SEQ ID NO: 16235 - protein, 9 aa, Homo sapiens
  light chain complementarity determining region 3 for antibody 8118
QQSSNTPLT

SEQ ID NO: 16236 - protein, 15 aa, Homo sapiens
  heavy chain complementarity determining region 3 for antibody 8118
GKEGPGSSGWLTGHY

SEQ ID NO: 16237 - protein, 9 aa, Homo sapiens
  light chain complementarity determining region 3 for antibody 8119
QQSSNTPLT

SEQ ID NO: 16238 - protein, 16 aa, Homo sapiens
  heavy chain complementarity determining region 3 for antibody 8119
ARWFSRSSTGVSYMDV

SEQ ID NO: 16239 - protein, 9 aa, Homo sapiens
  light chain complementarity determining region 3 for antibody 8120
QQSSNTPLT

SEQ ID NO: 16240 - protein, 14 aa, Homo sapiens
  heavy chain complementarity determining region 3 for antibody 8120
ARLHGSGLGRWLDP

SEQ ID NO: 16241 - protein, 9 aa, Homo sapiens
  light chain complementarity determining region 3 for antibody 8121
QQSSNTPLT

SEQ ID NO: 16242 - protein, 12 aa, Homo sapiens
  heavy chain complementarity determining region 3 for antibody 8121
ARLDWNYRAFDI

SEQ ID NO: 16243 - protein, 9 aa, Homo sapiens
  light chain complementarity determining region 3 for antibody 8122
QQSSNTPLT

SEQ ID NO: 16244 - protein, 13 aa, Homo sapiens
  heavy chain complementarity determining region 3 for antibody 8122
AKEGSSPGPDFDS

SEQ ID NO: 16245 - protein, 9 aa, Homo sapiens
  light chain complementarity determining region 3 for antibody 8123
QQSSNTPLT

SEQ ID NO: 16246 - protein, 9 aa, Homo sapiens
  heavy chain complementarity determining region 3 for antibody 8123
AGWGGLSNY

SEQ ID NO: 16247 - protein, 9 aa, Homo sapiens
  light chain complementarity determining region 3 for antibody 8124
QQSSNTPLP

SEQ ID NO: 16248 - protein, 16 aa, Homo sapiens
  heavy chain complementarity determining region 3 for antibody 8124
VRDLAGLTRGGSTFDY

SEQ ID NO: 16249 - protein, 9 aa, Homo sapiens
  light chain complementarity determining region 3 for antibody 8125
QQSSNNPLT

SEQ ID NO: 16250 - protein, 16 aa, Homo sapiens
  heavy chain complementarity determining region 3 for antibody 8125
VRDLAGFTRGGSTFDY

SEQ ID NO: 16251 - protein, 9 aa, Homo sapiens
  light chain complementarity determining region 3 for antibody 8126
QQSSNLPRT

SEQ ID NO: 16252 - protein, 13 aa, Homo sapiens
  heavy chain complementarity determining region 3 for antibody 8126
AKEGSSPGPDFDS

SEQ ID NO: 16253 - protein, 9 aa, Homo sapiens
  light chain complementarity determining region 3 for antibody 8127
QQSSNIPLT

SEQ ID NO: 16254 - protein, 16 aa, Homo sapiens
  heavy chain complementarity determining region 3 for antibody 8127
VRDLAGFTRGGSTFDY

SEQ ID NO: 16255 - protein, 9 aa, Homo sapiens
  light chain complementarity determining region 3 for antibody 8128
QQSSDTPLT

SEQ ID NO: 16256 - protein, 16 aa, Homo sapiens
  heavy chain complementarity determining region 3 for antibody 8128
VRDLAGFTRGGSTFDY

SEQ ID NO: 16257 - protein, 9 aa, Homo sapiens
  light chain complementarity determining region 3 for antibody 8129
QQSNSYSHT

SEQ ID NO: 16258 - protein, 14 aa, Homo sapiens
  heavy chain complementarity determining region 3 for antibody 8129
GRDVHTTGWTLGGY

SEQ ID NO: 16259 - protein, 9 aa, Homo sapiens
  light chain complementarity determining region 3 for antibody 8130
QQSNSYPYT

SEQ ID NO: 16260 - protein, 9 aa, Homo sapiens
  heavy chain complementarity determining region 3 for antibody 8130
ARFWTYGRK

SEQ ID NO: 16261 - protein, 9 aa, Homo sapiens
  light chain complementarity determining region 3 for antibody 8131
QQSNSTPHT

SEQ ID NO: 16262 - protein, 12 aa, Homo sapiens
  heavy chain complementarity determining region 3 for antibody 8131
AIVVPGRWDLDD

SEQ ID NO: 16263 - protein, 10 aa, Homo sapiens
  light chain complementarity determining region 3 for antibody 8132
QQSNKWPPWR

SEQ ID NO: 16264 - protein, 15 aa, Homo sapiens
  heavy chain complementarity determining region 3 for antibody 8132
ARDIRVGASEYYFDR

SEQ ID NO: 16265 - protein, 10 aa, Homo sapiens
  light chain complementarity determining region 3 for antibody 8133
QQSHTTPALT

SEQ ID NO: 16266 - protein, 17 aa, Homo sapiens
  heavy chain complementarity determining region 3 for antibody 8133
ARDGRIIWPGAQGSLDS

SEQ ID NO: 16267 - protein, 9 aa, Homo sapiens
  light chain complementarity determining region 3 for antibody 8134
QQSHTNPIT

SEQ ID NO: 16268 - protein, 13 aa, Homo sapiens
  heavy chain complementarity determining region 3 for antibody 8134
TSGCSGWCEWFDS

SEQ ID NO: 16269 - protein, 9 aa, Homo sapiens
  light chain complementarity determining region 3 for antibody 8135
QQSHSVPRP

SEQ ID NO: 16270 - protein, 10 aa, Homo sapiens
  heavy chain complementarity determining region 3 for antibody 8135
VRDWWQREDF

SEQ ID NO: 16271 - protein, 9 aa, Homo sapiens
  light chain complementarity determining region 3 for antibody 8136
QQSHSVHRT

SEQ ID NO: 16272 - protein, 10 aa, Homo sapiens
  heavy chain complementarity determining region 3 for antibody 8136
VRDWWQREDF

SEQ ID NO: 16273 - protein, 9 aa, Homo sapiens
  light chain complementarity determining region 3 for antibody 8137
QQSHSTPWT

SEQ ID NO: 16274 - protein, 11 aa, Homo sapiens
  heavy chain complementarity determining region 3 for antibody 8137
ATNSRGQGYEY

SEQ ID NO: 16275 - protein, 9 aa, Homo sapiens
  light chain complementarity determining region 3 for antibody 8138
QQSHSTPST

SEQ ID NO: 16276 - protein, 16 aa, Homo sapiens
  heavy chain complementarity determining region 3 for antibody 8138
ARWFSRSSTGVSYMDV

SEQ ID NO: 16277 - protein, 10 aa, Homo sapiens
  light chain complementarity determining region 3 for antibody 8139
QQSHSTPLFT

SEQ ID NO: 16278 - protein, 23 aa, Homo sapiens
  heavy chain complementarity determining region 3 for antibody 8139
ARHFPKGGSGVTGTQSLLYYMDV

SEQ ID NO: 16279 - protein, 8 aa, Homo sapiens
  light chain complementarity determining region 3 for antibody 8140
QQSGYSHT

SEQ ID NO: 16280 - protein, 15 aa, Homo sapiens
  heavy chain complementarity determining region 3 for antibody 8140
ARGLLATGGWYYFDY

SEQ ID NO: 16281 - protein, 9 aa, Homo sapiens
  light chain complementarity determining region 3 for antibody 8141
QQSFNTPLT

SEQ ID NO: 16282 - protein, 16 aa, Homo sapiens
  heavy chain complementarity determining region 3 for antibody 8141
VRDLAGFTRGGSTFDY

SEQ ID NO: 16283 - protein, 8 aa, Homo sapiens
  light chain complementarity determining region 3 for antibody 8142
QQSFGMYT

SEQ ID NO: 16284 - protein, 14 aa, Homo sapiens
  heavy chain complementarity determining region 3 for antibody 8142
ANYRASSGANCFDP

SEQ ID NO: 16285 - protein, 8 aa, Homo sapiens
  light chain complementarity determining region 3 for antibody 8143
QQSFGMYT

SEQ ID NO: 16286 - protein, 14 aa, Homo sapiens
  heavy chain complementarity determining region 3 for antibody 8143
ANYRASIGANCCDP

SEQ ID NO: 16287 - protein, 9 aa, Homo sapiens
  light chain complementarity determining region 3 for antibody 8144
QQSDSFPYT

SEQ ID NO: 16288 - protein, 16 aa, Homo sapiens
  heavy chain complementarity determining region 3 for antibody 8144
ARDQGLGYGVPDGCDI

SEQ ID NO: 16289 - protein, 9 aa, Homo sapiens
  light chain complementarity determining region 3 for antibody 8145
QQSCSTPRT

SEQ ID NO: 16290 - protein, 16 aa, Homo sapiens
  heavy chain complementarity determining region 3 for antibody 8145
ARSYDRSNTKVWYFDL

SEQ ID NO: 16291 - protein, 9 aa, Homo sapiens
  light chain complementarity determining region 3 for antibody 8146
QQRYSTPWT

SEQ ID NO: 16292 - protein, 11 aa, Homo sapiens
  heavy chain complementarity determining region 3 for antibody 8146
ATNSRGQGYEY

SEQ ID NO: 16293 - protein, 9 aa, Homo sapiens
  light chain complementarity determining region 3 for antibody 8147
QQRYSTPWT

SEQ ID NO: 16294 - protein, 15 aa, Homo sapiens
  heavy chain complementarity determining region 3 for antibody 8147
ARIWTSSTNCRYMDV

SEQ ID NO: 16295 - protein, 8 aa, Homo sapiens
  light chain complementarity determining region 3 for antibody 8148
QQRYSSPT

SEQ ID NO: 16296 - protein, 17 aa, Homo sapiens
  heavy chain complementarity determining region 3 for antibody 8148
AKGRGSVAMALIYYLDL

SEQ ID NO: 16297 - protein, 9 aa, Homo sapiens
  light chain complementarity determining region 3 for antibody 8149
QQRYSSPRT

SEQ ID NO: 16298 - protein, 12 aa, Homo sapiens
  heavy chain complementarity determining region 3 for antibody 8149
NADHGYVDGFDI

SEQ ID NO: 16299 - protein, 9 aa, Homo sapiens
  light chain complementarity determining region 3 for antibody 8150
QQRYNTPLT

SEQ ID NO: 16300 - protein, 11 aa, Homo sapiens
  heavy chain complementarity determining region 3 for antibody 8150
ARGGTLAWFDP

SEQ ID NO: 16301 - protein, 9 aa, Homo sapiens
  light chain complementarity determining region 3 for antibody 8151
QQRVNWPPP

SEQ ID NO: 16302 - protein, 17 aa, Homo sapiens
  heavy chain complementarity determining region 3 for antibody 8151
ARDMPMIVATPGGCFDC

SEQ ID NO: 16303 - protein, 10 aa, Homo sapiens
  light chain complementarity determining region 3 for antibody 8152
QQRTNWLPYT

SEQ ID NO: 16304 - protein, 8 aa, Homo sapiens
  heavy chain complementarity determining region 3 for antibody 8152
ARDRAVDH

SEQ ID NO: 16305 - protein, 10 aa, Homo sapiens
  light chain complementarity determining region 3 for antibody 8153
QQRSTWPPIT

SEQ ID NO: 16306 - protein, 22 aa, Homo sapiens
  heavy chain complementarity determining region 3 for antibody 8153
AKGGSGSWSGYYDAYYYYYMDV

SEQ ID NO: 16307 - protein, 8 aa, Homo sapiens
  light chain complementarity determining region 3 for antibody 8154
QQRSTLPT

SEQ ID NO: 16308 - protein, 13 aa, Homo sapiens
  heavy chain complementarity determining region 3 for antibody 8154
VKDKGNYDRCFDY

SEQ ID NO: 16309 - protein, 9 aa, Homo sapiens
  light chain complementarity determining region 3 for antibody 8155
QQRSSWSFT

SEQ ID NO: 16310 - protein, 17 aa, Homo sapiens
  heavy chain complementarity determining region 3 for antibody 8155
ARNTMVGTWQRQGNLDH

SEQ ID NO: 16311 - protein, 9 aa, Homo sapiens
  light chain complementarity determining region 3 for antibody 8156
QQRSNWSIT

SEQ ID NO: 16312 - protein, 12 aa, Homo sapiens
  heavy chain complementarity determining region 3 for antibody 8156
NADHGYVDGFDI

SEQ ID NO: 16313 - protein, 11 aa, Homo sapiens
  light chain complementarity determining region 3 for antibody 8157
QQRSNWRGMYT

SEQ ID NO: 16314 - protein, 11 aa, Homo sapiens
  heavy chain complementarity determining region 3 for antibody 8157
AREQHGQAPDY

SEQ ID NO: 16315 - protein, 8 aa, Homo sapiens
  light chain complementarity determining region 3 for antibody 8158
QQRSNWPT

SEQ ID NO: 16316 - protein, 16 aa, Homo sapiens
  heavy chain complementarity determining region 3 for antibody 8158
VGPHLTYNSGWRYFDY

SEQ ID NO: 16317 - protein, 8 aa, Homo sapiens
  light chain complementarity determining region 3 for antibody 8159
QQRSNWPT

SEQ ID NO: 16318 - protein, 14 aa, Homo sapiens
  heavy chain complementarity determining region 3 for antibody 8159
ANYRASIGARCFDP

SEQ ID NO: 16319 - protein, 9 aa, Homo sapiens
  light chain complementarity determining region 3 for antibody 8160
QQRSNWPST

SEQ ID NO: 16320 - protein, 12 aa, Homo sapiens
  heavy chain complementarity determining region 3 for antibody 8160
NADHGYVDGFDI

SEQ ID NO: 16321 - protein, 10 aa, Homo sapiens
  light chain complementarity determining region 3 for antibody 8161
QQRSNWPSLT

SEQ ID NO: 16322 - protein, 21 aa, Homo sapiens
  heavy chain complementarity determining region 3 for antibody 8161
GRWGAGYYDSNGNYFGRAIDN

SEQ ID NO: 16323 - protein, 9 aa, Homo sapiens
  light chain complementarity determining region 3 for antibody 8162
QQRSNWPRT

SEQ ID NO: 16324 - protein, 12 aa, Homo sapiens
  heavy chain complementarity determining region 3 for antibody 8162
TRGTIQATILGC

SEQ ID NO: 16325 - protein, 9 aa, Homo sapiens
  light chain complementarity determining region 3 for antibody 8163
QQRSNWPRT

SEQ ID NO: 16326 - protein, 12 aa, Homo sapiens
  heavy chain complementarity determining region 3 for antibody 8163
TRDTIQAAILGC

SEQ ID NO: 16327 - protein, 10 aa, Homo sapiens
  light chain complementarity determining region 3 for antibody 8164
QQRSNWPPYT

SEQ ID NO: 16328 - protein, 12 aa, Homo sapiens
  heavy chain complementarity determining region 3 for antibody 8164
TREYSGGWYPGY

SEQ ID NO: 16329 - protein, 9 aa, Homo sapiens
  light chain complementarity determining region 3 for antibody 8165
QQRSNWPPT

SEQ ID NO: 16330 - protein, 8 aa, Homo sapiens
  heavy chain complementarity determining region 3 for antibody 8165
AGWGYANY

SEQ ID NO: 16331 - protein, 9 aa, Homo sapiens
  light chain complementarity determining region 3 for antibody 8166
QQRSNWPPL

SEQ ID NO: 16332 - protein, 16 aa, Homo sapiens
  heavy chain complementarity determining region 3 for antibody 8166
VRDLAGFTRGGSTFDY

SEQ ID NO: 16333 - protein, 10 aa, Homo sapiens
  light chain complementarity determining region 3 for antibody 8167
QQRSNWPPIT

SEQ ID NO: 16334 - protein, 19 aa, Homo sapiens
  heavy chain complementarity determining region 3 for antibody 8167
ARGNGPNWGVLNSFYYMDV

SEQ ID NO: 16335 - protein, 10 aa, Homo sapiens
  light chain complementarity determining region 3 for antibody 8168
QQRSNWPPIT

SEQ ID NO: 16336 - protein, 19 aa, Homo sapiens
  heavy chain complementarity determining region 3 for antibody 8168
ARGNGPNWGILNAFYYMDV

SEQ ID NO: 16337 - protein, 8 aa, Homo sapiens
  light chain complementarity determining region 3 for antibody 8169
QQRSNWPP

SEQ ID NO: 16338 - protein, 15 aa, Homo sapiens
  heavy chain complementarity determining region 3 for antibody 8169
GKEGPGSSGWLTGHY

SEQ ID NO: 16339 - protein, 11 aa, Homo sapiens
  light chain complementarity determining region 3 for antibody 8170
QQRSNWPPEIT

SEQ ID NO: 16340 - protein, 17 aa, Homo sapiens
  heavy chain complementarity determining region 3 for antibody 8170
ARNTMVHGWQRQGSVDH

SEQ ID NO: 16341 - protein, 9 aa, Homo sapiens
  light chain complementarity determining region 3 for antibody 8171
QQRSNWPLT

SEQ ID NO: 16342 - protein, 20 aa, Homo sapiens
  heavy chain complementarity determining region 3 for antibody 8171
TRQDTQGPPRHHAVAEASDI

SEQ ID NO: 16343 - protein, 9 aa, Homo sapiens
  light chain complementarity determining region 3 for antibody 8172
QQRSNWPLT

SEQ ID NO: 16344 - protein, 9 aa, Homo sapiens
  heavy chain complementarity determining region 3 for antibody 8172
GSRRPYFDS

SEQ ID NO: 16345 - protein, 9 aa, Homo sapiens
  light chain complementarity determining region 3 for antibody 8173
QQRSNWPLT

SEQ ID NO: 16346 - protein, 12 aa, Homo sapiens
  heavy chain complementarity determining region 3 for antibody 8173
ARERSADYWLGP

SEQ ID NO: 16347 - protein, 9 aa, Homo sapiens
  light chain complementarity determining region 3 for antibody 8174
QQRSNWPLT

SEQ ID NO: 16348 - protein, 11 aa, Homo sapiens
  heavy chain complementarity determining region 3 for antibody 8174
ARDWEGRQFDY

SEQ ID NO: 16349 - protein, 9 aa, Homo sapiens
  light chain complementarity determining region 3 for antibody 8175
QQRSNWPLT

SEQ ID NO: 16350 - protein, 12 aa, Homo sapiens
  heavy chain complementarity determining region 3 for antibody 8175
ARDKGGRNGMDV

SEQ ID NO: 16351 - protein, 9 aa, Homo sapiens
  light chain complementarity determining region 3 for antibody 8176
QQRSNWPLT

SEQ ID NO: 16352 - protein, 18 aa, Homo sapiens
  heavy chain complementarity determining region 3 for antibody 8176
ARDGGYCTSGPCWNYFDY

SEQ ID NO: 16353 - protein, 9 aa, Homo sapiens
  light chain complementarity determining region 3 for antibody 8177
QQRSNWPLT

SEQ ID NO: 16354 - protein, 17 aa, Homo sapiens
  heavy chain complementarity determining region 3 for antibody 8177
AKAGSTPSHRGFYYMDV

SEQ ID NO: 16355 - protein, 10 aa, Homo sapiens
  light chain complementarity determining region 3 for antibody 8178
QQRSNWPLFT

SEQ ID NO: 16356 - protein, 10 aa, Homo sapiens
  heavy chain complementarity determining region 3 for antibody 8178
AGGVGWLMDY

SEQ ID NO: 16357 - protein, 9 aa, Homo sapiens
  light chain complementarity determining region 3 for antibody 8179
QQRSNWPIT

SEQ ID NO: 16358 - protein, 16 aa, Homo sapiens
  heavy chain complementarity determining region 3 for antibody 8179
VRDLAGFTRGGSTFDY

SEQ ID NO: 16359 - protein, 9 aa, Homo sapiens
  light chain complementarity determining region 3 for antibody 8180
QQRSNWPIT

SEQ ID NO: 16360 - protein, 12 aa, Homo sapiens
  heavy chain complementarity determining region 3 for antibody 8180
NADHSYVDGFDI

SEQ ID NO: 16361 - protein, 9 aa, Homo sapiens
  light chain complementarity determining region 3 for antibody 8181
QQRSNWPIT

SEQ ID NO: 16362 - protein, 12 aa, Homo sapiens
  heavy chain complementarity determining region 3 for antibody 8181
NADHDYVDGFDI

SEQ ID NO: 16363 - protein, 9 aa, Homo sapiens
  light chain complementarity determining region 3 for antibody 8182
QQRSNWPIT

SEQ ID NO: 16364 - protein, 15 aa, Homo sapiens
  heavy chain complementarity determining region 3 for antibody 8182
ARIWTSSTNCRYMDV

SEQ ID NO: 16365 - protein, 9 aa, Homo sapiens
  light chain complementarity determining region 3 for antibody 8183
QQRSNWPIT

SEQ ID NO: 16366 - protein, 13 aa, Homo sapiens
  heavy chain complementarity determining region 3 for antibody 8183
AKEGSAPGPDFEY

SEQ ID NO: 16367 - protein, 9 aa, Homo sapiens
  light chain complementarity determining region 3 for antibody 8184
QQRSNWPGT

SEQ ID NO: 16368 - protein, 17 aa, Homo sapiens
  heavy chain complementarity determining region 3 for antibody 8184
ARNTMVGTWQRQGNLDH

SEQ ID NO: 16369 - protein, 9 aa, Homo sapiens
  light chain complementarity determining region 3 for antibody 8185
QQRSNWPGT

SEQ ID NO: 16370 - protein, 13 aa, Homo sapiens
  heavy chain complementarity determining region 3 for antibody 8185
AKEGSSPGPDFDS

SEQ ID NO: 16371 - protein, 9 aa, Homo sapiens
  light chain complementarity determining region 3 for antibody 8186
QQRSNWLIT

SEQ ID NO: 16372 - protein, 12 aa, Homo sapiens
  heavy chain complementarity determining region 3 for antibody 8186
NADHGYVDGFDI

SEQ ID NO: 16373 - protein, 9 aa, Homo sapiens
  light chain complementarity determining region 3 for antibody 8187
QQRSNWLFT

SEQ ID NO: 16374 - protein, 14 aa, Homo sapiens
  heavy chain complementarity determining region 3 for antibody 8187
TRGVITGGMWYFDL

SEQ ID NO: 16375 - protein, 9 aa, Homo sapiens
  light chain complementarity determining region 3 for antibody 8188
QQRSNWLFT

SEQ ID NO: 16376 - protein, 12 aa, Homo sapiens
  heavy chain complementarity determining region 3 for antibody 8188
ARDKGGRNGMDV

SEQ ID NO: 16377 - protein, 7 aa, Homo sapiens
  light chain complementarity determining region 3 for antibody 8189
QQRSNWF

SEQ ID NO: 16378 - protein, 20 aa, Homo sapiens
  heavy chain complementarity determining region 3 for antibody 8189
ARVGPQWTPGPSGYYYYMDV

SEQ ID NO: 16379 - protein, 10 aa, Homo sapiens
  light chain complementarity determining region 3 for antibody 8190
QQRSNWAPTA

SEQ ID NO: 16380 - protein, 14 aa, Homo sapiens
  heavy chain complementarity determining region 3 for antibody 8190
VRDALGPGVPRFDS

SEQ ID NO: 16381 - protein, 9 aa, Homo sapiens
  light chain complementarity determining region 3 for antibody 8191
QQRSNRPLT

SEQ ID NO: 16382 - protein, 17 aa, Homo sapiens
  heavy chain complementarity determining region 3 for antibody 8191
AKASSTPSHRGFYYMDV

SEQ ID NO: 16383 - protein, 9 aa, Homo sapiens
  light chain complementarity determining region 3 for antibody 8192
QQRSNRPIT

SEQ ID NO: 16384 - protein, 12 aa, Homo sapiens
  heavy chain complementarity determining region 3 for antibody 8192
NADHGYVDGFDI

SEQ ID NO: 16385 - protein, 9 aa, Homo sapiens
  light chain complementarity determining region 3 for antibody 8193
QQRSNRLFT

SEQ ID NO: 16386 - protein, 13 aa, Homo sapiens
  heavy chain complementarity determining region 3 for antibody 8193
AKEGPYPGLDLDY

SEQ ID NO: 16387 - protein, 9 aa, Homo sapiens
  light chain complementarity determining region 3 for antibody 8194
QQRSNQTFT

SEQ ID NO: 16388 - protein, 7 aa, Homo sapiens
  heavy chain complementarity determining region 3 for antibody 8194
TTEDGRN

SEQ ID NO: 16389 - protein, 9 aa, Homo sapiens
  light chain complementarity determining region 3 for antibody 8195
QQRSNQSFT

SEQ ID NO: 16390 - protein, 7 aa, Homo sapiens
  heavy chain complementarity determining region 3 for antibody 8195
TTEDGRN

SEQ ID NO: 16391 - protein, 9 aa, Homo sapiens
  light chain complementarity determining region 3 for antibody 8196
QQRSNQRFT

SEQ ID NO: 16392 - protein, 7 aa, Homo sapiens
  heavy chain complementarity determining region 3 for antibody 8196
TTEEGRN

SEQ ID NO: 16393 - protein, 9 aa, Homo sapiens
  light chain complementarity determining region 3 for antibody 8197
QQRSNQRFT

SEQ ID NO: 16394 - protein, 7 aa, Homo sapiens
  heavy chain complementarity determining region 3 for antibody 8197
TTEDGSN

SEQ ID NO: 16395 - protein, 9 aa, Homo sapiens
  light chain complementarity determining region 3 for antibody 8198
QQRSNQRFT

SEQ ID NO: 16396 - protein, 7 aa, Homo sapiens
  heavy chain complementarity determining region 3 for antibody 8198
TTEDGRT

SEQ ID NO: 16397 - protein, 9 aa, Homo sapiens
  light chain complementarity determining region 3 for antibody 8199
QQRSNQRFT

SEQ ID NO: 16398 - protein, 7 aa, Homo sapiens
  heavy chain complementarity determining region 3 for antibody 8199
TTEDGRS

SEQ ID NO: 16399 - protein, 9 aa, Homo sapiens
  light chain complementarity determining region 3 for antibody 8200
QQRSNQRFT

SEQ ID NO: 16400 - protein, 7 aa, Homo sapiens
  heavy chain complementarity determining region 3 for antibody 8200
TTEDGGN

SEQ ID NO: 16401 - protein, 9 aa, Homo sapiens
  light chain complementarity determining region 3 for antibody 8201
QQRSNQRFT

SEQ ID NO: 16402 - protein, 7 aa, Homo sapiens
  heavy chain complementarity determining region 3 for antibody 8201
TKEDGRN

SEQ ID NO: 16403 - protein, 9 aa, Homo sapiens
  light chain complementarity determining region 3 for antibody 8202
QQRSNQRFT

SEQ ID NO: 16404 - protein, 12 aa, Homo sapiens
  heavy chain complementarity determining region 3 for antibody 8202
STDVETTFPSVS

SEQ ID NO: 16405 - protein, 9 aa, Homo sapiens
  light chain complementarity determining region 3 for antibody 8203
QQRSNLPIT

SEQ ID NO: 16406 - protein, 12 aa, Homo sapiens
  heavy chain complementarity determining region 3 for antibody 8203
NADHGYVDGFDI

SEQ ID NO: 16407 - protein, 9 aa, Homo sapiens
  light chain complementarity determining region 3 for antibody 8204
QQRSNCPRT

SEQ ID NO: 16408 - protein, 12 aa, Homo sapiens
  heavy chain complementarity determining region 3 for antibody 8204
TRDTIQATILGC

SEQ ID NO: 16409 - protein, 9 aa, Homo sapiens
  light chain complementarity determining region 3 for antibody 8205
QQRSNCPIT

SEQ ID NO: 16410 - protein, 12 aa, Homo sapiens
  heavy chain complementarity determining region 3 for antibody 8205
NADHGYVDGFDI

SEQ ID NO: 16411 - protein, 9 aa, Homo sapiens
  light chain complementarity determining region 3 for antibody 8206
QQRSKWPGT

SEQ ID NO: 16412 - protein, 13 aa, Homo sapiens
  heavy chain complementarity determining region 3 for antibody 8206
VKEGSSPGPDFDS

SEQ ID NO: 16413 - protein, 9 aa, Homo sapiens
  light chain complementarity determining region 3 for antibody 8207
QQRSKWPGT

SEQ ID NO: 16414 - protein, 13 aa, Homo sapiens
  heavy chain complementarity determining region 3 for antibody 8207
ANEGSSPGPDFDS

SEQ ID NO: 16415 - protein, 9 aa, Homo sapiens
  light chain complementarity determining region 3 for antibody 8208
QQRSKWPGT

SEQ ID NO: 16416 - protein, 13 aa, Homo sapiens
  heavy chain complementarity determining region 3 for antibody 8208
AKGGSSPGPDFDS

SEQ ID NO: 16417 - protein, 9 aa, Homo sapiens
  light chain complementarity determining region 3 for antibody 8209
QQRSKWPGT

SEQ ID NO: 16418 - protein, 13 aa, Homo sapiens
  heavy chain complementarity determining region 3 for antibody 8209
AKEGSSPGPYFDS

SEQ ID NO: 16419 - protein, 9 aa, Homo sapiens
  light chain complementarity determining region 3 for antibody 8210
QQRSHWPLT

SEQ ID NO: 16420 - protein, 14 aa, Homo sapiens
  heavy chain complementarity determining region 3 for antibody 8210
ARTYVYYDGSGSLP

SEQ ID NO: 16421 - protein, 9 aa, Homo sapiens
  light chain complementarity determining region 3 for antibody 8211
QQRSDWPRT

SEQ ID NO: 16422 - protein, 12 aa, Homo sapiens
  heavy chain complementarity determining region 3 for antibody 8211
TRDTIQATILGC

SEQ ID NO: 16423 - protein, 9 aa, Homo sapiens
  light chain complementarity determining region 3 for antibody 8212
QQRSDWPIT

SEQ ID NO: 16424 - protein, 12 aa, Homo sapiens
  heavy chain complementarity determining region 3 for antibody 8212
NADHGYVDGFDI

SEQ ID NO: 16425 - protein, 9 aa, Homo sapiens
  light chain complementarity determining region 3 for antibody 8213
QQRSDQRFT

SEQ ID NO: 16426 - protein, 7 aa, Homo sapiens
  heavy chain complementarity determining region 3 for antibody 8213
TTEDGRN

SEQ ID NO: 16427 - protein, 10 aa, Homo sapiens
  light chain complementarity determining region 3 for antibody 8214
QQRRNWPPFT

SEQ ID NO: 16428 - protein, 16 aa, Homo sapiens
  heavy chain complementarity determining region 3 for antibody 8214
ARHGVLPAAIHDAFDI

SEQ ID NO: 16429 - protein, 9 aa, Homo sapiens
  light chain complementarity determining region 3 for antibody 8215
QQRRNQRFT

SEQ ID NO: 16430 - protein, 7 aa, Homo sapiens
  heavy chain complementarity determining region 3 for antibody 8215
TTEDGRN

SEQ ID NO: 16431 - protein, 9 aa, Homo sapiens
  light chain complementarity determining region 3 for antibody 8216
QQRRDWPPT

SEQ ID NO: 16432 - protein, 13 aa, Homo sapiens
  heavy chain complementarity determining region 3 for antibody 8216
ARSEYQSVGPFDM

SEQ ID NO: 16433 - protein, 9 aa, Homo sapiens
  light chain complementarity determining region 3 for antibody 8217
QQRNSYPYT

SEQ ID NO: 16434 - protein, 10 aa, Homo sapiens
  heavy chain complementarity determining region 3 for antibody 8217
ARETSGAYDI

SEQ ID NO: 16435 - protein, 9 aa, Homo sapiens
  light chain complementarity determining region 3 for antibody 8218
QQRNNWPRT

SEQ ID NO: 16436 - protein, 12 aa, Homo sapiens
  heavy chain complementarity determining region 3 for antibody 8218
TRDTIQATILGC

SEQ ID NO: 16437 - protein, 10 aa, Homo sapiens
  light chain complementarity determining region 3 for antibody 8219
QQRNNWLPYT

SEQ ID NO: 16438 - protein, 8 aa, Homo sapiens
  heavy chain complementarity determining region 3 for antibody 8219
ARDRAGDH

SEQ ID NO: 16439 - protein, 9 aa, Homo sapiens
  light chain complementarity determining region 3 for antibody 8220
QQRNKWPGT

SEQ ID NO: 16440 - protein, 13 aa, Homo sapiens
  heavy chain complementarity determining region 3 for antibody 8220
AKEGSSPGPDFDS

SEQ ID NO: 16441 - protein, 10 aa, Homo sapiens
  light chain complementarity determining region 3 for antibody 8221
QQRNDWPPYT

SEQ ID NO: 16442 - protein, 18 aa, Homo sapiens
  heavy chain complementarity determining region 3 for antibody 8221
ARGNYCSGGSCYSGLFEF

SEQ ID NO: 16443 - protein, 11 aa, Homo sapiens
  light chain complementarity determining region 3 for antibody 8222
QQRNDWPPVDT

SEQ ID NO: 16444 - protein, 13 aa, Homo sapiens
  heavy chain complementarity determining region 3 for antibody 8222
ATLTVSTLWAFDY

SEQ ID NO: 16445 - protein, 9 aa, Homo sapiens
  light chain complementarity determining region 3 for antibody 8223
QQRGYWPPT

SEQ ID NO: 16446 - protein, 14 aa, Homo sapiens
  heavy chain complementarity determining region 3 for antibody 8223
ANHTHNWYLGVLDC

SEQ ID NO: 16447 - protein, 9 aa, Homo sapiens
  light chain complementarity determining region 3 for antibody 8224
QQRGYWPPT

SEQ ID NO: 16448 - protein, 14 aa, Homo sapiens
  heavy chain complementarity determining region 3 for antibody 8224
AKQTHNWYLGVLDC

SEQ ID NO: 16449 - protein, 9 aa, Homo sapiens
  light chain complementarity determining region 3 for antibody 8225
QQRGYWPPT

SEQ ID NO: 16450 - protein, 14 aa, Homo sapiens
  heavy chain complementarity determining region 3 for antibody 8225
AKHTHNWYLRVLDC

SEQ ID NO: 16451 - protein, 9 aa, Homo sapiens
  light chain complementarity determining region 3 for antibody 8226
QQRGYWPPT

SEQ ID NO: 16452 - protein, 14 aa, Homo sapiens
  heavy chain complementarity determining region 3 for antibody 8226
AKHTHNWYLGVLDF

SEQ ID NO: 16453 - protein, 9 aa, Homo sapiens
  light chain complementarity determining region 3 for antibody 8227
QQRGYWPPT

SEQ ID NO: 16454 - protein, 14 aa, Homo sapiens
  heavy chain complementarity determining region 3 for antibody 8227
AKHTHNGYLGVLDC

SEQ ID NO: 16455 - protein, 9 aa, Homo sapiens
  light chain complementarity determining region 3 for antibody 8228
QQRGYWPPN

SEQ ID NO: 16456 - protein, 14 aa, Homo sapiens
  heavy chain complementarity determining region 3 for antibody 8228
AKHTHNWYLGVLDC

SEQ ID NO: 16457 - protein, 9 aa, Homo sapiens
  light chain complementarity determining region 3 for antibody 8229
QQRGSWPST

SEQ ID NO: 16458 - protein, 14 aa, Homo sapiens
  heavy chain complementarity determining region 3 for antibody 8229
AKGMTTWYLMVVDY

SEQ ID NO: 16459 - protein, 9 aa, Homo sapiens
  light chain complementarity determining region 3 for antibody 8230
QQRGSWPPT

SEQ ID NO: 16460 - protein, 14 aa, Homo sapiens
  heavy chain complementarity determining region 3 for antibody 8230
VKGMTSWYLMVVDY

SEQ ID NO: 16461 - protein, 9 aa, Homo sapiens
  light chain complementarity determining region 3 for antibody 8231
QQRGSWPPT

SEQ ID NO: 16462 - protein, 14 aa, Homo sapiens
  heavy chain complementarity determining region 3 for antibody 8231
SKHTHNWYLGVLDC

SEQ ID NO: 16463 - protein, 9 aa, Homo sapiens
  light chain complementarity determining region 3 for antibody 8232
QQRGSWPPT

SEQ ID NO: 16464 - protein, 16 aa, Homo sapiens
  heavy chain complementarity determining region 3 for antibody 8232
ASPNTLGRLVGVAFDY

SEQ ID NO: 16465 - protein, 9 aa, Homo sapiens
  light chain complementarity determining region 3 for antibody 8233
QQRGSWPPT

SEQ ID NO: 16466 - protein, 12 aa, Homo sapiens
  heavy chain complementarity determining region 3 for antibody 8233
ARLDWNYRAFDI

SEQ ID NO: 16467 - protein, 9 aa, Homo sapiens
  light chain complementarity determining region 3 for antibody 8234
QQRGSWPPT

SEQ ID NO: 16468 - protein, 14 aa, Homo sapiens
  heavy chain complementarity determining region 3 for antibody 8234
AKQTHNWYLGVLDC

SEQ ID NO: 16469 - protein, 9 aa, Homo sapiens
  light chain complementarity determining region 3 for antibody 8235
QQRGSWPPT

SEQ ID NO: 16470 - protein, 14 aa, Homo sapiens
  heavy chain complementarity determining region 3 for antibody 8235
AKHTPNWYLGVLDC

SEQ ID NO: 16471 - protein, 9 aa, Homo sapiens
  light chain complementarity determining region 3 for antibody 8236
QQRGSWPPT

SEQ ID NO: 16472 - protein, 14 aa, Homo sapiens
  heavy chain complementarity determining region 3 for antibody 8236
AKHTLNWYLGVLDC

SEQ ID NO: 16473 - protein, 9 aa, Homo sapiens
  light chain complementarity determining region 3 for antibody 8237
QQRGSWPPT

SEQ ID NO: 16474 - protein, 14 aa, Homo sapiens
  heavy chain complementarity determining region 3 for antibody 8237
AKHTHNWYLGVLDS

SEQ ID NO: 16475 - protein, 9 aa, Homo sapiens
  light chain complementarity determining region 3 for antibody 8238
QQRGSWPPT

SEQ ID NO: 16476 - protein, 14 aa, Homo sapiens
  heavy chain complementarity determining region 3 for antibody 8238
AKHTHNWYLGVLDF

SEQ ID NO: 16477 - protein, 9 aa, Homo sapiens
  light chain complementarity determining region 3 for antibody 8239
QQRGSWPPT

SEQ ID NO: 16478 - protein, 14 aa, Homo sapiens
  heavy chain complementarity determining region 3 for antibody 8239
AKHTHNWYLGGLDC

SEQ ID NO: 16479 - protein, 9 aa, Homo sapiens
  light chain complementarity determining region 3 for antibody 8240
QQRGSWPPT

SEQ ID NO: 16480 - protein, 14 aa, Homo sapiens
  heavy chain complementarity determining region 3 for antibody 8240
AKHTHNWYLGFLDC

SEQ ID NO: 16481 - protein, 9 aa, Homo sapiens
  light chain complementarity determining region 3 for antibody 8241
QQRGSWPPT

SEQ ID NO: 16482 - protein, 14 aa, Homo sapiens
  heavy chain complementarity determining region 3 for antibody 8241
AKHTHNWCLGVLDC

SEQ ID NO: 16483 - protein, 9 aa, Homo sapiens
  light chain complementarity determining region 3 for antibody 8242
QQRGSWPPT

SEQ ID NO: 16484 - protein, 14 aa, Homo sapiens
  heavy chain complementarity determining region 3 for antibody 8242
AKGTTTWYLMVVDY

SEQ ID NO: 16485 - protein, 9 aa, Homo sapiens
  light chain complementarity determining region 3 for antibody 8243
QQRGSWPPT

SEQ ID NO: 16486 - protein, 14 aa, Homo sapiens
  heavy chain complementarity determining region 3 for antibody 8243
AKGMTTWYSMVVDY

SEQ ID NO: 16487 - protein, 9 aa, Homo sapiens
  light chain complementarity determining region 3 for antibody 8244
QQRGSWPPT

SEQ ID NO: 16488 - protein, 14 aa, Homo sapiens
  heavy chain complementarity determining region 3 for antibody 8244
AKGMTTWYLMVVDH

SEQ ID NO: 16489 - protein, 9 aa, Homo sapiens
  light chain complementarity determining region 3 for antibody 8245
QQRGSWPPT

SEQ ID NO: 16490 - protein, 14 aa, Homo sapiens
  heavy chain complementarity determining region 3 for antibody 8245
AKGMTSWYVMVVDY

SEQ ID NO: 16491 - protein, 9 aa, Homo sapiens
  light chain complementarity determining region 3 for antibody 8246
QQRGSWPPT

SEQ ID NO: 16492 - protein, 13 aa, Homo sapiens
  heavy chain complementarity determining region 3 for antibody 8246
AKEGSAPGPDFEY

SEQ ID NO: 16493 - protein, 8 aa, Homo sapiens
  light chain complementarity determining region 3 for antibody 8247
QQRGSGLP

SEQ ID NO: 16494 - protein, 14 aa, Homo sapiens
  heavy chain complementarity determining region 3 for antibody 8247
ARAVGRGPGAHFDY

SEQ ID NO: 16495 - protein, 9 aa, Homo sapiens
  light chain complementarity determining region 3 for antibody 8248
QQRGPWPPT

SEQ ID NO: 16496 - protein, 14 aa, Homo sapiens
  heavy chain complementarity determining region 3 for antibody 8248
AKGMTTWYLMVVDY

SEQ ID NO: 16497 - protein, 9 aa, Homo sapiens
  light chain complementarity determining region 3 for antibody 8249
QQPYTAPYT

SEQ ID NO: 16498 - protein, 10 aa, Homo sapiens
  heavy chain complementarity determining region 3 for antibody 8249
ARDISRHMDV

SEQ ID NO: 16499 - protein, 9 aa, Homo sapiens
  light chain complementarity determining region 3 for antibody 8250
QQPYSSPWT

SEQ ID NO: 16500 - protein, 11 aa, Homo sapiens
  heavy chain complementarity determining region 3 for antibody 8250
TRGGYSVGYDY

SEQ ID NO: 16501 - protein, 9 aa, Homo sapiens
  light chain complementarity determining region 3 for antibody 8251
QQPYNLPIT

SEQ ID NO: 16502 - protein, 12 aa, Homo sapiens
  heavy chain complementarity determining region 3 for antibody 8251
CVGGFGGTWFDS

SEQ ID NO: 16503 - protein, 9 aa, Homo sapiens
  light chain complementarity determining region 3 for antibody 8252
QQPYDVPLT

SEQ ID NO: 16504 - protein, 14 aa, Homo sapiens
  heavy chain complementarity determining region 3 for antibody 8252
ARPLNGWDNYPFDI

SEQ ID NO: 16505 - protein, 9 aa, Homo sapiens
  light chain complementarity determining region 3 for antibody 8253
QQPYDNMYT

SEQ ID NO: 16506 - protein, 17 aa, Homo sapiens
  heavy chain complementarity determining region 3 for antibody 8253
ATFFCGGRSCFQSPFDH

SEQ ID NO: 16507 - protein, 9 aa, Homo sapiens
  light chain complementarity determining region 3 for antibody 8254
QQNYSTPYT

SEQ ID NO: 16508 - protein, 13 aa, Homo sapiens
  heavy chain complementarity determining region 3 for antibody 8254
ATEPYYGSGRGVY

SEQ ID NO: 16509 - protein, 9 aa, Homo sapiens
  light chain complementarity determining region 3 for antibody 8255
QQNYSTPST

SEQ ID NO: 16510 - protein, 16 aa, Homo sapiens
  heavy chain complementarity determining region 3 for antibody 8255
ARWFSRSSTGVSYMDV

SEQ ID NO: 16511 - protein, 10 aa, Homo sapiens
  light chain complementarity determining region 3 for antibody 8256
QQNYSTPLFT

SEQ ID NO: 16512 - protein, 15 aa, Homo sapiens
  heavy chain complementarity determining region 3 for antibody 8256
ARVGRPYHNAWYFDN

SEQ ID NO: 16513 - protein, 9 aa, Homo sapiens
  light chain complementarity determining region 3 for antibody 8257
QQNYSAPIT

SEQ ID NO: 16514 - protein, 15 aa, Homo sapiens
  heavy chain complementarity determining region 3 for antibody 8257
VRALSPTEMSYAIAY

SEQ ID NO: 16515 - protein, 9 aa, Homo sapiens
  light chain complementarity determining region 3 for antibody 8258
QQNYRTPYT

SEQ ID NO: 16516 - protein, 10 aa, Homo sapiens
  heavy chain complementarity determining region 3 for antibody 8258
AHRINRAFDI

SEQ ID NO: 16517 - protein, 9 aa, Homo sapiens
  light chain complementarity determining region 3 for antibody 8259
QQNYRTPRT

SEQ ID NO: 16518 - protein, 10 aa, Homo sapiens
  heavy chain complementarity determining region 3 for antibody 8259
ARDQSPSPPY

SEQ ID NO: 16519 - protein, 10 aa, Homo sapiens
  light chain complementarity determining region 3 for antibody 8260
QQNNSYSPRP

SEQ ID NO: 16520 - protein, 15 aa, Homo sapiens
  heavy chain complementarity determining region 3 for antibody 8260
ARVGRPYHNAWYFDN

SEQ ID NO: 16521 - protein, 9 aa, Homo sapiens
  light chain complementarity determining region 3 for antibody 8261
QQNNSYPPT

SEQ ID NO: 16522 - protein, 13 aa, Homo sapiens
  heavy chain complementarity determining region 3 for antibody 8261
AKEGSSPGPDFEY

SEQ ID NO: 16523 - protein, 10 aa, Homo sapiens
  light chain complementarity determining region 3 for antibody 8262
QQNNFYSTLT

SEQ ID NO: 16524 - protein, 16 aa, Homo sapiens
  heavy chain complementarity determining region 3 for antibody 8262
GRQVISATKWPNRLDY

SEQ ID NO: 16525 - protein, 9 aa, Homo sapiens
  light chain complementarity determining region 3 for antibody 8263
QQNKTAPWT

SEQ ID NO: 16526 - protein, 20 aa, Homo sapiens
  heavy chain complementarity determining region 3 for antibody 8263
TRDARGSSSYAYGGGGGLDV

SEQ ID NO: 16527 - protein, 7 aa, Homo sapiens
  light chain complementarity determining region 3 for antibody 8264
QQNGSYT

SEQ ID NO: 16528 - protein, 10 aa, Homo sapiens
  heavy chain complementarity determining region 3 for antibody 8264
ARRWERYFDY

SEQ ID NO: 16529 - protein, 9 aa, Homo sapiens
  light chain complementarity determining region 3 for antibody 8265
QQNGSSPWT

SEQ ID NO: 16530 - protein, 10 aa, Homo sapiens
  heavy chain complementarity determining region 3 for antibody 8265
ARERSGSYDI

SEQ ID NO: 16531 - protein, 9 aa, Homo sapiens
  light chain complementarity determining region 3 for antibody 8266
QQNGRSPLT

SEQ ID NO: 16532 - protein, 9 aa, Homo sapiens
  heavy chain complementarity determining region 3 for antibody 8266
ARGSGYNYY

SEQ ID NO: 16533 - protein, 9 aa, Homo sapiens
  light chain complementarity determining region 3 for antibody 8267
QQNGNSPVP

SEQ ID NO: 16534 - protein, 18 aa, Homo sapiens
  heavy chain complementarity determining region 3 for antibody 8267
ARGDYPEARTGYFLDFDY

SEQ ID NO: 16535 - protein, 9 aa, Homo sapiens
  light chain complementarity determining region 3 for antibody 8268
QQNGNSPVP

SEQ ID NO: 16536 - protein, 18 aa, Homo sapiens
  heavy chain complementarity determining region 3 for antibody 8268
ARGDYPEARAGYFLDFDY

SEQ ID NO: 16537 - protein, 9 aa, Homo sapiens
  light chain complementarity determining region 3 for antibody 8269
QQNGDSPVP

SEQ ID NO: 16538 - protein, 18 aa, Homo sapiens
  heavy chain complementarity determining region 3 for antibody 8269
ARGDYPEARTGYFLDFDY

SEQ ID NO: 16539 - protein, 9 aa, Homo sapiens
  light chain complementarity determining region 3 for antibody 8270
QQNDSLPLT

SEQ ID NO: 16540 - protein, 12 aa, Homo sapiens
  heavy chain complementarity determining region 3 for antibody 8270
AKDCSGWGCFDS

SEQ ID NO: 16541 - protein, 10 aa, Homo sapiens
  light chain complementarity determining region 3 for antibody 8271
QQNDNWPPWR

SEQ ID NO: 16542 - protein, 15 aa, Homo sapiens
  heavy chain complementarity determining region 3 for antibody 8271
ARDIRVGASKYYFDY

SEQ ID NO: 16543 - protein, 9 aa, Homo sapiens
  light chain complementarity determining region 3 for antibody 8272
QQNDNLPPA

SEQ ID NO: 16544 - protein, 13 aa, Homo sapiens
  heavy chain complementarity determining region 3 for antibody 8272
TKEGSSAGPDFVY

SEQ ID NO: 16545 - protein, 9 aa, Homo sapiens
  light chain complementarity determining region 3 for antibody 8273
QQNAKSPIT

SEQ ID NO: 16546 - protein, 15 aa, Homo sapiens
  heavy chain complementarity determining region 3 for antibody 8273
ARASRGGYISFLIEF

SEQ ID NO: 16547 - protein, 9 aa, Homo sapiens
  light chain complementarity determining region 3 for antibody 8274
QQLYSYPLT

SEQ ID NO: 16548 - protein, 18 aa, Homo sapiens
  heavy chain complementarity determining region 3 for antibody 8274
AHTPGINCAAGRCYGFAT

SEQ ID NO: 16549 - protein, 9 aa, Homo sapiens
  light chain complementarity determining region 3 for antibody 8275
QQLYSYPLT

SEQ ID NO: 16550 - protein, 18 aa, Homo sapiens
  heavy chain complementarity determining region 3 for antibody 8275
AHPPGINCAAGRCYGFAN

SEQ ID NO: 16551 - protein, 9 aa, Homo sapiens
  light chain complementarity determining region 3 for antibody 8276
QQLYRYPTT

SEQ ID NO: 16552 - protein, 14 aa, Homo sapiens
  heavy chain complementarity determining region 3 for antibody 8276
GRDTTHDWSDGGIY

SEQ ID NO: 16553 - protein, 9 aa, Homo sapiens
  light chain complementarity determining region 3 for antibody 8277
QQLYRYPIT

SEQ ID NO: 16554 - protein, 12 aa, Homo sapiens
  heavy chain complementarity determining region 3 for antibody 8277
NADHGYVDGFDI

SEQ ID NO: 16555 - protein, 9 aa, Homo sapiens
  light chain complementarity determining region 3 for antibody 8278
QQLYRYPIT

SEQ ID NO: 16556 - protein, 14 aa, Homo sapiens
  heavy chain complementarity determining region 3 for antibody 8278
GRDTTNDWSDGGIY

SEQ ID NO: 16557 - protein, 9 aa, Homo sapiens
  light chain complementarity determining region 3 for antibody 8279
QQLYRYPIT

SEQ ID NO: 16558 - protein, 14 aa, Homo sapiens
  heavy chain complementarity determining region 3 for antibody 8279
GRDTTHEWSDGGIY

SEQ ID NO: 16559 - protein, 9 aa, Homo sapiens
  light chain complementarity determining region 3 for antibody 8280
QQLYRYPIT

SEQ ID NO: 16560 - protein, 14 aa, Homo sapiens
  heavy chain complementarity determining region 3 for antibody 8280
GRDTTHDWSGGGIY

SEQ ID NO: 16561 - protein, 9 aa, Homo sapiens
  light chain complementarity determining region 3 for antibody 8281
QQLYRYPIT

SEQ ID NO: 16562 - protein, 14 aa, Homo sapiens
  heavy chain complementarity determining region 3 for antibody 8281
GRDTTHDWSDEGIY

SEQ ID NO: 16563 - protein, 9 aa, Homo sapiens
  light chain complementarity determining region 3 for antibody 8282
QQLYRYPIT

SEQ ID NO: 16564 - protein, 14 aa, Homo sapiens
  heavy chain complementarity determining region 3 for antibody 8282
GRDTTHDWRDGGIY

SEQ ID NO: 16565 - protein, 9 aa, Homo sapiens
  light chain complementarity determining region 3 for antibody 8283
QQLYRYPIT

SEQ ID NO: 16566 - protein, 14 aa, Homo sapiens
  heavy chain complementarity determining region 3 for antibody 8283
GRDTTHDWNDGGIY

SEQ ID NO: 16567 - protein, 9 aa, Homo sapiens
  light chain complementarity determining region 3 for antibody 8284
QQLYRYPIT

SEQ ID NO: 16568 - protein, 14 aa, Homo sapiens
  heavy chain complementarity determining region 3 for antibody 8284
GRDTTHDRSDGGIY

SEQ ID NO: 16569 - protein, 9 aa, Homo sapiens
  light chain complementarity determining region 3 for antibody 8285
QQLYRYPIT

SEQ ID NO: 16570 - protein, 14 aa, Homo sapiens
  heavy chain complementarity determining region 3 for antibody 8285
GRDPTHDWSDGGIY

SEQ ID NO: 16571 - protein, 9 aa, Homo sapiens
  light chain complementarity determining region 3 for antibody 8286
QQLYRYPIT

SEQ ID NO: 16572 - protein, 13 aa, Homo sapiens
  heavy chain complementarity determining region 3 for antibody 8286
AKEGSSPGPDFEY

SEQ ID NO: 16573 - protein, 9 aa, Homo sapiens
  light chain complementarity determining region 3 for antibody 8287
QQLYRYPIP

SEQ ID NO: 16574 - protein, 14 aa, Homo sapiens
  heavy chain complementarity determining region 3 for antibody 8287
GRDTTHEWSDGGIY

SEQ ID NO: 16575 - protein, 9 aa, Homo sapiens
  light chain complementarity determining region 3 for antibody 8288
QQLYNYPVT

SEQ ID NO: 16576 - protein, 18 aa, Homo sapiens
  heavy chain complementarity determining region 3 for antibody 8288
ARGDYPEARSDYSLDFDY

SEQ ID NO: 16577 - protein, 9 aa, Homo sapiens
  light chain complementarity determining region 3 for antibody 8289
QQLYNYPVT

SEQ ID NO: 16578 - protein, 14 aa, Homo sapiens
  heavy chain complementarity determining region 3 for antibody 8289
ARDTTYNWNDGGIS

SEQ ID NO: 16579 - protein, 9 aa, Homo sapiens
  light chain complementarity determining region 3 for antibody 8290
QQLYNYPTT

SEQ ID NO: 16580 - protein, 14 aa, Homo sapiens
  heavy chain complementarity determining region 3 for antibody 8290
ARDTTYNWNDGGIS

SEQ ID NO: 16581 - protein, 9 aa, Homo sapiens
  light chain complementarity determining region 3 for antibody 8291
QQLYNYPLT

SEQ ID NO: 16582 - protein, 14 aa, Homo sapiens
  heavy chain complementarity determining region 3 for antibody 8291
ARDTTHNWNDGGIS

SEQ ID NO: 16583 - protein, 9 aa, Homo sapiens
  light chain complementarity determining region 3 for antibody 8292
QQLYNYPIT

SEQ ID NO: 16584 - protein, 9 aa, Homo sapiens
  heavy chain complementarity determining region 3 for antibody 8292
GSRRPYFDS

SEQ ID NO: 16585 - protein, 9 aa, Homo sapiens
  light chain complementarity determining region 3 for antibody 8293
QQLYNYPIT

SEQ ID NO: 16586 - protein, 16 aa, Homo sapiens
  heavy chain complementarity determining region 3 for antibody 8293
ARWFSRSSTGVSYMDV

SEQ ID NO: 16587 - protein, 9 aa, Homo sapiens
  light chain complementarity determining region 3 for antibody 8294
QQLYNYPIT

SEQ ID NO: 16588 - protein, 14 aa, Homo sapiens
  heavy chain complementarity determining region 3 for antibody 8294
ARGTTHNWNDGGIS

SEQ ID NO: 16589 - protein, 9 aa, Homo sapiens
  light chain complementarity determining region 3 for antibody 8295
QQLYNYPIT

SEQ ID NO: 16590 - protein, 14 aa, Homo sapiens
  heavy chain complementarity determining region 3 for antibody 8295
ARDTTYNWNDVGIS

SEQ ID NO: 16591 - protein, 9 aa, Homo sapiens
  light chain complementarity determining region 3 for antibody 8296
QQLYNYPIT

SEQ ID NO: 16592 - protein, 14 aa, Homo sapiens
  heavy chain complementarity determining region 3 for antibody 8296
ARDTTYNWNDRGIS

SEQ ID NO: 16593 - protein, 9 aa, Homo sapiens
  light chain complementarity determining region 3 for antibody 8297
QQLYNYPIT

SEQ ID NO: 16594 - protein, 14 aa, Homo sapiens
  heavy chain complementarity determining region 3 for antibody 8297
ARDTTYNWNDGGSS

SEQ ID NO: 16595 - protein, 9 aa, Homo sapiens
  light chain complementarity determining region 3 for antibody 8298
QQLYNYPIT

SEQ ID NO: 16596 - protein, 14 aa, Homo sapiens
  heavy chain complementarity determining region 3 for antibody 8298
ARDTTHNWNDGVIS

SEQ ID NO: 16597 - protein, 9 aa, Homo sapiens
  light chain complementarity determining region 3 for antibody 8299
QQLYNYPIT

SEQ ID NO: 16598 - protein, 14 aa, Homo sapiens
  heavy chain complementarity determining region 3 for antibody 8299
ARDTTHNGNDGGIS

SEQ ID NO: 16599 - protein, 9 aa, Homo sapiens
  light chain complementarity determining region 3 for antibody 8300
QQLYNYPFT

SEQ ID NO: 16600 - protein, 14 aa, Homo sapiens
  heavy chain complementarity determining region 3 for antibody 8300
ARDTTYNWNDGGIS

SEQ ID NO: 16601 - protein, 9 aa, Homo sapiens
  light chain complementarity determining region 3 for antibody 8301
QQLYNSPIT

SEQ ID NO: 16602 - protein, 14 aa, Homo sapiens
  heavy chain complementarity determining region 3 for antibody 8301
ARDTTYNWNDGGIS

SEQ ID NO: 16603 - protein, 9 aa, Homo sapiens
  light chain complementarity determining region 3 for antibody 8302
QQLTSYPYT

SEQ ID NO: 16604 - protein, 17 aa, Homo sapiens
  heavy chain complementarity determining region 3 for antibody 8302
ARNTMVHGWQRQGSVDH

SEQ ID NO: 16605 - protein, 9 aa, Homo sapiens
  light chain complementarity determining region 3 for antibody 8303
QQLTSYPYT

SEQ ID NO: 16606 - protein, 10 aa, Homo sapiens
  heavy chain complementarity determining region 3 for antibody 8303
ARETSGAYDI

SEQ ID NO: 16607 - protein, 9 aa, Homo sapiens
  light chain complementarity determining region 3 for antibody 8304
QQLTSSPYT

SEQ ID NO: 16608 - protein, 14 aa, Homo sapiens
  heavy chain complementarity determining region 3 for antibody 8304
ARGHFDSTGFRLDY

SEQ ID NO: 16609 - protein, 9 aa, Homo sapiens
  light chain complementarity determining region 3 for antibody 8305
QQLSSYPYT

SEQ ID NO: 16610 - protein, 14 aa, Homo sapiens
  heavy chain complementarity determining region 3 for antibody 8305
ARGHFDSTGFRLDY

SEQ ID NO: 16611 - protein, 9 aa, Homo sapiens
  light chain complementarity determining region 3 for antibody 8306
QQLSSAPLT

SEQ ID NO: 16612 - protein, 17 aa, Homo sapiens
  heavy chain complementarity determining region 3 for antibody 8306
AKRLPDLLGGGHHYIDV

SEQ ID NO: 16613 - protein, 9 aa, Homo sapiens
  light chain complementarity determining region 3 for antibody 8307
QQLSRYPFT

SEQ ID NO: 16614 - protein, 14 aa, Homo sapiens
  heavy chain complementarity determining region 3 for antibody 8307
GRDTTHDWNDGGIY

SEQ ID NO: 16615 - protein, 9 aa, Homo sapiens
  light chain complementarity determining region 3 for antibody 8308
QQLSNTPLT

SEQ ID NO: 16616 - protein, 17 aa, Homo sapiens
  heavy chain complementarity determining region 3 for antibody 8308
AKRFPDLLGGGHHYIDV

SEQ ID NO: 16617 - protein, 9 aa, Homo sapiens
  light chain complementarity determining region 3 for antibody 8309
QQLSNSPLT

SEQ ID NO: 16618 - protein, 17 aa, Homo sapiens
  heavy chain complementarity determining region 3 for antibody 8309
AKRLPDLLGGGHHYIDV

SEQ ID NO: 16619 - protein, 9 aa, Homo sapiens
  light chain complementarity determining region 3 for antibody 8310
QQLSNATLT

SEQ ID NO: 16620 - protein, 17 aa, Homo sapiens
  heavy chain complementarity determining region 3 for antibody 8310
AKRLPDLLGGGHHYIDV

SEQ ID NO: 16621 - protein, 9 aa, Homo sapiens
  light chain complementarity determining region 3 for antibody 8311
QQLSNAPLT

SEQ ID NO: 16622 - protein, 17 aa, Homo sapiens
  heavy chain complementarity determining region 3 for antibody 8311
SKRLPDLLGGGHHYIDV

SEQ ID NO: 16623 - protein, 9 aa, Homo sapiens
  light chain complementarity determining region 3 for antibody 8312
QQLSNAPLT

SEQ ID NO: 16624 - protein, 9 aa, Homo sapiens
  heavy chain complementarity determining region 3 for antibody 8312
GSRRPYFDS

SEQ ID NO: 16625 - protein, 9 aa, Homo sapiens
  light chain complementarity determining region 3 for antibody 8313
QQLSNAPLT

SEQ ID NO: 16626 - protein, 10 aa, Homo sapiens
  heavy chain complementarity determining region 3 for antibody 8313
CRDRWGFGDV

SEQ ID NO: 16627 - protein, 9 aa, Homo sapiens
  light chain complementarity determining region 3 for antibody 8314
QQLSNAPLT

SEQ ID NO: 16628 - protein, 9 aa, Homo sapiens
  heavy chain complementarity determining region 3 for antibody 8314
ARSEYQPTY

SEQ ID NO: 16629 - protein, 9 aa, Homo sapiens
  light chain complementarity determining region 3 for antibody 8315
QQLSNAPLT

SEQ ID NO: 16630 - protein, 11 aa, Homo sapiens
  heavy chain complementarity determining region 3 for antibody 8315
ARRSLGGAFDY

SEQ ID NO: 16631 - protein, 9 aa, Homo sapiens
  light chain complementarity determining region 3 for antibody 8316
QQLSNAPLT

SEQ ID NO: 16632 - protein, 14 aa, Homo sapiens
  heavy chain complementarity determining region 3 for antibody 8316
ARGTIGDYTDYFPY

SEQ ID NO: 16633 - protein, 9 aa, Homo sapiens
  light chain complementarity determining region 3 for antibody 8317
QQLSNAPLT

SEQ ID NO: 16634 - protein, 10 aa, Homo sapiens
  heavy chain complementarity determining region 3 for antibody 8317
ARETSGSYDI

SEQ ID NO: 16635 - protein, 9 aa, Homo sapiens
  light chain complementarity determining region 3 for antibody 8318
QQLSNAPLT

SEQ ID NO: 16636 - protein, 10 aa, Homo sapiens
  heavy chain complementarity determining region 3 for antibody 8318
ARERSGSYDI

SEQ ID NO: 16637 - protein, 9 aa, Homo sapiens
  light chain complementarity determining region 3 for antibody 8319
QQLSNAPLT

SEQ ID NO: 16638 - protein, 14 aa, Homo sapiens
  heavy chain complementarity determining region 3 for antibody 8319
ARDTTYNWNDGGIS

SEQ ID NO: 16639 - protein, 9 aa, Homo sapiens
  light chain complementarity determining region 3 for antibody 8320
QQLSNAPLT

SEQ ID NO: 16640 - protein, 17 aa, Homo sapiens
  heavy chain complementarity determining region 3 for antibody 8320
AKRLQDLLGGGHHYIDV

SEQ ID NO: 16641 - protein, 9 aa, Homo sapiens
  light chain complementarity determining region 3 for antibody 8321
QQLSNAPLT

SEQ ID NO: 16642 - protein, 17 aa, Homo sapiens
  heavy chain complementarity determining region 3 for antibody 8321
AKRLPDLLWGGHHYIDV

SEQ ID NO: 16643 - protein, 9 aa, Homo sapiens
  light chain complementarity determining region 3 for antibody 8322
QQLSNAPLT

SEQ ID NO: 16644 - protein, 17 aa, Homo sapiens
  heavy chain complementarity determining region 3 for antibody 8322
AKRLPDLLGGGHHYIHV

SEQ ID NO: 16645 - protein, 9 aa, Homo sapiens
  light chain complementarity determining region 3 for antibody 8323
QQLSNAPLT

SEQ ID NO: 16646 - protein, 17 aa, Homo sapiens
  heavy chain complementarity determining region 3 for antibody 8323
AKRLPDLLGGGHHYIDA

SEQ ID NO: 16647 - protein, 9 aa, Homo sapiens
  light chain complementarity determining region 3 for antibody 8324
QQLSNAPLT

SEQ ID NO: 16648 - protein, 17 aa, Homo sapiens
  heavy chain complementarity determining region 3 for antibody 8324
AKRLPDLLGGGHHDIDV

SEQ ID NO: 16649 - protein, 9 aa, Homo sapiens
  light chain complementarity determining region 3 for antibody 8325
QQLSNAPLT

SEQ ID NO: 16650 - protein, 17 aa, Homo sapiens
  heavy chain complementarity determining region 3 for antibody 8325
AKRLPDILGGGHHYIDV

SEQ ID NO: 16651 - protein, 9 aa, Homo sapiens
  light chain complementarity determining region 3 for antibody 8326
QQLSNAPLT

SEQ ID NO: 16652 - protein, 17 aa, Homo sapiens
  heavy chain complementarity determining region 3 for antibody 8326
AKRLPDHLGGGHHYIDV

SEQ ID NO: 16653 - protein, 9 aa, Homo sapiens
  light chain complementarity determining region 3 for antibody 8327
QQLSNAPLT

SEQ ID NO: 16654 - protein, 17 aa, Homo sapiens
  heavy chain complementarity determining region 3 for antibody 8327
AERLPDLLGGGHHYIDV

SEQ ID NO: 16655 - protein, 9 aa, Homo sapiens
  light chain complementarity determining region 3 for antibody 8328
QQLSNAPHT

SEQ ID NO: 16656 - protein, 17 aa, Homo sapiens
  heavy chain complementarity determining region 3 for antibody 8328
AKRLPDLLGGGHHYIDV

SEQ ID NO: 16657 - protein, 9 aa, Homo sapiens
  light chain complementarity determining region 3 for antibody 8329
QQLSDFPRT

SEQ ID NO: 16658 - protein, 9 aa, Homo sapiens
  heavy chain complementarity determining region 3 for antibody 8329
VRGRNNFRY

SEQ ID NO: 16659 - protein, 9 aa, Homo sapiens
  light chain complementarity determining region 3 for antibody 8330
QQLRISPYT

SEQ ID NO: 16660 - protein, 14 aa, Homo sapiens
  heavy chain complementarity determining region 3 for antibody 8330
ARGHFDSTGFRLDY

SEQ ID NO: 16661 - protein, 9 aa, Homo sapiens
  light chain complementarity determining region 3 for antibody 8331
QQLNTYQLT

SEQ ID NO: 16662 - protein, 13 aa, Homo sapiens
  heavy chain complementarity determining region 3 for antibody 8331
TREGDSSGPDFHL

SEQ ID NO: 16663 - protein, 9 aa, Homo sapiens
  light chain complementarity determining region 3 for antibody 8332
QQLNTYPVT

SEQ ID NO: 16664 - protein, 18 aa, Homo sapiens
  heavy chain complementarity determining region 3 for antibody 8332
TRPACSSPGCQGRDHFDP

SEQ ID NO: 16665 - protein, 9 aa, Homo sapiens
  light chain complementarity determining region 3 for antibody 8333
QQLNTYPVT

SEQ ID NO: 16666 - protein, 11 aa, Homo sapiens
  heavy chain complementarity determining region 3 for antibody 8333
ATFGQQWRLAH

SEQ ID NO: 16667 - protein, 9 aa, Homo sapiens
  light chain complementarity determining region 3 for antibody 8334
QQLNTYPLT

SEQ ID NO: 16668 - protein, 13 aa, Homo sapiens
  heavy chain complementarity determining region 3 for antibody 8334
TRGGDSSGPDFHL

SEQ ID NO: 16669 - protein, 9 aa, Homo sapiens
  light chain complementarity determining region 3 for antibody 8335
QQLNTYPLT

SEQ ID NO: 16670 - protein, 13 aa, Homo sapiens
  heavy chain complementarity determining region 3 for antibody 8335
TREGDTSGPDFHL

SEQ ID NO: 16671 - protein, 9 aa, Homo sapiens
  light chain complementarity determining region 3 for antibody 8336
QQLNTYPLT

SEQ ID NO: 16672 - protein, 13 aa, Homo sapiens
  heavy chain complementarity determining region 3 for antibody 8336
TREGDSSGPDFDL

SEQ ID NO: 16673 - protein, 9 aa, Homo sapiens
  light chain complementarity determining region 3 for antibody 8337
QQLNTYPLT

SEQ ID NO: 16674 - protein, 13 aa, Homo sapiens
  heavy chain complementarity determining region 3 for antibody 8337
TREGDSSDPDFHL

SEQ ID NO: 16675 - protein, 9 aa, Homo sapiens
  light chain complementarity determining region 3 for antibody 8338
QQLNTYPLT

SEQ ID NO: 16676 - protein, 13 aa, Homo sapiens
  heavy chain complementarity determining region 3 for antibody 8338
TREGDISGPDFHL

SEQ ID NO: 16677 - protein, 9 aa, Homo sapiens
  light chain complementarity determining region 3 for antibody 8339
QQLNTYPLT

SEQ ID NO: 16678 - protein, 13 aa, Homo sapiens
  heavy chain complementarity determining region 3 for antibody 8339
SREGDSSGPDFHL

SEQ ID NO: 16679 - protein, 9 aa, Homo sapiens
  light chain complementarity determining region 3 for antibody 8340
QQLNTYPLT

SEQ ID NO: 16680 - protein, 10 aa, Homo sapiens
  heavy chain complementarity determining region 3 for antibody 8340
CRDRWGFGDV

SEQ ID NO: 16681 - protein, 9 aa, Homo sapiens
  light chain complementarity determining region 3 for antibody 8341
QQLNTYPLT

SEQ ID NO: 16682 - protein, 17 aa, Homo sapiens
  heavy chain complementarity determining region 3 for antibody 8341
AKGRGSVAMALIYYLDL

SEQ ID NO: 16683 - protein, 9 aa, Homo sapiens
  light chain complementarity determining region 3 for antibody 8342
QQLNSYSYT

SEQ ID NO: 16684 - protein, 14 aa, Homo sapiens
  heavy chain complementarity determining region 3 for antibody 8342
ARGHFDSTGFRLDY

SEQ ID NO: 16685 - protein, 9 aa, Homo sapiens
  light chain complementarity determining region 3 for antibody 8343
QQLNSYQYT

SEQ ID NO: 16686 - protein, 14 aa, Homo sapiens
  heavy chain complementarity determining region 3 for antibody 8343
ARGHFDSTGFRLDY

SEQ ID NO: 16687 - protein, 9 aa, Homo sapiens
  light chain complementarity determining region 3 for antibody 8344
QQLNSYPYT

SEQ ID NO: 16688 - protein, 14 aa, Homo sapiens
  heavy chain complementarity determining region 3 for antibody 8344
VREEGSGYYRTADY

SEQ ID NO: 16689 - protein, 9 aa, Homo sapiens
  light chain complementarity determining region 3 for antibody 8345
QQLNSYPYT

SEQ ID NO: 16690 - protein, 16 aa, Homo sapiens
  heavy chain complementarity determining region 3 for antibody 8345
VRDLAGLTRGGSTFDY

SEQ ID NO: 16691 - protein, 9 aa, Homo sapiens
  light chain complementarity determining region 3 for antibody 8346
QQLNSYPYT

SEQ ID NO: 16692 - protein, 18 aa, Homo sapiens
  heavy chain complementarity determining region 3 for antibody 8346
TTVLSQLLAGDWHLYFQH

SEQ ID NO: 16693 - protein, 9 aa, Homo sapiens
  light chain complementarity determining region 3 for antibody 8347
QQLNSYPYT

SEQ ID NO: 16694 - protein, 7 aa, Homo sapiens
  heavy chain complementarity determining region 3 for antibody 8347
TTGDLRN

SEQ ID NO: 16695 - protein, 9 aa, Homo sapiens
  light chain complementarity determining region 3 for antibody 8348
QQLNSYPYT

SEQ ID NO: 16696 - protein, 13 aa, Homo sapiens
  heavy chain complementarity determining region 3 for antibody 8348
TADFYDYVWGPRY

SEQ ID NO: 16697 - protein, 9 aa, Homo sapiens
  light chain complementarity determining region 3 for antibody 8349
QQLNSYPYT

SEQ ID NO: 16698 - protein, 14 aa, Homo sapiens
  heavy chain complementarity determining region 3 for antibody 8349
SRGHFDSTGFRLDY

SEQ ID NO: 16699 - protein, 9 aa, Homo sapiens
  light chain complementarity determining region 3 for antibody 8350
QQLNSYPYT

SEQ ID NO: 16700 - protein, 17 aa, Homo sapiens
  heavy chain complementarity determining region 3 for antibody 8350
SRDGRIIWPGSQGSLDS

SEQ ID NO: 16701 - protein, 9 aa, Homo sapiens
  light chain complementarity determining region 3 for antibody 8351
QQLNSYPYT

SEQ ID NO: 16702 - protein, 12 aa, Homo sapiens
  heavy chain complementarity determining region 3 for antibody 8351
QGGNWGRDGFDV

SEQ ID NO: 16703 - protein, 9 aa, Homo sapiens
  light chain complementarity determining region 3 for antibody 8352
QQLNSYPYT

SEQ ID NO: 16704 - protein, 9 aa, Homo sapiens
  heavy chain complementarity determining region 3 for antibody 8352
GSRRPYFDY

SEQ ID NO: 16705 - protein, 9 aa, Homo sapiens
  light chain complementarity determining region 3 for antibody 8353
QQLNSYPYT

SEQ ID NO: 16706 - protein, 10 aa, Homo sapiens
  heavy chain complementarity determining region 3 for antibody 8353
GRETSGAYDI

SEQ ID NO: 16707 - protein, 9 aa, Homo sapiens
  light chain complementarity determining region 3 for antibody 8354
QQLNSYPYT

SEQ ID NO: 16708 - protein, 10 aa, Homo sapiens
  heavy chain complementarity determining region 3 for antibody 8354
ARRWERYFDY

SEQ ID NO: 16709 - protein, 9 aa, Homo sapiens
  light chain complementarity determining region 3 for antibody 8355
QQLNSYPYT

SEQ ID NO: 16710 - protein, 14 aa, Homo sapiens
  heavy chain complementarity determining region 3 for antibody 8355
ARRHCDSTGFRLDY

SEQ ID NO: 16711 - protein, 9 aa, Homo sapiens
  light chain complementarity determining region 3 for antibody 8356
QQLNSYPYT

SEQ ID NO: 16712 - protein, 15 aa, Homo sapiens
  heavy chain complementarity determining region 3 for antibody 8356
ARIWTSSTNCRYMDV

SEQ ID NO: 16713 - protein, 9 aa, Homo sapiens
  light chain complementarity determining region 3 for antibody 8357
QQLNSYPYT

SEQ ID NO: 16714 - protein, 14 aa, Homo sapiens
  heavy chain complementarity determining region 3 for antibody 8357
ARGYYDSTGFRLDY

SEQ ID NO: 16715 - protein, 9 aa, Homo sapiens
  light chain complementarity determining region 3 for antibody 8358
QQLNSYPYT

SEQ ID NO: 16716 - protein, 14 aa, Homo sapiens
  heavy chain complementarity determining region 3 for antibody 8358
ARGRFDSAGFRLDY

SEQ ID NO: 16717 - protein, 9 aa, Homo sapiens
  light chain complementarity determining region 3 for antibody 8359
QQLNSYPYT

SEQ ID NO: 16718 - protein, 14 aa, Homo sapiens
  heavy chain complementarity determining region 3 for antibody 8359
ARGRCDSTGFRLDY

SEQ ID NO: 16719 - protein, 9 aa, Homo sapiens
  light chain complementarity determining region 3 for antibody 8360
QQLNSYPYT

SEQ ID NO: 16720 - protein, 12 aa, Homo sapiens
  heavy chain complementarity determining region 3 for antibody 8360
ARGPLKMAGGSS

SEQ ID NO: 16721 - protein, 9 aa, Homo sapiens
  light chain complementarity determining region 3 for antibody 8361
QQLNSYPYT

SEQ ID NO: 16722 - protein, 14 aa, Homo sapiens
  heavy chain complementarity determining region 3 for antibody 8361
ARGHLDSTGFRLDY

SEQ ID NO: 16723 - protein, 9 aa, Homo sapiens
  light chain complementarity determining region 3 for antibody 8362
QQLNSYPYT

SEQ ID NO: 16724 - protein, 14 aa, Homo sapiens
  heavy chain complementarity determining region 3 for antibody 8362
ARGHFNSTGFRLDY

SEQ ID NO: 16725 - protein, 9 aa, Homo sapiens
  light chain complementarity determining region 3 for antibody 8363
QQLNSYPYT

SEQ ID NO: 16726 - protein, 14 aa, Homo sapiens
  heavy chain complementarity determining region 3 for antibody 8363
ARGHFDTTGFRLDY

SEQ ID NO: 16727 - protein, 9 aa, Homo sapiens
  light chain complementarity determining region 3 for antibody 8364
QQLNSYPYT

SEQ ID NO: 16728 - protein, 14 aa, Homo sapiens
  heavy chain complementarity determining region 3 for antibody 8364
ARGHFDSTSFRLDY

SEQ ID NO: 16729 - protein, 9 aa, Homo sapiens
  light chain complementarity determining region 3 for antibody 8365
QQLNSYPYT

SEQ ID NO: 16730 - protein, 14 aa, Homo sapiens
  heavy chain complementarity determining region 3 for antibody 8365
ARGHFDSTGSRLDY

SEQ ID NO: 16731 - protein, 9 aa, Homo sapiens
  light chain complementarity determining region 3 for antibody 8366
QQLNSYPYT

SEQ ID NO: 16732 - protein, 14 aa, Homo sapiens
  heavy chain complementarity determining region 3 for antibody 8366
ARGHFDSTGFRRDY

SEQ ID NO: 16733 - protein, 9 aa, Homo sapiens
  light chain complementarity determining region 3 for antibody 8367
QQLNSYPYT

SEQ ID NO: 16734 - protein, 14 aa, Homo sapiens
  heavy chain complementarity determining region 3 for antibody 8367
ARGHFDSPGFRLDY

SEQ ID NO: 16735 - protein, 9 aa, Homo sapiens
  light chain complementarity determining region 3 for antibody 8368
QQLNSYPYT

SEQ ID NO: 16736 - protein, 14 aa, Homo sapiens
  heavy chain complementarity determining region 3 for antibody 8368
ARGHFASTGFRLDY

SEQ ID NO: 16737 - protein, 9 aa, Homo sapiens
  light chain complementarity determining region 3 for antibody 8369
QQLNSYPYT

SEQ ID NO: 16738 - protein, 10 aa, Homo sapiens
  heavy chain complementarity determining region 3 for antibody 8369
ARETYGAYDI

SEQ ID NO: 16739 - protein, 9 aa, Homo sapiens
  light chain complementarity determining region 3 for antibody 8370
QQLNSYPYT

SEQ ID NO: 16740 - protein, 10 aa, Homo sapiens
  heavy chain complementarity determining region 3 for antibody 8370
ARETSGAYDV

SEQ ID NO: 16741 - protein, 9 aa, Homo sapiens
  light chain complementarity determining region 3 for antibody 8371
QQLNSYPYT

SEQ ID NO: 16742 - protein, 10 aa, Homo sapiens
  heavy chain complementarity determining region 3 for antibody 8371
ARETSGAYDN

SEQ ID NO: 16743 - protein, 9 aa, Homo sapiens
  light chain complementarity determining region 3 for antibody 8372
QQLNSYPYT

SEQ ID NO: 16744 - protein, 19 aa, Homo sapiens
  heavy chain complementarity determining region 3 for antibody 8372
ARERVRCRSGICYDATFDI

SEQ ID NO: 16745 - protein, 9 aa, Homo sapiens
  light chain complementarity determining region 3 for antibody 8373
QQLNSYPYT

SEQ ID NO: 16746 - protein, 10 aa, Homo sapiens
  heavy chain complementarity determining region 3 for antibody 8373
AREASGAYDI

SEQ ID NO: 16747 - protein, 9 aa, Homo sapiens
  light chain complementarity determining region 3 for antibody 8374
QQLNSYPYT

SEQ ID NO: 16748 - protein, 14 aa, Homo sapiens
  heavy chain complementarity determining region 3 for antibody 8374
ARDVHTTGWTLGGY

SEQ ID NO: 16749 - protein, 9 aa, Homo sapiens
  light chain complementarity determining region 3 for antibody 8375
QQLNSYPYT

SEQ ID NO: 16750 - protein, 10 aa, Homo sapiens
  heavy chain complementarity determining region 3 for antibody 8375
AKYLRRAFDV

SEQ ID NO: 16751 - protein, 9 aa, Homo sapiens
  light chain complementarity determining region 3 for antibody 8376
QQLNSYPYT

SEQ ID NO: 16752 - protein, 14 aa, Homo sapiens
  heavy chain complementarity determining region 3 for antibody 8376
AKGHFDSTGFRLDY

SEQ ID NO: 16753 - protein, 9 aa, Homo sapiens
  light chain complementarity determining region 3 for antibody 8377
QQLNSYPYT

SEQ ID NO: 16754 - protein, 10 aa, Homo sapiens
  heavy chain complementarity determining region 3 for antibody 8377
AKETSGAYDI

SEQ ID NO: 16755 - protein, 9 aa, Homo sapiens
  light chain complementarity determining region 3 for antibody 8378
QQLNSYPYT

SEQ ID NO: 16756 - protein, 13 aa, Homo sapiens
  heavy chain complementarity determining region 3 for antibody 8378
AKEGSSPGPDFEY

SEQ ID NO: 16757 - protein, 9 aa, Homo sapiens
  light chain complementarity determining region 3 for antibody 8379
QQLNSYPYT

SEQ ID NO: 16758 - protein, 13 aa, Homo sapiens
  heavy chain complementarity determining region 3 for antibody 8379
AKEGSSPGPDFDY

SEQ ID NO: 16759 - protein, 9 aa, Homo sapiens
  light chain complementarity determining region 3 for antibody 8380
QQLNSYPYT

SEQ ID NO: 16760 - protein, 13 aa, Homo sapiens
  heavy chain complementarity determining region 3 for antibody 8380
AKEGSAPGPDFEY

SEQ ID NO: 16761 - protein, 9 aa, Homo sapiens
  light chain complementarity determining region 3 for antibody 8381
QQLNSYPYT

SEQ ID NO: 16762 - protein, 12 aa, Homo sapiens
  heavy chain complementarity determining region 3 for antibody 8381
AKDRGGRSGMDV

SEQ ID NO: 16763 - protein, 9 aa, Homo sapiens
  light chain complementarity determining region 3 for antibody 8382
QQLNSYPYT

SEQ ID NO: 16764 - protein, 12 aa, Homo sapiens
  heavy chain complementarity determining region 3 for antibody 8382
AIVVPGRWDLDD

SEQ ID NO: 16765 - protein, 9 aa, Homo sapiens
  light chain complementarity determining region 3 for antibody 8383
QQLNSYPYT

SEQ ID NO: 16766 - protein, 14 aa, Homo sapiens
  heavy chain complementarity determining region 3 for antibody 8383
AIGHFDSTGFRLDY

SEQ ID NO: 16767 - protein, 9 aa, Homo sapiens
  light chain complementarity determining region 3 for antibody 8384
QQLNSYPYT

SEQ ID NO: 16768 - protein, 10 aa, Homo sapiens
  heavy chain complementarity determining region 3 for antibody 8384
AHRINRAFDI

SEQ ID NO: 16769 - protein, 9 aa, Homo sapiens
  light chain complementarity determining region 3 for antibody 8385
QQLNSYPYT

SEQ ID NO: 16770 - protein, 10 aa, Homo sapiens
  heavy chain complementarity determining region 3 for antibody 8385
AGETSGAYDI

SEQ ID NO: 16771 - protein, 9 aa, Homo sapiens
  light chain complementarity determining region 3 for antibody 8386
QQLNSYPYT

SEQ ID NO: 16772 - protein, 10 aa, Homo sapiens
  heavy chain complementarity determining region 3 for antibody 8386
AAGSGWLIEY

SEQ ID NO: 16773 - protein, 9 aa, Homo sapiens
  light chain complementarity determining region 3 for antibody 8387
QQLNSYPYT

SEQ ID NO: 16774 - protein, 13 aa, Homo sapiens
  heavy chain complementarity determining region 3 for antibody 8387
AADGPYGSSAFDY

SEQ ID NO: 16775 - protein, 9 aa, Homo sapiens
  light chain complementarity determining region 3 for antibody 8388
QQLNSYPYN

SEQ ID NO: 16776 - protein, 14 aa, Homo sapiens
  heavy chain complementarity determining region 3 for antibody 8388
ARGHFDSTGFRLDY

SEQ ID NO: 16777 - protein, 9 aa, Homo sapiens
  light chain complementarity determining region 3 for antibody 8389
QQLNSYPYI

SEQ ID NO: 16778 - protein, 14 aa, Homo sapiens
  heavy chain complementarity determining region 3 for antibody 8389
ARGHFDSTGFRLDY

SEQ ID NO: 16779 - protein, 9 aa, Homo sapiens
  light chain complementarity determining region 3 for antibody 8390
QQLNSYPLT

SEQ ID NO: 16780 - protein, 13 aa, Homo sapiens
  heavy chain complementarity determining region 3 for antibody 8390
ARRPGRDYVGFEY

SEQ ID NO: 16781 - protein, 9 aa, Homo sapiens
  light chain complementarity determining region 3 for antibody 8391
QQLNSYPHT

SEQ ID NO: 16782 - protein, 10 aa, Homo sapiens
  heavy chain complementarity determining region 3 for antibody 8391
ARETSGAYDI

SEQ ID NO: 16783 - protein, 9 aa, Homo sapiens
  light chain complementarity determining region 3 for antibody 8392
QQLNSYPCT

SEQ ID NO: 16784 - protein, 14 aa, Homo sapiens
  heavy chain complementarity determining region 3 for antibody 8392
ARGHFDSTGFRLDY

SEQ ID NO: 16785 - protein, 9 aa, Homo sapiens
  light chain complementarity determining region 3 for antibody 8393
QQLNSYPCT

SEQ ID NO: 16786 - protein, 10 aa, Homo sapiens
  heavy chain complementarity determining region 3 for antibody 8393
ARETSGAYDI

SEQ ID NO: 16787 - protein, 9 aa, Homo sapiens
  light chain complementarity determining region 3 for antibody 8394
QQLNSYLYT

SEQ ID NO: 16788 - protein, 14 aa, Homo sapiens
  heavy chain complementarity determining region 3 for antibody 8394
ARGHFDSTGFRLDY

SEQ ID NO: 16789 - protein, 9 aa, Homo sapiens
  light chain complementarity determining region 3 for antibody 8395
QQLNSSQYT

SEQ ID NO: 16790 - protein, 14 aa, Homo sapiens
  heavy chain complementarity determining region 3 for antibody 8395
ARGHFDSTGFRLDY

SEQ ID NO: 16791 - protein, 9 aa, Homo sapiens
  light chain complementarity determining region 3 for antibody 8396
QQLNSSPYT

SEQ ID NO: 16792 - protein, 13 aa, Homo sapiens
  heavy chain complementarity determining region 3 for antibody 8396
TKEGSSAGPDFVY

SEQ ID NO: 16793 - protein, 9 aa, Homo sapiens
  light chain complementarity determining region 3 for antibody 8397
QQLNSSPYT

SEQ ID NO: 16794 - protein, 16 aa, Homo sapiens
  heavy chain complementarity determining region 3 for antibody 8397
ARWFSRSSTGVSYMDV

SEQ ID NO: 16795 - protein, 9 aa, Homo sapiens
  light chain complementarity determining region 3 for antibody 8398
QQLNSSPYT

SEQ ID NO: 16796 - protein, 14 aa, Homo sapiens
  heavy chain complementarity determining region 3 for antibody 8398
ARVHFDSTGFRLDY

SEQ ID NO: 16797 - protein, 9 aa, Homo sapiens
  light chain complementarity determining region 3 for antibody 8399
QQLNSSPYT

SEQ ID NO: 16798 - protein, 9 aa, Homo sapiens
  heavy chain complementarity determining region 3 for antibody 8399
ARSEYQPTY

SEQ ID NO: 16799 - protein, 9 aa, Homo sapiens
  light chain complementarity determining region 3 for antibody 8400
QQLNSSPYT

SEQ ID NO: 16800 - protein, 14 aa, Homo sapiens
  heavy chain complementarity determining region 3 for antibody 8400
ARRHFDSTGFRLDY

SEQ ID NO: 16801 - protein, 9 aa, Homo sapiens
  light chain complementarity determining region 3 for antibody 8401
QQLNSSPYT

SEQ ID NO: 16802 - protein, 17 aa, Homo sapiens
  heavy chain complementarity determining region 3 for antibody 8401
ARNTMVGTWQRQGNLDH

SEQ ID NO: 16803 - protein, 9 aa, Homo sapiens
  light chain complementarity determining region 3 for antibody 8402
QQLNSSPYT

SEQ ID NO: 16804 - protein, 14 aa, Homo sapiens
  heavy chain complementarity determining region 3 for antibody 8402
ARLHGSGLGRWLDP

SEQ ID NO: 16805 - protein, 9 aa, Homo sapiens
  light chain complementarity determining region 3 for antibody 8403
QQLNSSPYT

SEQ ID NO: 16806 - protein, 14 aa, Homo sapiens
  heavy chain complementarity determining region 3 for antibody 8403
ARGPFDSTGFRLDY

SEQ ID NO: 16807 - protein, 9 aa, Homo sapiens
  light chain complementarity determining region 3 for antibody 8404
QQLNSSPYT

SEQ ID NO: 16808 - protein, 14 aa, Homo sapiens
  heavy chain complementarity determining region 3 for antibody 8404
ARGHFDSTGFRLVY

SEQ ID NO: 16809 - protein, 9 aa, Homo sapiens
  light chain complementarity determining region 3 for antibody 8405
QQLNSSPYT

SEQ ID NO: 16810 - protein, 14 aa, Homo sapiens
  heavy chain complementarity determining region 3 for antibody 8405
ARGHFDSTGFRLGY

SEQ ID NO: 16811 - protein, 9 aa, Homo sapiens
  light chain complementarity determining region 3 for antibody 8406
QQLNSSPYT

SEQ ID NO: 16812 - protein, 14 aa, Homo sapiens
  heavy chain complementarity determining region 3 for antibody 8406
ARGHFDSTGFRLDC

SEQ ID NO: 16813 - protein, 9 aa, Homo sapiens
  light chain complementarity determining region 3 for antibody 8407
QQLNSSPYT

SEQ ID NO: 16814 - protein, 14 aa, Homo sapiens
  heavy chain complementarity determining region 3 for antibody 8407
ARGHFDSTGFRFDY

SEQ ID NO: 16815 - protein, 9 aa, Homo sapiens
  light chain complementarity determining region 3 for antibody 8408
QQLNSSPYT

SEQ ID NO: 16816 - protein, 14 aa, Homo sapiens
  heavy chain complementarity determining region 3 for antibody 8408
ARGHFDSTGFCLDY

SEQ ID NO: 16817 - protein, 9 aa, Homo sapiens
  light chain complementarity determining region 3 for antibody 8409
QQLNSSPYT

SEQ ID NO: 16818 - protein, 14 aa, Homo sapiens
  heavy chain complementarity determining region 3 for antibody 8409
ARGHFDSTCFRLDY

SEQ ID NO: 16819 - protein, 9 aa, Homo sapiens
  light chain complementarity determining region 3 for antibody 8410
QQLNSSPYT

SEQ ID NO: 16820 - protein, 14 aa, Homo sapiens
  heavy chain complementarity determining region 3 for antibody 8410
ARGHFDRTGFRLDY

SEQ ID NO: 16821 - protein, 9 aa, Homo sapiens
  light chain complementarity determining region 3 for antibody 8411
QQLNSSPYT

SEQ ID NO: 16822 - protein, 14 aa, Homo sapiens
  heavy chain complementarity determining region 3 for antibody 8411
ARDVHTTGWTLGGY

SEQ ID NO: 16823 - protein, 9 aa, Homo sapiens
  light chain complementarity determining region 3 for antibody 8412
QQLNSSPYT

SEQ ID NO: 16824 - protein, 13 aa, Homo sapiens
  heavy chain complementarity determining region 3 for antibody 8412
AKEGSSPGPDFEY

SEQ ID NO: 16825 - protein, 9 aa, Homo sapiens
  light chain complementarity determining region 3 for antibody 8413
QQLNSSPYT

SEQ ID NO: 16826 - protein, 14 aa, Homo sapiens
  heavy chain complementarity determining region 3 for antibody 8413
AGGHFDSTGFRLDY

SEQ ID NO: 16827 - protein, 9 aa, Homo sapiens
  light chain complementarity determining region 3 for antibody 8414
QQLNSSPCT

SEQ ID NO: 16828 - protein, 14 aa, Homo sapiens
  heavy chain complementarity determining region 3 for antibody 8414
ARGHFDSTGFRLDY

SEQ ID NO: 16829 - protein, 9 aa, Homo sapiens
  light chain complementarity determining region 3 for antibody 8415
QQLNSRPYT

SEQ ID NO: 16830 - protein, 14 aa, Homo sapiens
  heavy chain complementarity determining region 3 for antibody 8415
TRGHFDSTGFRLDY

SEQ ID NO: 16831 - protein, 9 aa, Homo sapiens
  light chain complementarity determining region 3 for antibody 8416
QQLNSFPYT

SEQ ID NO: 16832 - protein, 21 aa, Homo sapiens
  heavy chain complementarity determining region 3 for antibody 8416
ARGSRTDCRSDDTGGRPMFDS

SEQ ID NO: 16833 - protein, 9 aa, Homo sapiens
  light chain complementarity determining region 3 for antibody 8417
QQLNSFPYT

SEQ ID NO: 16834 - protein, 21 aa, Homo sapiens
  heavy chain complementarity determining region 3 for antibody 8417
ARGSRTDCRSDDTGCRPMLDS

SEQ ID NO: 16835 - protein, 9 aa, Homo sapiens
  light chain complementarity determining region 3 for antibody 8418
QQLNSFPYT

SEQ ID NO: 16836 - protein, 21 aa, Homo sapiens
  heavy chain complementarity determining region 3 for antibody 8418
ARGSRTDCRSDDTGCRPMFDA

SEQ ID NO: 16837 - protein, 9 aa, Homo sapiens
  light chain complementarity determining region 3 for antibody 8419
QQLNSFPYT

SEQ ID NO: 16838 - protein, 21 aa, Homo sapiens
  heavy chain complementarity determining region 3 for antibody 8419
ARGSRTDCRSDDTGCRPLFDS

SEQ ID NO: 16839 - protein, 9 aa, Homo sapiens
  light chain complementarity determining region 3 for antibody 8420
QQLNSFPYT

SEQ ID NO: 16840 - protein, 21 aa, Homo sapiens
  heavy chain complementarity determining region 3 for antibody 8420
ARGSRTDCRSDDTGCRHMFDS

SEQ ID NO: 16841 - protein, 9 aa, Homo sapiens
  light chain complementarity determining region 3 for antibody 8421
QQLNSFPYT

SEQ ID NO: 16842 - protein, 14 aa, Homo sapiens
  heavy chain complementarity determining region 3 for antibody 8421
ARGLFDSTGFRLDY

SEQ ID NO: 16843 - protein, 9 aa, Homo sapiens
  light chain complementarity determining region 3 for antibody 8422
QQLNSFPYT

SEQ ID NO: 16844 - protein, 14 aa, Homo sapiens
  heavy chain complementarity determining region 3 for antibody 8422
ARGHFDSTGCRLDY

SEQ ID NO: 16845 - protein, 9 aa, Homo sapiens
  light chain complementarity determining region 3 for antibody 8423
QQLNSDQYT

SEQ ID NO: 16846 - protein, 14 aa, Homo sapiens
  heavy chain complementarity determining region 3 for antibody 8423
ARGHFDSTGFRLDY

SEQ ID NO: 16847 - protein, 9 aa, Homo sapiens
  light chain complementarity determining region 3 for antibody 8424
QQLNSDPYT

SEQ ID NO: 16848 - protein, 14 aa, Homo sapiens
  heavy chain complementarity determining region 3 for antibody 8424
ASGHFDSTGFRLDY

SEQ ID NO: 16849 - protein, 9 aa, Homo sapiens
  light chain complementarity determining region 3 for antibody 8425
QQLNSDPYT

SEQ ID NO: 16850 - protein, 14 aa, Homo sapiens
  heavy chain complementarity determining region 3 for antibody 8425
ARGPFDSTGFRLDY

SEQ ID NO: 16851 - protein, 9 aa, Homo sapiens
  light chain complementarity determining region 3 for antibody 8426
QQLNSDPYT

SEQ ID NO: 16852 - protein, 14 aa, Homo sapiens
  heavy chain complementarity determining region 3 for antibody 8426
ARGHFDSTVFRLDY

SEQ ID NO: 16853 - protein, 9 aa, Homo sapiens
  light chain complementarity determining region 3 for antibody 8427
QQLNSDPYT

SEQ ID NO: 16854 - protein, 14 aa, Homo sapiens
  heavy chain complementarity determining region 3 for antibody 8427
ARGHFDSTGLRLDY

SEQ ID NO: 16855 - protein, 9 aa, Homo sapiens
  light chain complementarity determining region 3 for antibody 8428
QQLNSDPYT

SEQ ID NO: 16856 - protein, 14 aa, Homo sapiens
  heavy chain complementarity determining region 3 for antibody 8428
ARGHFDSTGFRFDY

SEQ ID NO: 16857 - protein, 9 aa, Homo sapiens
  light chain complementarity determining region 3 for antibody 8429
QQLNSDPYT

SEQ ID NO: 16858 - protein, 18 aa, Homo sapiens
  heavy chain complementarity determining region 3 for antibody 8429
AKECCYFDSTSHPNWFDP

SEQ ID NO: 16859 - protein, 9 aa, Homo sapiens
  light chain complementarity determining region 3 for antibody 8430
QQLNSCPYT

SEQ ID NO: 16860 - protein, 14 aa, Homo sapiens
  heavy chain complementarity determining region 3 for antibody 8430
ARGHFDSTGFRLDY

SEQ ID NO: 16861 - protein, 9 aa, Homo sapiens
  light chain complementarity determining region 3 for antibody 8431
QQLNRSPYT

SEQ ID NO: 16862 - protein, 14 aa, Homo sapiens
  heavy chain complementarity determining region 3 for antibody 8431
ARGHFDSTGFRLDY

SEQ ID NO: 16863 - protein, 10 aa, Homo sapiens
  light chain complementarity determining region 3 for antibody 8432
QQLNNWPPLT

SEQ ID NO: 16864 - protein, 15 aa, Homo sapiens
  heavy chain complementarity determining region 3 for antibody 8432
ACPNGRYNRPHYFDY

SEQ ID NO: 16865 - protein, 9 aa, Homo sapiens
  light chain complementarity determining region 3 for antibody 8433
QQLNNSPYT

SEQ ID NO: 16866 - protein, 14 aa, Homo sapiens
  heavy chain complementarity determining region 3 for antibody 8433
ARGHFDSTGFRLDY

SEQ ID NO: 16867 - protein, 10 aa, Homo sapiens
  light chain complementarity determining region 3 for antibody 8434
QQLNGYAPNT

SEQ ID NO: 16868 - protein, 18 aa, Homo sapiens
  heavy chain complementarity determining region 3 for antibody 8434
ATPAARASCYSDGCYVDF

SEQ ID NO: 16869 - protein, 10 aa, Homo sapiens
  light chain complementarity determining region 3 for antibody 8435
QQLNGYAPNT

SEQ ID NO: 16870 - protein, 18 aa, Homo sapiens
  heavy chain complementarity determining region 3 for antibody 8435
ATPAARASCYSDGCYLDF

SEQ ID NO: 16871 - protein, 10 aa, Homo sapiens
  light chain complementarity determining region 3 for antibody 8436
QQLNGYAPNT

SEQ ID NO: 16872 - protein, 18 aa, Homo sapiens
  heavy chain complementarity determining region 3 for antibody 8436
ATPAARASCYSDGCYFDV

SEQ ID NO: 16873 - protein, 10 aa, Homo sapiens
  light chain complementarity determining region 3 for antibody 8437
QQLNGYAPNT

SEQ ID NO: 16874 - protein, 18 aa, Homo sapiens
  heavy chain complementarity determining region 3 for antibody 8437
ATPAARASCYPDGCYFDF

SEQ ID NO: 16875 - protein, 10 aa, Homo sapiens
  light chain complementarity determining region 3 for antibody 8438
QQLNGYAPNT

SEQ ID NO: 16876 - protein, 18 aa, Homo sapiens
  heavy chain complementarity determining region 3 for antibody 8438
ATPAARASCYADGCYFDF

SEQ ID NO: 16877 - protein, 10 aa, Homo sapiens
  light chain complementarity determining region 3 for antibody 8439
QQLNGYAPNT

SEQ ID NO: 16878 - protein, 18 aa, Homo sapiens
  heavy chain complementarity determining region 3 for antibody 8439
ATPAARASCDSDGCYFDF

SEQ ID NO: 16879 - protein, 10 aa, Homo sapiens
  light chain complementarity determining region 3 for antibody 8440
QQLNGYAPNT

SEQ ID NO: 16880 - protein, 18 aa, Homo sapiens
  heavy chain complementarity determining region 3 for antibody 8440
ATPAARARCYSDGCYFDF

SEQ ID NO: 16881 - protein, 10 aa, Homo sapiens
  light chain complementarity determining region 3 for antibody 8441
QQLNGYAPNT

SEQ ID NO: 16882 - protein, 18 aa, Homo sapiens
  heavy chain complementarity determining region 3 for antibody 8441
ATPAAGASCYSDGCYFDF

SEQ ID NO: 16883 - protein, 10 aa, Homo sapiens
  light chain complementarity determining region 3 for antibody 8442
QQLNGYAPNP

SEQ ID NO: 16884 - protein, 18 aa, Homo sapiens
  heavy chain complementarity determining region 3 for antibody 8442
ATPAARASCYSDGCYFDF

SEQ ID NO: 16885 - protein, 9 aa, Homo sapiens
  light chain complementarity determining region 3 for antibody 8443
QQLNEYSIT

SEQ ID NO: 16886 - protein, 18 aa, Homo sapiens
  heavy chain complementarity determining region 3 for antibody 8443
TRPDCSSHGCQGRDQFDP

SEQ ID NO: 16887 - protein, 9 aa, Homo sapiens
  light chain complementarity determining region 3 for antibody 8444
QQLNASPYT

SEQ ID NO: 16888 - protein, 14 aa, Homo sapiens
  heavy chain complementarity determining region 3 for antibody 8444
TRGHFDTTGFRLDY

SEQ ID NO: 16889 - protein, 9 aa, Homo sapiens
  light chain complementarity determining region 3 for antibody 8445
QQLMVYPYT

SEQ ID NO: 16890 - protein, 14 aa, Homo sapiens
  heavy chain complementarity determining region 3 for antibody 8445
TRRHFDSTGFRLDY

SEQ ID NO: 16891 - protein, 9 aa, Homo sapiens
  light chain complementarity determining region 3 for antibody 8446
QQLMVYPYT

SEQ ID NO: 16892 - protein, 14 aa, Homo sapiens
  heavy chain complementarity determining region 3 for antibody 8446
TRGHFDSTGIRLDY

SEQ ID NO: 16893 - protein, 9 aa, Homo sapiens
  light chain complementarity determining region 3 for antibody 8447
QQLMVYPYT

SEQ ID NO: 16894 - protein, 14 aa, Homo sapiens
  heavy chain complementarity determining region 3 for antibody 8447
TRGHFDSTGFRRDY

SEQ ID NO: 16895 - protein, 9 aa, Homo sapiens
  light chain complementarity determining region 3 for antibody 8448
QQLMVYPYT

SEQ ID NO: 16896 - protein, 14 aa, Homo sapiens
  heavy chain complementarity determining region 3 for antibody 8448
TRGHFDSTGFRPDY

SEQ ID NO: 16897 - protein, 9 aa, Homo sapiens
  light chain complementarity determining region 3 for antibody 8449
QQLMVYPYT

SEQ ID NO: 16898 - protein, 14 aa, Homo sapiens
  heavy chain complementarity determining region 3 for antibody 8449
TRGHFDSSGFRLDD

SEQ ID NO: 16899 - protein, 9 aa, Homo sapiens
  light chain complementarity determining region 3 for antibody 8450
QQLMVYPYT

SEQ ID NO: 16900 - protein, 14 aa, Homo sapiens
  heavy chain complementarity determining region 3 for antibody 8450
TRGHFDSPGFRLDY

SEQ ID NO: 16901 - protein, 9 aa, Homo sapiens
  light chain complementarity determining region 3 for antibody 8451
QQLMVYPYT

SEQ ID NO: 16902 - protein, 10 aa, Homo sapiens
  heavy chain complementarity determining region 3 for antibody 8451
CRDRWGFGDV

SEQ ID NO: 16903 - protein, 9 aa, Homo sapiens
  light chain complementarity determining region 3 for antibody 8452
QQLMVYPYT

SEQ ID NO: 16904 - protein, 12 aa, Homo sapiens
  heavy chain complementarity determining region 3 for antibody 8452
ARLDWNYRAFDI

SEQ ID NO: 16905 - protein, 9 aa, Homo sapiens
  light chain complementarity determining region 3 for antibody 8453
QQLMVYPYT

SEQ ID NO: 16906 - protein, 14 aa, Homo sapiens
  heavy chain complementarity determining region 3 for antibody 8453
ARGHVDTTGFRLDY

SEQ ID NO: 16907 - protein, 9 aa, Homo sapiens
  light chain complementarity determining region 3 for antibody 8454
QQLMVYPYT

SEQ ID NO: 16908 - protein, 10 aa, Homo sapiens
  heavy chain complementarity determining region 3 for antibody 8454
ARETSGAYDI

SEQ ID NO: 16909 - protein, 9 aa, Homo sapiens
  light chain complementarity determining region 3 for antibody 8455
QQLMVYPYT

SEQ ID NO: 16910 - protein, 9 aa, Homo sapiens
  heavy chain complementarity determining region 3 for antibody 8455
AGWGGLSNY

SEQ ID NO: 16911 - protein, 9 aa, Homo sapiens
  light chain complementarity determining region 3 for antibody 8456
QQLMVYPHT

SEQ ID NO: 16912 - protein, 14 aa, Homo sapiens
  heavy chain complementarity determining region 3 for antibody 8456
TRGHFDSTGFRLDY

SEQ ID NO: 16913 - protein, 9 aa, Homo sapiens
  light chain complementarity determining region 3 for antibody 8457
QQLMVHPYT

SEQ ID NO: 16914 - protein, 14 aa, Homo sapiens
  heavy chain complementarity determining region 3 for antibody 8457
TRGHFDSTGFRLDY

SEQ ID NO: 16915 - protein, 9 aa, Homo sapiens
  light chain complementarity determining region 3 for antibody 8458
QQLMSYPYT

SEQ ID NO: 16916 - protein, 7 aa, Homo sapiens
  heavy chain complementarity determining region 3 for antibody 8458
TTGDLRN

SEQ ID NO: 16917 - protein, 9 aa, Homo sapiens
  light chain complementarity determining region 3 for antibody 8459
QQLMSYPYT

SEQ ID NO: 16918 - protein, 14 aa, Homo sapiens
  heavy chain complementarity determining region 3 for antibody 8459
TRGHFDSTGFRLDY

SEQ ID NO: 16919 - protein, 9 aa, Homo sapiens
  light chain complementarity determining region 3 for antibody 8460
QQLMSYPYT

SEQ ID NO: 16920 - protein, 10 aa, Homo sapiens
  heavy chain complementarity determining region 3 for antibody 8460
CRDREGFGDV

SEQ ID NO: 16921 - protein, 9 aa, Homo sapiens
  light chain complementarity determining region 3 for antibody 8461
QQLMSYPYT

SEQ ID NO: 16922 - protein, 17 aa, Homo sapiens
  heavy chain complementarity determining region 3 for antibody 8461
ARNTMVYGWQRQGSVDH

SEQ ID NO: 16923 - protein, 9 aa, Homo sapiens
  light chain complementarity determining region 3 for antibody 8462
QQLMSYPYT

SEQ ID NO: 16924 - protein, 17 aa, Homo sapiens
  heavy chain complementarity determining region 3 for antibody 8462
ARNTMVHGWQRQGSFDH

SEQ ID NO: 16925 - protein, 9 aa, Homo sapiens
  light chain complementarity determining region 3 for antibody 8463
QQLMSYPYT

SEQ ID NO: 16926 - protein, 17 aa, Homo sapiens
  heavy chain complementarity determining region 3 for antibody 8463
ARNTMVHGWQRQGSADH

SEQ ID NO: 16927 - protein, 9 aa, Homo sapiens
  light chain complementarity determining region 3 for antibody 8464
QQLMSYPYT

SEQ ID NO: 16928 - protein, 17 aa, Homo sapiens
  heavy chain complementarity determining region 3 for antibody 8464
ARNTMVHGWQRQGRVDH

SEQ ID NO: 16929 - protein, 9 aa, Homo sapiens
  light chain complementarity determining region 3 for antibody 8465
QQLMSYPYT

SEQ ID NO: 16930 - protein, 17 aa, Homo sapiens
  heavy chain complementarity determining region 3 for antibody 8465
ARNTMVHGLQRQGSVDH

SEQ ID NO: 16931 - protein, 9 aa, Homo sapiens
  light chain complementarity determining region 3 for antibody 8466
QQLMSYPYT

SEQ ID NO: 16932 - protein, 17 aa, Homo sapiens
  heavy chain complementarity determining region 3 for antibody 8466
ARNTMVGTWQRQGNLDH

SEQ ID NO: 16933 - protein, 9 aa, Homo sapiens
  light chain complementarity determining region 3 for antibody 8467
QQLMSYPYT

SEQ ID NO: 16934 - protein, 14 aa, Homo sapiens
  heavy chain complementarity determining region 3 for antibody 8467
ARGHFGSTGFRLDY

SEQ ID NO: 16935 - protein, 9 aa, Homo sapiens
  light chain complementarity determining region 3 for antibody 8468
QQLMSYPYT

SEQ ID NO: 16936 - protein, 17 aa, Homo sapiens
  heavy chain complementarity determining region 3 for antibody 8468
ARDTMVHGWQRQGSVDH

SEQ ID NO: 16937 - protein, 9 aa, Homo sapiens
  light chain complementarity determining region 3 for antibody 8469
QQLMSYPYT

SEQ ID NO: 16938 - protein, 13 aa, Homo sapiens
  heavy chain complementarity determining region 3 for antibody 8469
AKEGSAPGPDFEY

SEQ ID NO: 16939 - protein, 9 aa, Homo sapiens
  light chain complementarity determining region 3 for antibody 8470
QQLMFYPYT

SEQ ID NO: 16940 - protein, 14 aa, Homo sapiens
  heavy chain complementarity determining region 3 for antibody 8470
TRGHFDSTGFRLDY

SEQ ID NO: 16941 - protein, 9 aa, Homo sapiens
  light chain complementarity determining region 3 for antibody 8471
QQLMDYPYT

SEQ ID NO: 16942 - protein, 14 aa, Homo sapiens
  heavy chain complementarity determining region 3 for antibody 8471
TRGHFDSTGFRLDY

SEQ ID NO: 16943 - protein, 9 aa, Homo sapiens
  light chain complementarity determining region 3 for antibody 8472
QQLMDSPYT

SEQ ID NO: 16944 - protein, 14 aa, Homo sapiens
  heavy chain complementarity determining region 3 for antibody 8472
TRGHFDSTGFRLDY

SEQ ID NO: 16945 - protein, 9 aa, Homo sapiens
  light chain complementarity determining region 3 for antibody 8473
QQLMCYPYT

SEQ ID NO: 16946 - protein, 14 aa, Homo sapiens
  heavy chain complementarity determining region 3 for antibody 8473
ARGHFDSTGFRLDY

SEQ ID NO: 16947 - protein, 9 aa, Homo sapiens
  light chain complementarity determining region 3 for antibody 8474
QQLLSYPYT

SEQ ID NO: 16948 - protein, 14 aa, Homo sapiens
  heavy chain complementarity determining region 3 for antibody 8474
ARGHFDSTGFRLDY

SEQ ID NO: 16949 - protein, 9 aa, Homo sapiens
  light chain complementarity determining region 3 for antibody 8475
QQLKVYPYT

SEQ ID NO: 16950 - protein, 14 aa, Homo sapiens
  heavy chain complementarity determining region 3 for antibody 8475
TRGHFDSTGFRLDY

SEQ ID NO: 16951 - protein, 9 aa, Homo sapiens
  light chain complementarity determining region 3 for antibody 8476
QQLKTYPIT

SEQ ID NO: 16952 - protein, 14 aa, Homo sapiens
  heavy chain complementarity determining region 3 for antibody 8476
VRETTHNWTDGVIY

SEQ ID NO: 16953 - protein, 9 aa, Homo sapiens
  light chain complementarity determining region 3 for antibody 8477
QQLKSYPLT

SEQ ID NO: 16954 - protein, 19 aa, Homo sapiens
  heavy chain complementarity determining region 3 for antibody 8477
AKGLYYYDSSGYNCEYLHH

SEQ ID NO: 16955 - protein, 9 aa, Homo sapiens
  light chain complementarity determining region 3 for antibody 8478
QQLISYPYT

SEQ ID NO: 16956 - protein, 17 aa, Homo sapiens
  heavy chain complementarity determining region 3 for antibody 8478
ARNTMVHGWQRQGSVDH

SEQ ID NO: 16957 - protein, 9 aa, Homo sapiens
  light chain complementarity determining region 3 for antibody 8479
QQLINAPLT

SEQ ID NO: 16958 - protein, 17 aa, Homo sapiens
  heavy chain complementarity determining region 3 for antibody 8479
AKRLPDLLGGGHHYIDV

SEQ ID NO: 16959 - protein, 9 aa, Homo sapiens
  light chain complementarity determining region 3 for antibody 8480
QQLIASPYT

SEQ ID NO: 16960 - protein, 14 aa, Homo sapiens
  heavy chain complementarity determining region 3 for antibody 8480
TRGHFDSTGFRLDY

SEQ ID NO: 16961 - protein, 9 aa, Homo sapiens
  light chain complementarity determining region 3 for antibody 8481
QQLHSYPYT

SEQ ID NO: 16962 - protein, 14 aa, Homo sapiens
  heavy chain complementarity determining region 3 for antibody 8481
ARRHFDTTGFRLDY

SEQ ID NO: 16963 - protein, 9 aa, Homo sapiens
  light chain complementarity determining region 3 for antibody 8482
QQLHSYPYT

SEQ ID NO: 16964 - protein, 14 aa, Homo sapiens
  heavy chain complementarity determining region 3 for antibody 8482
ARGRFDTTGFRLDY

SEQ ID NO: 16965 - protein, 9 aa, Homo sapiens
  light chain complementarity determining region 3 for antibody 8483
QQLHSYPYT

SEQ ID NO: 16966 - protein, 14 aa, Homo sapiens
  heavy chain complementarity determining region 3 for antibody 8483
ARGRFDSTGFRLDY

SEQ ID NO: 16967 - protein, 9 aa, Homo sapiens
  light chain complementarity determining region 3 for antibody 8484
QQLHSYPYT

SEQ ID NO: 16968 - protein, 14 aa, Homo sapiens
  heavy chain complementarity determining region 3 for antibody 8484
ARGHLDTTGFRLDY

SEQ ID NO: 16969 - protein, 9 aa, Homo sapiens
  light chain complementarity determining region 3 for antibody 8485
QQLHSYPYT

SEQ ID NO: 16970 - protein, 14 aa, Homo sapiens
  heavy chain complementarity determining region 3 for antibody 8485
ARGHLDSTGFRLDY

SEQ ID NO: 16971 - protein, 9 aa, Homo sapiens
  light chain complementarity determining region 3 for antibody 8486
QQLHSYPYT

SEQ ID NO: 16972 - protein, 14 aa, Homo sapiens
  heavy chain complementarity determining region 3 for antibody 8486
ARGHFDTTGVRLDY

SEQ ID NO: 16973 - protein, 9 aa, Homo sapiens
  light chain complementarity determining region 3 for antibody 8487
QQLHSYPYT

SEQ ID NO: 16974 - protein, 14 aa, Homo sapiens
  heavy chain complementarity determining region 3 for antibody 8487
ARGHFDTTGFRIDY

SEQ ID NO: 16975 - protein, 9 aa, Homo sapiens
  light chain complementarity determining region 3 for antibody 8488
QQLHSYPYT

SEQ ID NO: 16976 - protein, 14 aa, Homo sapiens
  heavy chain complementarity determining region 3 for antibody 8488
ARGHFDTTGCRLDY

SEQ ID NO: 16977 - protein, 9 aa, Homo sapiens
  light chain complementarity determining region 3 for antibody 8489
QQLHSYPYT

SEQ ID NO: 16978 - protein, 14 aa, Homo sapiens
  heavy chain complementarity determining region 3 for antibody 8489
ARGHFDSTGVRLDY

SEQ ID NO: 16979 - protein, 9 aa, Homo sapiens
  light chain complementarity determining region 3 for antibody 8490
QQLHSYPYT

SEQ ID NO: 16980 - protein, 14 aa, Homo sapiens
  heavy chain complementarity determining region 3 for antibody 8490
ARGHFDSTGFRPDY

SEQ ID NO: 16981 - protein, 9 aa, Homo sapiens
  light chain complementarity determining region 3 for antibody 8491
QQLHSYPYT

SEQ ID NO: 16982 - protein, 14 aa, Homo sapiens
  heavy chain complementarity determining region 3 for antibody 8491
ARGHFDSAGFRLDY

SEQ ID NO: 16983 - protein, 9 aa, Homo sapiens
  light chain complementarity determining region 3 for antibody 8492
QQLHSYPYT

SEQ ID NO: 16984 - protein, 14 aa, Homo sapiens
  heavy chain complementarity determining region 3 for antibody 8492
ARGHFDPTGFRLDY

SEQ ID NO: 16985 - protein, 9 aa, Homo sapiens
  light chain complementarity determining region 3 for antibody 8493
QQLHSYPYT

SEQ ID NO: 16986 - protein, 10 aa, Homo sapiens
  heavy chain complementarity determining region 3 for antibody 8493
ARETSGAYDI

SEQ ID NO: 16987 - protein, 9 aa, Homo sapiens
  light chain complementarity determining region 3 for antibody 8494
QQLHSYPYT

SEQ ID NO: 16988 - protein, 13 aa, Homo sapiens
  heavy chain complementarity determining region 3 for antibody 8494
AKEGSSPGPDFEY

SEQ ID NO: 16989 - protein, 9 aa, Homo sapiens
  light chain complementarity determining region 3 for antibody 8495
QQLHSSPYT

SEQ ID NO: 16990 - protein, 14 aa, Homo sapiens
  heavy chain complementarity determining region 3 for antibody 8495
DRGHFDSTGFRLDY

SEQ ID NO: 16991 - protein, 9 aa, Homo sapiens
  light chain complementarity determining region 3 for antibody 8496
QQLHSSPYT

SEQ ID NO: 16992 - protein, 14 aa, Homo sapiens
  heavy chain complementarity determining region 3 for antibody 8496
ARGPFDSTGFRLDY

SEQ ID NO: 16993 - protein, 9 aa, Homo sapiens
  light chain complementarity determining region 3 for antibody 8497
QQLHSSPYT

SEQ ID NO: 16994 - protein, 14 aa, Homo sapiens
  heavy chain complementarity determining region 3 for antibody 8497
ARGHFDSTGLRLDY

SEQ ID NO: 16995 - protein, 9 aa, Homo sapiens
  light chain complementarity determining region 3 for antibody 8498
QQLHSSPYT

SEQ ID NO: 16996 - protein, 14 aa, Homo sapiens
  heavy chain complementarity determining region 3 for antibody 8498
ARGHFDSTGFRLGY

SEQ ID NO: 16997 - protein, 9 aa, Homo sapiens
  light chain complementarity determining region 3 for antibody 8499
QQLHSSPYT

SEQ ID NO: 16998 - protein, 11 aa, Homo sapiens
  heavy chain complementarity determining region 3 for antibody 8499
ARGGTLAWFDP

SEQ ID NO: 16999 - protein, 9 aa, Homo sapiens
  light chain complementarity determining region 3 for antibody 8500
QQLHSSPST

SEQ ID NO: 17000 - protein, 14 aa, Homo sapiens
  heavy chain complementarity determining region 3 for antibody 8500
ARGHFDSTGFRLDY

SEQ ID NO: 17001 - protein, 9 aa, Homo sapiens
  light chain complementarity determining region 3 for antibody 8501
QQLHSDPYT

SEQ ID NO: 17002 - protein, 11 aa, Homo sapiens
  heavy chain complementarity determining region 3 for antibody 8501
ATFGQQWRLAH

SEQ ID NO: 17003 - protein, 9 aa, Homo sapiens
  light chain complementarity determining region 3 for antibody 8502
QQLHSDPYT

SEQ ID NO: 17004 - protein, 14 aa, Homo sapiens
  heavy chain complementarity determining region 3 for antibody 8502
ARGRFDSTGFRLDY

SEQ ID NO: 17005 - protein, 9 aa, Homo sapiens
  light chain complementarity determining region 3 for antibody 8503
QQLHSDPYT

SEQ ID NO: 17006 - protein, 14 aa, Homo sapiens
  heavy chain complementarity determining region 3 for antibody 8503
ARGHVDSTGFRLDY

SEQ ID NO: 17007 - protein, 9 aa, Homo sapiens
  light chain complementarity determining region 3 for antibody 8504
QQLHSDPYT

SEQ ID NO: 17008 - protein, 14 aa, Homo sapiens
  heavy chain complementarity determining region 3 for antibody 8504
ARGHFDSTGFRFDY

SEQ ID NO: 17009 - protein, 9 aa, Homo sapiens
  light chain complementarity determining region 3 for antibody 8505
QQLHSDPYT

SEQ ID NO: 17010 - protein, 14 aa, Homo sapiens
  heavy chain complementarity determining region 3 for antibody 8505
ARGHFDSPGFRLDY

SEQ ID NO: 17011 - protein, 9 aa, Homo sapiens
  light chain complementarity determining region 3 for antibody 8506
QQLHSCPYT

SEQ ID NO: 17012 - protein, 14 aa, Homo sapiens
  heavy chain complementarity determining region 3 for antibody 8506
ARGHFDSTGFRLDY

SEQ ID NO: 17013 - protein, 9 aa, Homo sapiens
  light chain complementarity determining region 3 for antibody 8507
QQLHISPYT

SEQ ID NO: 17014 - protein, 10 aa, Homo sapiens
  heavy chain complementarity determining region 3 for antibody 8507
CRDREGFGDV

SEQ ID NO: 17015 - protein, 9 aa, Homo sapiens
  light chain complementarity determining region 3 for antibody 8508
QQLHISPYT

SEQ ID NO: 17016 - protein, 14 aa, Homo sapiens
  heavy chain complementarity determining region 3 for antibody 8508
ARVHFDSTGFRLDY

SEQ ID NO: 17017 - protein, 9 aa, Homo sapiens
  light chain complementarity determining region 3 for antibody 8509
QQLHISPYT

SEQ ID NO: 17018 - protein, 17 aa, Homo sapiens
  heavy chain complementarity determining region 3 for antibody 8509
ARNTMVGTWQRQGNLDH

SEQ ID NO: 17019 - protein, 9 aa, Homo sapiens
  light chain complementarity determining region 3 for antibody 8510
QQLHISPYT

SEQ ID NO: 17020 - protein, 14 aa, Homo sapiens
  heavy chain complementarity determining region 3 for antibody 8510
ARGHVDSTGFRLDY

SEQ ID NO: 17021 - protein, 9 aa, Homo sapiens
  light chain complementarity determining region 3 for antibody 8511
QQLHISPYT

SEQ ID NO: 17022 - protein, 14 aa, Homo sapiens
  heavy chain complementarity determining region 3 for antibody 8511
ARGHFDSTGLRLDY

SEQ ID NO: 17023 - protein, 9 aa, Homo sapiens
  light chain complementarity determining region 3 for antibody 8512
QQLHISPYT

SEQ ID NO: 17024 - protein, 14 aa, Homo sapiens
  heavy chain complementarity determining region 3 for antibody 8512
ARGHFDSTGFRPDY

SEQ ID NO: 17025 - protein, 9 aa, Homo sapiens
  light chain complementarity determining region 3 for antibody 8513
QQLHISPYT

SEQ ID NO: 17026 - protein, 14 aa, Homo sapiens
  heavy chain complementarity determining region 3 for antibody 8513
ARGHFDSAGFRLDY

SEQ ID NO: 17027 - protein, 9 aa, Homo sapiens
  light chain complementarity determining region 3 for antibody 8514
QQLHISPYT

SEQ ID NO: 17028 - protein, 14 aa, Homo sapiens
  heavy chain complementarity determining region 3 for antibody 8514
ARGHFDRTGFRLDY

SEQ ID NO: 17029 - protein, 9 aa, Homo sapiens
  light chain complementarity determining region 3 for antibody 8515
QQLHIDPYT

SEQ ID NO: 17030 - protein, 14 aa, Homo sapiens
  heavy chain complementarity determining region 3 for antibody 8515
ARGHFDSTGFRLDY

SEQ ID NO: 17031 - protein, 9 aa, Homo sapiens
  light chain complementarity determining region 3 for antibody 8516
QQLHGYPIT

SEQ ID NO: 17032 - protein, 10 aa, Homo sapiens
  heavy chain complementarity determining region 3 for antibody 8516
CRDREGLGDV

SEQ ID NO: 17033 - protein, 9 aa, Homo sapiens
  light chain complementarity determining region 3 for antibody 8517
QQLHGYPIT

SEQ ID NO: 17034 - protein, 10 aa, Homo sapiens
  heavy chain complementarity determining region 3 for antibody 8517
CRDREGFVDV

SEQ ID NO: 17035 - protein, 9 aa, Homo sapiens
  light chain complementarity determining region 3 for antibody 8518
QQLGSWPPT

SEQ ID NO: 17036 - protein, 14 aa, Homo sapiens
  heavy chain complementarity determining region 3 for antibody 8518
AKGMTTWYLMVVDY

SEQ ID NO: 17037 - protein, 10 aa, Homo sapiens
  light chain complementarity determining region 3 for antibody 8519
QQLGGSPMYT

SEQ ID NO: 17038 - protein, 13 aa, Homo sapiens
  heavy chain complementarity determining region 3 for antibody 8519
TADFYDYVWGPRY

SEQ ID NO: 17039 - protein, 9 aa, Homo sapiens
  light chain complementarity determining region 3 for antibody 8520
QQLDSYPYT

SEQ ID NO: 17040 - protein, 14 aa, Homo sapiens
  heavy chain complementarity determining region 3 for antibody 8520
ARGHFDSTGFRLDY

SEQ ID NO: 17041 - protein, 9 aa, Homo sapiens
  light chain complementarity determining region 3 for antibody 8521
QQLANLPRT

SEQ ID NO: 17042 - protein, 9 aa, Homo sapiens
  heavy chain complementarity determining region 3 for antibody 8521
VRGRSNFRY

SEQ ID NO: 17043 - protein, 9 aa, Homo sapiens
  light chain complementarity determining region 3 for antibody 8522
QQIYSSPWT

SEQ ID NO: 17044 - protein, 15 aa, Homo sapiens
  heavy chain complementarity determining region 3 for antibody 8522
ARIWTSSTNCRYMDV

SEQ ID NO: 17045 - protein, 9 aa, Homo sapiens
  light chain complementarity determining region 3 for antibody 8523
QQIYNYPIT

SEQ ID NO: 17046 - protein, 14 aa, Homo sapiens
  heavy chain complementarity determining region 3 for antibody 8523
ARDTTYNWNDGGIS

SEQ ID NO: 17047 - protein, 9 aa, Homo sapiens
  light chain complementarity determining region 3 for antibody 8524
QQINSYPYT

SEQ ID NO: 17048 - protein, 10 aa, Homo sapiens
  heavy chain complementarity determining region 3 for antibody 8524
ARETSGAYDI

SEQ ID NO: 17049 - protein, 9 aa, Homo sapiens
  light chain complementarity determining region 3 for antibody 8525
QQINSFPLA

SEQ ID NO: 17050 - protein, 11 aa, Homo sapiens
  heavy chain complementarity determining region 3 for antibody 8525
ARHPPYRPFDH

SEQ ID NO: 17051 - protein, 9 aa, Homo sapiens
  light chain complementarity determining region 3 for antibody 8526
QQINIFPLA

SEQ ID NO: 17052 - protein, 11 aa, Homo sapiens
  heavy chain complementarity determining region 3 for antibody 8526
ARHPPYSPFDH

SEQ ID NO: 17053 - protein, 9 aa, Homo sapiens
  light chain complementarity determining region 3 for antibody 8527
QQIHTYPLT

SEQ ID NO: 17054 - protein, 18 aa, Homo sapiens
  heavy chain complementarity determining region 3 for antibody 8527
AREPNLGGVNTGVRNFDP

SEQ ID NO: 17055 - protein, 9 aa, Homo sapiens
  light chain complementarity determining region 3 for antibody 8528
QQIHTHPLT

SEQ ID NO: 17056 - protein, 14 aa, Homo sapiens
  heavy chain complementarity determining region 3 for antibody 8528
SHPTRAARLPIFDY

SEQ ID NO: 17057 - protein, 9 aa, Homo sapiens
  light chain complementarity determining region 3 for antibody 8529
QQIHSAPPT

SEQ ID NO: 17058 - protein, 13 aa, Homo sapiens
  heavy chain complementarity determining region 3 for antibody 8529
TRFGPTPHTNRDR

SEQ ID NO: 17059 - protein, 9 aa, Homo sapiens
  light chain complementarity determining region 3 for antibody 8530
QQIHASPYT

SEQ ID NO: 17060 - protein, 14 aa, Homo sapiens
  heavy chain complementarity determining region 3 for antibody 8530
TRGHFDTTGFRLDY

SEQ ID NO: 17061 - protein, 9 aa, Homo sapiens
  light chain complementarity determining region 3 for antibody 8531
QQHYSIPPP

SEQ ID NO: 17062 - protein, 14 aa, Homo sapiens
  heavy chain complementarity determining region 3 for antibody 8531
AKGRGGSSYSSLDY

SEQ ID NO: 17063 - protein, 9 aa, Homo sapiens
  light chain complementarity determining region 3 for antibody 8532
QQHYSIPFT

SEQ ID NO: 17064 - protein, 10 aa, Homo sapiens
  heavy chain complementarity determining region 3 for antibody 8532
TTACGGDCAY

SEQ ID NO: 17065 - protein, 9 aa, Homo sapiens
  light chain complementarity determining region 3 for antibody 8533
QQHYSIPFT

SEQ ID NO: 17066 - protein, 10 aa, Homo sapiens
  heavy chain complementarity determining region 3 for antibody 8533
TIACGGDCSY

SEQ ID NO: 17067 - protein, 9 aa, Homo sapiens
  light chain complementarity determining region 3 for antibody 8534
QQHYNTPYP

SEQ ID NO: 17068 - protein, 18 aa, Homo sapiens
  heavy chain complementarity determining region 3 for antibody 8534
ARAADCIGDKCYQSYFDF

SEQ ID NO: 17069 - protein, 9 aa, Homo sapiens
  light chain complementarity determining region 3 for antibody 8535
QQHYNNMYT

SEQ ID NO: 17070 - protein, 17 aa, Homo sapiens
  heavy chain complementarity determining region 3 for antibody 8535
ATFFCGGRSCFQSPFDH

SEQ ID NO: 17071 - protein, 9 aa, Homo sapiens
  light chain complementarity determining region 3 for antibody 8536
QQHYNIPFT

SEQ ID NO: 17072 - protein, 15 aa, Homo sapiens
  heavy chain complementarity determining region 3 for antibody 8536
GKEGPGSSGWLTGHY

SEQ ID NO: 17073 - protein, 9 aa, Homo sapiens
  light chain complementarity determining region 3 for antibody 8537
QQHYLTPGT

SEQ ID NO: 17074 - protein, 12 aa, Homo sapiens
  heavy chain complementarity determining region 3 for antibody 8537
ARDVGWQLPLDS

SEQ ID NO: 17075 - protein, 9 aa, Homo sapiens
  light chain complementarity determining region 3 for antibody 8538
QQHYGTPWT

SEQ ID NO: 17076 - protein, 10 aa, Homo sapiens
  heavy chain complementarity determining region 3 for antibody 8538
ATSTSGWFVY

SEQ ID NO: 17077 - protein, 9 aa, Homo sapiens
  light chain complementarity determining region 3 for antibody 8539
QQHYGTPWT

SEQ ID NO: 17078 - protein, 10 aa, Homo sapiens
  heavy chain complementarity determining region 3 for antibody 8539
ATATSGWYVY

SEQ ID NO: 17079 - protein, 9 aa, Homo sapiens
  light chain complementarity determining region 3 for antibody 8540
QQHYGNMYT

SEQ ID NO: 17080 - protein, 17 aa, Homo sapiens
  heavy chain complementarity determining region 3 for antibody 8540
ATFFCGGRSCFQSPFDH

SEQ ID NO: 17081 - protein, 9 aa, Homo sapiens
  light chain complementarity determining region 3 for antibody 8541
QQHYDVPPT

SEQ ID NO: 17082 - protein, 14 aa, Homo sapiens
  heavy chain complementarity determining region 3 for antibody 8541
ARPLNGWDNYPFDI

SEQ ID NO: 17083 - protein, 9 aa, Homo sapiens
  light chain complementarity determining region 3 for antibody 8542
QQHYDVPLT

SEQ ID NO: 17084 - protein, 14 aa, Homo sapiens
  heavy chain complementarity determining region 3 for antibody 8542
ARPLSGWDNYPFDI

SEQ ID NO: 17085 - protein, 9 aa, Homo sapiens
  light chain complementarity determining region 3 for antibody 8543
QQHYDVPLP

SEQ ID NO: 17086 - protein, 14 aa, Homo sapiens
  heavy chain complementarity determining region 3 for antibody 8543
ARPLNGWDNYPFDI

SEQ ID NO: 17087 - protein, 10 aa, Homo sapiens
  light chain complementarity determining region 3 for antibody 8544
QQHTNWPTIT

SEQ ID NO: 17088 - protein, 13 aa, Homo sapiens
  heavy chain complementarity determining region 3 for antibody 8544
AKPHYYGSGSGDY

SEQ ID NO: 17089 - protein, 7 aa, Homo sapiens
  light chain complementarity determining region 3 for antibody 8545
QQHSTWT

SEQ ID NO: 17090 - protein, 12 aa, Homo sapiens
  heavy chain complementarity determining region 3 for antibody 8545
VKDRGGRSGMDL

SEQ ID NO: 17091 - protein, 9 aa, Homo sapiens
  light chain complementarity determining region 3 for antibody 8546
QQHNSYSHT

SEQ ID NO: 17092 - protein, 14 aa, Homo sapiens
  heavy chain complementarity determining region 3 for antibody 8546
ARDVHTTGWTLGGY

SEQ ID NO: 17093 - protein, 9 aa, Homo sapiens
  light chain complementarity determining region 3 for antibody 8547
QQHNSYPWT

SEQ ID NO: 17094 - protein, 14 aa, Homo sapiens
  heavy chain complementarity determining region 3 for antibody 8547
VREEGSGYYRTADY

SEQ ID NO: 17095 - protein, 9 aa, Homo sapiens
  light chain complementarity determining region 3 for antibody 8548
QQHNSYPWT

SEQ ID NO: 17096 - protein, 15 aa, Homo sapiens
  heavy chain complementarity determining region 3 for antibody 8548
AKEGPGYSGWLTGHY

SEQ ID NO: 17097 - protein, 9 aa, Homo sapiens
  light chain complementarity determining region 3 for antibody 8549
QQHNSYPPT

SEQ ID NO: 17098 - protein, 13 aa, Homo sapiens
  heavy chain complementarity determining region 3 for antibody 8549
AKEGSSPGPDFEY

SEQ ID NO: 17099 - protein, 10 aa, Homo sapiens
  light chain complementarity determining region 3 for antibody 8550
QQHNSYPMYT

SEQ ID NO: 17100 - protein, 12 aa, Homo sapiens
  heavy chain complementarity determining region 3 for antibody 8550
AREGMTTKEFFY

SEQ ID NO: 17101 - protein, 9 aa, Homo sapiens
  light chain complementarity determining region 3 for antibody 8551
QQHNSYPLT

SEQ ID NO: 17102 - protein, 15 aa, Homo sapiens
  heavy chain complementarity determining region 3 for antibody 8551
ARSMVSGTTDDAFDI

SEQ ID NO: 17103 - protein, 9 aa, Homo sapiens
  light chain complementarity determining region 3 for antibody 8552
QQHNSPPYT

SEQ ID NO: 17104 - protein, 15 aa, Homo sapiens
  heavy chain complementarity determining region 3 for antibody 8552
ARHLSGETKVRYFDY

SEQ ID NO: 17105 - protein, 10 aa, Homo sapiens
  light chain complementarity determining region 3 for antibody 8553
QQHNNWPTNT

SEQ ID NO: 17106 - protein, 13 aa, Homo sapiens
  heavy chain complementarity determining region 3 for antibody 8553
AKPHYYGSGSGDY

SEQ ID NO: 17107 - protein, 10 aa, Homo sapiens
  light chain complementarity determining region 3 for antibody 8554
QQHNNWPTIT

SEQ ID NO: 17108 - protein, 11 aa, Homo sapiens
  heavy chain complementarity determining region 3 for antibody 8554
VRVSTGWNFDY

SEQ ID NO: 17109 - protein, 10 aa, Homo sapiens
  light chain complementarity determining region 3 for antibody 8555
QQHNNWPTIP

SEQ ID NO: 17110 - protein, 13 aa, Homo sapiens
  heavy chain complementarity determining region 3 for antibody 8555
AKPHYYGSGSGDY

SEQ ID NO: 17111 - protein, 10 aa, Homo sapiens
  light chain complementarity determining region 3 for antibody 8556
QQHNNWPTFT

SEQ ID NO: 17112 - protein, 13 aa, Homo sapiens
  heavy chain complementarity determining region 3 for antibody 8556
AKPHYYGSGSGDY

SEQ ID NO: 17113 - protein, 9 aa, Homo sapiens
  light chain complementarity determining region 3 for antibody 8557
QQHNNWPFT

SEQ ID NO: 17114 - protein, 10 aa, Homo sapiens
  heavy chain complementarity determining region 3 for antibody 8557
VRSDSPGDDS

SEQ ID NO: 17115 - protein, 10 aa, Homo sapiens
  light chain complementarity determining region 3 for antibody 8558
QQHNNLPTIT

SEQ ID NO: 17116 - protein, 13 aa, Homo sapiens
  heavy chain complementarity determining region 3 for antibody 8558
AKPHYYGSGSGDY

SEQ ID NO: 17117 - protein, 9 aa, Homo sapiens
  light chain complementarity determining region 3 for antibody 8559
QQHLYPPLP

SEQ ID NO: 17118 - protein, 21 aa, Homo sapiens
  heavy chain complementarity determining region 3 for antibody 8559
ARGRRTDCRNGDIGCRPMFDF

SEQ ID NO: 17119 - protein, 9 aa, Homo sapiens
  light chain complementarity determining region 3 for antibody 8560
QQHLNPPLT

SEQ ID NO: 17120 - protein, 21 aa, Homo sapiens
  heavy chain complementarity determining region 3 for antibody 8560
ARGRRTDCRNGDIGCRPMFDF

SEQ ID NO: 17121 - protein, 9 aa, Homo sapiens
  light chain complementarity determining region 3 for antibody 8561
QQHKTAPWT

SEQ ID NO: 17122 - protein, 20 aa, Homo sapiens
  heavy chain complementarity determining region 3 for antibody 8561
TRDARGSISYAYGGGGGLDV

SEQ ID NO: 17123 - protein, 10 aa, Homo sapiens
  light chain complementarity determining region 3 for antibody 8562
QQHKNWPPYT

SEQ ID NO: 17124 - protein, 14 aa, Homo sapiens
  heavy chain complementarity determining region 3 for antibody 8562
ARENCYGVGSCFDY

SEQ ID NO: 17125 - protein, 9 aa, Homo sapiens
  light chain complementarity determining region 3 for antibody 8563
QQHHGYPWT

SEQ ID NO: 17126 - protein, 11 aa, Homo sapiens
  heavy chain complementarity determining region 3 for antibody 8563
ARIVARKPDDY

SEQ ID NO: 17127 - protein, 8 aa, Homo sapiens
  light chain complementarity determining region 3 for antibody 8564
QQHGYSHT

SEQ ID NO: 17128 - protein, 15 aa, Homo sapiens
  heavy chain complementarity determining region 3 for antibody 8564
ARGLLATGGWYYFDY

SEQ ID NO: 17129 - protein, 9 aa, Homo sapiens
  light chain complementarity determining region 3 for antibody 8565
QQHGTFPLS

SEQ ID NO: 17130 - protein, 13 aa, Homo sapiens
  heavy chain complementarity determining region 3 for antibody 8565
ARGINSLSNNFLH

SEQ ID NO: 17131 - protein, 9 aa, Homo sapiens
  light chain complementarity determining region 3 for antibody 8566
QQHGTFPLS

SEQ ID NO: 17132 - protein, 13 aa, Homo sapiens
  heavy chain complementarity determining region 3 for antibody 8566
ARGINILSNNFRH

SEQ ID NO: 17133 - protein, 9 aa, Homo sapiens
  light chain complementarity determining region 3 for antibody 8567
QQHGNSPVP

SEQ ID NO: 17134 - protein, 18 aa, Homo sapiens
  heavy chain complementarity determining region 3 for antibody 8567
ARGDYPEARTGYFLDFDY

SEQ ID NO: 17135 - protein, 9 aa, Homo sapiens
  light chain complementarity determining region 3 for antibody 8568
QQHDTSHFT

SEQ ID NO: 17136 - protein, 10 aa, Homo sapiens
  heavy chain complementarity determining region 3 for antibody 8568
ARDISARFDS

SEQ ID NO: 17137 - protein, 9 aa, Homo sapiens
  light chain complementarity determining region 3 for antibody 8569
QQHDTSHFP

SEQ ID NO: 17138 - protein, 10 aa, Homo sapiens
  heavy chain complementarity determining region 3 for antibody 8569
ARDTSARFDS

SEQ ID NO: 17139 - protein, 9 aa, Homo sapiens
  light chain complementarity determining region 3 for antibody 8570
QQHDTSHFP

SEQ ID NO: 17140 - protein, 10 aa, Homo sapiens
  heavy chain complementarity determining region 3 for antibody 8570
ARDSSARFDS

SEQ ID NO: 17141 - protein, 9 aa, Homo sapiens
  light chain complementarity determining region 3 for antibody 8571
QQHDTSHFP

SEQ ID NO: 17142 - protein, 10 aa, Homo sapiens
  heavy chain complementarity determining region 3 for antibody 8571
ARDIAARFDS

SEQ ID NO: 17143 - protein, 9 aa, Homo sapiens
  light chain complementarity determining region 3 for antibody 8572
QQHDNLPLT

SEQ ID NO: 17144 - protein, 12 aa, Homo sapiens
  heavy chain complementarity determining region 3 for antibody 8572
AIVVPGRWDLDD

SEQ ID NO: 17145 - protein, 8 aa, Homo sapiens
  light chain complementarity determining region 3 for antibody 8573
QQHDNLLT

SEQ ID NO: 17146 - protein, 13 aa, Homo sapiens
  heavy chain complementarity determining region 3 for antibody 8573
ARPYGDYGWAFNI

SEQ ID NO: 17147 - protein, 9 aa, Homo sapiens
  light chain complementarity determining region 3 for antibody 8574
QQHATSHFP

SEQ ID NO: 17148 - protein, 10 aa, Homo sapiens
  heavy chain complementarity determining region 3 for antibody 8574
ARDISARFDS

SEQ ID NO: 17149 - protein, 9 aa, Homo sapiens
  light chain complementarity determining region 3 for antibody 8575
QQGYTTPRT

SEQ ID NO: 17150 - protein, 16 aa, Homo sapiens
  heavy chain complementarity determining region 3 for antibody 8575
AREFPYSSTSVWYFDV

SEQ ID NO: 17151 - protein, 9 aa, Homo sapiens
  light chain complementarity determining region 3 for antibody 8576
QQGYSTPRT

SEQ ID NO: 17152 - protein, 16 aa, Homo sapiens
  heavy chain complementarity determining region 3 for antibody 8576
ARSYDRSNTKVWYFDL

SEQ ID NO: 17153 - protein, 9 aa, Homo sapiens
  light chain complementarity determining region 3 for antibody 8577
QQGYSTPRT

SEQ ID NO: 17154 - protein, 11 aa, Homo sapiens
  heavy chain complementarity determining region 3 for antibody 8577
AREQHGQAPDY

SEQ ID NO: 17155 - protein, 9 aa, Homo sapiens
  light chain complementarity determining region 3 for antibody 8578
QQGYSTPLT

SEQ ID NO: 17156 - protein, 13 aa, Homo sapiens
  heavy chain complementarity determining region 3 for antibody 8578
AKEGSSPGPDFDY

SEQ ID NO: 17157 - protein, 10 aa, Homo sapiens
  light chain complementarity determining region 3 for antibody 8579
QQGYSTPLFT

SEQ ID NO: 17158 - protein, 17 aa, Homo sapiens
  heavy chain complementarity determining region 3 for antibody 8579
ARNTMVGTWQRQGNLDH

SEQ ID NO: 17159 - protein, 9 aa, Homo sapiens
  light chain complementarity determining region 3 for antibody 8580
QQGYNWPKT

SEQ ID NO: 17160 - protein, 7 aa, Homo sapiens
  heavy chain complementarity determining region 3 for antibody 8580
VYQLLNN

SEQ ID NO: 17161 - protein, 9 aa, Homo sapiens
  light chain complementarity determining region 3 for antibody 8581
QQGYKWPKT

SEQ ID NO: 17162 - protein, 7 aa, Homo sapiens
  heavy chain complementarity determining region 3 for antibody 8581
VYQLLSN

SEQ ID NO: 17163 - protein, 9 aa, Homo sapiens
  light chain complementarity determining region 3 for antibody 8582
QQGYKWPKT

SEQ ID NO: 17164 - protein, 7 aa, Homo sapiens
  heavy chain complementarity determining region 3 for antibody 8582
VCQLLNN

SEQ ID NO: 17165 - protein, 9 aa, Homo sapiens
  light chain complementarity determining region 3 for antibody 8583
QQGYKGPKT

SEQ ID NO: 17166 - protein, 7 aa, Homo sapiens
  heavy chain complementarity determining region 3 for antibody 8583
VYQLLNN

SEQ ID NO: 17167 - protein, 9 aa, Homo sapiens
  light chain complementarity determining region 3 for antibody 8584
QQGHSFPLT

SEQ ID NO: 17168 - protein, 9 aa, Homo sapiens
  heavy chain complementarity determining region 3 for antibody 8584
ARSEYQPTY

SEQ ID NO: 17169 - protein, 10 aa, Homo sapiens
  light chain complementarity determining region 3 for antibody 8585
QQFYSSPPWA

SEQ ID NO: 17170 - protein, 16 aa, Homo sapiens
  heavy chain complementarity determining region 3 for antibody 8585
ASLNRGDKEFGVPPAL

SEQ ID NO: 17171 - protein, 9 aa, Homo sapiens
  light chain complementarity determining region 3 for antibody 8586
QQFYNYPLT

SEQ ID NO: 17172 - protein, 14 aa, Homo sapiens
  heavy chain complementarity determining region 3 for antibody 8586
ARDTTYNWNDGGIS

SEQ ID NO: 17173 - protein, 9 aa, Homo sapiens
  light chain complementarity determining region 3 for antibody 8587
QQFYNTPYT

SEQ ID NO: 17174 - protein, 10 aa, Homo sapiens
  heavy chain complementarity determining region 3 for antibody 8587
ARSGNGYLDY

SEQ ID NO: 17175 - protein, 9 aa, Homo sapiens
  light chain complementarity determining region 3 for antibody 8588
QQFYNIPFT

SEQ ID NO: 17176 - protein, 14 aa, Homo sapiens
  heavy chain complementarity determining region 3 for antibody 8588
AKGRIASCYDASDI

SEQ ID NO: 17177 - protein, 9 aa, Homo sapiens
  light chain complementarity determining region 3 for antibody 8589
QQFYGIPPT

SEQ ID NO: 17178 - protein, 16 aa, Homo sapiens
  heavy chain complementarity determining region 3 for antibody 8589
ARDGRGASSQFNLFDP

SEQ ID NO: 17179 - protein, 9 aa, Homo sapiens
  light chain complementarity determining region 3 for antibody 8590
QQFYGIPLT

SEQ ID NO: 17180 - protein, 16 aa, Homo sapiens
  heavy chain complementarity determining region 3 for antibody 8590
ARDGRGASSQFNLFDP

SEQ ID NO: 17181 - protein, 9 aa, Homo sapiens
  light chain complementarity determining region 3 for antibody 8591
QQFSSFPRT

SEQ ID NO: 17182 - protein, 18 aa, Homo sapiens
  heavy chain complementarity determining region 3 for antibody 8591
TTVLSQLLAGDWHLYFQH

SEQ ID NO: 17183 - protein, 9 aa, Homo sapiens
  light chain complementarity determining region 3 for antibody 8592
QQFSSFPRT

SEQ ID NO: 17184 - protein, 9 aa, Homo sapiens
  heavy chain complementarity determining region 3 for antibody 8592
AWGRNNFRY

SEQ ID NO: 17185 - protein, 9 aa, Homo sapiens
  light chain complementarity determining region 3 for antibody 8593
QQFSSFPRT

SEQ ID NO: 17186 - protein, 16 aa, Homo sapiens
  heavy chain complementarity determining region 3 for antibody 8593
ARWFSRSSTGVSYMDV

SEQ ID NO: 17187 - protein, 9 aa, Homo sapiens
  light chain complementarity determining region 3 for antibody 8594
QQFSSFPRT

SEQ ID NO: 17188 - protein, 9 aa, Homo sapiens
  heavy chain complementarity determining region 3 for antibody 8594
ARGSNNFRY

SEQ ID NO: 17189 - protein, 9 aa, Homo sapiens
  light chain complementarity determining region 3 for antibody 8595
QQFSSFPRT

SEQ ID NO: 17190 - protein, 9 aa, Homo sapiens
  heavy chain complementarity determining region 3 for antibody 8595
ARGRNSFRY

SEQ ID NO: 17191 - protein, 9 aa, Homo sapiens
  light chain complementarity determining region 3 for antibody 8596
QQFSSFPRT

SEQ ID NO: 17192 - protein, 9 aa, Homo sapiens
  heavy chain complementarity determining region 3 for antibody 8596
ARGRNNVRY

SEQ ID NO: 17193 - protein, 9 aa, Homo sapiens
  light chain complementarity determining region 3 for antibody 8597
QQFSSFPRT

SEQ ID NO: 17194 - protein, 9 aa, Homo sapiens
  heavy chain complementarity determining region 3 for antibody 8597
ARGRNNLRY

SEQ ID NO: 17195 - protein, 9 aa, Homo sapiens
  light chain complementarity determining region 3 for antibody 8598
QQFSSFPRT

SEQ ID NO: 17196 - protein, 9 aa, Homo sapiens
  heavy chain complementarity determining region 3 for antibody 8598
ARGRNNFRH

SEQ ID NO: 17197 - protein, 9 aa, Homo sapiens
  light chain complementarity determining region 3 for antibody 8599
QQFSSFPRT

SEQ ID NO: 17198 - protein, 9 aa, Homo sapiens
  heavy chain complementarity determining region 3 for antibody 8599
ARGRNNCRY

SEQ ID NO: 17199 - protein, 9 aa, Homo sapiens
  light chain complementarity determining region 3 for antibody 8600
QQFSSFPRT

SEQ ID NO: 17200 - protein, 9 aa, Homo sapiens
  heavy chain complementarity determining region 3 for antibody 8600
ARGRNDFRY

SEQ ID NO: 17201 - protein, 9 aa, Homo sapiens
  light chain complementarity determining region 3 for antibody 8601
QQFSSFPRT

SEQ ID NO: 17202 - protein, 9 aa, Homo sapiens
  heavy chain complementarity determining region 3 for antibody 8601
ARGRKNFRY

SEQ ID NO: 17203 - protein, 9 aa, Homo sapiens
  light chain complementarity determining region 3 for antibody 8602
QQFSSFPRA

SEQ ID NO: 17204 - protein, 9 aa, Homo sapiens
  heavy chain complementarity determining region 3 for antibody 8602
ARGRNNFRY

SEQ ID NO: 17205 - protein, 9 aa, Homo sapiens
  light chain complementarity determining region 3 for antibody 8603
QQFSSFPQT

SEQ ID NO: 17206 - protein, 9 aa, Homo sapiens
  heavy chain complementarity determining region 3 for antibody 8603
ARGRNNFRY

SEQ ID NO: 17207 - protein, 9 aa, Homo sapiens
  light chain complementarity determining region 3 for antibody 8604
QQFSSFLRT

SEQ ID NO: 17208 - protein, 9 aa, Homo sapiens
  heavy chain complementarity determining region 3 for antibody 8604
ARGRNNFRY

SEQ ID NO: 17209 - protein, 9 aa, Homo sapiens
  light chain complementarity determining region 3 for antibody 8605
QQFSSFHRT

SEQ ID NO: 17210 - protein, 9 aa, Homo sapiens
  heavy chain complementarity determining region 3 for antibody 8605
ARGRNNFRY

SEQ ID NO: 17211 - protein, 9 aa, Homo sapiens
  light chain complementarity determining region 3 for antibody 8606
QQFSNLPRT

SEQ ID NO: 17212 - protein, 14 aa, Homo sapiens
  heavy chain complementarity determining region 3 for antibody 8606
VRRDDSSDHGRFDY

SEQ ID NO: 17213 - protein, 9 aa, Homo sapiens
  light chain complementarity determining region 3 for antibody 8607
QQFSNLPRT

SEQ ID NO: 17214 - protein, 16 aa, Homo sapiens
  heavy chain complementarity determining region 3 for antibody 8607
VGPHLTYNSGWRYFDY

SEQ ID NO: 17215 - protein, 9 aa, Homo sapiens
  light chain complementarity determining region 3 for antibody 8608
QQFSNLPRT

SEQ ID NO: 17216 - protein, 7 aa, Homo sapiens
  heavy chain complementarity determining region 3 for antibody 8608
TTGDLRN

SEQ ID NO: 17217 - protein, 9 aa, Homo sapiens
  light chain complementarity determining region 3 for antibody 8609
QQFSNLPRT

SEQ ID NO: 17218 - protein, 13 aa, Homo sapiens
  heavy chain complementarity determining region 3 for antibody 8609
TKEGSSAGPDFVY

SEQ ID NO: 17219 - protein, 9 aa, Homo sapiens
  light chain complementarity determining region 3 for antibody 8610
QQFSNLPRT

SEQ ID NO: 17220 - protein, 13 aa, Homo sapiens
  heavy chain complementarity determining region 3 for antibody 8610
SKEGSSPGPDFDS

SEQ ID NO: 17221 - protein, 9 aa, Homo sapiens
  light chain complementarity determining region 3 for antibody 8611
QQFSNLPRT

SEQ ID NO: 17222 - protein, 11 aa, Homo sapiens
  heavy chain complementarity determining region 3 for antibody 8611
ATFGQQWRLAH

SEQ ID NO: 17223 - protein, 9 aa, Homo sapiens
  light chain complementarity determining region 3 for antibody 8612
QQFSNLPRT

SEQ ID NO: 17224 - protein, 13 aa, Homo sapiens
  heavy chain complementarity determining region 3 for antibody 8612
ATEGSSPGPDFDS

SEQ ID NO: 17225 - protein, 9 aa, Homo sapiens
  light chain complementarity determining region 3 for antibody 8613
QQFSNLPRT

SEQ ID NO: 17226 - protein, 16 aa, Homo sapiens
  heavy chain complementarity determining region 3 for antibody 8613
ARWFSRSSTGVSYMDV

SEQ ID NO: 17227 - protein, 9 aa, Homo sapiens
  light chain complementarity determining region 3 for antibody 8614
QQFSNLPRT

SEQ ID NO: 17228 - protein, 15 aa, Homo sapiens
  heavy chain complementarity determining region 3 for antibody 8614
ARSMVSGTTDDAFDI

SEQ ID NO: 17229 - protein, 9 aa, Homo sapiens
  light chain complementarity determining region 3 for antibody 8615
QQFSNLPRT

SEQ ID NO: 17230 - protein, 9 aa, Homo sapiens
  heavy chain complementarity determining region 3 for antibody 8615
ARSEYQPTY

SEQ ID NO: 17231 - protein, 9 aa, Homo sapiens
  light chain complementarity determining region 3 for antibody 8616
QQFSNLPRT

SEQ ID NO: 17232 - protein, 13 aa, Homo sapiens
  heavy chain complementarity determining region 3 for antibody 8616
ARPYGDYGWAFNI

SEQ ID NO: 17233 - protein, 9 aa, Homo sapiens
  light chain complementarity determining region 3 for antibody 8617
QQFSNLPRT

SEQ ID NO: 17234 - protein, 17 aa, Homo sapiens
  heavy chain complementarity determining region 3 for antibody 8617
ARNTMVGTWQRQGNLDH

SEQ ID NO: 17235 - protein, 9 aa, Homo sapiens
  light chain complementarity determining region 3 for antibody 8618
QQFSNLPRT

SEQ ID NO: 17236 - protein, 15 aa, Homo sapiens
  heavy chain complementarity determining region 3 for antibody 8618
ARIWTSSTNCRYMDV

SEQ ID NO: 17237 - protein, 9 aa, Homo sapiens
  light chain complementarity determining region 3 for antibody 8619
QQFSNLPRT

SEQ ID NO: 17238 - protein, 23 aa, Homo sapiens
  heavy chain complementarity determining region 3 for antibody 8619
ARHFPMGGSTVTGTQSLLYYMDV

SEQ ID NO: 17239 - protein, 9 aa, Homo sapiens
  light chain complementarity determining region 3 for antibody 8620
QQFSNLPRT

SEQ ID NO: 17240 - protein, 9 aa, Homo sapiens
  heavy chain complementarity determining region 3 for antibody 8620
ARFWTYGRK

SEQ ID NO: 17241 - protein, 9 aa, Homo sapiens
  light chain complementarity determining region 3 for antibody 8621
QQFSNLPRT

SEQ ID NO: 17242 - protein, 10 aa, Homo sapiens
  heavy chain complementarity determining region 3 for antibody 8621
ARETSGAYDI

SEQ ID NO: 17243 - protein, 9 aa, Homo sapiens
  light chain complementarity determining region 3 for antibody 8622
QQFSNLPRT

SEQ ID NO: 17244 - protein, 12 aa, Homo sapiens
  heavy chain complementarity determining region 3 for antibody 8622
ARDKGGRNGMDV

SEQ ID NO: 17245 - protein, 9 aa, Homo sapiens
  light chain complementarity determining region 3 for antibody 8623
QQFSNLPRT

SEQ ID NO: 17246 - protein, 13 aa, Homo sapiens
  heavy chain complementarity determining region 3 for antibody 8623
AKVGSSPGPDFDS

SEQ ID NO: 17247 - protein, 9 aa, Homo sapiens
  light chain complementarity determining region 3 for antibody 8624
QQFSNLPRT

SEQ ID NO: 17248 - protein, 17 aa, Homo sapiens
  heavy chain complementarity determining region 3 for antibody 8624
AKRLPDLLGGGHHYIDV

SEQ ID NO: 17249 - protein, 9 aa, Homo sapiens
  light chain complementarity determining region 3 for antibody 8625
QQFSNLPRT

SEQ ID NO: 17250 - protein, 13 aa, Homo sapiens
  heavy chain complementarity determining region 3 for antibody 8625
AKEGSSTGPDFDS

SEQ ID NO: 17251 - protein, 9 aa, Homo sapiens
  light chain complementarity determining region 3 for antibody 8626
QQFSNLPRT

SEQ ID NO: 17252 - protein, 13 aa, Homo sapiens
  heavy chain complementarity determining region 3 for antibody 8626
AKEGSSRGPDFDS

SEQ ID NO: 17253 - protein, 9 aa, Homo sapiens
  light chain complementarity determining region 3 for antibody 8627
QQFSNLPRT

SEQ ID NO: 17254 - protein, 13 aa, Homo sapiens
  heavy chain complementarity determining region 3 for antibody 8627
AKEGSSPGPGFDS

SEQ ID NO: 17255 - protein, 9 aa, Homo sapiens
  light chain complementarity determining region 3 for antibody 8628
QQFSNLPRT

SEQ ID NO: 17256 - protein, 13 aa, Homo sapiens
  heavy chain complementarity determining region 3 for antibody 8628
AKEGSSPGPDFYS

SEQ ID NO: 17257 - protein, 9 aa, Homo sapiens
  light chain complementarity determining region 3 for antibody 8629
QQFSNLPRT

SEQ ID NO: 17258 - protein, 13 aa, Homo sapiens
  heavy chain complementarity determining region 3 for antibody 8629
AKEGSSPGPDFVY

SEQ ID NO: 17259 - protein, 9 aa, Homo sapiens
  light chain complementarity determining region 3 for antibody 8630
QQFSNLPRT

SEQ ID NO: 17260 - protein, 13 aa, Homo sapiens
  heavy chain complementarity determining region 3 for antibody 8630
AKEGSSPGPDFDT

SEQ ID NO: 17261 - protein, 9 aa, Homo sapiens
  light chain complementarity determining region 3 for antibody 8631
QQFSNLPRT

SEQ ID NO: 17262 - protein, 13 aa, Homo sapiens
  heavy chain complementarity determining region 3 for antibody 8631
AKEGSSLGPDFDS

SEQ ID NO: 17263 - protein, 9 aa, Homo sapiens
  light chain complementarity determining region 3 for antibody 8632
QQFSNLPRT

SEQ ID NO: 17264 - protein, 13 aa, Homo sapiens
  heavy chain complementarity determining region 3 for antibody 8632
AKEGSSAGPDFDS

SEQ ID NO: 17265 - protein, 9 aa, Homo sapiens
  light chain complementarity determining region 3 for antibody 8633
QQFSNLPRT

SEQ ID NO: 17266 - protein, 13 aa, Homo sapiens
  heavy chain complementarity determining region 3 for antibody 8633
AKEGSAPGPDFDA

SEQ ID NO: 17267 - protein, 9 aa, Homo sapiens
  light chain complementarity determining region 3 for antibody 8634
QQFSNLPRT

SEQ ID NO: 17268 - protein, 13 aa, Homo sapiens
  heavy chain complementarity determining region 3 for antibody 8634
AKEESSPGPDFDS

SEQ ID NO: 17269 - protein, 9 aa, Homo sapiens
  light chain complementarity determining region 3 for antibody 8635
QQFSNLPQT

SEQ ID NO: 17270 - protein, 13 aa, Homo sapiens
  heavy chain complementarity determining region 3 for antibody 8635
AKEGSSPGPDFDS

SEQ ID NO: 17271 - protein, 9 aa, Homo sapiens
  light chain complementarity determining region 3 for antibody 8636
QQFSDYPRT

SEQ ID NO: 17272 - protein, 9 aa, Homo sapiens
  heavy chain complementarity determining region 3 for antibody 8636
VRGRNNFRY

SEQ ID NO: 17273 - protein, 9 aa, Homo sapiens
  light chain complementarity determining region 3 for antibody 8637
QQFSDSPRT

SEQ ID NO: 17274 - protein, 9 aa, Homo sapiens
  heavy chain complementarity determining region 3 for antibody 8637
VRGRNNFRY

SEQ ID NO: 17275 - protein, 9 aa, Homo sapiens
  light chain complementarity determining region 3 for antibody 8638
QQFSDLPRT

SEQ ID NO: 17276 - protein, 9 aa, Homo sapiens
  heavy chain complementarity determining region 3 for antibody 8638
VRGRNNFRY

SEQ ID NO: 17277 - protein, 9 aa, Homo sapiens
  light chain complementarity determining region 3 for antibody 8639
QQFSDFPRT

SEQ ID NO: 17278 - protein, 9 aa, Homo sapiens
  heavy chain complementarity determining region 3 for antibody 8639
VRGRSNFRY

SEQ ID NO: 17279 - protein, 9 aa, Homo sapiens
  light chain complementarity determining region 3 for antibody 8640
QQFSDFPRT

SEQ ID NO: 17280 - protein, 9 aa, Homo sapiens
  heavy chain complementarity determining region 3 for antibody 8640
VRGRNNVRY

SEQ ID NO: 17281 - protein, 9 aa, Homo sapiens
  light chain complementarity determining region 3 for antibody 8641
QQFSDFPRT

SEQ ID NO: 17282 - protein, 9 aa, Homo sapiens
  heavy chain complementarity determining region 3 for antibody 8641
VRGRNNSRY

SEQ ID NO: 17283 - protein, 9 aa, Homo sapiens
  light chain complementarity determining region 3 for antibody 8642
QQFSDFPRT

SEQ ID NO: 17284 - protein, 9 aa, Homo sapiens
  heavy chain complementarity determining region 3 for antibody 8642
VRGRNNLRY

SEQ ID NO: 17285 - protein, 9 aa, Homo sapiens
  light chain complementarity determining region 3 for antibody 8643
QQFSDFPRT

SEQ ID NO: 17286 - protein, 9 aa, Homo sapiens
  heavy chain complementarity determining region 3 for antibody 8643
VRGRNNFRF

SEQ ID NO: 17287 - protein, 9 aa, Homo sapiens
  light chain complementarity determining region 3 for antibody 8644
QQFSDFPRT

SEQ ID NO: 17288 - protein, 9 aa, Homo sapiens
  heavy chain complementarity determining region 3 for antibody 8644
VRGRNHFRY

SEQ ID NO: 17289 - protein, 9 aa, Homo sapiens
  light chain complementarity determining region 3 for antibody 8645
QQFSDFPRT

SEQ ID NO: 17290 - protein, 9 aa, Homo sapiens
  heavy chain complementarity determining region 3 for antibody 8645
VRGRDNFRY

SEQ ID NO: 17291 - protein, 9 aa, Homo sapiens
  light chain complementarity determining region 3 for antibody 8646
QQFSDFPRT

SEQ ID NO: 17292 - protein, 9 aa, Homo sapiens
  heavy chain complementarity determining region 3 for antibody 8646
VRGGNNFRY

SEQ ID NO: 17293 - protein, 9 aa, Homo sapiens
  light chain complementarity determining region 3 for antibody 8647
QQFSDFPRT

SEQ ID NO: 17294 - protein, 16 aa, Homo sapiens
  heavy chain complementarity determining region 3 for antibody 8647
VRDLAGFTRGGSTFDY

SEQ ID NO: 17295 - protein, 9 aa, Homo sapiens
  light chain complementarity determining region 3 for antibody 8648
QQFSDFPRT

SEQ ID NO: 17296 - protein, 9 aa, Homo sapiens
  heavy chain complementarity determining region 3 for antibody 8648
VGGRNNFRY

SEQ ID NO: 17297 - protein, 9 aa, Homo sapiens
  light chain complementarity determining region 3 for antibody 8649
QQFSDFPRT

SEQ ID NO: 17298 - protein, 9 aa, Homo sapiens
  heavy chain complementarity determining region 3 for antibody 8649
LRGGNNFRY

SEQ ID NO: 17299 - protein, 9 aa, Homo sapiens
  light chain complementarity determining region 3 for antibody 8650
QQFSDFPRT

SEQ ID NO: 17300 - protein, 9 aa, Homo sapiens
  heavy chain complementarity determining region 3 for antibody 8650
GRGRNNFRY

SEQ ID NO: 17301 - protein, 9 aa, Homo sapiens
  light chain complementarity determining region 3 for antibody 8651
QQFSDFPRT

SEQ ID NO: 17302 - protein, 10 aa, Homo sapiens
  heavy chain complementarity determining region 3 for antibody 8651
CRDREGFGDV

SEQ ID NO: 17303 - protein, 9 aa, Homo sapiens
  light chain complementarity determining region 3 for antibody 8652
QQFSDFPRT

SEQ ID NO: 17304 - protein, 9 aa, Homo sapiens
  heavy chain complementarity determining region 3 for antibody 8652
ARSEYQPTY

SEQ ID NO: 17305 - protein, 9 aa, Homo sapiens
  light chain complementarity determining region 3 for antibody 8653
QQFSDFPRT

SEQ ID NO: 17306 - protein, 13 aa, Homo sapiens
  heavy chain complementarity determining region 3 for antibody 8653
AKEGSSPGPDFDY

SEQ ID NO: 17307 - protein, 9 aa, Homo sapiens
  light chain complementarity determining region 3 for antibody 8654
QQFSDFPRS

SEQ ID NO: 17308 - protein, 9 aa, Homo sapiens
  heavy chain complementarity determining region 3 for antibody 8654
VRGRNNFRY

SEQ ID NO: 17309 - protein, 9 aa, Homo sapiens
  light chain complementarity determining region 3 for antibody 8655
QQFSDFPRI

SEQ ID NO: 17310 - protein, 9 aa, Homo sapiens
  heavy chain complementarity determining region 3 for antibody 8655
VRGRNNFRY

SEQ ID NO: 17311 - protein, 9 aa, Homo sapiens
  light chain complementarity determining region 3 for antibody 8656
QQFSDFPRA

SEQ ID NO: 17312 - protein, 9 aa, Homo sapiens
  heavy chain complementarity determining region 3 for antibody 8656
VRGRNNFRY

SEQ ID NO: 17313 - protein, 9 aa, Homo sapiens
  light chain complementarity determining region 3 for antibody 8657
QQFSDFPLT

SEQ ID NO: 17314 - protein, 9 aa, Homo sapiens
  heavy chain complementarity determining region 3 for antibody 8657
VRGRNNFRY

SEQ ID NO: 17315 - protein, 9 aa, Homo sapiens
  light chain complementarity determining region 3 for antibody 8658
QQFRDVPRT

SEQ ID NO: 17316 - protein, 9 aa, Homo sapiens
  heavy chain complementarity determining region 3 for antibody 8658
ARGRSNFSH

SEQ ID NO: 17317 - protein, 9 aa, Homo sapiens
  light chain complementarity determining region 3 for antibody 8659
QQFRDIPRT

SEQ ID NO: 17318 - protein, 9 aa, Homo sapiens
  heavy chain complementarity determining region 3 for antibody 8659
ARGRNNFRR

SEQ ID NO: 17319 - protein, 9 aa, Homo sapiens
  light chain complementarity determining region 3 for antibody 8660
QQFRDFPRT

SEQ ID NO: 17320 - protein, 9 aa, Homo sapiens
  heavy chain complementarity determining region 3 for antibody 8660
ARGRSNFRH

SEQ ID NO: 17321 - protein, 9 aa, Homo sapiens
  light chain complementarity determining region 3 for antibody 8661
QQFNTYPLT

SEQ ID NO: 17322 - protein, 13 aa, Homo sapiens
  heavy chain complementarity determining region 3 for antibody 8661
TREGDSSGPDFHL

SEQ ID NO: 17323 - protein, 9 aa, Homo sapiens
  light chain complementarity determining region 3 for antibody 8662
QQFNTYPLT

SEQ ID NO: 17324 - protein, 20 aa, Homo sapiens
  heavy chain complementarity determining region 3 for antibody 8662
ARNLQYGSGGSCYGPFYFDY

SEQ ID NO: 17325 - protein, 9 aa, Homo sapiens
  light chain complementarity determining region 3 for antibody 8663
QQFNTYPLT

SEQ ID NO: 17326 - protein, 20 aa, Homo sapiens
  heavy chain complementarity determining region 3 for antibody 8663
ARNLQYCSGGSCYGPLYFDY

SEQ ID NO: 17327 - protein, 9 aa, Homo sapiens
  light chain complementarity determining region 3 for antibody 8664
QQFNTYPLT

SEQ ID NO: 17328 - protein, 20 aa, Homo sapiens
  heavy chain complementarity determining region 3 for antibody 8664
ARNLQYCSGGSCFGPFYFDY

SEQ ID NO: 17329 - protein, 9 aa, Homo sapiens
  light chain complementarity determining region 3 for antibody 8665
QQFNTYPLT

SEQ ID NO: 17330 - protein, 17 aa, Homo sapiens
  heavy chain complementarity determining region 3 for antibody 8665
AKDLSGVHYDIHHGLDV

SEQ ID NO: 17331 - protein, 9 aa, Homo sapiens
  light chain complementarity determining region 3 for antibody 8666
QQFNTFPRA

SEQ ID NO: 17332 - protein, 9 aa, Homo sapiens
  heavy chain complementarity determining region 3 for antibody 8666
ARGRNNFRY

SEQ ID NO: 17333 - protein, 9 aa, Homo sapiens
  light chain complementarity determining region 3 for antibody 8667
QQFNSYTYT

SEQ ID NO: 17334 - protein, 11 aa, Homo sapiens
  heavy chain complementarity determining region 3 for antibody 8667
AREQHGQAPDY

SEQ ID NO: 17335 - protein, 9 aa, Homo sapiens
  light chain complementarity determining region 3 for antibody 8668
QQFNSYPYT

SEQ ID NO: 17336 - protein, 9 aa, Homo sapiens
  heavy chain complementarity determining region 3 for antibody 8668
VRGRNNFRY

SEQ ID NO: 17337 - protein, 9 aa, Homo sapiens
  light chain complementarity determining region 3 for antibody 8669
QQFNSYPYT

SEQ ID NO: 17338 - protein, 12 aa, Homo sapiens
  heavy chain complementarity determining region 3 for antibody 8669
VKDRGGRSGMDV

SEQ ID NO: 17339 - protein, 9 aa, Homo sapiens
  light chain complementarity determining region 3 for antibody 8670
QQFNSYPYT

SEQ ID NO: 17340 - protein, 10 aa, Homo sapiens
  heavy chain complementarity determining region 3 for antibody 8670
CRDREGFGDV

SEQ ID NO: 17341 - protein, 9 aa, Homo sapiens
  light chain complementarity determining region 3 for antibody 8671
QQFNSYPYT

SEQ ID NO: 17342 - protein, 9 aa, Homo sapiens
  heavy chain complementarity determining region 3 for antibody 8671
ARGRSNFSF

SEQ ID NO: 17343 - protein, 9 aa, Homo sapiens
  light chain complementarity determining region 3 for antibody 8672
QQFNSYPYT

SEQ ID NO: 17344 - protein, 9 aa, Homo sapiens
  heavy chain complementarity determining region 3 for antibody 8672
ARFWTYGRT

SEQ ID NO: 17345 - protein, 9 aa, Homo sapiens
  light chain complementarity determining region 3 for antibody 8673
QQFNSYPYT

SEQ ID NO: 17346 - protein, 9 aa, Homo sapiens
  heavy chain complementarity determining region 3 for antibody 8673
ARFWTYGQK

SEQ ID NO: 17347 - protein, 9 aa, Homo sapiens
  light chain complementarity determining region 3 for antibody 8674
QQFNSYPYP

SEQ ID NO: 17348 - protein, 9 aa, Homo sapiens
  heavy chain complementarity determining region 3 for antibody 8674
ARFWTYGRK

SEQ ID NO: 17349 - protein, 9 aa, Homo sapiens
  light chain complementarity determining region 3 for antibody 8675
QQFNSYPST

SEQ ID NO: 17350 - protein, 9 aa, Homo sapiens
  heavy chain complementarity determining region 3 for antibody 8675
ARFWTYGRK

SEQ ID NO: 17351 - protein, 9 aa, Homo sapiens
  light chain complementarity determining region 3 for antibody 8676
QQFNSYPRT

SEQ ID NO: 17352 - protein, 15 aa, Homo sapiens
  heavy chain complementarity determining region 3 for antibody 8676
ARSMVSGTTDDAFDI

SEQ ID NO: 17353 - protein, 9 aa, Homo sapiens
  light chain complementarity determining region 3 for antibody 8677
QQFNSYPRT

SEQ ID NO: 17354 - protein, 12 aa, Homo sapiens
  heavy chain complementarity determining region 3 for antibody 8677
ARLDWNYRAFDI

SEQ ID NO: 17355 - protein, 9 aa, Homo sapiens
  light chain complementarity determining region 3 for antibody 8678
QQFNSYPRT

SEQ ID NO: 17356 - protein, 14 aa, Homo sapiens
  heavy chain complementarity determining region 3 for antibody 8678
ARGHVDSTGFRLDY

SEQ ID NO: 17357 - protein, 9 aa, Homo sapiens
  light chain complementarity determining region 3 for antibody 8679
QQFNSYPRT

SEQ ID NO: 17358 - protein, 19 aa, Homo sapiens
  heavy chain complementarity determining region 3 for antibody 8679
ARERVRCRSGICYDATFDI

SEQ ID NO: 17359 - protein, 9 aa, Homo sapiens
  light chain complementarity determining region 3 for antibody 8680
QQFNSYPRT

SEQ ID NO: 17360 - protein, 12 aa, Homo sapiens
  heavy chain complementarity determining region 3 for antibody 8680
ALDEWHPSWYKY

SEQ ID NO: 17361 - protein, 9 aa, Homo sapiens
  light chain complementarity determining region 3 for antibody 8681
QQFNSYPRT

SEQ ID NO: 17362 - protein, 10 aa, Homo sapiens
  heavy chain complementarity determining region 3 for antibody 8681
AKDLSGGGGY

SEQ ID NO: 17363 - protein, 9 aa, Homo sapiens
  light chain complementarity determining region 3 for antibody 8682
QQFNSYPRT

SEQ ID NO: 17364 - protein, 13 aa, Homo sapiens
  heavy chain complementarity determining region 3 for antibody 8682
AADGTYGSSAFDY

SEQ ID NO: 17365 - protein, 9 aa, Homo sapiens
  light chain complementarity determining region 3 for antibody 8683
QQFNSYPRT

SEQ ID NO: 17366 - protein, 13 aa, Homo sapiens
  heavy chain complementarity determining region 3 for antibody 8683
AADGPYGSSAVDY

SEQ ID NO: 17367 - protein, 9 aa, Homo sapiens
  light chain complementarity determining region 3 for antibody 8684
QQFNSYPRT

SEQ ID NO: 17368 - protein, 13 aa, Homo sapiens
  heavy chain complementarity determining region 3 for antibody 8684
AADGPYGGSAFDY

SEQ ID NO: 17369 - protein, 9 aa, Homo sapiens
  light chain complementarity determining region 3 for antibody 8685
QQFNSYPRT

SEQ ID NO: 17370 - protein, 13 aa, Homo sapiens
  heavy chain complementarity determining region 3 for antibody 8685
AADGPCGSSAFDY

SEQ ID NO: 17371 - protein, 9 aa, Homo sapiens
  light chain complementarity determining region 3 for antibody 8686
QQFNSYPRT

SEQ ID NO: 17372 - protein, 13 aa, Homo sapiens
  heavy chain complementarity determining region 3 for antibody 8686
AADGHYGSSAFDY

SEQ ID NO: 17373 - protein, 9 aa, Homo sapiens
  light chain complementarity determining region 3 for antibody 8687
QQFNSYPLT

SEQ ID NO: 17374 - protein, 13 aa, Homo sapiens
  heavy chain complementarity determining region 3 for antibody 8687
AADGPYGSSAFDY

SEQ ID NO: 17375 - protein, 10 aa, Homo sapiens
  light chain complementarity determining region 3 for antibody 8688
QQFNSYPGIT

SEQ ID NO: 17376 - protein, 17 aa, Homo sapiens
  heavy chain complementarity determining region 3 for antibody 8688
ARDSHKRGIVSPAWFDS

SEQ ID NO: 17377 - protein, 9 aa, Homo sapiens
  light chain complementarity determining region 3 for antibody 8689
QQFNSYPFT

SEQ ID NO: 17378 - protein, 12 aa, Homo sapiens
  heavy chain complementarity determining region 3 for antibody 8689
ARGVHWGRWFDP

SEQ ID NO: 17379 - protein, 7 aa, Homo sapiens
  light chain complementarity determining region 3 for antibody 8690
QQFNSWT

SEQ ID NO: 17380 - protein, 12 aa, Homo sapiens
  heavy chain complementarity determining region 3 for antibody 8690
AKDKGGRSGMDV

SEQ ID NO: 17381 - protein, 9 aa, Homo sapiens
  light chain complementarity determining region 3 for antibody 8691
QQFNSFPRT

SEQ ID NO: 17382 - protein, 9 aa, Homo sapiens
  heavy chain complementarity determining region 3 for antibody 8691
ARGRNNFRY

SEQ ID NO: 17383 - protein, 9 aa, Homo sapiens
  light chain complementarity determining region 3 for antibody 8692
QQFNNYLVT

SEQ ID NO: 17384 - protein, 25 aa, Homo sapiens
  heavy chain complementarity determining region 3 for antibody 8692
AREICHTAACYEILWFGQTPYYFDS

SEQ ID NO: 17385 - protein, 9 aa, Homo sapiens
  light chain complementarity determining region 3 for antibody 8693
QQFNIYPLT

SEQ ID NO: 17386 - protein, 17 aa, Homo sapiens
  heavy chain complementarity determining region 3 for antibody 8693
AKDLSDVHYDIHHGMDG

SEQ ID NO: 17387 - protein, 9 aa, Homo sapiens
  light chain complementarity determining region 3 for antibody 8694
QQFHSYPIT

SEQ ID NO: 17388 - protein, 16 aa, Homo sapiens
  heavy chain complementarity determining region 3 for antibody 8694
ARTQGTRDYYYYAMDV

SEQ ID NO: 17389 - protein, 9 aa, Homo sapiens
  light chain complementarity determining region 3 for antibody 8695
QQFGSFPRT

SEQ ID NO: 17390 - protein, 9 aa, Homo sapiens
  heavy chain complementarity determining region 3 for antibody 8695
ARGRNNFRY

SEQ ID NO: 17391 - protein, 10 aa, Homo sapiens
  light chain complementarity determining region 3 for antibody 8696
QQFGGSPMYT

SEQ ID NO: 17392 - protein, 13 aa, Homo sapiens
  heavy chain complementarity determining region 3 for antibody 8696
TADVYDYVWGPRY

SEQ ID NO: 17393 - protein, 10 aa, Homo sapiens
  light chain complementarity determining region 3 for antibody 8697
QQFGGSPMYT

SEQ ID NO: 17394 - protein, 13 aa, Homo sapiens
  heavy chain complementarity determining region 3 for antibody 8697
TADFYDYVWGPRD

SEQ ID NO: 17395 - protein, 10 aa, Homo sapiens
  light chain complementarity determining region 3 for antibody 8698
QQFGGSPMST

SEQ ID NO: 17396 - protein, 13 aa, Homo sapiens
  heavy chain complementarity determining region 3 for antibody 8698
TADFYDYVWGPRY

SEQ ID NO: 17397 - protein, 10 aa, Homo sapiens
  light chain complementarity determining region 3 for antibody 8699
QQFGGSPLYT

SEQ ID NO: 17398 - protein, 13 aa, Homo sapiens
  heavy chain complementarity determining region 3 for antibody 8699
TADFYDYVWGPRY

SEQ ID NO: 17399 - protein, 9 aa, Homo sapiens
  light chain complementarity determining region 3 for antibody 8700
QQFENLPIT

SEQ ID NO: 17400 - protein, 15 aa, Homo sapiens
  heavy chain complementarity determining region 3 for antibody 8700
ARGKDYDFGRGYPDY

SEQ ID NO: 17401 - protein, 9 aa, Homo sapiens
  light chain complementarity determining region 3 for antibody 8701
QQFDSYPYT

SEQ ID NO: 17402 - protein, 9 aa, Homo sapiens
  heavy chain complementarity determining region 3 for antibody 8701
ARFWTYGRK

SEQ ID NO: 17403 - protein, 9 aa, Homo sapiens
  light chain complementarity determining region 3 for antibody 8702
QQFDSYPLT

SEQ ID NO: 17404 - protein, 19 aa, Homo sapiens
  heavy chain complementarity determining region 3 for antibody 8702
AKGLYHYDNGVWKCEYLQH

SEQ ID NO: 17405 - protein, 9 aa, Homo sapiens
  light chain complementarity determining region 3 for antibody 8703
QQFDSLPRT

SEQ ID NO: 17406 - protein, 9 aa, Homo sapiens
  heavy chain complementarity determining region 3 for antibody 8703
TRGRNNFRY

SEQ ID NO: 17407 - protein, 9 aa, Homo sapiens
  light chain complementarity determining region 3 for antibody 8704
QQFDSFPRT

SEQ ID NO: 17408 - protein, 9 aa, Homo sapiens
  heavy chain complementarity determining region 3 for antibody 8704
ARGRNNFSY

SEQ ID NO: 17409 - protein, 9 aa, Homo sapiens
  light chain complementarity determining region 3 for antibody 8705
QQFDNLPRT

SEQ ID NO: 17410 - protein, 9 aa, Homo sapiens
  heavy chain complementarity determining region 3 for antibody 8705
VRGRSNFRY

SEQ ID NO: 17411 - protein, 9 aa, Homo sapiens
  light chain complementarity determining region 3 for antibody 8706
QQFANPPRT

SEQ ID NO: 17412 - protein, 9 aa, Homo sapiens
  heavy chain complementarity determining region 3 for antibody 8706
VRGRSNFRY

SEQ ID NO: 17413 - protein, 9 aa, Homo sapiens
  light chain complementarity determining region 3 for antibody 8707
QQFANLPRT

SEQ ID NO: 17414 - protein, 9 aa, Homo sapiens
  heavy chain complementarity determining region 3 for antibody 8707
VGGRSNFRY

SEQ ID NO: 17415 - protein, 9 aa, Homo sapiens
  light chain complementarity determining region 3 for antibody 8708
QQFANLPRT

SEQ ID NO: 17416 - protein, 9 aa, Homo sapiens
  heavy chain complementarity determining region 3 for antibody 8708
ARGRSNLRY

SEQ ID NO: 17417 - protein, 9 aa, Homo sapiens
  light chain complementarity determining region 3 for antibody 8709
QQFANLPRP

SEQ ID NO: 17418 - protein, 9 aa, Homo sapiens
  heavy chain complementarity determining region 3 for antibody 8709
ARGRSNFRY

SEQ ID NO: 17419 - protein, 9 aa, Homo sapiens
  light chain complementarity determining region 3 for antibody 8710
QQFAHLPRT

SEQ ID NO: 17420 - protein, 9 aa, Homo sapiens
  heavy chain complementarity determining region 3 for antibody 8710
ARGRSNFRY

SEQ ID NO: 17421 - protein, 9 aa, Homo sapiens
  light chain complementarity determining region 3 for antibody 8711
QQDYYTPWT

SEQ ID NO: 17422 - protein, 11 aa, Homo sapiens
  heavy chain complementarity determining region 3 for antibody 8711
ARRSLGGAFDY

SEQ ID NO: 17423 - protein, 9 aa, Homo sapiens
  light chain complementarity determining region 3 for antibody 8712
QQDYYTPRT

SEQ ID NO: 17424 - protein, 7 aa, Homo sapiens
  heavy chain complementarity determining region 3 for antibody 8712
TTGDLRN

SEQ ID NO: 17425 - protein, 9 aa, Homo sapiens
  light chain complementarity determining region 3 for antibody 8713
QQDYYTPRT

SEQ ID NO: 17426 - protein, 9 aa, Homo sapiens
  heavy chain complementarity determining region 3 for antibody 8713
GSRRPYFDS

SEQ ID NO: 17427 - protein, 9 aa, Homo sapiens
  light chain complementarity determining region 3 for antibody 8714
QQDYYTPRT

SEQ ID NO: 17428 - protein, 10 aa, Homo sapiens
  heavy chain complementarity determining region 3 for antibody 8714
CRDRWGFGDV

SEQ ID NO: 17429 - protein, 9 aa, Homo sapiens
  light chain complementarity determining region 3 for antibody 8715
QQDYYTPRT

SEQ ID NO: 17430 - protein, 9 aa, Homo sapiens
  heavy chain complementarity determining region 3 for antibody 8715
ARSEYQPTY

SEQ ID NO: 17431 - protein, 9 aa, Homo sapiens
  light chain complementarity determining region 3 for antibody 8716
QQDYYTPRT

SEQ ID NO: 17432 - protein, 11 aa, Homo sapiens
  heavy chain complementarity determining region 3 for antibody 8716
ARRSLVGAFDY

SEQ ID NO: 17433 - protein, 9 aa, Homo sapiens
  light chain complementarity determining region 3 for antibody 8717
QQDYYTPRT

SEQ ID NO: 17434 - protein, 11 aa, Homo sapiens
  heavy chain complementarity determining region 3 for antibody 8717
ARRSLGGASDY

SEQ ID NO: 17435 - protein, 9 aa, Homo sapiens
  light chain complementarity determining region 3 for antibody 8718
QQDYYTPRT

SEQ ID NO: 17436 - protein, 11 aa, Homo sapiens
  heavy chain complementarity determining region 3 for antibody 8718
ARRSLGGAFGY

SEQ ID NO: 17437 - protein, 9 aa, Homo sapiens
  light chain complementarity determining region 3 for antibody 8719
QQDYYTPRT

SEQ ID NO: 17438 - protein, 11 aa, Homo sapiens
  heavy chain complementarity determining region 3 for antibody 8719
ARRSLGGAFDC

SEQ ID NO: 17439 - protein, 9 aa, Homo sapiens
  light chain complementarity determining region 3 for antibody 8720
QQDYYTPRT

SEQ ID NO: 17440 - protein, 11 aa, Homo sapiens
  heavy chain complementarity determining region 3 for antibody 8720
ARRSLGGACDY

SEQ ID NO: 17441 - protein, 9 aa, Homo sapiens
  light chain complementarity determining region 3 for antibody 8721
QQDYYTPRT

SEQ ID NO: 17442 - protein, 12 aa, Homo sapiens
  heavy chain complementarity determining region 3 for antibody 8721
ARLDWNYRAFDI

SEQ ID NO: 17443 - protein, 9 aa, Homo sapiens
  light chain complementarity determining region 3 for antibody 8722
QQDYYTPRT

SEQ ID NO: 17444 - protein, 13 aa, Homo sapiens
  heavy chain complementarity determining region 3 for antibody 8722
AADGPYGSSAFDY

SEQ ID NO: 17445 - protein, 9 aa, Homo sapiens
  light chain complementarity determining region 3 for antibody 8723
QQDYYTPRR

SEQ ID NO: 17446 - protein, 11 aa, Homo sapiens
  heavy chain complementarity determining region 3 for antibody 8723
ARRSLGGAFDY

SEQ ID NO: 17447 - protein, 9 aa, Homo sapiens
  light chain complementarity determining region 3 for antibody 8724
QQDYYTPRQ

SEQ ID NO: 17448 - protein, 11 aa, Homo sapiens
  heavy chain complementarity determining region 3 for antibody 8724
ARRSLGGAFDY

SEQ ID NO: 17449 - protein, 9 aa, Homo sapiens
  light chain complementarity determining region 3 for antibody 8725
QQDYYTPRE

SEQ ID NO: 17450 - protein, 11 aa, Homo sapiens
  heavy chain complementarity determining region 3 for antibody 8725
ARRSLGGAFDY

SEQ ID NO: 17451 - protein, 9 aa, Homo sapiens
  light chain complementarity determining region 3 for antibody 8726
QQDYYTPPT

SEQ ID NO: 17452 - protein, 11 aa, Homo sapiens
  heavy chain complementarity determining region 3 for antibody 8726
ARRSLGGAFDY

SEQ ID NO: 17453 - protein, 9 aa, Homo sapiens
  light chain complementarity determining region 3 for antibody 8727
QQDYYTPGT

SEQ ID NO: 17454 - protein, 11 aa, Homo sapiens
  heavy chain complementarity determining region 3 for antibody 8727
ARRSLGGAFDY

SEQ ID NO: 17455 - protein, 9 aa, Homo sapiens
  light chain complementarity determining region 3 for antibody 8728
QQDYYAPRT

SEQ ID NO: 17456 - protein, 11 aa, Homo sapiens
  heavy chain complementarity determining region 3 for antibody 8728
ARRSLGGAFDY

SEQ ID NO: 17457 - protein, 9 aa, Homo sapiens
  light chain complementarity determining region 3 for antibody 8729
QQDYTIPRT

SEQ ID NO: 17458 - protein, 9 aa, Homo sapiens
  heavy chain complementarity determining region 3 for antibody 8729
VRELYYYGN

SEQ ID NO: 17459 - protein, 9 aa, Homo sapiens
  light chain complementarity determining region 3 for antibody 8730
QQDYSTLYT

SEQ ID NO: 17460 - protein, 15 aa, Homo sapiens
  heavy chain complementarity determining region 3 for antibody 8730
VKNSGWSGLRDSFGP

SEQ ID NO: 17461 - protein, 9 aa, Homo sapiens
  light chain complementarity determining region 3 for antibody 8731
QQDYNIPFT

SEQ ID NO: 17462 - protein, 15 aa, Homo sapiens
  heavy chain complementarity determining region 3 for antibody 8731
GKEGPGSSGWLTGHY

SEQ ID NO: 17463 - protein, 9 aa, Homo sapiens
  light chain complementarity determining region 3 for antibody 8732
QQDYNIPFT

SEQ ID NO: 17464 - protein, 15 aa, Homo sapiens
  heavy chain complementarity determining region 3 for antibody 8732
ARVGRPYHNAWYFDN

SEQ ID NO: 17465 - protein, 9 aa, Homo sapiens
  light chain complementarity determining region 3 for antibody 8733
QQDYFTPRT

SEQ ID NO: 17466 - protein, 14 aa, Homo sapiens
  heavy chain complementarity determining region 3 for antibody 8733
ARGHFDSTGFRLDY

SEQ ID NO: 17467 - protein, 10 aa, Homo sapiens
  light chain complementarity determining region 3 for antibody 8734
QQDYDISMYT

SEQ ID NO: 17468 - protein, 16 aa, Homo sapiens
  heavy chain complementarity determining region 3 for antibody 8734
AHRAVVTSNLNCRFDF

SEQ ID NO: 17469 - protein, 7 aa, Homo sapiens
  light chain complementarity determining region 3 for antibody 8735
QQDNTWT

SEQ ID NO: 17470 - protein, 12 aa, Homo sapiens
  heavy chain complementarity determining region 3 for antibody 8735
SRDKGGRNGMDV

SEQ ID NO: 17471 - protein, 10 aa, Homo sapiens
  light chain complementarity determining region 3 for antibody 8736
QQDNSYSPRP

SEQ ID NO: 17472 - protein, 15 aa, Homo sapiens
  heavy chain complementarity determining region 3 for antibody 8736
ARVGRPYHNAWYFDN

SEQ ID NO: 17473 - protein, 9 aa, Homo sapiens
  light chain complementarity determining region 3 for antibody 8737
QQDNSYPWT

SEQ ID NO: 17474 - protein, 11 aa, Homo sapiens
  heavy chain complementarity determining region 3 for antibody 8737
ARIVARKPDDY

SEQ ID NO: 17475 - protein, 9 aa, Homo sapiens
  light chain complementarity determining region 3 for antibody 8738
QQDNSYPWT

SEQ ID NO: 17476 - protein, 10 aa, Homo sapiens
  heavy chain complementarity determining region 3 for antibody 8738
AKYLARAFDV

SEQ ID NO: 17477 - protein, 9 aa, Homo sapiens
  light chain complementarity determining region 3 for antibody 8739
QQDHNWPGT

SEQ ID NO: 17478 - protein, 11 aa, Homo sapiens
  heavy chain complementarity determining region 3 for antibody 8739
AKGGFYFLTGD

SEQ ID NO: 17479 - protein, 9 aa, Homo sapiens
  light chain complementarity determining region 3 for antibody 8740
QQDGTSPKT

SEQ ID NO: 17480 - protein, 15 aa, Homo sapiens
  heavy chain complementarity determining region 3 for antibody 8740
TTEDITGVQGEPLDY

SEQ ID NO: 17481 - protein, 10 aa, Homo sapiens
  light chain complementarity determining region 3 for antibody 8741
QQDGSSPQET

SEQ ID NO: 17482 - protein, 13 aa, Homo sapiens
  heavy chain complementarity determining region 3 for antibody 8741
AKEGSSPGPDFEY

SEQ ID NO: 17483 - protein, 10 aa, Homo sapiens
  light chain complementarity determining region 3 for antibody 8742
QQDGSSPPLT

SEQ ID NO: 17484 - protein, 20 aa, Homo sapiens
  heavy chain complementarity determining region 3 for antibody 8742
GRDSSRSYSNSWAHYYGTDV

SEQ ID NO: 17485 - protein, 9 aa, Homo sapiens
  light chain complementarity determining region 3 for antibody 8743
QQDGSSPET

SEQ ID NO: 17486 - protein, 12 aa, Homo sapiens
  heavy chain complementarity determining region 3 for antibody 8743
AIVVPGRWDLDD

SEQ ID NO: 17487 - protein, 9 aa, Homo sapiens
  light chain complementarity determining region 3 for antibody 8744
QQDGSSLWT

SEQ ID NO: 17488 - protein, 11 aa, Homo sapiens
  heavy chain complementarity determining region 3 for antibody 8744
ALKIAAFPFDY

SEQ ID NO: 17489 - protein, 9 aa, Homo sapiens
  light chain complementarity determining region 3 for antibody 8745
QQDFYTPRT

SEQ ID NO: 17490 - protein, 11 aa, Homo sapiens
  heavy chain complementarity determining region 3 for antibody 8745
ARRSLGGAFDY

SEQ ID NO: 17491 - protein, 9 aa, Homo sapiens
  light chain complementarity determining region 3 for antibody 8746
QQDFNTPLT

SEQ ID NO: 17492 - protein, 17 aa, Homo sapiens
  heavy chain complementarity determining region 3 for antibody 8746
ARKSYYYDSSDFGWFGP

SEQ ID NO: 17493 - protein, 9 aa, Homo sapiens
  light chain complementarity determining region 3 for antibody 8747
QQDDNWPWT

SEQ ID NO: 17494 - protein, 17 aa, Homo sapiens
  heavy chain complementarity determining region 3 for antibody 8747
VTHYYHDSGIYYDFFNY

SEQ ID NO: 17495 - protein, 9 aa, Homo sapiens
  light chain complementarity determining region 3 for antibody 8748
QQDASSPFG

SEQ ID NO: 17496 - protein, 16 aa, Homo sapiens
  heavy chain complementarity determining region 3 for antibody 8748
AKDRQGRSSAWWLLEN

SEQ ID NO: 17497 - protein, 10 aa, Homo sapiens
  light chain complementarity determining region 3 for antibody 8749
QQCYSTPLFT

SEQ ID NO: 17498 - protein, 23 aa, Homo sapiens
  heavy chain complementarity determining region 3 for antibody 8749
ARHFPKGGSGVTGTQSLLYYMDV

SEQ ID NO: 17499 - protein, 7 aa, Homo sapiens
  light chain complementarity determining region 3 for antibody 8750
QQCNTWT

SEQ ID NO: 17500 - protein, 12 aa, Homo sapiens
  heavy chain complementarity determining region 3 for antibody 8750
SRDKGGRNGMDV

SEQ ID NO: 17501 - protein, 7 aa, Homo sapiens
  light chain complementarity determining region 3 for antibody 8751
QQCNSWT

SEQ ID NO: 17502 - protein, 12 aa, Homo sapiens
  heavy chain complementarity determining region 3 for antibody 8751
AKDKGGRSGMDV

SEQ ID NO: 17503 - protein, 8 aa, Homo sapiens
  light chain complementarity determining region 3 for antibody 8752
QQCKSYWT

SEQ ID NO: 17504 - protein, 10 aa, Homo sapiens
  heavy chain complementarity determining region 3 for antibody 8752
ARERSGSYDI

SEQ ID NO: 17505 - protein, 9 aa, Homo sapiens
  light chain complementarity determining region 3 for antibody 8753
QQCGSWPYT

SEQ ID NO: 17506 - protein, 14 aa, Homo sapiens
  heavy chain complementarity determining region 3 for antibody 8753
ARQDSPDYSKYMDV

SEQ ID NO: 17507 - protein, 10 aa, Homo sapiens
  light chain complementarity determining region 3 for antibody 8754
QQCGNWPQST

SEQ ID NO: 17508 - protein, 12 aa, Homo sapiens
  heavy chain complementarity determining region 3 for antibody 8754
AKPAYGSGSPDY

SEQ ID NO: 17509 - protein, 10 aa, Homo sapiens
  light chain complementarity determining region 3 for antibody 8755
QQCGNWPQCT

SEQ ID NO: 17510 - protein, 11 aa, Homo sapiens
  heavy chain complementarity determining region 3 for antibody 8755
VRVSTGWNFDY

SEQ ID NO: 17511 - protein, 10 aa, Homo sapiens
  light chain complementarity determining region 3 for antibody 8756
QQCGNWPQCT

SEQ ID NO: 17512 - protein, 12 aa, Homo sapiens
  heavy chain complementarity determining region 3 for antibody 8756
ANPAYGSGSPDY

SEQ ID NO: 17513 - protein, 10 aa, Homo sapiens
  light chain complementarity determining region 3 for antibody 8757
QQCGNWPQCT

SEQ ID NO: 17514 - protein, 12 aa, Homo sapiens
  heavy chain complementarity determining region 3 for antibody 8757
AKPAYGSGRPDY

SEQ ID NO: 17515 - protein, 10 aa, Homo sapiens
  light chain complementarity determining region 3 for antibody 8758
QQCGNWPQCT

SEQ ID NO: 17516 - protein, 12 aa, Homo sapiens
  heavy chain complementarity determining region 3 for antibody 8758
AKPAYGSGGPDY

SEQ ID NO: 17517 - protein, 10 aa, Homo sapiens
  light chain complementarity determining region 3 for antibody 8759
QQCGNWPQCT

SEQ ID NO: 17518 - protein, 12 aa, Homo sapiens
  heavy chain complementarity determining region 3 for antibody 8759
AKPADGSGSPDY

SEQ ID NO: 17519 - protein, 10 aa, Homo sapiens
  light chain complementarity determining region 3 for antibody 8760
QQCGNWPHCT

SEQ ID NO: 17520 - protein, 12 aa, Homo sapiens
  heavy chain complementarity determining region 3 for antibody 8760
AKPAYGSGSPDY

SEQ ID NO: 17521 - protein, 10 aa, Homo sapiens
  light chain complementarity determining region 3 for antibody 8761
QQCGNCPQCT

SEQ ID NO: 17522 - protein, 12 aa, Homo sapiens
  heavy chain complementarity determining region 3 for antibody 8761
AKPAYGSGSPDY

SEQ ID NO: 17523 - protein, 9 aa, Homo sapiens
  light chain complementarity determining region 3 for antibody 8762
QQCASSPLT

SEQ ID NO: 17524 - protein, 13 aa, Homo sapiens
  heavy chain complementarity determining region 3 for antibody 8762
VGGLRSGAWYGGY

SEQ ID NO: 17525 - protein, 9 aa, Homo sapiens
  light chain complementarity determining region 3 for antibody 8763
QQCARSPLT

SEQ ID NO: 17526 - protein, 15 aa, Homo sapiens
  heavy chain complementarity determining region 3 for antibody 8763
ARIWTSSTNCRYMDV

SEQ ID NO: 17527 - protein, 9 aa, Homo sapiens
  light chain complementarity determining region 3 for antibody 8764
QQCAPSPLT

SEQ ID NO: 17528 - protein, 13 aa, Homo sapiens
  heavy chain complementarity determining region 3 for antibody 8764
VGGLYSGTWYGGY

SEQ ID NO: 17529 - protein, 9 aa, Homo sapiens
  light chain complementarity determining region 3 for antibody 8765
QQCAHSPLT

SEQ ID NO: 17530 - protein, 13 aa, Homo sapiens
  heavy chain complementarity determining region 3 for antibody 8765
VGGRYSGTWYGGY

SEQ ID NO: 17531 - protein, 9 aa, Homo sapiens
  light chain complementarity determining region 3 for antibody 8766
QQCAHSPLT

SEQ ID NO: 17532 - protein, 13 aa, Homo sapiens
  heavy chain complementarity determining region 3 for antibody 8766
VGGLYSGPWYGGY

SEQ ID NO: 17533 - protein, 9 aa, Homo sapiens
  light chain complementarity determining region 3 for antibody 8767
QQAYRFPLS

SEQ ID NO: 17534 - protein, 13 aa, Homo sapiens
  heavy chain complementarity determining region 3 for antibody 8767
TRTYGSGRNWFDP

SEQ ID NO: 17535 - protein, 9 aa, Homo sapiens
  light chain complementarity determining region 3 for antibody 8768
QQAYNLPLT

SEQ ID NO: 17536 - protein, 19 aa, Homo sapiens
  heavy chain complementarity determining region 3 for antibody 8768
GRGQGFFTSTACRADAFDI

SEQ ID NO: 17537 - protein, 9 aa, Homo sapiens
  light chain complementarity determining region 3 for antibody 8769
QQAQTYPLT

SEQ ID NO: 17538 - protein, 14 aa, Homo sapiens
  heavy chain complementarity determining region 3 for antibody 8769
ARGPYGDPSSDFDY

SEQ ID NO: 17539 - protein, 9 aa, Homo sapiens
  light chain complementarity determining region 3 for antibody 8770
QQAQTYPLT

SEQ ID NO: 17540 - protein, 14 aa, Homo sapiens
  heavy chain complementarity determining region 3 for antibody 8770
ARDPYGDPASDFDY

SEQ ID NO: 17541 - protein, 9 aa, Homo sapiens
  light chain complementarity determining region 3 for antibody 8771
QQANTFPYT

SEQ ID NO: 17542 - protein, 25 aa, Homo sapiens
  heavy chain complementarity determining region 3 for antibody 8771
ARQPEYGSGGFLGIGQKYDYHGLDV

SEQ ID NO: 17543 - protein, 9 aa, Homo sapiens
  light chain complementarity determining region 3 for antibody 8772
QQANSSPLT

SEQ ID NO: 17544 - protein, 17 aa, Homo sapiens
  heavy chain complementarity determining region 3 for antibody 8772
ARGTGIGSGSYYADFDY

SEQ ID NO: 17545 - protein, 9 aa, Homo sapiens
  light chain complementarity determining region 3 for antibody 8773
QQANSLPRT

SEQ ID NO: 17546 - protein, 17 aa, Homo sapiens
  heavy chain complementarity determining region 3 for antibody 8773
ARGTGIGSGSYYADFDY

SEQ ID NO: 17547 - protein, 9 aa, Homo sapiens
  light chain complementarity determining region 3 for antibody 8774
QQANSLPLT

SEQ ID NO: 17548 - protein, 10 aa, Homo sapiens
  heavy chain complementarity determining region 3 for antibody 8774
CREREGFGDV

SEQ ID NO: 17549 - protein, 9 aa, Homo sapiens
  light chain complementarity determining region 3 for antibody 8775
QQANSLPLT

SEQ ID NO: 17550 - protein, 17 aa, Homo sapiens
  heavy chain complementarity determining region 3 for antibody 8775
ASGTGIGSGSYYADFDY

SEQ ID NO: 17551 - protein, 9 aa, Homo sapiens
  light chain complementarity determining region 3 for antibody 8776
QQANSLPLT

SEQ ID NO: 17552 - protein, 6 aa, Homo sapiens
  heavy chain complementarity determining region 3 for antibody 8776
ARISAY

SEQ ID NO: 17553 - protein, 9 aa, Homo sapiens
  light chain complementarity determining region 3 for antibody 8777
QQANSLPLT

SEQ ID NO: 17554 - protein, 17 aa, Homo sapiens
  heavy chain complementarity determining region 3 for antibody 8777
ARGTGIGSGSYYADSDY

SEQ ID NO: 17555 - protein, 9 aa, Homo sapiens
  light chain complementarity determining region 3 for antibody 8778
QQANSLPLT

SEQ ID NO: 17556 - protein, 17 aa, Homo sapiens
  heavy chain complementarity determining region 3 for antibody 8778
ARGTGIGSGSYYADLDY

SEQ ID NO: 17557 - protein, 9 aa, Homo sapiens
  light chain complementarity determining region 3 for antibody 8779
QQANSLPLT

SEQ ID NO: 17558 - protein, 17 aa, Homo sapiens
  heavy chain complementarity determining region 3 for antibody 8779
ARGTGIGSGSYYADFGY

SEQ ID NO: 17559 - protein, 9 aa, Homo sapiens
  light chain complementarity determining region 3 for antibody 8780
QQANSLPLT

SEQ ID NO: 17560 - protein, 17 aa, Homo sapiens
  heavy chain complementarity determining region 3 for antibody 8780
ARGTGIGPGSYYADFDY

SEQ ID NO: 17561 - protein, 9 aa, Homo sapiens
  light chain complementarity determining region 3 for antibody 8781
QQANSLPLT

SEQ ID NO: 17562 - protein, 17 aa, Homo sapiens
  heavy chain complementarity determining region 3 for antibody 8781
ARGTGIDSGSYYADFDY

SEQ ID NO: 17563 - protein, 9 aa, Homo sapiens
  light chain complementarity determining region 3 for antibody 8782
QQANSLPLT

SEQ ID NO: 17564 - protein, 8 aa, Homo sapiens
  heavy chain complementarity determining region 3 for antibody 8782
AGWGYANY

SEQ ID NO: 17565 - protein, 9 aa, Homo sapiens
  light chain complementarity determining region 3 for antibody 8783
QQANSLPLT

SEQ ID NO: 17566 - protein, 17 aa, Homo sapiens
  heavy chain complementarity determining region 3 for antibody 8783
AGGTGIGSGSYYADFDY

SEQ ID NO: 17567 - protein, 9 aa, Homo sapiens
  light chain complementarity determining region 3 for antibody 8784
QQANSLPLA

SEQ ID NO: 17568 - protein, 17 aa, Homo sapiens
  heavy chain complementarity determining region 3 for antibody 8784
ARGTGIGSGSYYADFDY

SEQ ID NO: 17569 - protein, 9 aa, Homo sapiens
  light chain complementarity determining region 3 for antibody 8785
QQANSLPFT

SEQ ID NO: 17570 - protein, 17 aa, Homo sapiens
  heavy chain complementarity determining region 3 for antibody 8785
ARGTGIGSGSYYADFDY

SEQ ID NO: 17571 - protein, 9 aa, Homo sapiens
  light chain complementarity determining region 3 for antibody 8786
QQANSFPYT

SEQ ID NO: 17572 - protein, 17 aa, Homo sapiens
  heavy chain complementarity determining region 3 for antibody 8786
ARGASGMNKEVKNWFDA

SEQ ID NO: 17573 - protein, 9 aa, Homo sapiens
  light chain complementarity determining region 3 for antibody 8787
QQANSFPYP

SEQ ID NO: 17574 - protein, 17 aa, Homo sapiens
  heavy chain complementarity determining region 3 for antibody 8787
ARGASGMNKEVKNWFDS

SEQ ID NO: 17575 - protein, 9 aa, Homo sapiens
  light chain complementarity determining region 3 for antibody 8788
QQANSFPRT

SEQ ID NO: 17576 - protein, 12 aa, Homo sapiens
  heavy chain complementarity determining region 3 for antibody 8788
AGSRFWGGSIDY

SEQ ID NO: 17577 - protein, 9 aa, Homo sapiens
  light chain complementarity determining region 3 for antibody 8789
QQANRLPLT

SEQ ID NO: 17578 - protein, 17 aa, Homo sapiens
  heavy chain complementarity determining region 3 for antibody 8789
ARGTGIGSGSYYADFDY

SEQ ID NO: 17579 - protein, 9 aa, Homo sapiens
  light chain complementarity determining region 3 for antibody 8790
QQAHTFPLP

SEQ ID NO: 17580 - protein, 13 aa, Homo sapiens
  heavy chain complementarity determining region 3 for antibody 8790
ARHPAAGGDWFDP

SEQ ID NO: 17581 - protein, 9 aa, Homo sapiens
  light chain complementarity determining region 3 for antibody 8791
QQAESFPYT

SEQ ID NO: 17582 - protein, 16 aa, Homo sapiens
  heavy chain complementarity determining region 3 for antibody 8791
TRDQGLGYGVPDGCDI

SEQ ID NO: 17583 - protein, 9 aa, Homo sapiens
  light chain complementarity determining region 3 for antibody 8792
QQADSFPYP

SEQ ID NO: 17584 - protein, 16 aa, Homo sapiens
  heavy chain complementarity determining region 3 for antibody 8792
ARDQGLGYGVPDGCDI

SEQ ID NO: 17585 - protein, 9 aa, Homo sapiens
  light chain complementarity determining region 3 for antibody 8793
QQADSFPIT

SEQ ID NO: 17586 - protein, 18 aa, Homo sapiens
  heavy chain complementarity determining region 3 for antibody 8793
AHMGCTLPVCPAIPRFAP

SEQ ID NO: 17587 - protein, 9 aa, Homo sapiens
  light chain complementarity determining region 3 for antibody 8794
QQADRFPYT

SEQ ID NO: 17588 - protein, 16 aa, Homo sapiens
  heavy chain complementarity determining region 3 for antibody 8794
ARDQGLGYGVPDACDI

SEQ ID NO: 17589 - protein, 9 aa, Homo sapiens
  light chain complementarity determining region 3 for antibody 8795
QPYYTPPYT

SEQ ID NO: 17590 - protein, 10 aa, Homo sapiens
  heavy chain complementarity determining region 3 for antibody 8795
TRSTDAYNDI

SEQ ID NO: 17591 - protein, 9 aa, Homo sapiens
  light chain complementarity determining region 3 for antibody 8796
QPYYSTPWT

SEQ ID NO: 17592 - protein, 18 aa, Homo sapiens
  heavy chain complementarity determining region 3 for antibody 8796
ARGLHQLRLGGYFYGLDV

SEQ ID NO: 17593 - protein, 10 aa, Homo sapiens
  light chain complementarity determining region 3 for antibody 8797
QPYYSTPPWT

SEQ ID NO: 17594 - protein, 12 aa, Homo sapiens
  heavy chain complementarity determining region 3 for antibody 8797
QGLDRSGYSSVY

SEQ ID NO: 17595 - protein, 9 aa, Homo sapiens
  light chain complementarity determining region 3 for antibody 8798
QPYYSSPLT

SEQ ID NO: 17596 - protein, 14 aa, Homo sapiens
  heavy chain complementarity determining region 3 for antibody 8798
TKPTRGPGSFLIDY

SEQ ID NO: 17597 - protein, 9 aa, Homo sapiens
  light chain complementarity determining region 3 for antibody 8799
QPYYSSPFT

SEQ ID NO: 17598 - protein, 13 aa, Homo sapiens
  heavy chain complementarity determining region 3 for antibody 8799
TSGCSGWCEWFDS

SEQ ID NO: 17599 - protein, 9 aa, Homo sapiens
  light chain complementarity determining region 3 for antibody 8800
QPYYSFPPT

SEQ ID NO: 17600 - protein, 13 aa, Homo sapiens
  heavy chain complementarity determining region 3 for antibody 8800
TTGAPDSGSVFDN

SEQ ID NO: 17601 - protein, 9 aa, Homo sapiens
  light chain complementarity determining region 3 for antibody 8801
QPYYSAPLT

SEQ ID NO: 17602 - protein, 11 aa, Homo sapiens
  heavy chain complementarity determining region 3 for antibody 8801
ARDRANSYSDY

SEQ ID NO: 17603 - protein, 9 aa, Homo sapiens
  light chain complementarity determining region 3 for antibody 8802
QPYYSAPIT

SEQ ID NO: 17604 - protein, 15 aa, Homo sapiens
  heavy chain complementarity determining region 3 for antibody 8802
VRALSPTEMSYAIAY

SEQ ID NO: 17605 - protein, 9 aa, Homo sapiens
  light chain complementarity determining region 3 for antibody 8803
QPYYNIPFT

SEQ ID NO: 17606 - protein, 14 aa, Homo sapiens
  heavy chain complementarity determining region 3 for antibody 8803
AKGRIASCYDASDI

SEQ ID NO: 17607 - protein, 9 aa, Homo sapiens
  light chain complementarity determining region 3 for antibody 8804
QPYYGTPLT

SEQ ID NO: 17608 - protein, 17 aa, Homo sapiens
  heavy chain complementarity determining region 3 for antibody 8804
ATGLGFCGDSSATCDDW

SEQ ID NO: 17609 - protein, 9 aa, Homo sapiens
  light chain complementarity determining region 3 for antibody 8805
QPYYGTPET

SEQ ID NO: 17610 - protein, 15 aa, Homo sapiens
  heavy chain complementarity determining region 3 for antibody 8805
ARDLFSGSYAYGDDY

SEQ ID NO: 17611 - protein, 9 aa, Homo sapiens
  light chain complementarity determining region 3 for antibody 8806
QPYYGSPLT

SEQ ID NO: 17612 - protein, 15 aa, Homo sapiens
  heavy chain complementarity determining region 3 for antibody 8806
ATSIKYGDNSFLCDS

SEQ ID NO: 17613 - protein, 9 aa, Homo sapiens
  light chain complementarity determining region 3 for antibody 8807
QPYNNWPWT

SEQ ID NO: 17614 - protein, 18 aa, Homo sapiens
  heavy chain complementarity determining region 3 for antibody 8807
ASWAGSCSSTSCYAVYDY

SEQ ID NO: 17615 - protein, 9 aa, Homo sapiens
  light chain complementarity determining region 3 for antibody 8808
QPYKTYPWT

SEQ ID NO: 17616 - protein, 14 aa, Homo sapiens
  heavy chain complementarity determining region 3 for antibody 8808
AREEGSGWYRTSDY

SEQ ID NO: 17617 - protein, 9 aa, Homo sapiens
  light chain complementarity determining region 3 for antibody 8809
QPYGSSPYT

SEQ ID NO: 17618 - protein, 10 aa, Homo sapiens
  heavy chain complementarity determining region 3 for antibody 8809
TTIIWHDIDY

SEQ ID NO: 17619 - protein, 8 aa, Homo sapiens
  light chain complementarity determining region 3 for antibody 8810
QPYGGSPT

SEQ ID NO: 17620 - protein, 23 aa, Homo sapiens
  heavy chain complementarity determining region 3 for antibody 8810
ARHFPKGGSGVTGTQSLLYYMDV

SEQ ID NO: 17621 - protein, 9 aa, Homo sapiens
  light chain complementarity determining region 3 for antibody 8811
QPTYSSPWT

SEQ ID NO: 17622 - protein, 15 aa, Homo sapiens
  heavy chain complementarity determining region 3 for antibody 8811
ARIWTSSTNCRYMDV

SEQ ID NO: 17623 - protein, 10 aa, Homo sapiens
  light chain complementarity determining region 3 for antibody 8812
QPSYSTPLFT

SEQ ID NO: 17624 - protein, 23 aa, Homo sapiens
  heavy chain complementarity determining region 3 for antibody 8812
ARHFPKGGSTVTGTQSLLYYMDV

SEQ ID NO: 17625 - protein, 8 aa, Homo sapiens
  light chain complementarity determining region 3 for antibody 8813
QPSYSSPT

SEQ ID NO: 17626 - protein, 17 aa, Homo sapiens
  heavy chain complementarity determining region 3 for antibody 8813
AKGRGSVAMALIYYLDL

SEQ ID NO: 17627 - protein, 9 aa, Homo sapiens
  light chain complementarity determining region 3 for antibody 8814
QPSYNTPRT

SEQ ID NO: 17628 - protein, 20 aa, Homo sapiens
  heavy chain complementarity determining region 3 for antibody 8814
AREERMGASGGGYYYYGMDV

SEQ ID NO: 17629 - protein, 9 aa, Homo sapiens
  light chain complementarity determining region 3 for antibody 8815
QPSSNTPLP

SEQ ID NO: 17630 - protein, 16 aa, Homo sapiens
  heavy chain complementarity determining region 3 for antibody 8815
VRDLAGFTRGGSTFDY

SEQ ID NO: 17631 - protein, 9 aa, Homo sapiens
  light chain complementarity determining region 3 for antibody 8816
QPLNSYPYT

SEQ ID NO: 17632 - protein, 10 aa, Homo sapiens
  heavy chain complementarity determining region 3 for antibody 8816
ARETSGAYDI

SEQ ID NO: 17633 - protein, 9 aa, Homo sapiens
  light chain complementarity determining region 3 for antibody 8817
QPAYYTPRT

SEQ ID NO: 17634 - protein, 11 aa, Homo sapiens
  heavy chain complementarity determining region 3 for antibody 8817
ARRSLGGAFDY

SEQ ID NO: 17635 - protein, 9 aa, Homo sapiens
  light chain complementarity determining region 3 for antibody 8818
QPANSLPLT

SEQ ID NO: 17636 - protein, 17 aa, Homo sapiens
  heavy chain complementarity determining region 3 for antibody 8818
ARGTGIGSGSYYADFDY

SEQ ID NO: 17637 - protein, 9 aa, Homo sapiens
  light chain complementarity determining region 3 for antibody 8819
QNYNTAPFA

SEQ ID NO: 17638 - protein, 11 aa, Homo sapiens
  heavy chain complementarity determining region 3 for antibody 8819
TRGGYSVGYDY

SEQ ID NO: 17639 - protein, 9 aa, Homo sapiens
  light chain complementarity determining region 3 for antibody 8820
QNYNSVQLT

SEQ ID NO: 17640 - protein, 10 aa, Homo sapiens
  heavy chain complementarity determining region 3 for antibody 8820
CRDREGFGDV

SEQ ID NO: 17641 - protein, 9 aa, Homo sapiens
  light chain complementarity determining region 3 for antibody 8821
QNYNSAPFT

SEQ ID NO: 17642 - protein, 10 aa, Homo sapiens
  heavy chain complementarity determining region 3 for antibody 8821
VREGYWRLDH

SEQ ID NO: 17643 - protein, 9 aa, Homo sapiens
  light chain complementarity determining region 3 for antibody 8822
QNYNIAPWT

SEQ ID NO: 17644 - protein, 12 aa, Homo sapiens
  heavy chain complementarity determining region 3 for antibody 8822
ARLDWNYRAFDI

SEQ ID NO: 17645 - protein, 9 aa, Homo sapiens
  light chain complementarity determining region 3 for antibody 8823
QNYKAYPHT

SEQ ID NO: 17646 - protein, 11 aa, Homo sapiens
  heavy chain complementarity determining region 3 for antibody 8823
AREGALYAFDF

SEQ ID NO: 17647 - protein, 9 aa, Homo sapiens
  light chain complementarity determining region 3 for antibody 8824
QNYDDWPPT

SEQ ID NO: 17648 - protein, 17 aa, Homo sapiens
  heavy chain complementarity determining region 3 for antibody 8824
ARDHCLDSAIYCTYFDC

SEQ ID NO: 17649 - protein, 9 aa, Homo sapiens
  light chain complementarity determining region 3 for antibody 8825
QNYDDWPHT

SEQ ID NO: 17650 - protein, 13 aa, Homo sapiens
  heavy chain complementarity determining region 3 for antibody 8825
AKEGSSPGPDFEY

SEQ ID NO: 17651 - protein, 9 aa, Homo sapiens
  light chain complementarity determining region 3 for antibody 8826
QMYNTVPWA

SEQ ID NO: 17652 - protein, 20 aa, Homo sapiens
  heavy chain complementarity determining region 3 for antibody 8826
TRDQRSIHLWLLAEGGGMDV

SEQ ID NO: 17653 - protein, 7 aa, Homo sapiens
  light chain complementarity determining region 3 for antibody 8827
QLYGSYT

SEQ ID NO: 17654 - protein, 10 aa, Homo sapiens
  heavy chain complementarity determining region 3 for antibody 8827
ARRWERYFDY

SEQ ID NO: 17655 - protein, 9 aa, Homo sapiens
  light chain complementarity determining region 3 for antibody 8828
QLYADSPNT

SEQ ID NO: 17656 - protein, 9 aa, Homo sapiens
  heavy chain complementarity determining region 3 for antibody 8828
ASLYGSGSR

SEQ ID NO: 17657 - protein, 9 aa, Homo sapiens
  light chain complementarity determining region 3 for antibody 8829
QLTYSSPWT

SEQ ID NO: 17658 - protein, 15 aa, Homo sapiens
  heavy chain complementarity determining region 3 for antibody 8829
ARIWTSSTNCRYMDV

SEQ ID NO: 17659 - protein, 9 aa, Homo sapiens
  light chain complementarity determining region 3 for antibody 8830
QLTGSSLLT

SEQ ID NO: 17660 - protein, 12 aa, Homo sapiens
  heavy chain complementarity determining region 3 for antibody 8830
ALDEWHPSWYKY

SEQ ID NO: 17661 - protein, 9 aa, Homo sapiens
  light chain complementarity determining region 3 for antibody 8831
QLSGSSLLT

SEQ ID NO: 17662 - protein, 11 aa, Homo sapiens
  heavy chain complementarity determining region 3 for antibody 8831
VRVSTGWNFDY

SEQ ID NO: 17663 - protein, 9 aa, Homo sapiens
  light chain complementarity determining region 3 for antibody 8832
QLSGSSLLT

SEQ ID NO: 17664 - protein, 12 aa, Homo sapiens
  heavy chain complementarity determining region 3 for antibody 8832
TRDPEGDEDFDY

SEQ ID NO: 17665 - protein, 9 aa, Homo sapiens
  light chain complementarity determining region 3 for antibody 8833
QLSGSSLLT

SEQ ID NO: 17666 - protein, 12 aa, Homo sapiens
  heavy chain complementarity determining region 3 for antibody 8833
TLDEWHPSWYKY

SEQ ID NO: 17667 - protein, 9 aa, Homo sapiens
  light chain complementarity determining region 3 for antibody 8834
QLSGSSLLT

SEQ ID NO: 17668 - protein, 16 aa, Homo sapiens
  heavy chain complementarity determining region 3 for antibody 8834
GRQVISATKWPNRLDY

SEQ ID NO: 17669 - protein, 9 aa, Homo sapiens
  light chain complementarity determining region 3 for antibody 8835
QLSGSSLLT

SEQ ID NO: 17670 - protein, 14 aa, Homo sapiens
  heavy chain complementarity determining region 3 for antibody 8835
GRDTTHDWSDGGIY

SEQ ID NO: 17671 - protein, 9 aa, Homo sapiens
  light chain complementarity determining region 3 for antibody 8836
QLSGSSLLT

SEQ ID NO: 17672 - protein, 10 aa, Homo sapiens
  heavy chain complementarity determining region 3 for antibody 8836
CRDREGFGDV

SEQ ID NO: 17673 - protein, 9 aa, Homo sapiens
  light chain complementarity determining region 3 for antibody 8837
QLSGSSLLT

SEQ ID NO: 17674 - protein, 16 aa, Homo sapiens
  heavy chain complementarity determining region 3 for antibody 8837
ASPNTLGRLVGVAFDY

SEQ ID NO: 17675 - protein, 9 aa, Homo sapiens
  light chain complementarity determining region 3 for antibody 8838
QLSGSSLLT

SEQ ID NO: 17676 - protein, 12 aa, Homo sapiens
  heavy chain complementarity determining region 3 for antibody 8838
ASDEWHPSWYKY

SEQ ID NO: 17677 - protein, 9 aa, Homo sapiens
  light chain complementarity determining region 3 for antibody 8839
QLSGSSLLT

SEQ ID NO: 17678 - protein, 17 aa, Homo sapiens
  heavy chain complementarity determining region 3 for antibody 8839
ARNTMVGTWQRHGNLDH

SEQ ID NO: 17679 - protein, 9 aa, Homo sapiens
  light chain complementarity determining region 3 for antibody 8840
QLSGSSLLT

SEQ ID NO: 17680 - protein, 14 aa, Homo sapiens
  heavy chain complementarity determining region 3 for antibody 8840
ARLHGSGLGRWLDP

SEQ ID NO: 17681 - protein, 9 aa, Homo sapiens
  light chain complementarity determining region 3 for antibody 8841
QLSGSSLLT

SEQ ID NO: 17682 - protein, 23 aa, Homo sapiens
  heavy chain complementarity determining region 3 for antibody 8841
ARHFPMGGSTVTGTQSLLYYMDV

SEQ ID NO: 17683 - protein, 9 aa, Homo sapiens
  light chain complementarity determining region 3 for antibody 8842
QLSGSSLLT

SEQ ID NO: 17684 - protein, 16 aa, Homo sapiens
  heavy chain complementarity determining region 3 for antibody 8842
ARGHPYCGGDCYHFDY

SEQ ID NO: 17685 - protein, 9 aa, Homo sapiens
  light chain complementarity determining region 3 for antibody 8843
QLSGSSLLT

SEQ ID NO: 17686 - protein, 12 aa, Homo sapiens
  heavy chain complementarity determining region 3 for antibody 8843
ALDVWHPSWYKY

SEQ ID NO: 17687 - protein, 9 aa, Homo sapiens
  light chain complementarity determining region 3 for antibody 8844
QLSGSSLLT

SEQ ID NO: 17688 - protein, 12 aa, Homo sapiens
  heavy chain complementarity determining region 3 for antibody 8844
ALDEWQPSWYKY

SEQ ID NO: 17689 - protein, 9 aa, Homo sapiens
  light chain complementarity determining region 3 for antibody 8845
QLSGSSLLT

SEQ ID NO: 17690 - protein, 12 aa, Homo sapiens
  heavy chain complementarity determining region 3 for antibody 8845
ALDEWNPSWYKY

SEQ ID NO: 17691 - protein, 9 aa, Homo sapiens
  light chain complementarity determining region 3 for antibody 8846
QLSGSSLLT

SEQ ID NO: 17692 - protein, 12 aa, Homo sapiens
  heavy chain complementarity determining region 3 for antibody 8846
ALDEWHRSWYKY

SEQ ID NO: 17693 - protein, 9 aa, Homo sapiens
  light chain complementarity determining region 3 for antibody 8847
QLSGSSLLT

SEQ ID NO: 17694 - protein, 12 aa, Homo sapiens
  heavy chain complementarity determining region 3 for antibody 8847
ALDEWHPSWYRY

SEQ ID NO: 17695 - protein, 9 aa, Homo sapiens
  light chain complementarity determining region 3 for antibody 8848
QLSGSSLLT

SEQ ID NO: 17696 - protein, 12 aa, Homo sapiens
  heavy chain complementarity determining region 3 for antibody 8848
ALDEWHPSLYKY

SEQ ID NO: 17697 - protein, 9 aa, Homo sapiens
  light chain complementarity determining region 3 for antibody 8849
QLSGSSLLT

SEQ ID NO: 17698 - protein, 12 aa, Homo sapiens
  heavy chain complementarity determining region 3 for antibody 8849
ALDEWHPGWYKY

SEQ ID NO: 17699 - protein, 9 aa, Homo sapiens
  light chain complementarity determining region 3 for antibody 8850
QLSGSSLLT

SEQ ID NO: 17700 - protein, 12 aa, Homo sapiens
  heavy chain complementarity determining region 3 for antibody 8850
ALDEWHHSWYKY

SEQ ID NO: 17701 - protein, 9 aa, Homo sapiens
  light chain complementarity determining region 3 for antibody 8851
QLSGSSLLT

SEQ ID NO: 17702 - protein, 16 aa, Homo sapiens
  heavy chain complementarity determining region 3 for antibody 8851
AKERGYSSAWYGDLDY

SEQ ID NO: 17703 - protein, 9 aa, Homo sapiens
  light chain complementarity determining region 3 for antibody 8852
QLSGSSLLT

SEQ ID NO: 17704 - protein, 13 aa, Homo sapiens
  heavy chain complementarity determining region 3 for antibody 8852
AKEGSSPGPDFEY

SEQ ID NO: 17705 - protein, 9 aa, Homo sapiens
  light chain complementarity determining region 3 for antibody 8853
QLSGSSILT

SEQ ID NO: 17706 - protein, 12 aa, Homo sapiens
  heavy chain complementarity determining region 3 for antibody 8853
ALDEWHPSWYKY

SEQ ID NO: 17707 - protein, 9 aa, Homo sapiens
  light chain complementarity determining region 3 for antibody 8854
QLSGGSLLT

SEQ ID NO: 17708 - protein, 12 aa, Homo sapiens
  heavy chain complementarity determining region 3 for antibody 8854
ALDEWPPSWYKY

SEQ ID NO: 17709 - protein, 9 aa, Homo sapiens
  light chain complementarity determining region 3 for antibody 8855
QLFSDFPRT

SEQ ID NO: 17710 - protein, 9 aa, Homo sapiens
  heavy chain complementarity determining region 3 for antibody 8855
VRGRNNFRY

SEQ ID NO: 17711 - protein, 9 aa, Homo sapiens
  light chain complementarity determining region 3 for antibody 8856
QKYYTVQLT

SEQ ID NO: 17712 - protein, 10 aa, Homo sapiens
  heavy chain complementarity determining region 3 for antibody 8856
VGGEGWLTDF

SEQ ID NO: 17713 - protein, 9 aa, Homo sapiens
  light chain complementarity determining region 3 for antibody 8857
QKYYTVPLT

SEQ ID NO: 17714 - protein, 10 aa, Homo sapiens
  heavy chain complementarity determining region 3 for antibody 8857
VGGEGWLPDF

SEQ ID NO: 17715 - protein, 9 aa, Homo sapiens
  light chain complementarity determining region 3 for antibody 8858
QKYYTVPLT

SEQ ID NO: 17716 - protein, 10 aa, Homo sapiens
  heavy chain complementarity determining region 3 for antibody 8858
GGGGGWLTDF

SEQ ID NO: 17717 - protein, 9 aa, Homo sapiens
  light chain complementarity determining region 3 for antibody 8859
QKYYTVPLT

SEQ ID NO: 17718 - protein, 17 aa, Homo sapiens
  heavy chain complementarity determining region 3 for antibody 8859
ARNTMVGTWQRQGNLDH

SEQ ID NO: 17719 - protein, 9 aa, Homo sapiens
  light chain complementarity determining region 3 for antibody 8860
QKYYSVPLT

SEQ ID NO: 17720 - protein, 15 aa, Homo sapiens
  heavy chain complementarity determining region 3 for antibody 8860
GKEGPGSSGWLTGHY

SEQ ID NO: 17721 - protein, 9 aa, Homo sapiens
  light chain complementarity determining region 3 for antibody 8861
QKYRSAPFT

SEQ ID NO: 17722 - protein, 13 aa, Homo sapiens
  heavy chain complementarity determining region 3 for antibody 8861
AKEGSSPGPDFEY

SEQ ID NO: 17723 - protein, 9 aa, Homo sapiens
  light chain complementarity determining region 3 for antibody 8862
QKYNTAPFT

SEQ ID NO: 17724 - protein, 13 aa, Homo sapiens
  heavy chain complementarity determining region 3 for antibody 8862
TREGDSSGPDFHL

SEQ ID NO: 17725 - protein, 9 aa, Homo sapiens
  light chain complementarity determining region 3 for antibody 8863
QKYNTAPFT

SEQ ID NO: 17726 - protein, 12 aa, Homo sapiens
  heavy chain complementarity determining region 3 for antibody 8863
ARGGLRDGAFDI

SEQ ID NO: 17727 - protein, 9 aa, Homo sapiens
  light chain complementarity determining region 3 for antibody 8864
QKYNSVPWT

SEQ ID NO: 17728 - protein, 17 aa, Homo sapiens
  heavy chain complementarity determining region 3 for antibody 8864
TRDRADSTWSSANRRDS

SEQ ID NO: 17729 - protein, 9 aa, Homo sapiens
  light chain complementarity determining region 3 for antibody 8865
QKYNSVPRT

SEQ ID NO: 17730 - protein, 17 aa, Homo sapiens
  heavy chain complementarity determining region 3 for antibody 8865
TRDRADSTWTSANRRDS

SEQ ID NO: 17731 - protein, 9 aa, Homo sapiens
  light chain complementarity determining region 3 for antibody 8866
QKYNSVPCT

SEQ ID NO: 17732 - protein, 17 aa, Homo sapiens
  heavy chain complementarity determining region 3 for antibody 8866
TRDRADSTWTSANRRDS

SEQ ID NO: 17733 - protein, 9 aa, Homo sapiens
  light chain complementarity determining region 3 for antibody 8867
QKYNSSFLT

SEQ ID NO: 17734 - protein, 18 aa, Homo sapiens
  heavy chain complementarity determining region 3 for antibody 8867
ARWAGSCSGRSCYAPFDF

SEQ ID NO: 17735 - protein, 9 aa, Homo sapiens
  light chain complementarity determining region 3 for antibody 8868
QKYNSAPWT

SEQ ID NO: 17736 - protein, 12 aa, Homo sapiens
  heavy chain complementarity determining region 3 for antibody 8868
ARELGTSCPFDY

SEQ ID NO: 17737 - protein, 9 aa, Homo sapiens
  light chain complementarity determining region 3 for antibody 8869
QKYNSAPVI

SEQ ID NO: 17738 - protein, 16 aa, Homo sapiens
  heavy chain complementarity determining region 3 for antibody 8869
VRGLSFYSRAWGVLDY

SEQ ID NO: 17739 - protein, 10 aa, Homo sapiens
  light chain complementarity determining region 3 for antibody 8870
QKYNSAPRVT

SEQ ID NO: 17740 - protein, 11 aa, Homo sapiens
  heavy chain complementarity determining region 3 for antibody 8870
ATCGQQWRLAH

SEQ ID NO: 17741 - protein, 9 aa, Homo sapiens
  light chain complementarity determining region 3 for antibody 8871
QKYNSAPQT

SEQ ID NO: 17742 - protein, 15 aa, Homo sapiens
  heavy chain complementarity determining region 3 for antibody 8871
TTDYVDKSVLLAFDS

SEQ ID NO: 17743 - protein, 9 aa, Homo sapiens
  light chain complementarity determining region 3 for antibody 8872
QKYNSAPLT

SEQ ID NO: 17744 - protein, 25 aa, Homo sapiens
  heavy chain complementarity determining region 3 for antibody 8872
AHTRGYCSGPGCYTSATIHLNWFDP

SEQ ID NO: 17745 - protein, 9 aa, Homo sapiens
  light chain complementarity determining region 3 for antibody 8873
QKYNSAPHT

SEQ ID NO: 17746 - protein, 17 aa, Homo sapiens
  heavy chain complementarity determining region 3 for antibody 8873
ARNTMVGTWQRQGNLDH

SEQ ID NO: 17747 - protein, 9 aa, Homo sapiens
  light chain complementarity determining region 3 for antibody 8874
QKYNSAPHT

SEQ ID NO: 17748 - protein, 12 aa, Homo sapiens
  heavy chain complementarity determining region 3 for antibody 8874
ARDKGGRNGMDV

SEQ ID NO: 17749 - protein, 9 aa, Homo sapiens
  light chain complementarity determining region 3 for antibody 8875
QKYNSAPFT

SEQ ID NO: 17750 - protein, 10 aa, Homo sapiens
  heavy chain complementarity determining region 3 for antibody 8875
VREGHWNLDP

SEQ ID NO: 17751 - protein, 8 aa, Homo sapiens
  light chain complementarity determining region 3 for antibody 8876
QKYNSALT

SEQ ID NO: 17752 - protein, 13 aa, Homo sapiens
  heavy chain complementarity determining region 3 for antibody 8876
AKRYSTNWGHFDY

SEQ ID NO: 17753 - protein, 9 aa, Homo sapiens
  light chain complementarity determining region 3 for antibody 8877
QKYNSAFLT

SEQ ID NO: 17754 - protein, 18 aa, Homo sapiens
  heavy chain complementarity determining region 3 for antibody 8877
ARWAGSCSGRSGYAPFDF

SEQ ID NO: 17755 - protein, 9 aa, Homo sapiens
  light chain complementarity determining region 3 for antibody 8878
QKYNSAFLT

SEQ ID NO: 17756 - protein, 18 aa, Homo sapiens
  heavy chain complementarity determining region 3 for antibody 8878
ARWAGSCSGGSCYAPFDF

SEQ ID NO: 17757 - protein, 9 aa, Homo sapiens
  light chain complementarity determining region 3 for antibody 8879
QKYNSAFLP

SEQ ID NO: 17758 - protein, 18 aa, Homo sapiens
  heavy chain complementarity determining region 3 for antibody 8879
ARWAGSCSGRSCYAPFDF

SEQ ID NO: 17759 - protein, 9 aa, Homo sapiens
  light chain complementarity determining region 3 for antibody 8880
QKYNNVPWT

SEQ ID NO: 17760 - protein, 10 aa, Homo sapiens
  heavy chain complementarity determining region 3 for antibody 8880
ARERSCSYDI

SEQ ID NO: 17761 - protein, 9 aa, Homo sapiens
  light chain complementarity determining region 3 for antibody 8881
QKYNNVPWT

SEQ ID NO: 17762 - protein, 12 aa, Homo sapiens
  heavy chain complementarity determining region 3 for antibody 8881
ARDKGGRNGMDV

SEQ ID NO: 17763 - protein, 9 aa, Homo sapiens
  light chain complementarity determining region 3 for antibody 8882
QKYNNVPRT

SEQ ID NO: 17764 - protein, 10 aa, Homo sapiens
  heavy chain complementarity determining region 3 for antibody 8882
ARERSGSYDI

SEQ ID NO: 17765 - protein, 9 aa, Homo sapiens
  light chain complementarity determining region 3 for antibody 8883
QKYNNAPPT

SEQ ID NO: 17766 - protein, 13 aa, Homo sapiens
  heavy chain complementarity determining region 3 for antibody 8883
ASEKDGSGGAFDI

SEQ ID NO: 17767 - protein, 9 aa, Homo sapiens
  light chain complementarity determining region 3 for antibody 8884
QKYNIYPWT

SEQ ID NO: 17768 - protein, 15 aa, Homo sapiens
  heavy chain complementarity determining region 3 for antibody 8884
ARIRGEQQTGGPFDY

SEQ ID NO: 17769 - protein, 10 aa, Homo sapiens
  light chain complementarity determining region 3 for antibody 8885
QKYKTAPPLP

SEQ ID NO: 17770 - protein, 12 aa, Homo sapiens
  heavy chain complementarity determining region 3 for antibody 8885
TRGDKYGDYAVY

SEQ ID NO: 17771 - protein, 8 aa, Homo sapiens
  light chain complementarity determining region 3 for antibody 8886
QKYKSYWT

SEQ ID NO: 17772 - protein, 10 aa, Homo sapiens
  heavy chain complementarity determining region 3 for antibody 8886
ARERSGSYDI

SEQ ID NO: 17773 - protein, 9 aa, Homo sapiens
  light chain complementarity determining region 3 for antibody 8887
QKYKSVPFT

SEQ ID NO: 17774 - protein, 13 aa, Homo sapiens
  heavy chain complementarity determining region 3 for antibody 8887
AKEGSSPGPDFEY

SEQ ID NO: 17775 - protein, 9 aa, Homo sapiens
  light chain complementarity determining region 3 for antibody 8888
QKYKSAPFT

SEQ ID NO: 17776 - protein, 13 aa, Homo sapiens
  heavy chain complementarity determining region 3 for antibody 8888
SKEGSSPGPDFEY

SEQ ID NO: 17777 - protein, 9 aa, Homo sapiens
  light chain complementarity determining region 3 for antibody 8889
QKYKSAPFT

SEQ ID NO: 17778 - protein, 15 aa, Homo sapiens
  heavy chain complementarity determining region 3 for antibody 8889
ARVGRPYHNAWYFDN

SEQ ID NO: 17779 - protein, 9 aa, Homo sapiens
  light chain complementarity determining region 3 for antibody 8890
QKYKSAPFT

SEQ ID NO: 17780 - protein, 10 aa, Homo sapiens
  heavy chain complementarity determining region 3 for antibody 8890
ARETSGSYDI

SEQ ID NO: 17781 - protein, 9 aa, Homo sapiens
  light chain complementarity determining region 3 for antibody 8891
QKYKSAPFT

SEQ ID NO: 17782 - protein, 12 aa, Homo sapiens
  heavy chain complementarity determining region 3 for antibody 8891
ARDKGGRNGMDV

SEQ ID NO: 17783 - protein, 9 aa, Homo sapiens
  light chain complementarity determining region 3 for antibody 8892
QKYKSAPFT

SEQ ID NO: 17784 - protein, 13 aa, Homo sapiens
  heavy chain complementarity determining region 3 for antibody 8892
ANEGSSPGPDFEY

SEQ ID NO: 17785 - protein, 9 aa, Homo sapiens
  light chain complementarity determining region 3 for antibody 8893
QKYKSAPFT

SEQ ID NO: 17786 - protein, 13 aa, Homo sapiens
  heavy chain complementarity determining region 3 for antibody 8893
AKEGYSPGPDFEY

SEQ ID NO: 17787 - protein, 9 aa, Homo sapiens
  light chain complementarity determining region 3 for antibody 8894
QKYKSAPFT

SEQ ID NO: 17788 - protein, 13 aa, Homo sapiens
  heavy chain complementarity determining region 3 for antibody 8894
AKEGSSRGPDFEY

SEQ ID NO: 17789 - protein, 9 aa, Homo sapiens
  light chain complementarity determining region 3 for antibody 8895
QKYKSAPFT

SEQ ID NO: 17790 - protein, 13 aa, Homo sapiens
  heavy chain complementarity determining region 3 for antibody 8895
AKEGSSPGPSTQS

SEQ ID NO: 17791 - protein, 9 aa, Homo sapiens
  light chain complementarity determining region 3 for antibody 8896
QKYKSAPFT

SEQ ID NO: 17792 - protein, 13 aa, Homo sapiens
  heavy chain complementarity determining region 3 for antibody 8896
AKEGSSPGPDSEY

SEQ ID NO: 17793 - protein, 9 aa, Homo sapiens
  light chain complementarity determining region 3 for antibody 8897
QKYKSAPFT

SEQ ID NO: 17794 - protein, 13 aa, Homo sapiens
  heavy chain complementarity determining region 3 for antibody 8897
AKEGSSPGPAFEY

SEQ ID NO: 17795 - protein, 9 aa, Homo sapiens
  light chain complementarity determining region 3 for antibody 8898
QKYKSAPFT

SEQ ID NO: 17796 - protein, 13 aa, Homo sapiens
  heavy chain complementarity determining region 3 for antibody 8898
AKEGSSPGLDFEY

SEQ ID NO: 17797 - protein, 9 aa, Homo sapiens
  light chain complementarity determining region 3 for antibody 8899
QKYKSAPFT

SEQ ID NO: 17798 - protein, 13 aa, Homo sapiens
  heavy chain complementarity determining region 3 for antibody 8899
AKDGSSPGPDFEY

SEQ ID NO: 17799 - protein, 9 aa, Homo sapiens
  light chain complementarity determining region 3 for antibody 8900
QKYKSAPFP

SEQ ID NO: 17800 - protein, 13 aa, Homo sapiens
  heavy chain complementarity determining region 3 for antibody 8900
AKEGSSPGPDFEY

SEQ ID NO: 17801 - protein, 9 aa, Homo sapiens
  light chain complementarity determining region 3 for antibody 8901
QKYKHVPWT

SEQ ID NO: 17802 - protein, 20 aa, Homo sapiens
  heavy chain complementarity determining region 3 for antibody 8901
TREQRSIHLWSFSEGGGMDV

SEQ ID NO: 17803 - protein, 9 aa, Homo sapiens
  light chain complementarity determining region 3 for antibody 8902
QKYKHVPWT

SEQ ID NO: 17804 - protein, 10 aa, Homo sapiens
  heavy chain complementarity determining region 3 for antibody 8902
ARKRSGSYDI

SEQ ID NO: 17805 - protein, 9 aa, Homo sapiens
  light chain complementarity determining region 3 for antibody 8903
QKYKHVPWT

SEQ ID NO: 17806 - protein, 10 aa, Homo sapiens
  heavy chain complementarity determining region 3 for antibody 8903
ARETSGSYDI

SEQ ID NO: 17807 - protein, 9 aa, Homo sapiens
  light chain complementarity determining region 3 for antibody 8904
QKYKHVPWT

SEQ ID NO: 17808 - protein, 10 aa, Homo sapiens
  heavy chain complementarity determining region 3 for antibody 8904
ARESSGSYDI

SEQ ID NO: 17809 - protein, 9 aa, Homo sapiens
  light chain complementarity determining region 3 for antibody 8905
QKYKHVPWT

SEQ ID NO: 17810 - protein, 10 aa, Homo sapiens
  heavy chain complementarity determining region 3 for antibody 8905
ARERYGSYDI

SEQ ID NO: 17811 - protein, 9 aa, Homo sapiens
  light chain complementarity determining region 3 for antibody 8906
QKYKHVPWT

SEQ ID NO: 17812 - protein, 10 aa, Homo sapiens
  heavy chain complementarity determining region 3 for antibody 8906
ARERSGYYDI

SEQ ID NO: 17813 - protein, 9 aa, Homo sapiens
  light chain complementarity determining region 3 for antibody 8907
QKYKHVPWT

SEQ ID NO: 17814 - protein, 10 aa, Homo sapiens
  heavy chain complementarity determining region 3 for antibody 8907
AREISGSYDI

SEQ ID NO: 17815 - protein, 9 aa, Homo sapiens
  light chain complementarity determining region 3 for antibody 8908
QKYKHVPWT

SEQ ID NO: 17816 - protein, 10 aa, Homo sapiens
  heavy chain complementarity determining region 3 for antibody 8908
AREGSGSYDI

SEQ ID NO: 17817 - protein, 9 aa, Homo sapiens
  light chain complementarity determining region 3 for antibody 8909
QKYKHVPWT

SEQ ID NO: 17818 - protein, 13 aa, Homo sapiens
  heavy chain complementarity determining region 3 for antibody 8909
AKEGSSPGPDFEY

SEQ ID NO: 17819 - protein, 9 aa, Homo sapiens
  light chain complementarity determining region 3 for antibody 8910
QKYKHVPWK

SEQ ID NO: 17820 - protein, 10 aa, Homo sapiens
  heavy chain complementarity determining region 3 for antibody 8910
ARERSGSYDI

SEQ ID NO: 17821 - protein, 9 aa, Homo sapiens
  light chain complementarity determining region 3 for antibody 8911
QKYKHVPGT

SEQ ID NO: 17822 - protein, 10 aa, Homo sapiens
  heavy chain complementarity determining region 3 for antibody 8911
ARERSGSYDI

SEQ ID NO: 17823 - protein, 9 aa, Homo sapiens
  light chain complementarity determining region 3 for antibody 8912
QKYGYSPVP

SEQ ID NO: 17824 - protein, 18 aa, Homo sapiens
  heavy chain complementarity determining region 3 for antibody 8912
ARGDYPEGRTGYFLDFDY

SEQ ID NO: 17825 - protein, 9 aa, Homo sapiens
  light chain complementarity determining region 3 for antibody 8913
QKYGSTPVP

SEQ ID NO: 17826 - protein, 18 aa, Homo sapiens
  heavy chain complementarity determining region 3 for antibody 8913
ARGDYPEARTGYFLDFDY

SEQ ID NO: 17827 - protein, 9 aa, Homo sapiens
  light chain complementarity determining region 3 for antibody 8914
QKYGSSQVP

SEQ ID NO: 17828 - protein, 18 aa, Homo sapiens
  heavy chain complementarity determining region 3 for antibody 8914
ARGDYPEARTGYFLDFDY

SEQ ID NO: 17829 - protein, 9 aa, Homo sapiens
  light chain complementarity determining region 3 for antibody 8915
QKYGSSPWT

SEQ ID NO: 17830 - protein, 10 aa, Homo sapiens
  heavy chain complementarity determining region 3 for antibody 8915
ARERSGSYDI

SEQ ID NO: 17831 - protein, 9 aa, Homo sapiens
  light chain complementarity determining region 3 for antibody 8916
QKYGSSPVS

SEQ ID NO: 17832 - protein, 18 aa, Homo sapiens
  heavy chain complementarity determining region 3 for antibody 8916
ARGDYPEARTGYFLDFDY

SEQ ID NO: 17833 - protein, 9 aa, Homo sapiens
  light chain complementarity determining region 3 for antibody 8917
QKYGSSPVP

SEQ ID NO: 17834 - protein, 9 aa, Homo sapiens
  heavy chain complementarity determining region 3 for antibody 8917
ARSEYQPTY

SEQ ID NO: 17835 - protein, 9 aa, Homo sapiens
  light chain complementarity determining region 3 for antibody 8918
QKYGSSPVP

SEQ ID NO: 17836 - protein, 17 aa, Homo sapiens
  heavy chain complementarity determining region 3 for antibody 8918
ARNTMVGTWQRQGNLDH

SEQ ID NO: 17837 - protein, 9 aa, Homo sapiens
  light chain complementarity determining region 3 for antibody 8919
QKYGSSPVP

SEQ ID NO: 17838 - protein, 18 aa, Homo sapiens
  heavy chain complementarity determining region 3 for antibody 8919
ARGNYPEARTGYFLDFDY

SEQ ID NO: 17839 - protein, 9 aa, Homo sapiens
  light chain complementarity determining region 3 for antibody 8920
QKYGSSPVP

SEQ ID NO: 17840 - protein, 18 aa, Homo sapiens
  heavy chain complementarity determining region 3 for antibody 8920
ARGGYPEARTGYFLDFDY

SEQ ID NO: 17841 - protein, 9 aa, Homo sapiens
  light chain complementarity determining region 3 for antibody 8921
QKYGSSPVP

SEQ ID NO: 17842 - protein, 18 aa, Homo sapiens
  heavy chain complementarity determining region 3 for antibody 8921
ARGEYPEARTGYFLDFDY

SEQ ID NO: 17843 - protein, 9 aa, Homo sapiens
  light chain complementarity determining region 3 for antibody 8922
QKYGSSPVP

SEQ ID NO: 17844 - protein, 18 aa, Homo sapiens
  heavy chain complementarity determining region 3 for antibody 8922
ARGDYSEARTGYFLDFDY

SEQ ID NO: 17845 - protein, 9 aa, Homo sapiens
  light chain complementarity determining region 3 for antibody 8923
QKYGSSPVP

SEQ ID NO: 17846 - protein, 18 aa, Homo sapiens
  heavy chain complementarity determining region 3 for antibody 8923
ARGDYPKARTGYFLDFDY

SEQ ID NO: 17847 - protein, 9 aa, Homo sapiens
  light chain complementarity determining region 3 for antibody 8924
QKYGSSPVP

SEQ ID NO: 17848 - protein, 18 aa, Homo sapiens
  heavy chain complementarity determining region 3 for antibody 8924
ARGDYPGARTGYFLDFDY

SEQ ID NO: 17849 - protein, 9 aa, Homo sapiens
  light chain complementarity determining region 3 for antibody 8925
QKYGSSPVP

SEQ ID NO: 17850 - protein, 18 aa, Homo sapiens
  heavy chain complementarity determining region 3 for antibody 8925
ARGDYPEGRTGYFLDFDY

SEQ ID NO: 17851 - protein, 9 aa, Homo sapiens
  light chain complementarity determining region 3 for antibody 8926
QKYGSSPVP

SEQ ID NO: 17852 - protein, 18 aa, Homo sapiens
  heavy chain complementarity determining region 3 for antibody 8926
ARGDYPEASTGYFLDFDY

SEQ ID NO: 17853 - protein, 9 aa, Homo sapiens
  light chain complementarity determining region 3 for antibody 8927
QKYGSSPVP

SEQ ID NO: 17854 - protein, 18 aa, Homo sapiens
  heavy chain complementarity determining region 3 for antibody 8927
ARGDYPEARTGYYLDFDY

SEQ ID NO: 17855 - protein, 9 aa, Homo sapiens
  light chain complementarity determining region 3 for antibody 8928
QKYGSSPVP

SEQ ID NO: 17856 - protein, 18 aa, Homo sapiens
  heavy chain complementarity determining region 3 for antibody 8928
ARGDYPEARTGYVLDFDY

SEQ ID NO: 17857 - protein, 9 aa, Homo sapiens
  light chain complementarity determining region 3 for antibody 8929
QKYGSSPVP

SEQ ID NO: 17858 - protein, 18 aa, Homo sapiens
  heavy chain complementarity determining region 3 for antibody 8929
ARGDYPEARTGYFRGFDY

SEQ ID NO: 17859 - protein, 9 aa, Homo sapiens
  light chain complementarity determining region 3 for antibody 8930
QKYGSSPVP

SEQ ID NO: 17860 - protein, 18 aa, Homo sapiens
  heavy chain complementarity determining region 3 for antibody 8930
ARGDYPEARTGYFLDFAY

SEQ ID NO: 17861 - protein, 9 aa, Homo sapiens
  light chain complementarity determining region 3 for antibody 8931
QKYGSSPVP

SEQ ID NO: 17862 - protein, 18 aa, Homo sapiens
  heavy chain complementarity determining region 3 for antibody 8931
ARGDYPEARTGYCLDFDY

SEQ ID NO: 17863 - protein, 9 aa, Homo sapiens
  light chain complementarity determining region 3 for antibody 8932
QKYGSSPVP

SEQ ID NO: 17864 - protein, 18 aa, Homo sapiens
  heavy chain complementarity determining region 3 for antibody 8932
ARGDYPEARTGCFLDFDY

SEQ ID NO: 17865 - protein, 9 aa, Homo sapiens
  light chain complementarity determining region 3 for antibody 8933
QKYGSSPVP

SEQ ID NO: 17866 - protein, 18 aa, Homo sapiens
  heavy chain complementarity determining region 3 for antibody 8933
ARGDYPEARPGYFLDFDY

SEQ ID NO: 17867 - protein, 9 aa, Homo sapiens
  light chain complementarity determining region 3 for antibody 8934
QKYGSSPVP

SEQ ID NO: 17868 - protein, 18 aa, Homo sapiens
  heavy chain complementarity determining region 3 for antibody 8934
ARGDYPEAGTGYFLDFDY

SEQ ID NO: 17869 - protein, 9 aa, Homo sapiens
  light chain complementarity determining region 3 for antibody 8935
QKYGSSPVP

SEQ ID NO: 17870 - protein, 18 aa, Homo sapiens
  heavy chain complementarity determining region 3 for antibody 8935
ARGDHPEARTGYFLDFDY

SEQ ID NO: 17871 - protein, 9 aa, Homo sapiens
  light chain complementarity determining region 3 for antibody 8936
QKYGSSPVP

SEQ ID NO: 17872 - protein, 18 aa, Homo sapiens
  heavy chain complementarity determining region 3 for antibody 8936
ARGDFPEARTGYFLDFDY

SEQ ID NO: 17873 - protein, 9 aa, Homo sapiens
  light chain complementarity determining region 3 for antibody 8937
QKYGSSPVP

SEQ ID NO: 17874 - protein, 18 aa, Homo sapiens
  heavy chain complementarity determining region 3 for antibody 8937
ARGAYPEARTGYFLDFDY

SEQ ID NO: 17875 - protein, 9 aa, Homo sapiens
  light chain complementarity determining region 3 for antibody 8938
QKYGSSPVP

SEQ ID NO: 17876 - protein, 10 aa, Homo sapiens
  heavy chain complementarity determining region 3 for antibody 8938
ARERSGSYDI

SEQ ID NO: 17877 - protein, 9 aa, Homo sapiens
  light chain complementarity determining region 3 for antibody 8939
QKYGSSPIP

SEQ ID NO: 17878 - protein, 18 aa, Homo sapiens
  heavy chain complementarity determining region 3 for antibody 8939
ARGDYPEARTGYFLDFDY

SEQ ID NO: 17879 - protein, 9 aa, Homo sapiens
  light chain complementarity determining region 3 for antibody 8940
QKYGSSPFP

SEQ ID NO: 17880 - protein, 18 aa, Homo sapiens
  heavy chain complementarity determining region 3 for antibody 8940
ARGDYPEARTGYFLDFDY

SEQ ID NO: 17881 - protein, 9 aa, Homo sapiens
  light chain complementarity determining region 3 for antibody 8941
QKYGSSPDP

SEQ ID NO: 17882 - protein, 18 aa, Homo sapiens
  heavy chain complementarity determining region 3 for antibody 8941
ARGDYPEARTGYFLDFDY

SEQ ID NO: 17883 - protein, 9 aa, Homo sapiens
  light chain complementarity determining region 3 for antibody 8942
QKYGSSLVP

SEQ ID NO: 17884 - protein, 18 aa, Homo sapiens
  heavy chain complementarity determining region 3 for antibody 8942
ARGDYPEARTGYFLDFDY

SEQ ID NO: 17885 - protein, 9 aa, Homo sapiens
  light chain complementarity determining region 3 for antibody 8943
QKYGSAPVP

SEQ ID NO: 17886 - protein, 18 aa, Homo sapiens
  heavy chain complementarity determining region 3 for antibody 8943
ARGGYPEARTGYFLDFDY

SEQ ID NO: 17887 - protein, 9 aa, Homo sapiens
  light chain complementarity determining region 3 for antibody 8944
QKYGSAPVP

SEQ ID NO: 17888 - protein, 18 aa, Homo sapiens
  heavy chain complementarity determining region 3 for antibody 8944
ARGDYPEDRTGYFLDFDY

SEQ ID NO: 17889 - protein, 9 aa, Homo sapiens
  light chain complementarity determining region 3 for antibody 8945
QKYGSAPAP

SEQ ID NO: 17890 - protein, 18 aa, Homo sapiens
  heavy chain complementarity determining region 3 for antibody 8945
ARGDYPEARTGYFLDFDY

SEQ ID NO: 17891 - protein, 9 aa, Homo sapiens
  light chain complementarity determining region 3 for antibody 8946
QKYGDSPVP

SEQ ID NO: 17892 - protein, 18 aa, Homo sapiens
  heavy chain complementarity determining region 3 for antibody 8946
ARGDYPEGRTGYLLDFDY

SEQ ID NO: 17893 - protein, 9 aa, Homo sapiens
  light chain complementarity determining region 3 for antibody 8947
QKYGDSPVP

SEQ ID NO: 17894 - protein, 18 aa, Homo sapiens
  heavy chain complementarity determining region 3 for antibody 8947
ARGDYPEGRTGYFLDLDY

SEQ ID NO: 17895 - protein, 9 aa, Homo sapiens
  light chain complementarity determining region 3 for antibody 8948
QKYGDSPVP

SEQ ID NO: 17896 - protein, 18 aa, Homo sapiens
  heavy chain complementarity determining region 3 for antibody 8948
ARGDYPEGRTGYCLDFDY

SEQ ID NO: 17897 - protein, 9 aa, Homo sapiens
  light chain complementarity determining region 3 for antibody 8949
QKYGDSPVP

SEQ ID NO: 17898 - protein, 18 aa, Homo sapiens
  heavy chain complementarity determining region 3 for antibody 8949
ARGDYPEGRTGDFLDFDY

SEQ ID NO: 17899 - protein, 9 aa, Homo sapiens
  light chain complementarity determining region 3 for antibody 8950
QKYGDSPVP

SEQ ID NO: 17900 - protein, 18 aa, Homo sapiens
  heavy chain complementarity determining region 3 for antibody 8950
ARGDYPEGGTGYFLDFDY

SEQ ID NO: 17901 - protein, 9 aa, Homo sapiens
  light chain complementarity determining region 3 for antibody 8951
QKYGDSPVP

SEQ ID NO: 17902 - protein, 18 aa, Homo sapiens
  heavy chain complementarity determining region 3 for antibody 8951
ARGDYPEARTGYFRDFDY

SEQ ID NO: 17903 - protein, 9 aa, Homo sapiens
  light chain complementarity determining region 3 for antibody 8952
QKYGDSPVP

SEQ ID NO: 17904 - protein, 18 aa, Homo sapiens
  heavy chain complementarity determining region 3 for antibody 8952
ARGDYPEARTAYFRDFDY

SEQ ID NO: 17905 - protein, 9 aa, Homo sapiens
  light chain complementarity determining region 3 for antibody 8953
QKYGDSPVP

SEQ ID NO: 17906 - protein, 18 aa, Homo sapiens
  heavy chain complementarity determining region 3 for antibody 8953
ARGDYAEGRTGYFLDFDY

SEQ ID NO: 17907 - protein, 9 aa, Homo sapiens
  light chain complementarity determining region 3 for antibody 8954
QKYDTAPLT

SEQ ID NO: 17908 - protein, 10 aa, Homo sapiens
  heavy chain complementarity determining region 3 for antibody 8954
VREGNWNLDY

SEQ ID NO: 17909 - protein, 9 aa, Homo sapiens
  light chain complementarity determining region 3 for antibody 8955
QKYDTAPFT

SEQ ID NO: 17910 - protein, 10 aa, Homo sapiens
  heavy chain complementarity determining region 3 for antibody 8955
VREGNWSLDY

SEQ ID NO: 17911 - protein, 9 aa, Homo sapiens
  light chain complementarity determining region 3 for antibody 8956
QKYDTAPFT

SEQ ID NO: 17912 - protein, 10 aa, Homo sapiens
  heavy chain complementarity determining region 3 for antibody 8956
VREGNWNRDY

SEQ ID NO: 17913 - protein, 9 aa, Homo sapiens
  light chain complementarity determining region 3 for antibody 8957
QKYDTAPFT

SEQ ID NO: 17914 - protein, 9 aa, Homo sapiens
  heavy chain complementarity determining region 3 for antibody 8957
ALDHYGPRN

SEQ ID NO: 17915 - protein, 9 aa, Homo sapiens
  light chain complementarity determining region 3 for antibody 8958
QKYDSAPWT

SEQ ID NO: 17916 - protein, 17 aa, Homo sapiens
  heavy chain complementarity determining region 3 for antibody 8958
ARDRPDSTWTSANRRDF

SEQ ID NO: 17917 - protein, 9 aa, Homo sapiens
  light chain complementarity determining region 3 for antibody 8959
QKYDSAPWP

SEQ ID NO: 17918 - protein, 17 aa, Homo sapiens
  heavy chain complementarity determining region 3 for antibody 8959
TRDRPDSTWTSANRRDF

SEQ ID NO: 17919 - protein, 9 aa, Homo sapiens
  light chain complementarity determining region 3 for antibody 8960
QKYDSAPRT

SEQ ID NO: 17920 - protein, 17 aa, Homo sapiens
  heavy chain complementarity determining region 3 for antibody 8960
TRDRPDSTWTSANRRDF

SEQ ID NO: 17921 - protein, 9 aa, Homo sapiens
  light chain complementarity determining region 3 for antibody 8961
QKYASSPVP

SEQ ID NO: 17922 - protein, 18 aa, Homo sapiens
  heavy chain complementarity determining region 3 for antibody 8961
ARGDYPEARTGYFLDFDY

SEQ ID NO: 17923 - protein, 9 aa, Homo sapiens
  light chain complementarity determining region 3 for antibody 8962
QKTYSSPWT

SEQ ID NO: 17924 - protein, 15 aa, Homo sapiens
  heavy chain complementarity determining region 3 for antibody 8962
ARIWTSSTNCRYMDV

SEQ ID NO: 17925 - protein, 11 aa, Homo sapiens
  light chain complementarity determining region 3 for antibody 8963
QKSYSTPPRLT

SEQ ID NO: 17926 - protein, 13 aa, Homo sapiens
  heavy chain complementarity determining region 3 for antibody 8963
TKEGSSAGPDFVY

SEQ ID NO: 17927 - protein, 9 aa, Homo sapiens
  light chain complementarity determining region 3 for antibody 8964
QKSKHVPWT

SEQ ID NO: 17928 - protein, 10 aa, Homo sapiens
  heavy chain complementarity determining region 3 for antibody 8964
ARERSGSYDI

SEQ ID NO: 17929 - protein, 9 aa, Homo sapiens
  light chain complementarity determining region 3 for antibody 8965
QKSHSVPRT

SEQ ID NO: 17930 - protein, 10 aa, Homo sapiens
  heavy chain complementarity determining region 3 for antibody 8965
VRDWWQREDF

SEQ ID NO: 17931 - protein, 9 aa, Homo sapiens
  light chain complementarity determining region 3 for antibody 8966
QKNYSVPLT

SEQ ID NO: 17932 - protein, 12 aa, Homo sapiens
  heavy chain complementarity determining region 3 for antibody 8966
SRDKGGRNGMDV

SEQ ID NO: 17933 - protein, 9 aa, Homo sapiens
  light chain complementarity determining region 3 for antibody 8967
QKLMSYPYT

SEQ ID NO: 17934 - protein, 17 aa, Homo sapiens
  heavy chain complementarity determining region 3 for antibody 8967
ARNTMVHGWQRQGSVDH

SEQ ID NO: 17935 - protein, 9 aa, Homo sapiens
  light chain complementarity determining region 3 for antibody 8968
QKHKSAPFT

SEQ ID NO: 17936 - protein, 13 aa, Homo sapiens
  heavy chain complementarity determining region 3 for antibody 8968
AKEGSAPGPDFEY

SEQ ID NO: 17937 - protein, 9 aa, Homo sapiens
  light chain complementarity determining region 3 for antibody 8969
QKHGSAPVP

SEQ ID NO: 17938 - protein, 18 aa, Homo sapiens
  heavy chain complementarity determining region 3 for antibody 8969
ARGDYPEARTGYFLDFDY

SEQ ID NO: 17939 - protein, 9 aa, Homo sapiens
  light chain complementarity determining region 3 for antibody 8970
QKFSSFPRT

SEQ ID NO: 17940 - protein, 9 aa, Homo sapiens
  heavy chain complementarity determining region 3 for antibody 8970
ARGRNNFRY

SEQ ID NO: 17941 - protein, 9 aa, Homo sapiens
  light chain complementarity determining region 3 for antibody 8971
QKDGDSPVP

SEQ ID NO: 17942 - protein, 18 aa, Homo sapiens
  heavy chain complementarity determining region 3 for antibody 8971
ARGDYPEARTGYFLDFDY

SEQ ID NO: 17943 - protein, 9 aa, Homo sapiens
  light chain complementarity determining region 3 for antibody 8972
QKCKSAPFT

SEQ ID NO: 17944 - protein, 13 aa, Homo sapiens
  heavy chain complementarity determining region 3 for antibody 8972
AKEGSSPGPDFEY

SEQ ID NO: 17945 - protein, 9 aa, Homo sapiens
  light chain complementarity determining region 3 for antibody 8973
QHYYTPPYT

SEQ ID NO: 17946 - protein, 10 aa, Homo sapiens
  heavy chain complementarity determining region 3 for antibody 8973
TRSTYAYNDI

SEQ ID NO: 17947 - protein, 9 aa, Homo sapiens
  light chain complementarity determining region 3 for antibody 8974
QHYYSTPYT

SEQ ID NO: 17948 - protein, 13 aa, Homo sapiens
  heavy chain complementarity determining region 3 for antibody 8974
ATEPYYGSGRGVY

SEQ ID NO: 17949 - protein, 9 aa, Homo sapiens
  light chain complementarity determining region 3 for antibody 8975
QHYYSTPWT

SEQ ID NO: 17950 - protein, 16 aa, Homo sapiens
  heavy chain complementarity determining region 3 for antibody 8975
ARTLSGYHGGWGGFDH

SEQ ID NO: 17951 - protein, 9 aa, Homo sapiens
  light chain complementarity determining region 3 for antibody 8976
QHYYSTPWT

SEQ ID NO: 17952 - protein, 18 aa, Homo sapiens
  heavy chain complementarity determining region 3 for antibody 8976
ARGLHQLRLGGYFYGLDV

SEQ ID NO: 17953 - protein, 9 aa, Homo sapiens
  light chain complementarity determining region 3 for antibody 8977
QHYYSTPPT

SEQ ID NO: 17954 - protein, 10 aa, Homo sapiens
  heavy chain complementarity determining region 3 for antibody 8977
AKNSINYYDM

SEQ ID NO: 17955 - protein, 9 aa, Homo sapiens
  light chain complementarity determining region 3 for antibody 8978
QHYYSTPNT

SEQ ID NO: 17956 - protein, 20 aa, Homo sapiens
  heavy chain complementarity determining region 3 for antibody 8978
ARDRGYCSGGSCHSNWYFDL

SEQ ID NO: 17957 - protein, 9 aa, Homo sapiens
  light chain complementarity determining region 3 for antibody 8979
QHYYSSPLT

SEQ ID NO: 17958 - protein, 14 aa, Homo sapiens
  heavy chain complementarity determining region 3 for antibody 8979
AKPTRGPGSFLIDY

SEQ ID NO: 17959 - protein, 10 aa, Homo sapiens
  light chain complementarity determining region 3 for antibody 8980
QHYYSNPPWT

SEQ ID NO: 17960 - protein, 14 aa, Homo sapiens
  heavy chain complementarity determining region 3 for antibody 8980
VSQSRSAVNGGGVY

SEQ ID NO: 17961 - protein, 9 aa, Homo sapiens
  light chain complementarity determining region 3 for antibody 8981
QHYYSAPQA

SEQ ID NO: 17962 - protein, 9 aa, Homo sapiens
  heavy chain complementarity determining region 3 for antibody 8981
ARDVWPEDC

SEQ ID NO: 17963 - protein, 9 aa, Homo sapiens
  light chain complementarity determining region 3 for antibody 8982
QHYYSAPIT

SEQ ID NO: 17964 - protein, 15 aa, Homo sapiens
  heavy chain complementarity determining region 3 for antibody 8982
VRALSPTEMSYAIAY

SEQ ID NO: 17965 - protein, 9 aa, Homo sapiens
  light chain complementarity determining region 3 for antibody 8983
QHYYSAPIT

SEQ ID NO: 17966 - protein, 14 aa, Homo sapiens
  heavy chain complementarity determining region 3 for antibody 8983
AKGESTSCDFIIDY

SEQ ID NO: 17967 - protein, 9 aa, Homo sapiens
  light chain complementarity determining region 3 for antibody 8984
QHYYNWPRT

SEQ ID NO: 17968 - protein, 10 aa, Homo sapiens
  heavy chain complementarity determining region 3 for antibody 8984
CRDREGFGDV

SEQ ID NO: 17969 - protein, 9 aa, Homo sapiens
  light chain complementarity determining region 3 for antibody 8985
QHYYNTPET

SEQ ID NO: 17970 - protein, 15 aa, Homo sapiens
  heavy chain complementarity determining region 3 for antibody 8985
ARDLFSGSYAYGDDY

SEQ ID NO: 17971 - protein, 9 aa, Homo sapiens
  light chain complementarity determining region 3 for antibody 8986
QHYYNTPET

SEQ ID NO: 17972 - protein, 15 aa, Homo sapiens
  heavy chain complementarity determining region 3 for antibody 8986
ARDLFSGSYAYGDDW

SEQ ID NO: 17973 - protein, 9 aa, Homo sapiens
  light chain complementarity determining region 3 for antibody 8987
QHYYNLPRT

SEQ ID NO: 17974 - protein, 14 aa, Homo sapiens
  heavy chain complementarity determining region 3 for antibody 8987
AFQEYSGWSLVLDY

SEQ ID NO: 17975 - protein, 9 aa, Homo sapiens
  light chain complementarity determining region 3 for antibody 8988
QHYYNAPQA

SEQ ID NO: 17976 - protein, 9 aa, Homo sapiens
  heavy chain complementarity determining region 3 for antibody 8988
ARDLWPEDC

SEQ ID NO: 17977 - protein, 9 aa, Homo sapiens
  light chain complementarity determining region 3 for antibody 8989
QHYYGSPLT

SEQ ID NO: 17978 - protein, 14 aa, Homo sapiens
  heavy chain complementarity determining region 3 for antibody 8989
AKPTRGPGSFLIDY

SEQ ID NO: 17979 - protein, 8 aa, Homo sapiens
  light chain complementarity determining region 3 for antibody 8990
QHYYATPT

SEQ ID NO: 17980 - protein, 16 aa, Homo sapiens
  heavy chain complementarity determining region 3 for antibody 8990
VRAADTSSWSFLISDY

SEQ ID NO: 17981 - protein, 9 aa, Homo sapiens
  light chain complementarity determining region 3 for antibody 8991
QHYTSYSWT

SEQ ID NO: 17982 - protein, 16 aa, Homo sapiens
  heavy chain complementarity determining region 3 for antibody 8991
ASLNRGDKEFGVPPAL

SEQ ID NO: 17983 - protein, 9 aa, Homo sapiens
  light chain complementarity determining region 3 for antibody 8992
QHYSSSLYT

SEQ ID NO: 17984 - protein, 11 aa, Homo sapiens
  heavy chain complementarity determining region 3 for antibody 8992
AKVKSDLCMDV

SEQ ID NO: 17985 - protein, 8 aa, Homo sapiens
  light chain complementarity determining region 3 for antibody 8993
QHYSGSPT

SEQ ID NO: 17986 - protein, 23 aa, Homo sapiens
  heavy chain complementarity determining region 3 for antibody 8993
ARHFPKGGSGVTGTQSLLYYMDV

SEQ ID NO: 17987 - protein, 8 aa, Homo sapiens
  light chain complementarity determining region 3 for antibody 8994
QHYSGLPA

SEQ ID NO: 17988 - protein, 15 aa, Homo sapiens
  heavy chain complementarity determining region 3 for antibody 8994
GRHVFSGSYPDYCDY

SEQ ID NO: 17989 - protein, 8 aa, Homo sapiens
  light chain complementarity determining region 3 for antibody 8995
QHYSGFPA

SEQ ID NO: 17990 - protein, 11 aa, Homo sapiens
  heavy chain complementarity determining region 3 for antibody 8995
VRVSTGWNFDY

SEQ ID NO: 17991 - protein, 8 aa, Homo sapiens
  light chain complementarity determining region 3 for antibody 8996
QHYSGFPA

SEQ ID NO: 17992 - protein, 15 aa, Homo sapiens
  heavy chain complementarity determining region 3 for antibody 8996
GRNVFSGSYPDYCDY

SEQ ID NO: 17993 - protein, 8 aa, Homo sapiens
  light chain complementarity determining region 3 for antibody 8997
QHYSGFPA

SEQ ID NO: 17994 - protein, 15 aa, Homo sapiens
  heavy chain complementarity determining region 3 for antibody 8997
GRHVLSGSYPDYCDY

SEQ ID NO: 17995 - protein, 8 aa, Homo sapiens
  light chain complementarity determining region 3 for antibody 8998
QHYSGFPA

SEQ ID NO: 17996 - protein, 15 aa, Homo sapiens
  heavy chain complementarity determining region 3 for antibody 8998
GRHVFSGSYRDYCDY

SEQ ID NO: 17997 - protein, 8 aa, Homo sapiens
  light chain complementarity determining region 3 for antibody 8999
QHYSGFPA

SEQ ID NO: 17998 - protein, 15 aa, Homo sapiens
  heavy chain complementarity determining region 3 for antibody 8999
GRHVFSGSYPDSCDY

SEQ ID NO: 17999 - protein, 8 aa, Homo sapiens
  light chain complementarity determining region 3 for antibody 9000
QHYSGFPA

SEQ ID NO: 18000 - protein, 15 aa, Homo sapiens
  heavy chain complementarity determining region 3 for antibody 9000
GRHVFSGSYPDDCDY

SEQ ID NO: 18001 - protein, 8 aa, Homo sapiens
  light chain complementarity determining region 3 for antibody 9001
QHYSGFPA

SEQ ID NO: 18002 - protein, 15 aa, Homo sapiens
  heavy chain complementarity determining region 3 for antibody 9001
GRHVFSGAYPDYCDY

SEQ ID NO: 18003 - protein, 8 aa, Homo sapiens
  light chain complementarity determining region 3 for antibody 9002
QHYSGFPA

SEQ ID NO: 18004 - protein, 15 aa, Homo sapiens
  heavy chain complementarity determining region 3 for antibody 9002
GRHVCSGSYPDYCDY

SEQ ID NO: 18005 - protein, 8 aa, Homo sapiens
  light chain complementarity determining region 3 for antibody 9003
QHYSGFPA

SEQ ID NO: 18006 - protein, 10 aa, Homo sapiens
  heavy chain complementarity determining region 3 for antibody 9003
ARERSGSYDI

SEQ ID NO: 18007 - protein, 8 aa, Homo sapiens
  light chain complementarity determining region 3 for antibody 9004
QHYSDFPA

SEQ ID NO: 18008 - protein, 15 aa, Homo sapiens
  heavy chain complementarity determining region 3 for antibody 9004
GRHVFSGSYPDYCDY

SEQ ID NO: 18009 - protein, 9 aa, Homo sapiens
  light chain complementarity determining region 3 for antibody 9005
QHYRTVPWT

SEQ ID NO: 18010 - protein, 13 aa, Homo sapiens
  heavy chain complementarity determining region 3 for antibody 9005
AKEGSSPGPDFDY

SEQ ID NO: 18011 - protein, 8 aa, Homo sapiens
  light chain complementarity determining region 3 for antibody 9006
QHYRGFPA

SEQ ID NO: 18012 - protein, 15 aa, Homo sapiens
  heavy chain complementarity determining region 3 for antibody 9006
GRHVFSGSYPDYCDY

SEQ ID NO: 18013 - protein, 9 aa, Homo sapiens
  light chain complementarity determining region 3 for antibody 9007
QHYNTYSRT

SEQ ID NO: 18014 - protein, 18 aa, Homo sapiens
  heavy chain complementarity determining region 3 for antibody 9007
ARSAPYCSSNACYYLFDS

SEQ ID NO: 18015 - protein, 9 aa, Homo sapiens
  light chain complementarity determining region 3 for antibody 9008
QHYNSYSHT

SEQ ID NO: 18016 - protein, 14 aa, Homo sapiens
  heavy chain complementarity determining region 3 for antibody 9008
GRDVHTTGWTLGGY

SEQ ID NO: 18017 - protein, 9 aa, Homo sapiens
  light chain complementarity determining region 3 for antibody 9009
QHYNSYPWT

SEQ ID NO: 18018 - protein, 9 aa, Homo sapiens
  heavy chain complementarity determining region 3 for antibody 9009
ARSEYHPTY

SEQ ID NO: 18019 - protein, 9 aa, Homo sapiens
  light chain complementarity determining region 3 for antibody 9010
QHYNSYPWP

SEQ ID NO: 18020 - protein, 17 aa, Homo sapiens
  heavy chain complementarity determining region 3 for antibody 9010
ARDPKVRGVGRRGWFDP

SEQ ID NO: 18021 - protein, 7 aa, Homo sapiens
  light chain complementarity determining region 3 for antibody 9011
QHYNSWT

SEQ ID NO: 18022 - protein, 12 aa, Homo sapiens
  heavy chain complementarity determining region 3 for antibody 9011
AKDKGGRSGMDV

SEQ ID NO: 18023 - protein, 7 aa, Homo sapiens
  light chain complementarity determining region 3 for antibody 9012
QHYNSWA

SEQ ID NO: 18024 - protein, 11 aa, Homo sapiens
  heavy chain complementarity determining region 3 for antibody 9012
ARETPVAVCGD

SEQ ID NO: 18025 - protein, 9 aa, Homo sapiens
  light chain complementarity determining region 3 for antibody 9013
QHYNNYPWT

SEQ ID NO: 18026 - protein, 12 aa, Homo sapiens
  heavy chain complementarity determining region 3 for antibody 9013
AKDRGRGRYFHH

SEQ ID NO: 18027 - protein, 9 aa, Homo sapiens
  light chain complementarity determining region 3 for antibody 9014
QHYNNWPRT

SEQ ID NO: 18028 - protein, 15 aa, Homo sapiens
  heavy chain complementarity determining region 3 for antibody 9014
TRECFSGAYPDYFEY

SEQ ID NO: 18029 - protein, 10 aa, Homo sapiens
  light chain complementarity determining region 3 for antibody 9015
QHYNNWPPLT

SEQ ID NO: 18030 - protein, 14 aa, Homo sapiens
  heavy chain complementarity determining region 3 for antibody 9015
ATGGGSGVEGAFDV

SEQ ID NO: 18031 - protein, 9 aa, Homo sapiens
  light chain complementarity determining region 3 for antibody 9016
QHYNNWPLI

SEQ ID NO: 18032 - protein, 17 aa, Homo sapiens
  heavy chain complementarity determining region 3 for antibody 9016
SRAASCTSASCHRVFDN

SEQ ID NO: 18033 - protein, 8 aa, Homo sapiens
  light chain complementarity determining region 3 for antibody 9017
QHYNGFPA

SEQ ID NO: 18034 - protein, 15 aa, Homo sapiens
  heavy chain complementarity determining region 3 for antibody 9017
GRHVLSGSHPDYVDY

SEQ ID NO: 18035 - protein, 8 aa, Homo sapiens
  light chain complementarity determining region 3 for antibody 9018
QHYNGFPA

SEQ ID NO: 18036 - protein, 15 aa, Homo sapiens
  heavy chain complementarity determining region 3 for antibody 9018
GRHVFSGSYPDYVDF

SEQ ID NO: 18037 - protein, 8 aa, Homo sapiens
  light chain complementarity determining region 3 for antibody 9019
QHYNGFPA

SEQ ID NO: 18038 - protein, 15 aa, Homo sapiens
  heavy chain complementarity determining region 3 for antibody 9019
GRHVFSGSYPDYCDY

SEQ ID NO: 18039 - protein, 8 aa, Homo sapiens
  light chain complementarity determining region 3 for antibody 9020
QHYNGFPA

SEQ ID NO: 18040 - protein, 12 aa, Homo sapiens
  heavy chain complementarity determining region 3 for antibody 9020
CVGGFGGTWFDS

SEQ ID NO: 18041 - protein, 9 aa, Homo sapiens
  light chain complementarity determining region 3 for antibody 9021
QHYNDWGWT

SEQ ID NO: 18042 - protein, 10 aa, Homo sapiens
  heavy chain complementarity determining region 3 for antibody 9021
AQSSSGRFDN

SEQ ID NO: 18043 - protein, 9 aa, Homo sapiens
  light chain complementarity determining region 3 for antibody 9022
QHYKGYPIT

SEQ ID NO: 18044 - protein, 8 aa, Homo sapiens
  heavy chain complementarity determining region 3 for antibody 9022
TGGRYGDV

SEQ ID NO: 18045 - protein, 9 aa, Homo sapiens
  light chain complementarity determining region 3 for antibody 9023
QHYKGYPFT

SEQ ID NO: 18046 - protein, 8 aa, Homo sapiens
  heavy chain complementarity determining region 3 for antibody 9023
TGGRYWDV

SEQ ID NO: 18047 - protein, 8 aa, Homo sapiens
  light chain complementarity determining region 3 for antibody 9024
QHYKGYPA

SEQ ID NO: 18048 - protein, 15 aa, Homo sapiens
  heavy chain complementarity determining region 3 for antibody 9024
GRHVFSGSHPDYVDY

SEQ ID NO: 18049 - protein, 8 aa, Homo sapiens
  light chain complementarity determining region 3 for antibody 9025
QHYKGFPA

SEQ ID NO: 18050 - protein, 16 aa, Homo sapiens
  heavy chain complementarity determining region 3 for antibody 9025
VRDLAGFTRGGSTFDY

SEQ ID NO: 18051 - protein, 8 aa, Homo sapiens
  light chain complementarity determining region 3 for antibody 9026
QHYKGFPA

SEQ ID NO: 18052 - protein, 15 aa, Homo sapiens
  heavy chain complementarity determining region 3 for antibody 9026
GSHVFSGSYPDYVDF

SEQ ID NO: 18053 - protein, 8 aa, Homo sapiens
  light chain complementarity determining region 3 for antibody 9027
QHYKGFPA

SEQ ID NO: 18054 - protein, 15 aa, Homo sapiens
  heavy chain complementarity determining region 3 for antibody 9027
GRHVLSGSHPDYVVY

SEQ ID NO: 18055 - protein, 8 aa, Homo sapiens
  light chain complementarity determining region 3 for antibody 9028
QHYKGFPA

SEQ ID NO: 18056 - protein, 15 aa, Homo sapiens
  heavy chain complementarity determining region 3 for antibody 9028
GIHVFSGSYPDYVDF

SEQ ID NO: 18057 - protein, 8 aa, Homo sapiens
  light chain complementarity determining region 3 for antibody 9029
QHYKGFPA

SEQ ID NO: 18058 - protein, 15 aa, Homo sapiens
  heavy chain complementarity determining region 3 for antibody 9029
ERHVFSGSYPDYVDF

SEQ ID NO: 18059 - protein, 8 aa, Homo sapiens
  light chain complementarity determining region 3 for antibody 9030
QHYKGFPA

SEQ ID NO: 18060 - protein, 12 aa, Homo sapiens
  heavy chain complementarity determining region 3 for antibody 9030
CVGGFGGTWFDP

SEQ ID NO: 18061 - protein, 8 aa, Homo sapiens
  light chain complementarity determining region 3 for antibody 9031
QHYKGFPA

SEQ ID NO: 18062 - protein, 12 aa, Homo sapiens
  heavy chain complementarity determining region 3 for antibody 9031
CVGGFGGPWFDS

SEQ ID NO: 18063 - protein, 8 aa, Homo sapiens
  light chain complementarity determining region 3 for antibody 9032
QHYKGFPA

SEQ ID NO: 18064 - protein, 12 aa, Homo sapiens
  heavy chain complementarity determining region 3 for antibody 9032
CVGGFGGAWFDS

SEQ ID NO: 18065 - protein, 8 aa, Homo sapiens
  light chain complementarity determining region 3 for antibody 9033
QHYKCFPA

SEQ ID NO: 18066 - protein, 12 aa, Homo sapiens
  heavy chain complementarity determining region 3 for antibody 9033
CVGGFGGTWFDS

SEQ ID NO: 18067 - protein, 9 aa, Homo sapiens
  light chain complementarity determining region 3 for antibody 9034
QHYKAYPNT

SEQ ID NO: 18068 - protein, 17 aa, Homo sapiens
  heavy chain complementarity determining region 3 for antibody 9034
ARNTMVGTWQRQGNLDH

SEQ ID NO: 18069 - protein, 9 aa, Homo sapiens
  light chain complementarity determining region 3 for antibody 9035
QHYKAYPHT

SEQ ID NO: 18070 - protein, 17 aa, Homo sapiens
  heavy chain complementarity determining region 3 for antibody 9035
ARNTMVGTWQRRGNLDH

SEQ ID NO: 18071 - protein, 9 aa, Homo sapiens
  light chain complementarity determining region 3 for antibody 9036
QHYKAYPHT

SEQ ID NO: 18072 - protein, 23 aa, Homo sapiens
  heavy chain complementarity determining region 3 for antibody 9036
ARHFPKGGSGVTGTQSLLYYMDV

SEQ ID NO: 18073 - protein, 9 aa, Homo sapiens
  light chain complementarity determining region 3 for antibody 9037
QHYHRYPHT

SEQ ID NO: 18074 - protein, 14 aa, Homo sapiens
  heavy chain complementarity determining region 3 for antibody 9037
ARDVHTTGWTLGGY

SEQ ID NO: 18075 - protein, 9 aa, Homo sapiens
  light chain complementarity determining region 3 for antibody 9038
QHYGSSTWT

SEQ ID NO: 18076 - protein, 17 aa, Homo sapiens
  heavy chain complementarity determining region 3 for antibody 9038
AKGRGSVAMALIYYLDL

SEQ ID NO: 18077 - protein, 10 aa, Homo sapiens
  light chain complementarity determining region 3 for antibody 9039
QHYGSSQWIT

SEQ ID NO: 18078 - protein, 17 aa, Homo sapiens
  heavy chain complementarity determining region 3 for antibody 9039
ARGTGIGSGSYYADFDY

SEQ ID NO: 18079 - protein, 10 aa, Homo sapiens
  light chain complementarity determining region 3 for antibody 9040
QHYGSSQRIT

SEQ ID NO: 18080 - protein, 17 aa, Homo sapiens
  heavy chain complementarity determining region 3 for antibody 9040
ARGTGIGSGSYYADFDY

SEQ ID NO: 18081 - protein, 10 aa, Homo sapiens
  light chain complementarity determining region 3 for antibody 9041
QHYGSSQGVT

SEQ ID NO: 18082 - protein, 17 aa, Homo sapiens
  heavy chain complementarity determining region 3 for antibody 9041
ARGTGIGSGSYYADFDY

SEQ ID NO: 18083 - protein, 10 aa, Homo sapiens
  light chain complementarity determining region 3 for antibody 9042
QHYGSSQGST

SEQ ID NO: 18084 - protein, 17 aa, Homo sapiens
  heavy chain complementarity determining region 3 for antibody 9042
ARGTGIGSGSYYADFDY

SEQ ID NO: 18085 - protein, 10 aa, Homo sapiens
  light chain complementarity determining region 3 for antibody 9043
QHYGSSQGNT

SEQ ID NO: 18086 - protein, 17 aa, Homo sapiens
  heavy chain complementarity determining region 3 for antibody 9043
ARGTGIGSGSYYADFDY

SEQ ID NO: 18087 - protein, 10 aa, Homo sapiens
  light chain complementarity determining region 3 for antibody 9044
QHYGSSQGIT

SEQ ID NO: 18088 - protein, 11 aa, Homo sapiens
  heavy chain complementarity determining region 3 for antibody 9044
TRGGYSVGYDY

SEQ ID NO: 18089 - protein, 10 aa, Homo sapiens
  light chain complementarity determining region 3 for antibody 9045
QHYGSSQGIT

SEQ ID NO: 18090 - protein, 17 aa, Homo sapiens
  heavy chain complementarity determining region 3 for antibody 9045
ASGTGIGSGSYYADFDY

SEQ ID NO: 18091 - protein, 10 aa, Homo sapiens
  light chain complementarity determining region 3 for antibody 9046
QHYGSSQGIT

SEQ ID NO: 18092 - protein, 9 aa, Homo sapiens
  heavy chain complementarity determining region 3 for antibody 9046
ARSEYQPTY

SEQ ID NO: 18093 - protein, 10 aa, Homo sapiens
  light chain complementarity determining region 3 for antibody 9047
QHYGSSQGIT

SEQ ID NO: 18094 - protein, 17 aa, Homo sapiens
  heavy chain complementarity determining region 3 for antibody 9047
ARGTGMGSGSYYADFDY

SEQ ID NO: 18095 - protein, 10 aa, Homo sapiens
  light chain complementarity determining region 3 for antibody 9048
QHYGSSQGIT

SEQ ID NO: 18096 - protein, 17 aa, Homo sapiens
  heavy chain complementarity determining region 3 for antibody 9048
ARGTGIGSWSYYADFDY

SEQ ID NO: 18097 - protein, 10 aa, Homo sapiens
  light chain complementarity determining region 3 for antibody 9049
QHYGSSQGIT

SEQ ID NO: 18098 - protein, 17 aa, Homo sapiens
  heavy chain complementarity determining region 3 for antibody 9049
ARGTGIGSGSYYADFDS

SEQ ID NO: 18099 - protein, 10 aa, Homo sapiens
  light chain complementarity determining region 3 for antibody 9050
QHYGSSQGIT

SEQ ID NO: 18100 - protein, 17 aa, Homo sapiens
  heavy chain complementarity determining region 3 for antibody 9050
ARGTGIGSGSYYADFDH

SEQ ID NO: 18101 - protein, 10 aa, Homo sapiens
  light chain complementarity determining region 3 for antibody 9051
QHYGSSQGIT

SEQ ID NO: 18102 - protein, 17 aa, Homo sapiens
  heavy chain complementarity determining region 3 for antibody 9051
ARGTGIGSGSDYADFDY

SEQ ID NO: 18103 - protein, 10 aa, Homo sapiens
  light chain complementarity determining region 3 for antibody 9052
QHYGSSQGIT

SEQ ID NO: 18104 - protein, 17 aa, Homo sapiens
  heavy chain complementarity determining region 3 for antibody 9052
ARGAGIGSGSYYADFDY

SEQ ID NO: 18105 - protein, 10 aa, Homo sapiens
  light chain complementarity determining region 3 for antibody 9053
QHYGSSQGIT

SEQ ID NO: 18106 - protein, 17 aa, Homo sapiens
  heavy chain complementarity determining region 3 for antibody 9053
AGGTGIGSGSYYADFDY

SEQ ID NO: 18107 - protein, 10 aa, Homo sapiens
  light chain complementarity determining region 3 for antibody 9054
QHYGSSQGIA

SEQ ID NO: 18108 - protein, 17 aa, Homo sapiens
  heavy chain complementarity determining region 3 for antibody 9054
ARGTGIGSGSYYADFDY

SEQ ID NO: 18109 - protein, 10 aa, Homo sapiens
  light chain complementarity determining region 3 for antibody 9055
QHYGSSPPGT

SEQ ID NO: 18110 - protein, 17 aa, Homo sapiens
  heavy chain complementarity determining region 3 for antibody 9055
ARGSHYGSGSYYADFDH

SEQ ID NO: 18111 - protein, 10 aa, Homo sapiens
  light chain complementarity determining region 3 for antibody 9056
QHYGSSLPVT

SEQ ID NO: 18112 - protein, 18 aa, Homo sapiens
  heavy chain complementarity determining region 3 for antibody 9056
SRGHAYSSSWNSYPDFDF

SEQ ID NO: 18113 - protein, 10 aa, Homo sapiens
  light chain complementarity determining region 3 for antibody 9057
QHYGSSLGST

SEQ ID NO: 18114 - protein, 14 aa, Homo sapiens
  heavy chain complementarity determining region 3 for antibody 9057
AGGRHNSGWYSFAY

SEQ ID NO: 18115 - protein, 10 aa, Homo sapiens
  light chain complementarity determining region 3 for antibody 9058
QHYGSSLGLT

SEQ ID NO: 18116 - protein, 14 aa, Homo sapiens
  heavy chain complementarity determining region 3 for antibody 9058
AGGRHNSGWYSFAY

SEQ ID NO: 18117 - protein, 10 aa, Homo sapiens
  light chain complementarity determining region 3 for antibody 9059
QHYGSSIGIT

SEQ ID NO: 18118 - protein, 14 aa, Homo sapiens
  heavy chain complementarity determining region 3 for antibody 9059
AGGRHNSGWYSFAY

SEQ ID NO: 18119 - protein, 10 aa, Homo sapiens
  light chain complementarity determining region 3 for antibody 9060
QHYGSSHGIT

SEQ ID NO: 18120 - protein, 17 aa, Homo sapiens
  heavy chain complementarity determining region 3 for antibody 9060
ARGTGIGSGSYYADFDY

SEQ ID NO: 18121 - protein, 10 aa, Homo sapiens
  light chain complementarity determining region 3 for antibody 9061
QHYGSLQGIT

SEQ ID NO: 18122 - protein, 17 aa, Homo sapiens
  heavy chain complementarity determining region 3 for antibody 9061
ARGTGIGSGSYYADFDY

SEQ ID NO: 18123 - protein, 10 aa, Homo sapiens
  light chain complementarity determining region 3 for antibody 9062
QHYGPSPVFT

SEQ ID NO: 18124 - protein, 19 aa, Homo sapiens
  heavy chain complementarity determining region 3 for antibody 9062
ARLTPYYDFFSGYHYGMDV

SEQ ID NO: 18125 - protein, 9 aa, Homo sapiens
  light chain complementarity determining region 3 for antibody 9063
QHYGKFTWT

SEQ ID NO: 18126 - protein, 15 aa, Homo sapiens
  heavy chain complementarity determining region 3 for antibody 9063
ARELPQRTNSDGWDH

SEQ ID NO: 18127 - protein, 9 aa, Homo sapiens
  light chain complementarity determining region 3 for antibody 9064
QHYGHSLFL

SEQ ID NO: 18128 - protein, 10 aa, Homo sapiens
  heavy chain complementarity determining region 3 for antibody 9064
TSESWGKFDY

SEQ ID NO: 18129 - protein, 9 aa, Homo sapiens
  light chain complementarity determining region 3 for antibody 9065
QHYGGSTLS

SEQ ID NO: 18130 - protein, 18 aa, Homo sapiens
  heavy chain complementarity determining region 3 for antibody 9065
ATALADYDRLGLHFSLDS

SEQ ID NO: 18131 - protein, 9 aa, Homo sapiens
  light chain complementarity determining region 3 for antibody 9066
QHYGGSTLS

SEQ ID NO: 18132 - protein, 18 aa, Homo sapiens
  heavy chain complementarity determining region 3 for antibody 9066
ATALADYDLLGLHVSLDS

SEQ ID NO: 18133 - protein, 9 aa, Homo sapiens
  light chain complementarity determining region 3 for antibody 9067
QHYGGSTLS

SEQ ID NO: 18134 - protein, 18 aa, Homo sapiens
  heavy chain complementarity determining region 3 for antibody 9067
ATALADYDLLGLHFSLDA

SEQ ID NO: 18135 - protein, 8 aa, Homo sapiens
  light chain complementarity determining region 3 for antibody 9068
QHYGGSPT

SEQ ID NO: 18136 - protein, 23 aa, Homo sapiens
  heavy chain complementarity determining region 3 for antibody 9068
VRHFPKGGSGVTGTQSLLYYMDV

SEQ ID NO: 18137 - protein, 8 aa, Homo sapiens
  light chain complementarity determining region 3 for antibody 9069
QHYGGSPT

SEQ ID NO: 18138 - protein, 14 aa, Homo sapiens
  heavy chain complementarity determining region 3 for antibody 9069
SRPTRAARLPIFDY

SEQ ID NO: 18139 - protein, 8 aa, Homo sapiens
  light chain complementarity determining region 3 for antibody 9070
QHYGGSPT

SEQ ID NO: 18140 - protein, 23 aa, Homo sapiens
  heavy chain complementarity determining region 3 for antibody 9070
SRHFPKGGSGVTGTQSLLYYMDV

SEQ ID NO: 18141 - protein, 8 aa, Homo sapiens
  light chain complementarity determining region 3 for antibody 9071
QHYGGSPT

SEQ ID NO: 18142 - protein, 14 aa, Homo sapiens
  heavy chain complementarity determining region 3 for antibody 9071
SHPTSAARLPIFDY

SEQ ID NO: 18143 - protein, 8 aa, Homo sapiens
  light chain complementarity determining region 3 for antibody 9072
QHYGGSPT

SEQ ID NO: 18144 - protein, 14 aa, Homo sapiens
  heavy chain complementarity determining region 3 for antibody 9072
SHPTRAARLPTFDY

SEQ ID NO: 18145 - protein, 8 aa, Homo sapiens
  light chain complementarity determining region 3 for antibody 9073
QHYGGSPT

SEQ ID NO: 18146 - protein, 14 aa, Homo sapiens
  heavy chain complementarity determining region 3 for antibody 9073
SHPTRAARLPSFDY

SEQ ID NO: 18147 - protein, 8 aa, Homo sapiens
  light chain complementarity determining region 3 for antibody 9074
QHYGGSPT

SEQ ID NO: 18148 - protein, 10 aa, Homo sapiens
  heavy chain complementarity determining region 3 for antibody 9074
CRDREGFGDV

SEQ ID NO: 18149 - protein, 8 aa, Homo sapiens
  light chain complementarity determining region 3 for antibody 9075
QHYGGSPT

SEQ ID NO: 18150 - protein, 17 aa, Homo sapiens
  heavy chain complementarity determining region 3 for antibody 9075
ARNTMVGTWQRQGNLDH

SEQ ID NO: 18151 - protein, 8 aa, Homo sapiens
  light chain complementarity determining region 3 for antibody 9076
QHYGGSPT

SEQ ID NO: 18152 - protein, 23 aa, Homo sapiens
  heavy chain complementarity determining region 3 for antibody 9076
ARHFPKGGSGVTGTQSMLYYMDV

SEQ ID NO: 18153 - protein, 8 aa, Homo sapiens
  light chain complementarity determining region 3 for antibody 9077
QHYGGSPT

SEQ ID NO: 18154 - protein, 23 aa, Homo sapiens
  heavy chain complementarity determining region 3 for antibody 9077
ARHFPKGGSGVTGTQSLLYYMDF

SEQ ID NO: 18155 - protein, 8 aa, Homo sapiens
  light chain complementarity determining region 3 for antibody 9078
QHYGGSPT

SEQ ID NO: 18156 - protein, 23 aa, Homo sapiens
  heavy chain complementarity determining region 3 for antibody 9078
ARHFPKGGSGVTGTQSLLYYMDA

SEQ ID NO: 18157 - protein, 8 aa, Homo sapiens
  light chain complementarity determining region 3 for antibody 9079
QHYGGSPT

SEQ ID NO: 18158 - protein, 23 aa, Homo sapiens
  heavy chain complementarity determining region 3 for antibody 9079
ARHFPKGGSGVTGTQSLLCYMDV

SEQ ID NO: 18159 - protein, 8 aa, Homo sapiens
  light chain complementarity determining region 3 for antibody 9080
QHYGGSPT

SEQ ID NO: 18160 - protein, 23 aa, Homo sapiens
  heavy chain complementarity determining region 3 for antibody 9080
ARHFPKGGPGVTGTQSLLYYMDV

SEQ ID NO: 18161 - protein, 8 aa, Homo sapiens
  light chain complementarity determining region 3 for antibody 9081
QHYGGSPT

SEQ ID NO: 18162 - protein, 23 aa, Homo sapiens
  heavy chain complementarity determining region 3 for antibody 9081
ARHFPKGESGVTGTQSLLYYMDV

SEQ ID NO: 18163 - protein, 8 aa, Homo sapiens
  light chain complementarity determining region 3 for antibody 9082
QHYGGSPT

SEQ ID NO: 18164 - protein, 16 aa, Homo sapiens
  heavy chain complementarity determining region 3 for antibody 9082
ARGNGYDLLYVADFDY

SEQ ID NO: 18165 - protein, 8 aa, Homo sapiens
  light chain complementarity determining region 3 for antibody 9083
QHYGGSPT

SEQ ID NO: 18166 - protein, 16 aa, Homo sapiens
  heavy chain complementarity determining region 3 for antibody 9083
ARGHGYDLLYVAYFDY

SEQ ID NO: 18167 - protein, 8 aa, Homo sapiens
  light chain complementarity determining region 3 for antibody 9084
QHYGGSPT

SEQ ID NO: 18168 - protein, 16 aa, Homo sapiens
  heavy chain complementarity determining region 3 for antibody 9084
ARGHGYDLLDVADFDY

SEQ ID NO: 18169 - protein, 8 aa, Homo sapiens
  light chain complementarity determining region 3 for antibody 9085
QHYGGSPT

SEQ ID NO: 18170 - protein, 12 aa, Homo sapiens
  heavy chain complementarity determining region 3 for antibody 9085
ARDKGGRNGMDV

SEQ ID NO: 18171 - protein, 8 aa, Homo sapiens
  light chain complementarity determining region 3 for antibody 9086
QHYGGSPT

SEQ ID NO: 18172 - protein, 14 aa, Homo sapiens
  heavy chain complementarity determining region 3 for antibody 9086
AHPTRAARLPIFDY

SEQ ID NO: 18173 - protein, 10 aa, Homo sapiens
  light chain complementarity determining region 3 for antibody 9087
QHYGGSPRVT

SEQ ID NO: 18174 - protein, 15 aa, Homo sapiens
  heavy chain complementarity determining region 3 for antibody 9087
ARVGRPYHNAWYFDN

SEQ ID NO: 18175 - protein, 10 aa, Homo sapiens
  light chain complementarity determining region 3 for antibody 9088
QHYGGSPRVT

SEQ ID NO: 18176 - protein, 17 aa, Homo sapiens
  heavy chain complementarity determining region 3 for antibody 9088
ARNTMVHGWQRQGSVDH

SEQ ID NO: 18177 - protein, 10 aa, Homo sapiens
  light chain complementarity determining region 3 for antibody 9089
QHYGGSPRVT

SEQ ID NO: 18178 - protein, 14 aa, Homo sapiens
  heavy chain complementarity determining region 3 for antibody 9089
AREIIVRGAQQFDS

SEQ ID NO: 18179 - protein, 10 aa, Homo sapiens
  light chain complementarity determining region 3 for antibody 9090
QHYGGSPRVT

SEQ ID NO: 18180 - protein, 13 aa, Homo sapiens
  heavy chain complementarity determining region 3 for antibody 9090
AKEGSSPGPDFEY

SEQ ID NO: 18181 - protein, 10 aa, Homo sapiens
  light chain complementarity determining region 3 for antibody 9091
QHYGGSPRGT

SEQ ID NO: 18182 - protein, 14 aa, Homo sapiens
  heavy chain complementarity determining region 3 for antibody 9091
AREIIVRGTQQFDS

SEQ ID NO: 18183 - protein, 8 aa, Homo sapiens
  light chain complementarity determining region 3 for antibody 9092
QHYGGSPP

SEQ ID NO: 18184 - protein, 23 aa, Homo sapiens
  heavy chain complementarity determining region 3 for antibody 9092
ARHFPKGGSGVTGTQSLLYYMDV

SEQ ID NO: 18185 - protein, 8 aa, Homo sapiens
  light chain complementarity determining region 3 for antibody 9093
QHYGGSPK

SEQ ID NO: 18186 - protein, 23 aa, Homo sapiens
  heavy chain complementarity determining region 3 for antibody 9093
ARHFPKGGSGVTGTQSLLYYMDV

SEQ ID NO: 18187 - protein, 8 aa, Homo sapiens
  light chain complementarity determining region 3 for antibody 9094
QHYGGSPA

SEQ ID NO: 18188 - protein, 23 aa, Homo sapiens
  heavy chain complementarity determining region 3 for antibody 9094
ARHFPKGGSGVTGTQSLLYYMDV

SEQ ID NO: 18189 - protein, 8 aa, Homo sapiens
  light chain complementarity determining region 3 for antibody 9095
QHYGGLPT

SEQ ID NO: 18190 - protein, 14 aa, Homo sapiens
  heavy chain complementarity determining region 3 for antibody 9095
SHPTRAARLPIFDY

SEQ ID NO: 18191 - protein, 8 aa, Homo sapiens
  light chain complementarity determining region 3 for antibody 9096
QHYGGLPT

SEQ ID NO: 18192 - protein, 23 aa, Homo sapiens
  heavy chain complementarity determining region 3 for antibody 9096
ARHFPKGGSGVTGTQSLLYYMDV

SEQ ID NO: 18193 - protein, 12 aa, Homo sapiens
  light chain complementarity determining region 3 for antibody 9097
QHYGEVGSPPIT

SEQ ID NO: 18194 - protein, 17 aa, Homo sapiens
  heavy chain complementarity determining region 3 for antibody 9097
ARNTMVHGWQRQGSVDH

SEQ ID NO: 18195 - protein, 12 aa, Homo sapiens
  light chain complementarity determining region 3 for antibody 9098
QHYGEGGSPPIT

SEQ ID NO: 18196 - protein, 17 aa, Homo sapiens
  heavy chain complementarity determining region 3 for antibody 9098
ARTTMVHGWQRQGSVDH

SEQ ID NO: 18197 - protein, 12 aa, Homo sapiens
  light chain complementarity determining region 3 for antibody 9099
QHYGEGGSPPIT

SEQ ID NO: 18198 - protein, 17 aa, Homo sapiens
  heavy chain complementarity determining region 3 for antibody 9099
ARNTMVHGRQRQGSVDH

SEQ ID NO: 18199 - protein, 12 aa, Homo sapiens
  light chain complementarity determining region 3 for antibody 9100
QHYGEGGSPPIT

SEQ ID NO: 18200 - protein, 17 aa, Homo sapiens
  heavy chain complementarity determining region 3 for antibody 9100
ARDTMVHGWQRQGSVDH

SEQ ID NO: 18201 - protein, 12 aa, Homo sapiens
  light chain complementarity determining region 3 for antibody 9101
QHYGEGGSPPIP

SEQ ID NO: 18202 - protein, 17 aa, Homo sapiens
  heavy chain complementarity determining region 3 for antibody 9101
ARNTMVHGWQRQGSVDH

SEQ ID NO: 18203 - protein, 12 aa, Homo sapiens
  light chain complementarity determining region 3 for antibody 9102
QHYGEGGSPPIA

SEQ ID NO: 18204 - protein, 17 aa, Homo sapiens
  heavy chain complementarity determining region 3 for antibody 9102
ARNTMVHGWQRQGSVDH

SEQ ID NO: 18205 - protein, 10 aa, Homo sapiens
  light chain complementarity determining region 3 for antibody 9103
QHYGDSPPIT

SEQ ID NO: 18206 - protein, 6 aa, Homo sapiens
  heavy chain complementarity determining region 3 for antibody 9103
AGFFEY

SEQ ID NO: 18207 - protein, 8 aa, Homo sapiens
  light chain complementarity determining region 3 for antibody 9104
QHYGCSPT

SEQ ID NO: 18208 - protein, 23 aa, Homo sapiens
  heavy chain complementarity determining region 3 for antibody 9104
ARHFPKGGSGVTGTQSLLYYMDV

SEQ ID NO: 18209 - protein, 10 aa, Homo sapiens
  light chain complementarity determining region 3 for antibody 9105
QHYFSTPPWT

SEQ ID NO: 18210 - protein, 11 aa, Homo sapiens
  heavy chain complementarity determining region 3 for antibody 9105
ATFGQQWRLAH

SEQ ID NO: 18211 - protein, 10 aa, Homo sapiens
  light chain complementarity determining region 3 for antibody 9106
QHYFSTPPWT

SEQ ID NO: 18212 - protein, 13 aa, Homo sapiens
  heavy chain complementarity determining region 3 for antibody 9106
ASLRSDNSGHFNY

SEQ ID NO: 18213 - protein, 10 aa, Homo sapiens
  light chain complementarity determining region 3 for antibody 9107
QHYFSTPPWP

SEQ ID NO: 18214 - protein, 13 aa, Homo sapiens
  heavy chain complementarity determining region 3 for antibody 9107
ASLRRDNSGHFNY

SEQ ID NO: 18215 - protein, 9 aa, Homo sapiens
  light chain complementarity determining region 3 for antibody 9108
QHYDTSILT

SEQ ID NO: 18216 - protein, 12 aa, Homo sapiens
  heavy chain complementarity determining region 3 for antibody 9108
ALDEWHPNWYNY

SEQ ID NO: 18217 - protein, 9 aa, Homo sapiens
  light chain complementarity determining region 3 for antibody 9109
QHYDSYPFS

SEQ ID NO: 18218 - protein, 14 aa, Homo sapiens
  heavy chain complementarity determining region 3 for antibody 9109
AREGWESALGALDI

SEQ ID NO: 18219 - protein, 9 aa, Homo sapiens
  light chain complementarity determining region 3 for antibody 9110
QHYDRAPDT

SEQ ID NO: 18220 - protein, 11 aa, Homo sapiens
  heavy chain complementarity determining region 3 for antibody 9110
AKEATETTPGY

SEQ ID NO: 18221 - protein, 10 aa, Homo sapiens
  light chain complementarity determining region 3 for antibody 9111
QHYCSSQGIT

SEQ ID NO: 18222 - protein, 17 aa, Homo sapiens
  heavy chain complementarity determining region 3 for antibody 9111
ARGTGIGSGSYYADFDY

SEQ ID NO: 18223 - protein, 9 aa, Homo sapiens
  light chain complementarity determining region 3 for antibody 9112
QHYASDSYT

SEQ ID NO: 18224 - protein, 16 aa, Homo sapiens
  heavy chain complementarity determining region 3 for antibody 9112
ARDHCTTIKCPDAFDI

SEQ ID NO: 18225 - protein, 9 aa, Homo sapiens
  light chain complementarity determining region 3 for antibody 9113
QHSYTMPRT

SEQ ID NO: 18226 - protein, 18 aa, Homo sapiens
  heavy chain complementarity determining region 3 for antibody 9113
TTVLSQLLAGDWHLYFQH

SEQ ID NO: 18227 - protein, 9 aa, Homo sapiens
  light chain complementarity determining region 3 for antibody 9114
QHSYSTPRT

SEQ ID NO: 18228 - protein, 7 aa, Homo sapiens
  heavy chain complementarity determining region 3 for antibody 9114
TTGDLRN

SEQ ID NO: 18229 - protein, 10 aa, Homo sapiens
  light chain complementarity determining region 3 for antibody 9115
QHSYSTPLFT

SEQ ID NO: 18230 - protein, 23 aa, Homo sapiens
  heavy chain complementarity determining region 3 for antibody 9115
ARHFPMGGSTVTGTQSLLYYMDV

SEQ ID NO: 18231 - protein, 9 aa, Homo sapiens
  light chain complementarity determining region 3 for antibody 9116
QHSYNYPLT

SEQ ID NO: 18232 - protein, 11 aa, Homo sapiens
  heavy chain complementarity determining region 3 for antibody 9116
AKGGALNGFDS

SEQ ID NO: 18233 - protein, 9 aa, Homo sapiens
  light chain complementarity determining region 3 for antibody 9117
QHSYNTPRT

SEQ ID NO: 18234 - protein, 7 aa, Homo sapiens
  heavy chain complementarity determining region 3 for antibody 9117
TTGDLSN

SEQ ID NO: 18235 - protein, 9 aa, Homo sapiens
  light chain complementarity determining region 3 for antibody 9118
QHSYNTPRT

SEQ ID NO: 18236 - protein, 7 aa, Homo sapiens
  heavy chain complementarity determining region 3 for antibody 9118
PTGDLRN

SEQ ID NO: 18237 - protein, 9 aa, Homo sapiens
  light chain complementarity determining region 3 for antibody 9119
QHSYNTPRT

SEQ ID NO: 18238 - protein, 7 aa, Homo sapiens
  heavy chain complementarity determining region 3 for antibody 9119
ATGDLRN

SEQ ID NO: 18239 - protein, 9 aa, Homo sapiens
  light chain complementarity determining region 3 for antibody 9120
QHSYNTPRT

SEQ ID NO: 18240 - protein, 11 aa, Homo sapiens
  heavy chain complementarity determining region 3 for antibody 9120
ATFGQQWRLAH

SEQ ID NO: 18241 - protein, 9 aa, Homo sapiens
  light chain complementarity determining region 3 for antibody 9121
QHSYNTPRT

SEQ ID NO: 18242 - protein, 9 aa, Homo sapiens
  heavy chain complementarity determining region 3 for antibody 9121
ARSEYQPTY

SEQ ID NO: 18243 - protein, 9 aa, Homo sapiens
  light chain complementarity determining region 3 for antibody 9122
QHSYNTPRT

SEQ ID NO: 18244 - protein, 17 aa, Homo sapiens
  heavy chain complementarity determining region 3 for antibody 9122
ARNTRVHGWQRQGSVDH

SEQ ID NO: 18245 - protein, 9 aa, Homo sapiens
  light chain complementarity determining region 3 for antibody 9123
QHSYNTPRT

SEQ ID NO: 18246 - protein, 17 aa, Homo sapiens
  heavy chain complementarity determining region 3 for antibody 9123
ARNTMGHGWQRQGSVDH

SEQ ID NO: 18247 - protein, 9 aa, Homo sapiens
  light chain complementarity determining region 3 for antibody 9124
QHSYNTPRT

SEQ ID NO: 18248 - protein, 17 aa, Homo sapiens
  heavy chain complementarity determining region 3 for antibody 9124
ARNAMVHGWQRQGSVDH

SEQ ID NO: 18249 - protein, 9 aa, Homo sapiens
  light chain complementarity determining region 3 for antibody 9125
QHSYNTPRT

SEQ ID NO: 18250 - protein, 20 aa, Homo sapiens
  heavy chain complementarity determining region 3 for antibody 9125
AREGRMGASGGGYYYYGMDV

SEQ ID NO: 18251 - protein, 9 aa, Homo sapiens
  light chain complementarity determining region 3 for antibody 9126
QHSYNTPRT

SEQ ID NO: 18252 - protein, 20 aa, Homo sapiens
  heavy chain complementarity determining region 3 for antibody 9126
AREERVGASGGGYYYYGMDV

SEQ ID NO: 18253 - protein, 9 aa, Homo sapiens
  light chain complementarity determining region 3 for antibody 9127
QHSYNTPRT

SEQ ID NO: 18254 - protein, 13 aa, Homo sapiens
  heavy chain complementarity determining region 3 for antibody 9127
ALEGSDPGPDFVY

SEQ ID NO: 18255 - protein, 9 aa, Homo sapiens
  light chain complementarity determining region 3 for antibody 9128
QHSYNTPRT

SEQ ID NO: 18256 - protein, 17 aa, Homo sapiens
  heavy chain complementarity determining region 3 for antibody 9128
AGNTMVHGWQRQGSVDH

SEQ ID NO: 18257 - protein, 9 aa, Homo sapiens
  light chain complementarity determining region 3 for antibody 9129
QHSYNTPRP

SEQ ID NO: 18258 - protein, 17 aa, Homo sapiens
  heavy chain complementarity determining region 3 for antibody 9129
ARNTMVHGWQRQGSVDH

SEQ ID NO: 18259 - protein, 9 aa, Homo sapiens
  light chain complementarity determining region 3 for antibody 9130
QHSYNAPRT

SEQ ID NO: 18260 - protein, 20 aa, Homo sapiens
  heavy chain complementarity determining region 3 for antibody 9130
AREERMGASGGGYYYYGMDV

SEQ ID NO: 18261 - protein, 8 aa, Homo sapiens
  light chain complementarity determining region 3 for antibody 9131
QHSSGFPA

SEQ ID NO: 18262 - protein, 15 aa, Homo sapiens
  heavy chain complementarity determining region 3 for antibody 9131
GRHVFSGSYPDYCDY

SEQ ID NO: 18263 - protein, 8 aa, Homo sapiens
  light chain complementarity determining region 3 for antibody 9132
QHSKGFPA

SEQ ID NO: 18264 - protein, 15 aa, Homo sapiens
  heavy chain complementarity determining region 3 for antibody 9132
GRHVFSGSYPDYVDF

SEQ ID NO: 18265 - protein, 9 aa, Homo sapiens
  light chain complementarity determining region 3 for antibody 9133
QHSKAYPHT

SEQ ID NO: 18266 - protein, 11 aa, Homo sapiens
  heavy chain complementarity determining region 3 for antibody 9133
AREGALYAFDF

SEQ ID NO: 18267 - protein, 7 aa, Homo sapiens
  light chain complementarity determining region 3 for antibody 9134
QHRSNWS

SEQ ID NO: 18268 - protein, 11 aa, Homo sapiens
  heavy chain complementarity determining region 3 for antibody 9134
GRNNLGGGCVF

SEQ ID NO: 18269 - protein, 7 aa, Homo sapiens
  light chain complementarity determining region 3 for antibody 9135
QHRSNWS

SEQ ID NO: 18270 - protein, 11 aa, Homo sapiens
  heavy chain complementarity determining region 3 for antibody 9135
GRNDRGGGCVF

SEQ ID NO: 18271 - protein, 11 aa, Homo sapiens
  light chain complementarity determining region 3 for antibody 9136
QHRSNGPPILT

SEQ ID NO: 18272 - protein, 13 aa, Homo sapiens
  heavy chain complementarity determining region 3 for antibody 9136
ARDVPGIIWFSGL

SEQ ID NO: 18273 - protein, 7 aa, Homo sapiens
  light chain complementarity determining region 3 for antibody 9137
QHRCNWS

SEQ ID NO: 18274 - protein, 11 aa, Homo sapiens
  heavy chain complementarity determining region 3 for antibody 9137
GRNDLGGGCVF

SEQ ID NO: 18275 - protein, 9 aa, Homo sapiens
  light chain complementarity determining region 3 for antibody 9138
QHLSNAPLT

SEQ ID NO: 18276 - protein, 17 aa, Homo sapiens
  heavy chain complementarity determining region 3 for antibody 9138
AKRLPDLLGGGHHYIDV

SEQ ID NO: 18277 - protein, 10 aa, Homo sapiens
  light chain complementarity determining region 3 for antibody 9139
QHHGSSQGIT

SEQ ID NO: 18278 - protein, 17 aa, Homo sapiens
  heavy chain complementarity determining region 3 for antibody 9139
ARGTGIGSGSYYADFDY

SEQ ID NO: 18279 - protein, 9 aa, Homo sapiens
  light chain complementarity determining region 3 for antibody 9140
QHFGRSAWP

SEQ ID NO: 18280 - protein, 18 aa, Homo sapiens
  heavy chain complementarity determining region 3 for antibody 9140
ARVIGREVTWGWHLGLDP

SEQ ID NO: 18281 - protein, 12 aa, Homo sapiens
  light chain complementarity determining region 3 for antibody 9141
QHFDSTPPGGDT

SEQ ID NO: 18282 - protein, 21 aa, Homo sapiens
  heavy chain complementarity determining region 3 for antibody 9141
ARVRRRGVGYGSYERYYAMDV

SEQ ID NO: 18283 - protein, 12 aa, Homo sapiens
  light chain complementarity determining region 3 for antibody 9142
QHFDSPPPGGYT

SEQ ID NO: 18284 - protein, 21 aa, Homo sapiens
  heavy chain complementarity determining region 3 for antibody 9142
ARVRRRGVGYGSYERYYAMDV

SEQ ID NO: 18285 - protein, 8 aa, Homo sapiens
  light chain complementarity determining region 3 for antibody 9143
QHCGGSPT

SEQ ID NO: 18286 - protein, 14 aa, Homo sapiens
  heavy chain complementarity determining region 3 for antibody 9143
SHPTRAARLPIFDY

SEQ ID NO: 18287 - protein, 9 aa, Homo sapiens
  light chain complementarity determining region 3 for antibody 9144
QGYSTYSRT

SEQ ID NO: 18288 - protein, 15 aa, Homo sapiens
  heavy chain complementarity determining region 3 for antibody 9144
ARDCISTNCYLIFDN

SEQ ID NO: 18289 - protein, 9 aa, Homo sapiens
  light chain complementarity determining region 3 for antibody 9145
QGRSTWPGS

SEQ ID NO: 18290 - protein, 13 aa, Homo sapiens
  heavy chain complementarity determining region 3 for antibody 9145
ATGAWGSSWWGDY

SEQ ID NO: 18291 - protein, 7 aa, Homo sapiens
  light chain complementarity determining region 3 for antibody 9146
QGRSDGG

SEQ ID NO: 18292 - protein, 20 aa, Homo sapiens
  heavy chain complementarity determining region 3 for antibody 9146
ATYVPGDCTCTDCFYWYFDF

SEQ ID NO: 18293 - protein, 7 aa, Homo sapiens
  light chain complementarity determining region 3 for antibody 9147
QGNRNWA

SEQ ID NO: 18294 - protein, 20 aa, Homo sapiens
  heavy chain complementarity determining region 3 for antibody 9147
STYLPGDCTCTACFYWYSDF

SEQ ID NO: 18295 - protein, 7 aa, Homo sapiens
  light chain complementarity determining region 3 for antibody 9148
QGNRNWA

SEQ ID NO: 18296 - protein, 20 aa, Homo sapiens
  heavy chain complementarity determining region 3 for antibody 9148
STYLPGDCTCANCFYWYSDF

SEQ ID NO: 18297 - protein, 9 aa, Homo sapiens
  light chain complementarity determining region 3 for antibody 9149
QEYYSVPLT

SEQ ID NO: 18298 - protein, 12 aa, Homo sapiens
  heavy chain complementarity determining region 3 for antibody 9149
SRDKGGRNGMDV

SEQ ID NO: 18299 - protein, 9 aa, Homo sapiens
  light chain complementarity determining region 3 for antibody 9150
QEYSTYSRT

SEQ ID NO: 18300 - protein, 10 aa, Homo sapiens
  heavy chain complementarity determining region 3 for antibody 9150
CRDREGFGDV

SEQ ID NO: 18301 - protein, 9 aa, Homo sapiens
  light chain complementarity determining region 3 for antibody 9151
QEYSTYSRT

SEQ ID NO: 18302 - protein, 15 aa, Homo sapiens
  heavy chain complementarity determining region 3 for antibody 9151
ARDCSSTNCYLIFDN

SEQ ID NO: 18303 - protein, 9 aa, Homo sapiens
  light chain complementarity determining region 3 for antibody 9152
QEYSTYSRT

SEQ ID NO: 18304 - protein, 15 aa, Homo sapiens
  heavy chain complementarity determining region 3 for antibody 9152
ARDCISTNCYQIFDN

SEQ ID NO: 18305 - protein, 9 aa, Homo sapiens
  light chain complementarity determining region 3 for antibody 9153
QEYSTYSRT

SEQ ID NO: 18306 - protein, 15 aa, Homo sapiens
  heavy chain complementarity determining region 3 for antibody 9153
ARDCISTNCYLSFDN

SEQ ID NO: 18307 - protein, 9 aa, Homo sapiens
  light chain complementarity determining region 3 for antibody 9154
QEYSTYSRT

SEQ ID NO: 18308 - protein, 15 aa, Homo sapiens
  heavy chain complementarity determining region 3 for antibody 9154
ARDCISTNCYLLFDN

SEQ ID NO: 18309 - protein, 9 aa, Homo sapiens
  light chain complementarity determining region 3 for antibody 9155
QEYSTYSRT

SEQ ID NO: 18310 - protein, 15 aa, Homo sapiens
  heavy chain complementarity determining region 3 for antibody 9155
ARDCISTNCYLIFDT

SEQ ID NO: 18311 - protein, 9 aa, Homo sapiens
  light chain complementarity determining region 3 for antibody 9156
QEYSTYSRT

SEQ ID NO: 18312 - protein, 15 aa, Homo sapiens
  heavy chain complementarity determining region 3 for antibody 9156
ARDCISTNCCLIFDN

SEQ ID NO: 18313 - protein, 9 aa, Homo sapiens
  light chain complementarity determining region 3 for antibody 9157
QEYSTYSRT

SEQ ID NO: 18314 - protein, 15 aa, Homo sapiens
  heavy chain complementarity determining region 3 for antibody 9157
ARDCISTKCYLIFDN

SEQ ID NO: 18315 - protein, 9 aa, Homo sapiens
  light chain complementarity determining region 3 for antibody 9158
QEYSTYSRT

SEQ ID NO: 18316 - protein, 15 aa, Homo sapiens
  heavy chain complementarity determining region 3 for antibody 9158
ARDCISTICYLIFDN

SEQ ID NO: 18317 - protein, 9 aa, Homo sapiens
  light chain complementarity determining region 3 for antibody 9159
QEYSTSSRT

SEQ ID NO: 18318 - protein, 15 aa, Homo sapiens
  heavy chain complementarity determining region 3 for antibody 9159
ARDCISTNCYLIFDN

SEQ ID NO: 18319 - protein, 9 aa, Homo sapiens
  light chain complementarity determining region 3 for antibody 9160
QEYSNYSRT

SEQ ID NO: 18320 - protein, 15 aa, Homo sapiens
  heavy chain complementarity determining region 3 for antibody 9160
ARDCISTNCYLIFDN

SEQ ID NO: 18321 - protein, 9 aa, Homo sapiens
  light chain complementarity determining region 3 for antibody 9161
QEYRTVPWT

SEQ ID NO: 18322 - protein, 20 aa, Homo sapiens
  heavy chain complementarity determining region 3 for antibody 9161
AKDGRGTANYHSAGGGGLDV

SEQ ID NO: 18323 - protein, 9 aa, Homo sapiens
  light chain complementarity determining region 3 for antibody 9162
QEYRTPPWT

SEQ ID NO: 18324 - protein, 20 aa, Homo sapiens
  heavy chain complementarity determining region 3 for antibody 9162
ATDGRGIADYDHAGGGGLDV

SEQ ID NO: 18325 - protein, 9 aa, Homo sapiens
  light chain complementarity determining region 3 for antibody 9163
QEYRTPPWT

SEQ ID NO: 18326 - protein, 20 aa, Homo sapiens
  heavy chain complementarity determining region 3 for antibody 9163
ARDGRGIVEYDYAGGGGLDA

SEQ ID NO: 18327 - protein, 9 aa, Homo sapiens
  light chain complementarity determining region 3 for antibody 9164
QEYRTAPWT

SEQ ID NO: 18328 - protein, 14 aa, Homo sapiens
  heavy chain complementarity determining region 3 for antibody 9164
ARGHFDSTGFRLDY

SEQ ID NO: 18329 - protein, 9 aa, Homo sapiens
  light chain complementarity determining region 3 for antibody 9165
QEYRTAPRT

SEQ ID NO: 18330 - protein, 24 aa, Homo sapiens
  heavy chain complementarity determining region 3 for antibody 9165
ARDGRGTVYYHSAGGGAGGGGLDV

SEQ ID NO: 18331 - protein, 9 aa, Homo sapiens
  light chain complementarity determining region 3 for antibody 9166
QEYNTVPWT

SEQ ID NO: 18332 - protein, 20 aa, Homo sapiens
  heavy chain complementarity determining region 3 for antibody 9166
AKDGRGTAFYHGAGGGGLDV

SEQ ID NO: 18333 - protein, 9 aa, Homo sapiens
  light chain complementarity determining region 3 for antibody 9167
QEYNTPPWT

SEQ ID NO: 18334 - protein, 20 aa, Homo sapiens
  heavy chain complementarity determining region 3 for antibody 9167
ATDGRGIADYDHSGGGGLDV

SEQ ID NO: 18335 - protein, 9 aa, Homo sapiens
  light chain complementarity determining region 3 for antibody 9168
QEYKTVTWT

SEQ ID NO: 18336 - protein, 20 aa, Homo sapiens
  heavy chain complementarity determining region 3 for antibody 9168
AKDGRGTANYHSAGGGGLDV

SEQ ID NO: 18337 - protein, 9 aa, Homo sapiens
  light chain complementarity determining region 3 for antibody 9169
QEYKTVPWT

SEQ ID NO: 18338 - protein, 20 aa, Homo sapiens
  heavy chain complementarity determining region 3 for antibody 9169
GKDGRGTANYHSAGGGGLDV

SEQ ID NO: 18339 - protein, 9 aa, Homo sapiens
  light chain complementarity determining region 3 for antibody 9170
QEYKTVPWT

SEQ ID NO: 18340 - protein, 10 aa, Homo sapiens
  heavy chain complementarity determining region 3 for antibody 9170
ARETSGAYDI

SEQ ID NO: 18341 - protein, 9 aa, Homo sapiens
  light chain complementarity determining region 3 for antibody 9171
QEYKTVPWT

SEQ ID NO: 18342 - protein, 20 aa, Homo sapiens
  heavy chain complementarity determining region 3 for antibody 9171
AKDGRVTANYHSAGGGGLDV

SEQ ID NO: 18343 - protein, 9 aa, Homo sapiens
  light chain complementarity determining region 3 for antibody 9172
QEYKTVPWT

SEQ ID NO: 18344 - protein, 20 aa, Homo sapiens
  heavy chain complementarity determining region 3 for antibody 9172
AKDGRGTATYHSAGGGGLDV

SEQ ID NO: 18345 - protein, 9 aa, Homo sapiens
  light chain complementarity determining region 3 for antibody 9173
QEYKTVPWT

SEQ ID NO: 18346 - protein, 20 aa, Homo sapiens
  heavy chain complementarity determining region 3 for antibody 9173
AKDGRGTANYHSGGGGGLDV

SEQ ID NO: 18347 - protein, 9 aa, Homo sapiens
  light chain complementarity determining region 3 for antibody 9174
QEYKTVPWT

SEQ ID NO: 18348 - protein, 20 aa, Homo sapiens
  heavy chain complementarity determining region 3 for antibody 9174
AKDGRGTANYHSAGGRGLDV

SEQ ID NO: 18349 - protein, 9 aa, Homo sapiens
  light chain complementarity determining region 3 for antibody 9175
QEYKTVPWT

SEQ ID NO: 18350 - protein, 20 aa, Homo sapiens
  heavy chain complementarity determining region 3 for antibody 9175
AKDGRGTANYHSAGGGGVDV

SEQ ID NO: 18351 - protein, 9 aa, Homo sapiens
  light chain complementarity determining region 3 for antibody 9176
QEYKTVPWT

SEQ ID NO: 18352 - protein, 20 aa, Homo sapiens
  heavy chain complementarity determining region 3 for antibody 9176
AKDGRGTANYHSAGGGGLGV

SEQ ID NO: 18353 - protein, 9 aa, Homo sapiens
  light chain complementarity determining region 3 for antibody 9177
QEYKTVPWT

SEQ ID NO: 18354 - protein, 20 aa, Homo sapiens
  heavy chain complementarity determining region 3 for antibody 9177
AKDGRGTANYHSAGCGGLDV

SEQ ID NO: 18355 - protein, 9 aa, Homo sapiens
  light chain complementarity determining region 3 for antibody 9178
QEYKTVPWT

SEQ ID NO: 18356 - protein, 20 aa, Homo sapiens
  heavy chain complementarity determining region 3 for antibody 9178
AKDGRGTAFYHVAGGGGLDV

SEQ ID NO: 18357 - protein, 9 aa, Homo sapiens
  light chain complementarity determining region 3 for antibody 9179
QEYKTVPWT

SEQ ID NO: 18358 - protein, 20 aa, Homo sapiens
  heavy chain complementarity determining region 3 for antibody 9179
AKDGRGTAFYHGPGGGGLDV

SEQ ID NO: 18359 - protein, 9 aa, Homo sapiens
  light chain complementarity determining region 3 for antibody 9180
QEYKTVPWT

SEQ ID NO: 18360 - protein, 20 aa, Homo sapiens
  heavy chain complementarity determining region 3 for antibody 9180
AKDGRGTACYHGAGGGGLDV

SEQ ID NO: 18361 - protein, 9 aa, Homo sapiens
  light chain complementarity determining region 3 for antibody 9181
QEYKTVPWT

SEQ ID NO: 18362 - protein, 12 aa, Homo sapiens
  heavy chain complementarity determining region 3 for antibody 9181
AIVVPGRWDLDD

SEQ ID NO: 18363 - protein, 9 aa, Homo sapiens
  light chain complementarity determining region 3 for antibody 9182
QEYKTVPWA

SEQ ID NO: 18364 - protein, 10 aa, Homo sapiens
  heavy chain complementarity determining region 3 for antibody 9182
CRDREGFGDV

SEQ ID NO: 18365 - protein, 9 aa, Homo sapiens
  light chain complementarity determining region 3 for antibody 9183
QEYKTVPLT

SEQ ID NO: 18366 - protein, 20 aa, Homo sapiens
  heavy chain complementarity determining region 3 for antibody 9183
AKDGRGTAFYHGAGGGGLDV

SEQ ID NO: 18367 - protein, 9 aa, Homo sapiens
  light chain complementarity determining region 3 for antibody 9184
QEYKTGPWT

SEQ ID NO: 18368 - protein, 20 aa, Homo sapiens
  heavy chain complementarity determining region 3 for antibody 9184
AKDGRGTAFYHGAGGGGLDV

SEQ ID NO: 18369 - protein, 9 aa, Homo sapiens
  light chain complementarity determining region 3 for antibody 9185
QEYKTFPWT

SEQ ID NO: 18370 - protein, 20 aa, Homo sapiens
  heavy chain complementarity determining region 3 for antibody 9185
AKDGRGTAFYHGAGGGGLDV

SEQ ID NO: 18371 - protein, 9 aa, Homo sapiens
  light chain complementarity determining region 3 for antibody 9186
QEYKNVPWT

SEQ ID NO: 18372 - protein, 20 aa, Homo sapiens
  heavy chain complementarity determining region 3 for antibody 9186
AKDGRGTAFYHGSGGGGLDV

SEQ ID NO: 18373 - protein, 9 aa, Homo sapiens
  light chain complementarity determining region 3 for antibody 9187
QEYGTYSRT

SEQ ID NO: 18374 - protein, 15 aa, Homo sapiens
  heavy chain complementarity determining region 3 for antibody 9187
ARDCISTNCYLIFDN

SEQ ID NO: 18375 - protein, 8 aa, Homo sapiens
  light chain complementarity determining region 3 for antibody 9188
QEYGESFP

SEQ ID NO: 18376 - protein, 16 aa, Homo sapiens
  heavy chain complementarity determining region 3 for antibody 9188
AIWAAVSSGWSGPFDF

SEQ ID NO: 18377 - protein, 8 aa, Homo sapiens
  light chain complementarity determining region 3 for antibody 9189
QEYGDSFP

SEQ ID NO: 18378 - protein, 16 aa, Homo sapiens
  heavy chain complementarity determining region 3 for antibody 9189
AIWATVSSGWSGPFDF

SEQ ID NO: 18379 - protein, 8 aa, Homo sapiens
  light chain complementarity determining region 3 for antibody 9190
QEYGDSFP

SEQ ID NO: 18380 - protein, 16 aa, Homo sapiens
  heavy chain complementarity determining region 3 for antibody 9190
AIWAAVSSGWSGPFNF

SEQ ID NO: 18381 - protein, 8 aa, Homo sapiens
  light chain complementarity determining region 3 for antibody 9191
QEYGDSFP

SEQ ID NO: 18382 - protein, 16 aa, Homo sapiens
  heavy chain complementarity determining region 3 for antibody 9191
AIWAAVSSGWSCPFDF

SEQ ID NO: 18383 - protein, 8 aa, Homo sapiens
  light chain complementarity determining region 3 for antibody 9192
QEYGDSFP

SEQ ID NO: 18384 - protein, 16 aa, Homo sapiens
  heavy chain complementarity determining region 3 for antibody 9192
AIWAAVSSGWGGPFDF

SEQ ID NO: 18385 - protein, 8 aa, Homo sapiens
  light chain complementarity determining region 3 for antibody 9193
QEYGDSFP

SEQ ID NO: 18386 - protein, 16 aa, Homo sapiens
  heavy chain complementarity determining region 3 for antibody 9193
AIWAAVSSGGSGPFDF

SEQ ID NO: 18387 - protein, 8 aa, Homo sapiens
  light chain complementarity determining region 3 for antibody 9194
QEYGDSFP

SEQ ID NO: 18388 - protein, 16 aa, Homo sapiens
  heavy chain complementarity determining region 3 for antibody 9194
AICAAVSSGWSGPFDF

SEQ ID NO: 18389 - protein, 8 aa, Homo sapiens
  light chain complementarity determining region 3 for antibody 9195
QEYGDPFP

SEQ ID NO: 18390 - protein, 16 aa, Homo sapiens
  heavy chain complementarity determining region 3 for antibody 9195
AIWAAVSSGWSGPFDF

SEQ ID NO: 18391 - protein, 8 aa, Homo sapiens
  light chain complementarity determining region 3 for antibody 9196
QEYGASFP

SEQ ID NO: 18392 - protein, 16 aa, Homo sapiens
  heavy chain complementarity determining region 3 for antibody 9196
AIWAAVSSGWSGPFDF

SEQ ID NO: 18393 - protein, 8 aa, Homo sapiens
  light chain complementarity determining region 3 for antibody 9197
QEYADSFP

SEQ ID NO: 18394 - protein, 16 aa, Homo sapiens
  heavy chain complementarity determining region 3 for antibody 9197
AIWAAVSSGWSGPFDF

SEQ ID NO: 18395 - protein, 10 aa, Homo sapiens
  light chain complementarity determining region 3 for antibody 9198
QESYSTPLFT

SEQ ID NO: 18396 - protein, 23 aa, Homo sapiens
  heavy chain complementarity determining region 3 for antibody 9198
ARHFPKGESGVTGTQSLHYYMDV

SEQ ID NO: 18397 - protein, 9 aa, Homo sapiens
  light chain complementarity determining region 3 for antibody 9199
QESSTWPGS

SEQ ID NO: 18398 - protein, 13 aa, Homo sapiens
  heavy chain complementarity determining region 3 for antibody 9199
ATGAWGSSWWGDY

SEQ ID NO: 18399 - protein, 9 aa, Homo sapiens
  light chain complementarity determining region 3 for antibody 9200
QERSTWSGS

SEQ ID NO: 18400 - protein, 13 aa, Homo sapiens
  heavy chain complementarity determining region 3 for antibody 9200
ATGAWGSSWWGDY

SEQ ID NO: 18401 - protein, 9 aa, Homo sapiens
  light chain complementarity determining region 3 for antibody 9201
QERSTWPRS

SEQ ID NO: 18402 - protein, 13 aa, Homo sapiens
  heavy chain complementarity determining region 3 for antibody 9201
ATGAWDSSWWGDY

SEQ ID NO: 18403 - protein, 9 aa, Homo sapiens
  light chain complementarity determining region 3 for antibody 9202
QERSTWPGS

SEQ ID NO: 18404 - protein, 13 aa, Homo sapiens
  heavy chain complementarity determining region 3 for antibody 9202
VTGAWGSSWWGDY

SEQ ID NO: 18405 - protein, 9 aa, Homo sapiens
  light chain complementarity determining region 3 for antibody 9203
QERSTWPGS

SEQ ID NO: 18406 - protein, 10 aa, Homo sapiens
  heavy chain complementarity determining region 3 for antibody 9203
VREWWGAFDI

SEQ ID NO: 18407 - protein, 9 aa, Homo sapiens
  light chain complementarity determining region 3 for antibody 9204
QERSTWPGS

SEQ ID NO: 18408 - protein, 10 aa, Homo sapiens
  heavy chain complementarity determining region 3 for antibody 9204
VRDYWNSIDY

SEQ ID NO: 18409 - protein, 9 aa, Homo sapiens
  light chain complementarity determining region 3 for antibody 9205
QERSTWPGS

SEQ ID NO: 18410 - protein, 16 aa, Homo sapiens
  heavy chain complementarity determining region 3 for antibody 9205
VGPHLTYNSGWRYFDY

SEQ ID NO: 18411 - protein, 9 aa, Homo sapiens
  light chain complementarity determining region 3 for antibody 9206
QERSTWPGS

SEQ ID NO: 18412 - protein, 15 aa, Homo sapiens
  heavy chain complementarity determining region 3 for antibody 9206
GKEGPGSSGWLTGHY

SEQ ID NO: 18413 - protein, 9 aa, Homo sapiens
  light chain complementarity determining region 3 for antibody 9207
QERSTWPGS

SEQ ID NO: 18414 - protein, 13 aa, Homo sapiens
  heavy chain complementarity determining region 3 for antibody 9207
ATGVWGSSWWGDY

SEQ ID NO: 18415 - protein, 9 aa, Homo sapiens
  light chain complementarity determining region 3 for antibody 9208
QERSTWPGS

SEQ ID NO: 18416 - protein, 13 aa, Homo sapiens
  heavy chain complementarity determining region 3 for antibody 9208
ATGTWGSSWWGDY

SEQ ID NO: 18417 - protein, 9 aa, Homo sapiens
  light chain complementarity determining region 3 for antibody 9209
QERSTWPGS

SEQ ID NO: 18418 - protein, 13 aa, Homo sapiens
  heavy chain complementarity determining region 3 for antibody 9209
ATGAWGSSWWRDY

SEQ ID NO: 18419 - protein, 9 aa, Homo sapiens
  light chain complementarity determining region 3 for antibody 9210
QERSTWPGS

SEQ ID NO: 18420 - protein, 13 aa, Homo sapiens
  heavy chain complementarity determining region 3 for antibody 9210
ATGAWGSGWWGDY

SEQ ID NO: 18421 - protein, 9 aa, Homo sapiens
  light chain complementarity determining region 3 for antibody 9211
QERSTWPGS

SEQ ID NO: 18422 - protein, 7 aa, Homo sapiens
  heavy chain complementarity determining region 3 for antibody 9211
ATGAWDS

SEQ ID NO: 18423 - protein, 9 aa, Homo sapiens
  light chain complementarity determining region 3 for antibody 9212
QERSTWPGS

SEQ ID NO: 18424 - protein, 11 aa, Homo sapiens
  heavy chain complementarity determining region 3 for antibody 9212
ATFGQQWRLAH

SEQ ID NO: 18425 - protein, 9 aa, Homo sapiens
  light chain complementarity determining region 3 for antibody 9213
QERSTWPGS

SEQ ID NO: 18426 - protein, 13 aa, Homo sapiens
  heavy chain complementarity determining region 3 for antibody 9213
ATCAWGSSWWGDY

SEQ ID NO: 18427 - protein, 9 aa, Homo sapiens
  light chain complementarity determining region 3 for antibody 9214
QERSTWPGS

SEQ ID NO: 18428 - protein, 14 aa, Homo sapiens
  heavy chain complementarity determining region 3 for antibody 9214
ARLHGSGLGRWLDP

SEQ ID NO: 18429 - protein, 9 aa, Homo sapiens
  light chain complementarity determining region 3 for antibody 9215
QERSTWPGS

SEQ ID NO: 18430 - protein, 12 aa, Homo sapiens
  heavy chain complementarity determining region 3 for antibody 9215
ARLDWNYRAFDI

SEQ ID NO: 18431 - protein, 9 aa, Homo sapiens
  light chain complementarity determining region 3 for antibody 9216
QERSTWPGS

SEQ ID NO: 18432 - protein, 15 aa, Homo sapiens
  heavy chain complementarity determining region 3 for antibody 9216
ARIWTSSTNCRYMDV

SEQ ID NO: 18433 - protein, 9 aa, Homo sapiens
  light chain complementarity determining region 3 for antibody 9217
QERSTWPGS

SEQ ID NO: 18434 - protein, 14 aa, Homo sapiens
  heavy chain complementarity determining region 3 for antibody 9217
ARGHFDSTGFRLDY

SEQ ID NO: 18435 - protein, 9 aa, Homo sapiens
  light chain complementarity determining region 3 for antibody 9218
QERSTWPGS

SEQ ID NO: 18436 - protein, 10 aa, Homo sapiens
  heavy chain complementarity determining region 3 for antibody 9218
ARATYWAYDS

SEQ ID NO: 18437 - protein, 9 aa, Homo sapiens
  light chain complementarity determining region 3 for antibody 9219
QERSTWPGP

SEQ ID NO: 18438 - protein, 13 aa, Homo sapiens
  heavy chain complementarity determining region 3 for antibody 9219
ATGAWDSSWWGDY

SEQ ID NO: 18439 - protein, 9 aa, Homo sapiens
  light chain complementarity determining region 3 for antibody 9220
QERSTWPGF

SEQ ID NO: 18440 - protein, 13 aa, Homo sapiens
  heavy chain complementarity determining region 3 for antibody 9220
ATGAWGSSWWGDY

SEQ ID NO: 18441 - protein, 9 aa, Homo sapiens
  light chain complementarity determining region 3 for antibody 9221
QERSTRPGS

SEQ ID NO: 18442 - protein, 13 aa, Homo sapiens
  heavy chain complementarity determining region 3 for antibody 9221
ATGAWGSSWWGDY

SEQ ID NO: 18443 - protein, 9 aa, Homo sapiens
  light chain complementarity determining region 3 for antibody 9222
QERNTWPGS

SEQ ID NO: 18444 - protein, 13 aa, Homo sapiens
  heavy chain complementarity determining region 3 for antibody 9222
ATGAWGSSWWGDY

SEQ ID NO: 18445 - protein, 9 aa, Homo sapiens
  light chain complementarity determining region 3 for antibody 9223
QERATWPGS

SEQ ID NO: 18446 - protein, 13 aa, Homo sapiens
  heavy chain complementarity determining region 3 for antibody 9223
ATGAWASSWWRDY

SEQ ID NO: 18447 - protein, 9 aa, Homo sapiens
  light chain complementarity determining region 3 for antibody 9224
QERATWPGS

SEQ ID NO: 18448 - protein, 13 aa, Homo sapiens
  heavy chain complementarity determining region 3 for antibody 9224
AAGAWASSWWGDY

SEQ ID NO: 18449 - protein, 9 aa, Homo sapiens
  light chain complementarity determining region 3 for antibody 9225
QENKNVPWT

SEQ ID NO: 18450 - protein, 20 aa, Homo sapiens
  heavy chain complementarity determining region 3 for antibody 9225
AKDGRGTAFYHGAGGGGLDV

SEQ ID NO: 18451 - protein, 9 aa, Homo sapiens
  light chain complementarity determining region 3 for antibody 9226
QEHKTVPWT

SEQ ID NO: 18452 - protein, 20 aa, Homo sapiens
  heavy chain complementarity determining region 3 for antibody 9226
AKDGRGTANYHSAGGGGLDV

SEQ ID NO: 18453 - protein, 8 aa, Homo sapiens
  light chain complementarity determining region 3 for antibody 9227
QEFGDSFP

SEQ ID NO: 18454 - protein, 16 aa, Homo sapiens
  heavy chain complementarity determining region 3 for antibody 9227
AIWAAVSSGWSGPFDF

SEQ ID NO: 18455 - protein, 9 aa, Homo sapiens
  light chain complementarity determining region 3 for antibody 9228
QEDKNVPWT

SEQ ID NO: 18456 - protein, 20 aa, Homo sapiens
  heavy chain complementarity determining region 3 for antibody 9228
AKDGRGTAFYHGAGGGGLDV

SEQ ID NO: 18457 - protein, 9 aa, Homo sapiens
  light chain complementarity determining region 3 for antibody 9229
QEDKNGPWT

SEQ ID NO: 18458 - protein, 20 aa, Homo sapiens
  heavy chain complementarity determining region 3 for antibody 9229
AKDGRGTAFYHGAGGGGLDV

SEQ ID NO: 18459 - protein, 9 aa, Homo sapiens
  light chain complementarity determining region 3 for antibody 9230
QEANSLPVT

SEQ ID NO: 18460 - protein, 13 aa, Homo sapiens
  heavy chain complementarity determining region 3 for antibody 9230
TREGDSSGPDFHL

SEQ ID NO: 18461 - protein, 9 aa, Homo sapiens
  light chain complementarity determining region 3 for antibody 9231
QDYNSVPLT

SEQ ID NO: 18462 - protein, 10 aa, Homo sapiens
  heavy chain complementarity determining region 3 for antibody 9231
CRDREGFGDV

SEQ ID NO: 18463 - protein, 10 aa, Homo sapiens
  light chain complementarity determining region 3 for antibody 9232
QDYNSPVEWP

SEQ ID NO: 18464 - protein, 10 aa, Homo sapiens
  heavy chain complementarity determining region 3 for antibody 9232
ARRSTAALDF

SEQ ID NO: 18465 - protein, 7 aa, Homo sapiens
  light chain complementarity determining region 3 for antibody 9233
QCRSAGG

SEQ ID NO: 18466 - protein, 20 aa, Homo sapiens
  heavy chain complementarity determining region 3 for antibody 9233
ATYVPGDCTCTDCFYWYFDF

SEQ ID NO: 18467 - protein, 7 aa, Homo sapiens
  light chain complementarity determining region 3 for antibody 9234
QCNRNWA

SEQ ID NO: 18468 - protein, 16 aa, Homo sapiens
  heavy chain complementarity determining region 3 for antibody 9234
VRDLAGFTRGGSTFDY

SEQ ID NO: 18469 - protein, 7 aa, Homo sapiens
  light chain complementarity determining region 3 for antibody 9235
QCNRNWA

SEQ ID NO: 18470 - protein, 20 aa, Homo sapiens
  heavy chain complementarity determining region 3 for antibody 9235
STYRPGDCTCTGCFYWYSDF

SEQ ID NO: 18471 - protein, 7 aa, Homo sapiens
  light chain complementarity determining region 3 for antibody 9236
QCNRNWA

SEQ ID NO: 18472 - protein, 20 aa, Homo sapiens
  heavy chain complementarity determining region 3 for antibody 9236
STYPPGDCTCTGCFYWYSDF

SEQ ID NO: 18473 - protein, 7 aa, Homo sapiens
  light chain complementarity determining region 3 for antibody 9237
QCNRNWA

SEQ ID NO: 18474 - protein, 20 aa, Homo sapiens
  heavy chain complementarity determining region 3 for antibody 9237
STYLPGGCTCTGCFYWYSDF

SEQ ID NO: 18475 - protein, 7 aa, Homo sapiens
  light chain complementarity determining region 3 for antibody 9238
QCNRNWA

SEQ ID NO: 18476 - protein, 20 aa, Homo sapiens
  heavy chain complementarity determining region 3 for antibody 9238
STYLPGDRTCTACFYWYSDF

SEQ ID NO: 18477 - protein, 7 aa, Homo sapiens
  light chain complementarity determining region 3 for antibody 9239
QCNRNWA

SEQ ID NO: 18478 - protein, 20 aa, Homo sapiens
  heavy chain complementarity determining region 3 for antibody 9239
STYLPGDCTCTGCVYWYSDF

SEQ ID NO: 18479 - protein, 7 aa, Homo sapiens
  light chain complementarity determining region 3 for antibody 9240
QCNRNWA

SEQ ID NO: 18480 - protein, 20 aa, Homo sapiens
  heavy chain complementarity determining region 3 for antibody 9240
STYLPGDCTCTGCCYWYSDF

SEQ ID NO: 18481 - protein, 7 aa, Homo sapiens
  light chain complementarity determining region 3 for antibody 9241
QCNRNWA

SEQ ID NO: 18482 - protein, 20 aa, Homo sapiens
  heavy chain complementarity determining region 3 for antibody 9241
STYLPGDCTCTACFYWYPDF

SEQ ID NO: 18483 - protein, 7 aa, Homo sapiens
  light chain complementarity determining region 3 for antibody 9242
QCNRNWA

SEQ ID NO: 18484 - protein, 20 aa, Homo sapiens
  heavy chain complementarity determining region 3 for antibody 9242
STSLPGDCTCTGCFYWYSDF

SEQ ID NO: 18485 - protein, 7 aa, Homo sapiens
  light chain complementarity determining region 3 for antibody 9243
QCNRNWA

SEQ ID NO: 18486 - protein, 20 aa, Homo sapiens
  heavy chain complementarity determining region 3 for antibody 9243
STFLPGDCTCTGCFYWYSDF

SEQ ID NO: 18487 - protein, 7 aa, Homo sapiens
  light chain complementarity determining region 3 for antibody 9244
QCNRNWA

SEQ ID NO: 18488 - protein, 15 aa, Homo sapiens
  heavy chain complementarity determining region 3 for antibody 9244
ARIWTSSTNCRYMDV

SEQ ID NO: 18489 - protein, 7 aa, Homo sapiens
  light chain complementarity determining region 3 for antibody 9245
QCNRNRA

SEQ ID NO: 18490 - protein, 20 aa, Homo sapiens
  heavy chain complementarity determining region 3 for antibody 9245
STYLPGDCTCTACFYWYSDF

SEQ ID NO: 18491 - protein, 7 aa, Homo sapiens
  light chain complementarity determining region 3 for antibody 9246
QCKRNWA

SEQ ID NO: 18492 - protein, 20 aa, Homo sapiens
  heavy chain complementarity determining region 3 for antibody 9246
STYLPGDCSCTSCCYWYSDL

SEQ ID NO: 18493 - protein, 7 aa, Homo sapiens
  light chain complementarity determining region 3 for antibody 9247
QCKRNWA

SEQ ID NO: 18494 - protein, 20 aa, Homo sapiens
  heavy chain complementarity determining region 3 for antibody 9247
STYLPGDCSCPSCFYWYSDL

SEQ ID NO: 18495 - protein, 7 aa, Homo sapiens
  light chain complementarity determining region 3 for antibody 9248
QCFGTSP

SEQ ID NO: 18496 - protein, 11 aa, Homo sapiens
  heavy chain complementarity determining region 3 for antibody 9248
VRDGSYWRFDP

SEQ ID NO: 18497 - protein, 9 aa, Homo sapiens
  light chain complementarity determining region 3 for antibody 9249
QAYKTVPWT

SEQ ID NO: 18498 - protein, 20 aa, Homo sapiens
  heavy chain complementarity determining region 3 for antibody 9249
AKDGRGTANYHSAGGGGLDV

SEQ ID NO: 18499 - protein, 9 aa, Homo sapiens
  light chain complementarity determining region 3 for antibody 9250
QAYKTVPWT

SEQ ID NO: 18500 - protein, 20 aa, Homo sapiens
  heavy chain complementarity determining region 3 for antibody 9250
AKDGRGTAFYHGAGGGGLDV

SEQ ID NO: 18501 - protein, 9 aa, Homo sapiens
  light chain complementarity determining region 3 for antibody 9251
PQYYTSPPP

SEQ ID NO: 18502 - protein, 10 aa, Homo sapiens
  heavy chain complementarity determining region 3 for antibody 9251
AAGSGWLIEY

SEQ ID NO: 18503 - protein, 9 aa, Homo sapiens
  light chain complementarity determining region 3 for antibody 9252
PQYYTSPLT

SEQ ID NO: 18504 - protein, 10 aa, Homo sapiens
  heavy chain complementarity determining region 3 for antibody 9252
AAGSGWLIEY

SEQ ID NO: 18505 - protein, 9 aa, Homo sapiens
  light chain complementarity determining region 3 for antibody 9253
PQYYTAPWA

SEQ ID NO: 18506 - protein, 17 aa, Homo sapiens
  heavy chain complementarity determining region 3 for antibody 9253
SRDGRTVWPGSQGTLDS

SEQ ID NO: 18507 - protein, 9 aa, Homo sapiens
  light chain complementarity determining region 3 for antibody 9254
PQYYTAPFT

SEQ ID NO: 18508 - protein, 12 aa, Homo sapiens
  heavy chain complementarity determining region 3 for antibody 9254
AIAGPWGSYYPH

SEQ ID NO: 18509 - protein, 9 aa, Homo sapiens
  light chain complementarity determining region 3 for antibody 9255
PQYYSTPPT

SEQ ID NO: 18510 - protein, 10 aa, Homo sapiens
  heavy chain complementarity determining region 3 for antibody 9255
AKNSINYYDM

SEQ ID NO: 18511 - protein, 9 aa, Homo sapiens
  light chain complementarity determining region 3 for antibody 9256
PQYYSSPFT

SEQ ID NO: 18512 - protein, 14 aa, Homo sapiens
  heavy chain complementarity determining region 3 for antibody 9256
AASYSSGWLEYFQY

SEQ ID NO: 18513 - protein, 9 aa, Homo sapiens
  light chain complementarity determining region 3 for antibody 9257
PQYYSFPPT

SEQ ID NO: 18514 - protein, 13 aa, Homo sapiens
  heavy chain complementarity determining region 3 for antibody 9257
TTGAADSGSVFDN

SEQ ID NO: 18515 - protein, 9 aa, Homo sapiens
  light chain complementarity determining region 3 for antibody 9258
PQYNSYSRT

SEQ ID NO: 18516 - protein, 16 aa, Homo sapiens
  heavy chain complementarity determining region 3 for antibody 9258
VGPHLTYNSGWRYFDY

SEQ ID NO: 18517 - protein, 9 aa, Homo sapiens
  light chain complementarity determining region 3 for antibody 9259
PQYNSYPWT

SEQ ID NO: 18518 - protein, 15 aa, Homo sapiens
  heavy chain complementarity determining region 3 for antibody 9259
GKEGPGSSGWLTGHY

SEQ ID NO: 18519 - protein, 9 aa, Homo sapiens
  light chain complementarity determining region 3 for antibody 9260
PQYHNWPGT

SEQ ID NO: 18520 - protein, 11 aa, Homo sapiens
  heavy chain complementarity determining region 3 for antibody 9260
AKGGFYFLTGD

SEQ ID NO: 18521 - protein, 9 aa, Homo sapiens
  light chain complementarity determining region 3 for antibody 9261
PQYGSSTWT

SEQ ID NO: 18522 - protein, 17 aa, Homo sapiens
  heavy chain complementarity determining region 3 for antibody 9261
AKGRGSVAMALIYYLDL

SEQ ID NO: 18523 - protein, 9 aa, Homo sapiens
  light chain complementarity determining region 3 for antibody 9262
PQYGSSPWT

SEQ ID NO: 18524 - protein, 10 aa, Homo sapiens
  heavy chain complementarity determining region 3 for antibody 9262
ARERSGSYDI

SEQ ID NO: 18525 - protein, 9 aa, Homo sapiens
  light chain complementarity determining region 3 for antibody 9263
PQYGSSPRT

SEQ ID NO: 18526 - protein, 11 aa, Homo sapiens
  heavy chain complementarity determining region 3 for antibody 9263
ALKIAAFPFDY

SEQ ID NO: 18527 - protein, 8 aa, Homo sapiens
  light chain complementarity determining region 3 for antibody 9264
PQYGRPWT

SEQ ID NO: 18528 - protein, 13 aa, Homo sapiens
  heavy chain complementarity determining region 3 for antibody 9264
ARDRPSTGWYLEY

SEQ ID NO: 18529 - protein, 9 aa, Homo sapiens
  light chain complementarity determining region 3 for antibody 9265
PQYFTSPLT

SEQ ID NO: 18530 - protein, 10 aa, Homo sapiens
  heavy chain complementarity determining region 3 for antibody 9265
AAGSGWLIEY

SEQ ID NO: 18531 - protein, 10 aa, Homo sapiens
  light chain complementarity determining region 3 for antibody 9266
PQSYSSPPWA

SEQ ID NO: 18532 - protein, 16 aa, Homo sapiens
  heavy chain complementarity determining region 3 for antibody 9266
ASLNRGDKEFGVPPAL

SEQ ID NO: 18533 - protein, 9 aa, Homo sapiens
  light chain complementarity determining region 3 for antibody 9267
PQSSNTPLT

SEQ ID NO: 18534 - protein, 16 aa, Homo sapiens
  heavy chain complementarity determining region 3 for antibody 9267
VRDLAGFTRGGSTFDY

SEQ ID NO: 18535 - protein, 9 aa, Homo sapiens
  light chain complementarity determining region 3 for antibody 9268
PQLSNAPLT

SEQ ID NO: 18536 - protein, 17 aa, Homo sapiens
  heavy chain complementarity determining region 3 for antibody 9268
AKRLPDLLGGGHHYIDV

SEQ ID NO: 18537 - protein, 9 aa, Homo sapiens
  light chain complementarity determining region 3 for antibody 9269
PQLNSYPYT

SEQ ID NO: 18538 - protein, 14 aa, Homo sapiens
  heavy chain complementarity determining region 3 for antibody 9269
ARGHFDSTGFRLDY

SEQ ID NO: 18539 - protein, 9 aa, Homo sapiens
  light chain complementarity determining region 3 for antibody 9270
PQLMSYPYT

SEQ ID NO: 18540 - protein, 17 aa, Homo sapiens
  heavy chain complementarity determining region 3 for antibody 9270
ARNTMVHGWQRQGSVDH

SEQ ID NO: 18541 - protein, 9 aa, Homo sapiens
  light chain complementarity determining region 3 for antibody 9271
PQHNSYPLT

SEQ ID NO: 18542 - protein, 11 aa, Homo sapiens
  heavy chain complementarity determining region 3 for antibody 9271
VRVSTGWSFDY

SEQ ID NO: 18543 - protein, 9 aa, Homo sapiens
  light chain complementarity determining region 3 for antibody 9272
PQFNTYPLT

SEQ ID NO: 18544 - protein, 20 aa, Homo sapiens
  heavy chain complementarity determining region 3 for antibody 9272
ARNLQYCSGGSCYGPFYFDY

SEQ ID NO: 18545 - protein, 9 aa, Homo sapiens
  light chain complementarity determining region 3 for antibody 9273
PQFKSYPWA

SEQ ID NO: 18546 - protein, 13 aa, Homo sapiens
  heavy chain complementarity determining region 3 for antibody 9273
AKATVPTGGHFDH

SEQ ID NO: 18547 - protein, 9 aa, Homo sapiens
  light chain complementarity determining region 3 for antibody 9274
PQDYYTPRP

SEQ ID NO: 18548 - protein, 11 aa, Homo sapiens
  heavy chain complementarity determining region 3 for antibody 9274
ARRSLGGAFDY

SEQ ID NO: 18549 - protein, 9 aa, Homo sapiens
  light chain complementarity determining region 3 for antibody 9275
PQCGTSPKT

SEQ ID NO: 18550 - protein, 13 aa, Homo sapiens
  heavy chain complementarity determining region 3 for antibody 9275
ARDGSSDWYELAY

SEQ ID NO: 18551 - protein, 9 aa, Homo sapiens
  light chain complementarity determining region 3 for antibody 9276
PLSGSSLLT

SEQ ID NO: 18552 - protein, 12 aa, Homo sapiens
  heavy chain complementarity determining region 3 for antibody 9276
ALDEWHPSWYKY

SEQ ID NO: 18553 - protein, 9 aa, Homo sapiens
  light chain complementarity determining region 3 for antibody 9277
PKYNNVPWT

SEQ ID NO: 18554 - protein, 10 aa, Homo sapiens
  heavy chain complementarity determining region 3 for antibody 9277
ARERSGSYDI

SEQ ID NO: 18555 - protein, 9 aa, Homo sapiens
  light chain complementarity determining region 3 for antibody 9278
PKYGDSPVP

SEQ ID NO: 18556 - protein, 18 aa, Homo sapiens
  heavy chain complementarity determining region 3 for antibody 9278
ARGDYPEGRTGYFLDFDY

SEQ ID NO: 18557 - protein, 9 aa, Homo sapiens
  light chain complementarity determining region 3 for antibody 9279
PHYYSAPLT

SEQ ID NO: 18558 - protein, 14 aa, Homo sapiens
  heavy chain complementarity determining region 3 for antibody 9279
ARPTSGPGSFLIDS

SEQ ID NO: 18559 - protein, 9 aa, Homo sapiens
  light chain complementarity determining region 3 for antibody 9280
PHYYNWPRT

SEQ ID NO: 18560 - protein, 14 aa, Homo sapiens
  heavy chain complementarity determining region 3 for antibody 9280
AFQEYSGWSLVLDY

SEQ ID NO: 18561 - protein, 7 aa, Homo sapiens
  light chain complementarity determining region 3 for antibody 9281
PHYNSWA

SEQ ID NO: 18562 - protein, 11 aa, Homo sapiens
  heavy chain complementarity determining region 3 for antibody 9281
ARETPVAVGGD

SEQ ID NO: 18563 - protein, 10 aa, Homo sapiens
  light chain complementarity determining region 3 for antibody 9282
PHYGSSPRGT

SEQ ID NO: 18564 - protein, 17 aa, Homo sapiens
  heavy chain complementarity determining region 3 for antibody 9282
ARPRDEYEFWSGYFFDY

SEQ ID NO: 18565 - protein, 9 aa, Homo sapiens
  light chain complementarity determining region 3 for antibody 9283
PHFNNYLVT

SEQ ID NO: 18566 - protein, 25 aa, Homo sapiens
  heavy chain complementarity determining region 3 for antibody 9283
AREICHTAACYEILWFGQTPYYFDS

SEQ ID NO: 18567 - protein, 9 aa, Homo sapiens
  light chain complementarity determining region 3 for antibody 9284
PERSTWPGS

SEQ ID NO: 18568 - protein, 13 aa, Homo sapiens
  heavy chain complementarity determining region 3 for antibody 9284
ATGAWGSSWWGDY

SEQ ID NO: 18569 - protein, 9 aa, Homo sapiens
  light chain complementarity determining region 3 for antibody 9285
PERSNWPGS

SEQ ID NO: 18570 - protein, 14 aa, Homo sapiens
  heavy chain complementarity determining region 3 for antibody 9285
ANYRASIGARCFDP

SEQ ID NO: 18571 - protein, 7 aa, Homo sapiens
  light chain complementarity determining region 3 for antibody 9286
PCRDCWV

SEQ ID NO: 18572 - protein, 20 aa, Homo sapiens
  heavy chain complementarity determining region 3 for antibody 9286
ATYLPGDCSCTGCYYWYFNF

SEQ ID NO: 18573 - protein, 9 aa, Homo sapiens
  light chain complementarity determining region 3 for antibody 9287
NQSANSPRT

SEQ ID NO: 18574 - protein, 13 aa, Homo sapiens
  heavy chain complementarity determining region 3 for antibody 9287
ARGATATSWNIDY

SEQ ID NO: 18575 - protein, 9 aa, Homo sapiens
  light chain complementarity determining region 3 for antibody 9288
MRYAHGPHT

SEQ ID NO: 18576 - protein, 8 aa, Homo sapiens
  heavy chain complementarity determining region 3 for antibody 9288
AGWGYGNY

SEQ ID NO: 18577 - protein, 9 aa, Homo sapiens
  light chain complementarity determining region 3 for antibody 9289
MRATHWPRT

SEQ ID NO: 18578 - protein, 12 aa, Homo sapiens
  heavy chain complementarity determining region 3 for antibody 9289
STDVETTFPSVS

SEQ ID NO: 18579 - protein, 9 aa, Homo sapiens
  light chain complementarity determining region 3 for antibody 9290
MQYTYWPHT

SEQ ID NO: 18580 - protein, 8 aa, Homo sapiens
  heavy chain complementarity determining region 3 for antibody 9290
AGWSDASY

SEQ ID NO: 18581 - protein, 9 aa, Homo sapiens
  light chain complementarity determining region 3 for antibody 9291
MQYTYRPHT

SEQ ID NO: 18582 - protein, 8 aa, Homo sapiens
  heavy chain complementarity determining region 3 for antibody 9291
AGWGYANY

SEQ ID NO: 18583 - protein, 9 aa, Homo sapiens
  light chain complementarity determining region 3 for antibody 9292
MQYTPRPHT

SEQ ID NO: 18584 - protein, 8 aa, Homo sapiens
  heavy chain complementarity determining region 3 for antibody 9292
AGWGYANY

SEQ ID NO: 18585 - protein, 9 aa, Homo sapiens
  light chain complementarity determining region 3 for antibody 9293
MQYTHWPQT

SEQ ID NO: 18586 - protein, 8 aa, Homo sapiens
  heavy chain complementarity determining region 3 for antibody 9293
AGWNNANY

SEQ ID NO: 18587 - protein, 9 aa, Homo sapiens
  light chain complementarity determining region 3 for antibody 9294
MQYTHWPPT

SEQ ID NO: 18588 - protein, 8 aa, Homo sapiens
  heavy chain complementarity determining region 3 for antibody 9294
AGWNNANY

SEQ ID NO: 18589 - protein, 9 aa, Homo sapiens
  light chain complementarity determining region 3 for antibody 9295
MQYTHWPPT

SEQ ID NO: 18590 - protein, 8 aa, Homo sapiens
  heavy chain complementarity determining region 3 for antibody 9295
AGWNDANY

SEQ ID NO: 18591 - protein, 9 aa, Homo sapiens
  light chain complementarity determining region 3 for antibody 9296
MQYTHWPHT

SEQ ID NO: 18592 - protein, 12 aa, Homo sapiens
  heavy chain complementarity determining region 3 for antibody 9296
ARLDWNYRAFDI

SEQ ID NO: 18593 - protein, 9 aa, Homo sapiens
  light chain complementarity determining region 3 for antibody 9297
MQYTHWPHT

SEQ ID NO: 18594 - protein, 8 aa, Homo sapiens
  heavy chain complementarity determining region 3 for antibody 9297
AGWSDANY

SEQ ID NO: 18595 - protein, 9 aa, Homo sapiens
  light chain complementarity determining region 3 for antibody 9298
MQYTHWPHT

SEQ ID NO: 18596 - protein, 8 aa, Homo sapiens
  heavy chain complementarity determining region 3 for antibody 9298
AGWNGANY

SEQ ID NO: 18597 - protein, 9 aa, Homo sapiens
  light chain complementarity determining region 3 for antibody 9299
MQYTHRPQT

SEQ ID NO: 18598 - protein, 8 aa, Homo sapiens
  heavy chain complementarity determining region 3 for antibody 9299
AGWGYANY

SEQ ID NO: 18599 - protein, 9 aa, Homo sapiens
  light chain complementarity determining region 3 for antibody 9300
MQYTHRPHT

SEQ ID NO: 18600 - protein, 13 aa, Homo sapiens
  heavy chain complementarity determining region 3 for antibody 9300
TWISSATYLFLHS

SEQ ID NO: 18601 - protein, 9 aa, Homo sapiens
  light chain complementarity determining region 3 for antibody 9301
MQYTHRPHT

SEQ ID NO: 18602 - protein, 13 aa, Homo sapiens
  heavy chain complementarity determining region 3 for antibody 9301
TKEGSSAGPDFVY

SEQ ID NO: 18603 - protein, 9 aa, Homo sapiens
  light chain complementarity determining region 3 for antibody 9302
MQYTHRPHT

SEQ ID NO: 18604 - protein, 12 aa, Homo sapiens
  heavy chain complementarity determining region 3 for antibody 9302
NADHGYVDGFDI

SEQ ID NO: 18605 - protein, 9 aa, Homo sapiens
  light chain complementarity determining region 3 for antibody 9303
MQYTHRPHT

SEQ ID NO: 18606 - protein, 16 aa, Homo sapiens
  heavy chain complementarity determining region 3 for antibody 9303
GRQVISATKWPNRLDY

SEQ ID NO: 18607 - protein, 9 aa, Homo sapiens
  light chain complementarity determining region 3 for antibody 9304
MQYTHRPHT

SEQ ID NO: 18608 - protein, 17 aa, Homo sapiens
  heavy chain complementarity determining region 3 for antibody 9304
ARNTMVGTWQRQGNLDH

SEQ ID NO: 18609 - protein, 9 aa, Homo sapiens
  light chain complementarity determining region 3 for antibody 9305
MQYTHRPHT

SEQ ID NO: 18610 - protein, 11 aa, Homo sapiens
  heavy chain complementarity determining region 3 for antibody 9305
AREQHGQAPDY

SEQ ID NO: 18611 - protein, 9 aa, Homo sapiens
  light chain complementarity determining region 3 for antibody 9306
MQYTHRPHT

SEQ ID NO: 18612 - protein, 12 aa, Homo sapiens
  heavy chain complementarity determining region 3 for antibody 9306
ARDKGGRNGMDV

SEQ ID NO: 18613 - protein, 9 aa, Homo sapiens
  light chain complementarity determining region 3 for antibody 9307
MQYTHRPHT

SEQ ID NO: 18614 - protein, 8 aa, Homo sapiens
  heavy chain complementarity determining region 3 for antibody 9307
AGWGYVNY

SEQ ID NO: 18615 - protein, 9 aa, Homo sapiens
  light chain complementarity determining region 3 for antibody 9308
MQYTHRPHT

SEQ ID NO: 18616 - protein, 8 aa, Homo sapiens
  heavy chain complementarity determining region 3 for antibody 9308
AGWGYGSY

SEQ ID NO: 18617 - protein, 9 aa, Homo sapiens
  light chain complementarity determining region 3 for antibody 9309
MQYTHRPHT

SEQ ID NO: 18618 - protein, 8 aa, Homo sapiens
  heavy chain complementarity determining region 3 for antibody 9309
AGWGYANS

SEQ ID NO: 18619 - protein, 9 aa, Homo sapiens
  light chain complementarity determining region 3 for antibody 9310
MQYTHRPHT

SEQ ID NO: 18620 - protein, 8 aa, Homo sapiens
  heavy chain complementarity determining region 3 for antibody 9310
AGWGYANC

SEQ ID NO: 18621 - protein, 9 aa, Homo sapiens
  light chain complementarity determining region 3 for antibody 9311
MQYTHRPHT

SEQ ID NO: 18622 - protein, 8 aa, Homo sapiens
  heavy chain complementarity determining region 3 for antibody 9311
AGWCYANY

SEQ ID NO: 18623 - protein, 9 aa, Homo sapiens
  light chain complementarity determining region 3 for antibody 9312
MQYTHCPHT

SEQ ID NO: 18624 - protein, 8 aa, Homo sapiens
  heavy chain complementarity determining region 3 for antibody 9312
AGWSYANY

SEQ ID NO: 18625 - protein, 9 aa, Homo sapiens
  light chain complementarity determining region 3 for antibody 9313
MQYKHWPHT

SEQ ID NO: 18626 - protein, 8 aa, Homo sapiens
  heavy chain complementarity determining region 3 for antibody 9313
AGWNDANY

SEQ ID NO: 18627 - protein, 9 aa, Homo sapiens
  light chain complementarity determining region 3 for antibody 9314
MQYIHRPHT

SEQ ID NO: 18628 - protein, 8 aa, Homo sapiens
  heavy chain complementarity determining region 3 for antibody 9314
AGWGYANY

SEQ ID NO: 18629 - protein, 9 aa, Homo sapiens
  light chain complementarity determining region 3 for antibody 9315
MQYAPGPHT

SEQ ID NO: 18630 - protein, 8 aa, Homo sapiens
  heavy chain complementarity determining region 3 for antibody 9315
AGWGYGNY

SEQ ID NO: 18631 - protein, 9 aa, Homo sapiens
  light chain complementarity determining region 3 for antibody 9316
MQYAHWPHT

SEQ ID NO: 18632 - protein, 12 aa, Homo sapiens
  heavy chain complementarity determining region 3 for antibody 9316
ARLDWNYRAFDI

SEQ ID NO: 18633 - protein, 9 aa, Homo sapiens
  light chain complementarity determining region 3 for antibody 9317
MQYAHGPQT

SEQ ID NO: 18634 - protein, 8 aa, Homo sapiens
  heavy chain complementarity determining region 3 for antibody 9317
AGWGYGNY

SEQ ID NO: 18635 - protein, 9 aa, Homo sapiens
  light chain complementarity determining region 3 for antibody 9318
MQYAHGPHT

SEQ ID NO: 18636 - protein, 8 aa, Homo sapiens
  heavy chain complementarity determining region 3 for antibody 9318
TGWGYGNY

SEQ ID NO: 18637 - protein, 9 aa, Homo sapiens
  light chain complementarity determining region 3 for antibody 9319
MQYAHGPHT

SEQ ID NO: 18638 - protein, 15 aa, Homo sapiens
  heavy chain complementarity determining region 3 for antibody 9319
ARVGRPYHNAWYFDN

SEQ ID NO: 18639 - protein, 9 aa, Homo sapiens
  light chain complementarity determining region 3 for antibody 9320
MQYAHGPHT

SEQ ID NO: 18640 - protein, 12 aa, Homo sapiens
  heavy chain complementarity determining region 3 for antibody 9320
ARDKGGRNGMDV

SEQ ID NO: 18641 - protein, 9 aa, Homo sapiens
  light chain complementarity determining region 3 for antibody 9321
MQYAHGPHT

SEQ ID NO: 18642 - protein, 12 aa, Homo sapiens
  heavy chain complementarity determining region 3 for antibody 9321
AIVVPGRWDLDD

SEQ ID NO: 18643 - protein, 9 aa, Homo sapiens
  light chain complementarity determining region 3 for antibody 9322
MQYAHGPHT

SEQ ID NO: 18644 - protein, 8 aa, Homo sapiens
  heavy chain complementarity determining region 3 for antibody 9322
AGWGYGNF

SEQ ID NO: 18645 - protein, 9 aa, Homo sapiens
  light chain complementarity determining region 3 for antibody 9323
MQYAHGPHT

SEQ ID NO: 18646 - protein, 9 aa, Homo sapiens
  heavy chain complementarity determining region 3 for antibody 9323
AGWGGLSNY

SEQ ID NO: 18647 - protein, 9 aa, Homo sapiens
  light chain complementarity determining region 3 for antibody 9324
MQYAHGPHT

SEQ ID NO: 18648 - protein, 8 aa, Homo sapiens
  heavy chain complementarity determining region 3 for antibody 9324
AGWGDGNY

SEQ ID NO: 18649 - protein, 9 aa, Homo sapiens
  light chain complementarity determining region 3 for antibody 9325
MQYAHGPHT

SEQ ID NO: 18650 - protein, 8 aa, Homo sapiens
  heavy chain complementarity determining region 3 for antibody 9325
AGWGCGNY

SEQ ID NO: 18651 - protein, 9 aa, Homo sapiens
  light chain complementarity determining region 3 for antibody 9326
MQVTHWPRT

SEQ ID NO: 18652 - protein, 10 aa, Homo sapiens
  heavy chain complementarity determining region 3 for antibody 9326
VRDYWNSIDY

SEQ ID NO: 18653 - protein, 9 aa, Homo sapiens
  light chain complementarity determining region 3 for antibody 9327
MQVTHWPRT

SEQ ID NO: 18654 - protein, 13 aa, Homo sapiens
  heavy chain complementarity determining region 3 for antibody 9327
TKEGSAAGPDFVY

SEQ ID NO: 18655 - protein, 9 aa, Homo sapiens
  light chain complementarity determining region 3 for antibody 9328
MQVTHWPRT

SEQ ID NO: 18656 - protein, 16 aa, Homo sapiens
  heavy chain complementarity determining region 3 for antibody 9328
TAGVGDHRDRYVTLDH

SEQ ID NO: 18657 - protein, 9 aa, Homo sapiens
  light chain complementarity determining region 3 for antibody 9329
MQVTHWPRT

SEQ ID NO: 18658 - protein, 16 aa, Homo sapiens
  heavy chain complementarity determining region 3 for antibody 9329
TADVGDHRDRYVTLNH

SEQ ID NO: 18659 - protein, 9 aa, Homo sapiens
  light chain complementarity determining region 3 for antibody 9330
MQVTHWPRT

SEQ ID NO: 18660 - protein, 13 aa, Homo sapiens
  heavy chain complementarity determining region 3 for antibody 9330
AKEGSSPGPDFDY

SEQ ID NO: 18661 - protein, 9 aa, Homo sapiens
  light chain complementarity determining region 3 for antibody 9331
MQVTHWPRT

SEQ ID NO: 18662 - protein, 16 aa, Homo sapiens
  heavy chain complementarity determining region 3 for antibody 9331
AADVGDHRDRYVTLDH

SEQ ID NO: 18663 - protein, 9 aa, Homo sapiens
  light chain complementarity determining region 3 for antibody 9332
MQVTHWPRK

SEQ ID NO: 18664 - protein, 12 aa, Homo sapiens
  heavy chain complementarity determining region 3 for antibody 9332
AIVVPGRWDLDD

SEQ ID NO: 18665 - protein, 9 aa, Homo sapiens
  light chain complementarity determining region 3 for antibody 9333
MQVTHWPPS

SEQ ID NO: 18666 - protein, 13 aa, Homo sapiens
  heavy chain complementarity determining region 3 for antibody 9333
ARDTVTNKMGSDY

SEQ ID NO: 18667 - protein, 9 aa, Homo sapiens
  light chain complementarity determining region 3 for antibody 9334
MQTVQTPWT

SEQ ID NO: 18668 - protein, 12 aa, Homo sapiens
  heavy chain complementarity determining region 3 for antibody 9334
ARWDWNYRAFDI

SEQ ID NO: 18669 - protein, 9 aa, Homo sapiens
  light chain complementarity determining region 3 for antibody 9335
MQTVQTPWT

SEQ ID NO: 18670 - protein, 12 aa, Homo sapiens
  heavy chain complementarity determining region 3 for antibody 9335
ARLEWNYRAFDI

SEQ ID NO: 18671 - protein, 9 aa, Homo sapiens
  light chain complementarity determining region 3 for antibody 9336
MQTVQTPWT

SEQ ID NO: 18672 - protein, 12 aa, Homo sapiens
  heavy chain complementarity determining region 3 for antibody 9336
ARLDWNYRTFDI

SEQ ID NO: 18673 - protein, 9 aa, Homo sapiens
  light chain complementarity determining region 3 for antibody 9337
MQTVQTPWT

SEQ ID NO: 18674 - protein, 12 aa, Homo sapiens
  heavy chain complementarity determining region 3 for antibody 9337
ARLDWNYRDFDI

SEQ ID NO: 18675 - protein, 9 aa, Homo sapiens
  light chain complementarity determining region 3 for antibody 9338
MQTVQTPWT

SEQ ID NO: 18676 - protein, 12 aa, Homo sapiens
  heavy chain complementarity determining region 3 for antibody 9338
ARLDWNYRAFDL

SEQ ID NO: 18677 - protein, 9 aa, Homo sapiens
  light chain complementarity determining region 3 for antibody 9339
MQTVQTPWT

SEQ ID NO: 18678 - protein, 12 aa, Homo sapiens
  heavy chain complementarity determining region 3 for antibody 9339
ARLDWNYGAFDI

SEQ ID NO: 18679 - protein, 9 aa, Homo sapiens
  light chain complementarity determining region 3 for antibody 9340
MQTVQTPWT

SEQ ID NO: 18680 - protein, 12 aa, Homo sapiens
  heavy chain complementarity determining region 3 for antibody 9340
ARLDWDYRAFDI

SEQ ID NO: 18681 - protein, 9 aa, Homo sapiens
  light chain complementarity determining region 3 for antibody 9341
MQTVQTPWT

SEQ ID NO: 18682 - protein, 12 aa, Homo sapiens
  heavy chain complementarity determining region 3 for antibody 9341
AIVVPGRWDLDD

SEQ ID NO: 18683 - protein, 9 aa, Homo sapiens
  light chain complementarity determining region 3 for antibody 9342
MQTVQTPWM

SEQ ID NO: 18684 - protein, 12 aa, Homo sapiens
  heavy chain complementarity determining region 3 for antibody 9342
ARLDWNYRAFDI

SEQ ID NO: 18685 - protein, 9 aa, Homo sapiens
  light chain complementarity determining region 3 for antibody 9343
MQTVQTPWA

SEQ ID NO: 18686 - protein, 12 aa, Homo sapiens
  heavy chain complementarity determining region 3 for antibody 9343
ARLDWNYRAFDI

SEQ ID NO: 18687 - protein, 9 aa, Homo sapiens
  light chain complementarity determining region 3 for antibody 9344
MQTVQSPGT

SEQ ID NO: 18688 - protein, 12 aa, Homo sapiens
  heavy chain complementarity determining region 3 for antibody 9344
ARLDWNYRAFDI

SEQ ID NO: 18689 - protein, 9 aa, Homo sapiens
  light chain complementarity determining region 3 for antibody 9345
MQTVQPPGT

SEQ ID NO: 18690 - protein, 12 aa, Homo sapiens
  heavy chain complementarity determining region 3 for antibody 9345
ARLDWNYRAFDI

SEQ ID NO: 18691 - protein, 9 aa, Homo sapiens
  light chain complementarity determining region 3 for antibody 9346
MQTVPTPWT

SEQ ID NO: 18692 - protein, 12 aa, Homo sapiens
  heavy chain complementarity determining region 3 for antibody 9346
ARLDWNYRAFDI

SEQ ID NO: 18693 - protein, 9 aa, Homo sapiens
  light chain complementarity determining region 3 for antibody 9347
MQTVKTPGT

SEQ ID NO: 18694 - protein, 12 aa, Homo sapiens
  heavy chain complementarity determining region 3 for antibody 9347
ARLDWNYRAFDI

SEQ ID NO: 18695 - protein, 9 aa, Homo sapiens
  light chain complementarity determining region 3 for antibody 9348
MQTTHWPRT

SEQ ID NO: 18696 - protein, 9 aa, Homo sapiens
  heavy chain complementarity determining region 3 for antibody 9348
AKGVCSFDY

SEQ ID NO: 18697 - protein, 9 aa, Homo sapiens
  light chain complementarity determining region 3 for antibody 9349
MQTTHWPRR

SEQ ID NO: 18698 - protein, 9 aa, Homo sapiens
  heavy chain complementarity determining region 3 for antibody 9349
AKGVFSFDY

SEQ ID NO: 18699 - protein, 9 aa, Homo sapiens
  light chain complementarity determining region 3 for antibody 9350
MQTPQTPGT

SEQ ID NO: 18700 - protein, 12 aa, Homo sapiens
  heavy chain complementarity determining region 3 for antibody 9350
ARLDWNYRAFDI

SEQ ID NO: 18701 - protein, 9 aa, Homo sapiens
  light chain complementarity determining region 3 for antibody 9351
MQTLQTSWT

SEQ ID NO: 18702 - protein, 12 aa, Homo sapiens
  heavy chain complementarity determining region 3 for antibody 9351
ARLDWNYRAFDI

SEQ ID NO: 18703 - protein, 9 aa, Homo sapiens
  light chain complementarity determining region 3 for antibody 9352
MQTLQTPYT

SEQ ID NO: 18704 - protein, 15 aa, Homo sapiens
  heavy chain complementarity determining region 3 for antibody 9352
ARERRMFGELRGFDV

SEQ ID NO: 18705 - protein, 9 aa, Homo sapiens
  light chain complementarity determining region 3 for antibody 9353
MQTLQTPWT

SEQ ID NO: 18706 - protein, 6 aa, Homo sapiens
  heavy chain complementarity determining region 3 for antibody 9353
VSRWFR

SEQ ID NO: 18707 - protein, 9 aa, Homo sapiens
  light chain complementarity determining region 3 for antibody 9354
MQTLQTPWT

SEQ ID NO: 18708 - protein, 10 aa, Homo sapiens
  heavy chain complementarity determining region 3 for antibody 9354
VRDYWNSIDY

SEQ ID NO: 18709 - protein, 9 aa, Homo sapiens
  light chain complementarity determining region 3 for antibody 9355
MQTLQTPWT

SEQ ID NO: 18710 - protein, 9 aa, Homo sapiens
  heavy chain complementarity determining region 3 for antibody 9355
GSRRPYFDS

SEQ ID NO: 18711 - protein, 9 aa, Homo sapiens
  light chain complementarity determining region 3 for antibody 9356
MQTLQTPWT

SEQ ID NO: 18712 - protein, 12 aa, Homo sapiens
  heavy chain complementarity determining region 3 for antibody 9356
GRLDWNYRAFDI

SEQ ID NO: 18713 - protein, 9 aa, Homo sapiens
  light chain complementarity determining region 3 for antibody 9357
MQTLQTPWT

SEQ ID NO: 18714 - protein, 15 aa, Homo sapiens
  heavy chain complementarity determining region 3 for antibody 9357
GKEGPGSSGWLTGHY

SEQ ID NO: 18715 - protein, 9 aa, Homo sapiens
  light chain complementarity determining region 3 for antibody 9358
MQTLQTPWT

SEQ ID NO: 18716 - protein, 14 aa, Homo sapiens
  heavy chain complementarity determining region 3 for antibody 9358
CRGWLDPATPHYDF

SEQ ID NO: 18717 - protein, 9 aa, Homo sapiens
  light chain complementarity determining region 3 for antibody 9359
MQTLQTPWT

SEQ ID NO: 18718 - protein, 13 aa, Homo sapiens
  heavy chain complementarity determining region 3 for antibody 9359
ATGAWGSSWWGDY

SEQ ID NO: 18719 - protein, 9 aa, Homo sapiens
  light chain complementarity determining region 3 for antibody 9360
MQTLQTPWT

SEQ ID NO: 18720 - protein, 12 aa, Homo sapiens
  heavy chain complementarity determining region 3 for antibody 9360
ASLDWNYRAFDI

SEQ ID NO: 18721 - protein, 9 aa, Homo sapiens
  light chain complementarity determining region 3 for antibody 9361
MQTLQTPWT

SEQ ID NO: 18722 - protein, 12 aa, Homo sapiens
  heavy chain complementarity determining region 3 for antibody 9361
ARWEWNYRAFDI

SEQ ID NO: 18723 - protein, 9 aa, Homo sapiens
  light chain complementarity determining region 3 for antibody 9362
MQTLQTPWT

SEQ ID NO: 18724 - protein, 12 aa, Homo sapiens
  heavy chain complementarity determining region 3 for antibody 9362
ARSDWNYRAFDI

SEQ ID NO: 18725 - protein, 9 aa, Homo sapiens
  light chain complementarity determining region 3 for antibody 9363
MQTLQTPWT

SEQ ID NO: 18726 - protein, 12 aa, Homo sapiens
  heavy chain complementarity determining region 3 for antibody 9363
ARLNWNYRAFDI

SEQ ID NO: 18727 - protein, 9 aa, Homo sapiens
  light chain complementarity determining region 3 for antibody 9364
MQTLQTPWT

SEQ ID NO: 18728 - protein, 14 aa, Homo sapiens
  heavy chain complementarity determining region 3 for antibody 9364
ARLHGSGLGRWLDP

SEQ ID NO: 18729 - protein, 9 aa, Homo sapiens
  light chain complementarity determining region 3 for antibody 9365
MQTLQTPWT

SEQ ID NO: 18730 - protein, 12 aa, Homo sapiens
  heavy chain complementarity determining region 3 for antibody 9365
ARLGWNYRAFHI

SEQ ID NO: 18731 - protein, 9 aa, Homo sapiens
  light chain complementarity determining region 3 for antibody 9366
MQTLQTPWT

SEQ ID NO: 18732 - protein, 12 aa, Homo sapiens
  heavy chain complementarity determining region 3 for antibody 9366
ARLDWSYRALDI

SEQ ID NO: 18733 - protein, 9 aa, Homo sapiens
  light chain complementarity determining region 3 for antibody 9367
MQTLQTPWT

SEQ ID NO: 18734 - protein, 12 aa, Homo sapiens
  heavy chain complementarity determining region 3 for antibody 9367
ARLDWNYRPFDI

SEQ ID NO: 18735 - protein, 9 aa, Homo sapiens
  light chain complementarity determining region 3 for antibody 9368
MQTLQTPWT

SEQ ID NO: 18736 - protein, 12 aa, Homo sapiens
  heavy chain complementarity determining region 3 for antibody 9368
ARLDWNYRGFDI

SEQ ID NO: 18737 - protein, 9 aa, Homo sapiens
  light chain complementarity determining region 3 for antibody 9369
MQTLQTPWT

SEQ ID NO: 18738 - protein, 12 aa, Homo sapiens
  heavy chain complementarity determining region 3 for antibody 9369
ARLDWNYRAFDF

SEQ ID NO: 18739 - protein, 9 aa, Homo sapiens
  light chain complementarity determining region 3 for antibody 9370
MQTLQTPWT

SEQ ID NO: 18740 - protein, 12 aa, Homo sapiens
  heavy chain complementarity determining region 3 for antibody 9370
ARLDWNYKAFDI

SEQ ID NO: 18741 - protein, 9 aa, Homo sapiens
  light chain complementarity determining region 3 for antibody 9371
MQTLQTPWT

SEQ ID NO: 18742 - protein, 23 aa, Homo sapiens
  heavy chain complementarity determining region 3 for antibody 9371
ARHFPKGGSGVTGTQSLIYYMDV

SEQ ID NO: 18743 - protein, 9 aa, Homo sapiens
  light chain complementarity determining region 3 for antibody 9372
MQTLQTPWT

SEQ ID NO: 18744 - protein, 17 aa, Homo sapiens
  heavy chain complementarity determining region 3 for antibody 9372
ARGTGIGSGSYYADFDY

SEQ ID NO: 18745 - protein, 9 aa, Homo sapiens
  light chain complementarity determining region 3 for antibody 9373
MQTLQTPWT

SEQ ID NO: 18746 - protein, 9 aa, Homo sapiens
  heavy chain complementarity determining region 3 for antibody 9373
ARGRSNFRH

SEQ ID NO: 18747 - protein, 9 aa, Homo sapiens
  light chain complementarity determining region 3 for antibody 9374
MQTLQTPWT

SEQ ID NO: 18748 - protein, 16 aa, Homo sapiens
  heavy chain complementarity determining region 3 for antibody 9374
ARGHTNPGERRGGSDF

SEQ ID NO: 18749 - protein, 9 aa, Homo sapiens
  light chain complementarity determining region 3 for antibody 9375
MQTLQTPWT

SEQ ID NO: 18750 - protein, 14 aa, Homo sapiens
  heavy chain complementarity determining region 3 for antibody 9375
ARGHFDSTGFRLDY

SEQ ID NO: 18751 - protein, 9 aa, Homo sapiens
  light chain complementarity determining region 3 for antibody 9376
MQTLQTPWT

SEQ ID NO: 18752 - protein, 10 aa, Homo sapiens
  heavy chain complementarity determining region 3 for antibody 9376
ARETSGSYDI

SEQ ID NO: 18753 - protein, 9 aa, Homo sapiens
  light chain complementarity determining region 3 for antibody 9377
MQTLQTPWT

SEQ ID NO: 18754 - protein, 10 aa, Homo sapiens
  heavy chain complementarity determining region 3 for antibody 9377
ARETSGAYDI

SEQ ID NO: 18755 - protein, 9 aa, Homo sapiens
  light chain complementarity determining region 3 for antibody 9378
MQTLQTPWT

SEQ ID NO: 18756 - protein, 19 aa, Homo sapiens
  heavy chain complementarity determining region 3 for antibody 9378
ARERVRCRSGICYDATFDI

SEQ ID NO: 18757 - protein, 9 aa, Homo sapiens
  light chain complementarity determining region 3 for antibody 9379
MQTLQTPWT

SEQ ID NO: 18758 - protein, 10 aa, Homo sapiens
  heavy chain complementarity determining region 3 for antibody 9379
ARERSGSYDI

SEQ ID NO: 18759 - protein, 9 aa, Homo sapiens
  light chain complementarity determining region 3 for antibody 9380
MQTLQTPWT

SEQ ID NO: 18760 - protein, 9 aa, Homo sapiens
  heavy chain complementarity determining region 3 for antibody 9380
ARDSHSFSY

SEQ ID NO: 18761 - protein, 9 aa, Homo sapiens
  light chain complementarity determining region 3 for antibody 9381
MQTLQTPWT

SEQ ID NO: 18762 - protein, 11 aa, Homo sapiens
  heavy chain complementarity determining region 3 for antibody 9381
ARDFDGAGYDY

SEQ ID NO: 18763 - protein, 9 aa, Homo sapiens
  light chain complementarity determining region 3 for antibody 9382
MQTLQTPWT

SEQ ID NO: 18764 - protein, 12 aa, Homo sapiens
  heavy chain complementarity determining region 3 for antibody 9382
AMLDWNYRAFDI

SEQ ID NO: 18765 - protein, 9 aa, Homo sapiens
  light chain complementarity determining region 3 for antibody 9383
MQTLQTPWT

SEQ ID NO: 18766 - protein, 12 aa, Homo sapiens
  heavy chain complementarity determining region 3 for antibody 9383
AKLDWNYRAFDI

SEQ ID NO: 18767 - protein, 9 aa, Homo sapiens
  light chain complementarity determining region 3 for antibody 9384
MQTLQTPWT

SEQ ID NO: 18768 - protein, 10 aa, Homo sapiens
  heavy chain complementarity determining region 3 for antibody 9384
AKDLSGGGGY

SEQ ID NO: 18769 - protein, 9 aa, Homo sapiens
  light chain complementarity determining region 3 for antibody 9385
MQTLQTPWT

SEQ ID NO: 18770 - protein, 9 aa, Homo sapiens
  heavy chain complementarity determining region 3 for antibody 9385
AGWGGLSNY

SEQ ID NO: 18771 - protein, 9 aa, Homo sapiens
  light chain complementarity determining region 3 for antibody 9386
MQTLQTPWS

SEQ ID NO: 18772 - protein, 12 aa, Homo sapiens
  heavy chain complementarity determining region 3 for antibody 9386
ARLDWNYRAFDI

SEQ ID NO: 18773 - protein, 9 aa, Homo sapiens
  light chain complementarity determining region 3 for antibody 9387
MQTLQTPWP

SEQ ID NO: 18774 - protein, 13 aa, Homo sapiens
  heavy chain complementarity determining region 3 for antibody 9387
AKEGSAPGPDFEY

SEQ ID NO: 18775 - protein, 9 aa, Homo sapiens
  light chain complementarity determining region 3 for antibody 9388
MQTLQTPVT

SEQ ID NO: 18776 - protein, 15 aa, Homo sapiens
  heavy chain complementarity determining region 3 for antibody 9388
ARIWTSSPNCRYMDV

SEQ ID NO: 18777 - protein, 9 aa, Homo sapiens
  light chain complementarity determining region 3 for antibody 9389
MQTLQTPVT

SEQ ID NO: 18778 - protein, 15 aa, Homo sapiens
  heavy chain complementarity determining region 3 for antibody 9389
ARIGTSSTNCRYMDV

SEQ ID NO: 18779 - protein, 9 aa, Homo sapiens
  light chain complementarity determining region 3 for antibody 9390
MQTLQTPRR

SEQ ID NO: 18780 - protein, 12 aa, Homo sapiens
  heavy chain complementarity determining region 3 for antibody 9390
ARLDWNYRAFDI

SEQ ID NO: 18781 - protein, 9 aa, Homo sapiens
  light chain complementarity determining region 3 for antibody 9391
MQTLQTPGT

SEQ ID NO: 18782 - protein, 11 aa, Homo sapiens
  heavy chain complementarity determining region 3 for antibody 9391
VRVSTGWNFDY

SEQ ID NO: 18783 - protein, 9 aa, Homo sapiens
  light chain complementarity determining region 3 for antibody 9392
MQTLQTPGT

SEQ ID NO: 18784 - protein, 12 aa, Homo sapiens
  heavy chain complementarity determining region 3 for antibody 9392
ASLDWNYRAFDI

SEQ ID NO: 18785 - protein, 9 aa, Homo sapiens
  light chain complementarity determining region 3 for antibody 9393
MQTLQTPGT

SEQ ID NO: 18786 - protein, 12 aa, Homo sapiens
  heavy chain complementarity determining region 3 for antibody 9393
ARLDWNYRAFDT

SEQ ID NO: 18787 - protein, 9 aa, Homo sapiens
  light chain complementarity determining region 3 for antibody 9394
MQTLQTPGQ

SEQ ID NO: 18788 - protein, 12 aa, Homo sapiens
  heavy chain complementarity determining region 3 for antibody 9394
ARLDWNYRAFDI

SEQ ID NO: 18789 - protein, 8 aa, Homo sapiens
  light chain complementarity determining region 3 for antibody 9395
MQTLQTPA

SEQ ID NO: 18790 - protein, 18 aa, Homo sapiens
  heavy chain complementarity determining region 3 for antibody 9395
AKVEDRDSNGYHFDYFDD

SEQ ID NO: 18791 - protein, 9 aa, Homo sapiens
  light chain complementarity determining region 3 for antibody 9396
MQTLQSPGT

SEQ ID NO: 18792 - protein, 12 aa, Homo sapiens
  heavy chain complementarity determining region 3 for antibody 9396
ARLDWNYRAFDI

SEQ ID NO: 18793 - protein, 9 aa, Homo sapiens
  light chain complementarity determining region 3 for antibody 9397
MQTLQNTRT

SEQ ID NO: 18794 - protein, 17 aa, Homo sapiens
  heavy chain complementarity determining region 3 for antibody 9397
ARQLGWCTDWSCPGMDV

SEQ ID NO: 18795 - protein, 9 aa, Homo sapiens
  light chain complementarity determining region 3 for antibody 9398
MQTLQNPRT

SEQ ID NO: 18796 - protein, 12 aa, Homo sapiens
  heavy chain complementarity determining region 3 for antibody 9398
ARLDWNYRAFDI

SEQ ID NO: 18797 - protein, 9 aa, Homo sapiens
  light chain complementarity determining region 3 for antibody 9399
MQTLPTPRT

SEQ ID NO: 18798 - protein, 12 aa, Homo sapiens
  heavy chain complementarity determining region 3 for antibody 9399
ARLDWNYRAFDI

SEQ ID NO: 18799 - protein, 9 aa, Homo sapiens
  light chain complementarity determining region 3 for antibody 9400
MQTLLTPWT

SEQ ID NO: 18800 - protein, 12 aa, Homo sapiens
  heavy chain complementarity determining region 3 for antibody 9400
ARLDWNYRAFDI

SEQ ID NO: 18801 - protein, 9 aa, Homo sapiens
  light chain complementarity determining region 3 for antibody 9401
MQTLHTPWT

SEQ ID NO: 18802 - protein, 12 aa, Homo sapiens
  heavy chain complementarity determining region 3 for antibody 9401
TRLLWQLRGLDV

SEQ ID NO: 18803 - protein, 9 aa, Homo sapiens
  light chain complementarity determining region 3 for antibody 9402
MQTLHTPWT

SEQ ID NO: 18804 - protein, 12 aa, Homo sapiens
  heavy chain complementarity determining region 3 for antibody 9402
ARLLWQLRGPDV

SEQ ID NO: 18805 - protein, 9 aa, Homo sapiens
  light chain complementarity determining region 3 for antibody 9403
MQTLHTPGT

SEQ ID NO: 18806 - protein, 12 aa, Homo sapiens
  heavy chain complementarity determining region 3 for antibody 9403
ARLDWNYRAFDI

SEQ ID NO: 18807 - protein, 9 aa, Homo sapiens
  light chain complementarity determining region 3 for antibody 9404
MQTGQTPGT

SEQ ID NO: 18808 - protein, 12 aa, Homo sapiens
  heavy chain complementarity determining region 3 for antibody 9404
ARLDWNYRAFDI

SEQ ID NO: 18809 - protein, 9 aa, Homo sapiens
  light chain complementarity determining region 3 for antibody 9405
MQSTNWPNT

SEQ ID NO: 18810 - protein, 11 aa, Homo sapiens
  heavy chain complementarity determining region 3 for antibody 9405
ARGDGWYGLDF

SEQ ID NO: 18811 - protein, 6 aa, Homo sapiens
  light chain complementarity determining region 3 for antibody 9406
MQSTNW

SEQ ID NO: 18812 - protein, 11 aa, Homo sapiens
  heavy chain complementarity determining region 3 for antibody 9406
ATFGQQWRLAH

SEQ ID NO: 18813 - protein, 6 aa, Homo sapiens
  light chain complementarity determining region 3 for antibody 9407
MQSTNW

SEQ ID NO: 18814 - protein, 13 aa, Homo sapiens
  heavy chain complementarity determining region 3 for antibody 9407
ARPYGDYGWAFNI

SEQ ID NO: 18815 - protein, 6 aa, Homo sapiens
  light chain complementarity determining region 3 for antibody 9408
MQSTNW

SEQ ID NO: 18816 - protein, 17 aa, Homo sapiens
  heavy chain complementarity determining region 3 for antibody 9408
ARNTMVGTWQRQGNLDH

SEQ ID NO: 18817 - protein, 6 aa, Homo sapiens
  light chain complementarity determining region 3 for antibody 9409
MQSTNW

SEQ ID NO: 18818 - protein, 11 aa, Homo sapiens
  heavy chain complementarity determining region 3 for antibody 9409
ARIVARKPDDY

SEQ ID NO: 18819 - protein, 6 aa, Homo sapiens
  light chain complementarity determining region 3 for antibody 9410
MQSTNW

SEQ ID NO: 18820 - protein, 19 aa, Homo sapiens
  heavy chain complementarity determining region 3 for antibody 9410
ARERVRCWSGICYDATFDI

SEQ ID NO: 18821 - protein, 6 aa, Homo sapiens
  light chain complementarity determining region 3 for antibody 9411
MQSTNW

SEQ ID NO: 18822 - protein, 19 aa, Homo sapiens
  heavy chain complementarity determining region 3 for antibody 9411
ARERVRCRSGICYDATFDT

SEQ ID NO: 18823 - protein, 6 aa, Homo sapiens
  light chain complementarity determining region 3 for antibody 9412
MQSTNW

SEQ ID NO: 18824 - protein, 19 aa, Homo sapiens
  heavy chain complementarity determining region 3 for antibody 9412
ARERVHCRSGICYDATFDI

SEQ ID NO: 18825 - protein, 6 aa, Homo sapiens
  light chain complementarity determining region 3 for antibody 9413
MQSTNW

SEQ ID NO: 18826 - protein, 12 aa, Homo sapiens
  heavy chain complementarity determining region 3 for antibody 9413
ARDKGGRNGMDV

SEQ ID NO: 18827 - protein, 6 aa, Homo sapiens
  light chain complementarity determining region 3 for antibody 9414
MQSTNW

SEQ ID NO: 18828 - protein, 19 aa, Homo sapiens
  heavy chain complementarity determining region 3 for antibody 9414
AGERVRCRSGICYDATFDI

SEQ ID NO: 18829 - protein, 6 aa, Homo sapiens
  light chain complementarity determining region 3 for antibody 9415
MQSTNW

SEQ ID NO: 18830 - protein, 13 aa, Homo sapiens
  heavy chain complementarity determining region 3 for antibody 9415
AADGPYGSSAFDY

SEQ ID NO: 18831 - protein, 6 aa, Homo sapiens
  light chain complementarity determining region 3 for antibody 9416
MQSTNL

SEQ ID NO: 18832 - protein, 19 aa, Homo sapiens
  heavy chain complementarity determining region 3 for antibody 9416
ARERVRCRSGICYDATFDI

SEQ ID NO: 18833 - protein, 9 aa, Homo sapiens
  light chain complementarity determining region 3 for antibody 9417
MQSTHWPYT

SEQ ID NO: 18834 - protein, 14 aa, Homo sapiens
  heavy chain complementarity determining region 3 for antibody 9417
ARDSLFDWPASGDY

SEQ ID NO: 18835 - protein, 6 aa, Homo sapiens
  light chain complementarity determining region 3 for antibody 9418
MQSPNW

SEQ ID NO: 18836 - protein, 19 aa, Homo sapiens
  heavy chain complementarity determining region 3 for antibody 9418
ARERVRCRSGICYDATFDI

SEQ ID NO: 18837 - protein, 9 aa, Homo sapiens
  light chain complementarity determining region 3 for antibody 9419
MQSLQTPYT

SEQ ID NO: 18838 - protein, 10 aa, Homo sapiens
  heavy chain complementarity determining region 3 for antibody 9419
AKDLSGGGGY

SEQ ID NO: 18839 - protein, 9 aa, Homo sapiens
  light chain complementarity determining region 3 for antibody 9420
MQSLQTPWT

SEQ ID NO: 18840 - protein, 17 aa, Homo sapiens
  heavy chain complementarity determining region 3 for antibody 9420
ARAGIEGTTIRMAFFDY

SEQ ID NO: 18841 - protein, 9 aa, Homo sapiens
  light chain complementarity determining region 3 for antibody 9421
MQSLQTPPT

SEQ ID NO: 18842 - protein, 10 aa, Homo sapiens
  heavy chain complementarity determining region 3 for antibody 9421
ARERSGSYDI

SEQ ID NO: 18843 - protein, 9 aa, Homo sapiens
  light chain complementarity determining region 3 for antibody 9422
MQSLQTPGT

SEQ ID NO: 18844 - protein, 12 aa, Homo sapiens
  heavy chain complementarity determining region 3 for antibody 9422
ARLDWNYRAFDI

SEQ ID NO: 18845 - protein, 8 aa, Homo sapiens
  light chain complementarity determining region 3 for antibody 9423
MQSIHRPT

SEQ ID NO: 18846 - protein, 8 aa, Homo sapiens
  heavy chain complementarity determining region 3 for antibody 9423
VSQTLVVN

SEQ ID NO: 18847 - protein, 9 aa, Homo sapiens
  light chain complementarity determining region 3 for antibody 9424
MQPTHWPRT

SEQ ID NO: 18848 - protein, 9 aa, Homo sapiens
  heavy chain complementarity determining region 3 for antibody 9424
AKGVFSFDY

SEQ ID NO: 18849 - protein, 9 aa, Homo sapiens
  light chain complementarity determining region 3 for antibody 9425
MQPLQTPYT

SEQ ID NO: 18850 - protein, 17 aa, Homo sapiens
  heavy chain complementarity determining region 3 for antibody 9425
ARVDHLEPRDYSYGMDV

SEQ ID NO: 18851 - protein, 9 aa, Homo sapiens
  light chain complementarity determining region 3 for antibody 9426
MQNTHWPWR

SEQ ID NO: 18852 - protein, 16 aa, Homo sapiens
  heavy chain complementarity determining region 3 for antibody 9426
ARGHTFPGERRGGSDF

SEQ ID NO: 18853 - protein, 9 aa, Homo sapiens
  light chain complementarity determining region 3 for antibody 9427
MQNPHWPWT

SEQ ID NO: 18854 - protein, 16 aa, Homo sapiens
  heavy chain complementarity determining region 3 for antibody 9427
ARGHTFPGERRGGSDF

SEQ ID NO: 18855 - protein, 9 aa, Homo sapiens
  light chain complementarity determining region 3 for antibody 9428
MQNLHTPWT

SEQ ID NO: 18856 - protein, 12 aa, Homo sapiens
  heavy chain complementarity determining region 3 for antibody 9428
ARLLWQLRGLDV

SEQ ID NO: 18857 - protein, 9 aa, Homo sapiens
  light chain complementarity determining region 3 for antibody 9429
MQILQTPLT

SEQ ID NO: 18858 - protein, 10 aa, Homo sapiens
  heavy chain complementarity determining region 3 for antibody 9429
ARERSGSYDI

SEQ ID NO: 18859 - protein, 9 aa, Homo sapiens
  light chain complementarity determining region 3 for antibody 9430
MQILQTPGT

SEQ ID NO: 18860 - protein, 12 aa, Homo sapiens
  heavy chain complementarity determining region 3 for antibody 9430
ARLDWNYRAFDI

SEQ ID NO: 18861 - protein, 9 aa, Homo sapiens
  light chain complementarity determining region 3 for antibody 9431
MQHLQTPWT

SEQ ID NO: 18862 - protein, 12 aa, Homo sapiens
  heavy chain complementarity determining region 3 for antibody 9431
ARLDWNYRAFDI

SEQ ID NO: 18863 - protein, 9 aa, Homo sapiens
  light chain complementarity determining region 3 for antibody 9432
MQGVQSAGT

SEQ ID NO: 18864 - protein, 12 aa, Homo sapiens
  heavy chain complementarity determining region 3 for antibody 9432
ARQGLWLTRQEY

SEQ ID NO: 18865 - protein, 9 aa, Homo sapiens
  light chain complementarity determining region 3 for antibody 9433
MQGTYWPYT

SEQ ID NO: 18866 - protein, 11 aa, Homo sapiens
  heavy chain complementarity determining region 3 for antibody 9433
VREGWGSLLDY

SEQ ID NO: 18867 - protein, 9 aa, Homo sapiens
  light chain complementarity determining region 3 for antibody 9434
MQGTYWPYT

SEQ ID NO: 18868 - protein, 11 aa, Homo sapiens
  heavy chain complementarity determining region 3 for antibody 9434
AREGWGSLLDS

SEQ ID NO: 18869 - protein, 9 aa, Homo sapiens
  light chain complementarity determining region 3 for antibody 9435
MQGTYWPYT

SEQ ID NO: 18870 - protein, 11 aa, Homo sapiens
  heavy chain complementarity determining region 3 for antibody 9435
AREGCGSLLDY

SEQ ID NO: 18871 - protein, 9 aa, Homo sapiens
  light chain complementarity determining region 3 for antibody 9436
MQGTYWPYH

SEQ ID NO: 18872 - protein, 11 aa, Homo sapiens
  heavy chain complementarity determining region 3 for antibody 9436
AREGWGSLLDY

SEQ ID NO: 18873 - protein, 9 aa, Homo sapiens
  light chain complementarity determining region 3 for antibody 9437
MQGTYWPQT

SEQ ID NO: 18874 - protein, 11 aa, Homo sapiens
  heavy chain complementarity determining region 3 for antibody 9437
VSFGQQWGLAY

SEQ ID NO: 18875 - protein, 9 aa, Homo sapiens
  light chain complementarity determining region 3 for antibody 9438
MQGTYWPPT

SEQ ID NO: 18876 - protein, 11 aa, Homo sapiens
  heavy chain complementarity determining region 3 for antibody 9438
VSFGQQWGLAY

SEQ ID NO: 18877 - protein, 10 aa, Homo sapiens
  light chain complementarity determining region 3 for antibody 9439
MQGTYWPPNT

SEQ ID NO: 18878 - protein, 11 aa, Homo sapiens
  heavy chain complementarity determining region 3 for antibody 9439
AGGGAGIKIDS

SEQ ID NO: 18879 - protein, 10 aa, Homo sapiens
  light chain complementarity determining region 3 for antibody 9440
MQGTYWPPIT

SEQ ID NO: 18880 - protein, 11 aa, Homo sapiens
  heavy chain complementarity determining region 3 for antibody 9440
AWGGAGIKIDS

SEQ ID NO: 18881 - protein, 9 aa, Homo sapiens
  light chain complementarity determining region 3 for antibody 9441
MQGTYWPKT

SEQ ID NO: 18882 - protein, 11 aa, Homo sapiens
  heavy chain complementarity determining region 3 for antibody 9441
ARGDGWYGLDY

SEQ ID NO: 18883 - protein, 9 aa, Homo sapiens
  light chain complementarity determining region 3 for antibody 9442
MQGTYWPHT

SEQ ID NO: 18884 - protein, 11 aa, Homo sapiens
  heavy chain complementarity determining region 3 for antibody 9442
VSFGQQWGLAS

SEQ ID NO: 18885 - protein, 9 aa, Homo sapiens
  light chain complementarity determining region 3 for antibody 9443
MQGTYWPHT

SEQ ID NO: 18886 - protein, 11 aa, Homo sapiens
  heavy chain complementarity determining region 3 for antibody 9443
VSCGQQWGLAY

SEQ ID NO: 18887 - protein, 9 aa, Homo sapiens
  light chain complementarity determining region 3 for antibody 9444
MQGTYWPHT

SEQ ID NO: 18888 - protein, 11 aa, Homo sapiens
  heavy chain complementarity determining region 3 for antibody 9444
AREGWGSLLDY

SEQ ID NO: 18889 - protein, 9 aa, Homo sapiens
  light chain complementarity determining region 3 for antibody 9445
MQGTYRPNT

SEQ ID NO: 18890 - protein, 11 aa, Homo sapiens
  heavy chain complementarity determining region 3 for antibody 9445
ARGDGWYGLDY

SEQ ID NO: 18891 - protein, 9 aa, Homo sapiens
  light chain complementarity determining region 3 for antibody 9446
MQGTYLPYT

SEQ ID NO: 18892 - protein, 11 aa, Homo sapiens
  heavy chain complementarity determining region 3 for antibody 9446
AREGWGSLLDY

SEQ ID NO: 18893 - protein, 9 aa, Homo sapiens
  light chain complementarity determining region 3 for antibody 9447
MQGTWWPDT

SEQ ID NO: 18894 - protein, 11 aa, Homo sapiens
  heavy chain complementarity determining region 3 for antibody 9447
AREGWGTLLDY

SEQ ID NO: 18895 - protein, 9 aa, Homo sapiens
  light chain complementarity determining region 3 for antibody 9448
MQGTRWPIT

SEQ ID NO: 18896 - protein, 15 aa, Homo sapiens
  heavy chain complementarity determining region 3 for antibody 9448
ARELPQRTYSDGWDH

SEQ ID NO: 18897 - protein, 9 aa, Homo sapiens
  light chain complementarity determining region 3 for antibody 9449
MQGTPWPPT

SEQ ID NO: 18898 - protein, 11 aa, Homo sapiens
  heavy chain complementarity determining region 3 for antibody 9449
ATFGQQWRLAH

SEQ ID NO: 18899 - protein, 9 aa, Homo sapiens
  light chain complementarity determining region 3 for antibody 9450
MQGTPWPNT

SEQ ID NO: 18900 - protein, 11 aa, Homo sapiens
  heavy chain complementarity determining region 3 for antibody 9450
ARGDGWYGLDY

SEQ ID NO: 18901 - protein, 9 aa, Homo sapiens
  light chain complementarity determining region 3 for antibody 9451
MQGTPWPHT

SEQ ID NO: 18902 - protein, 11 aa, Homo sapiens
  heavy chain complementarity determining region 3 for antibody 9451
ATFGISWYFSG

SEQ ID NO: 18903 - protein, 9 aa, Homo sapiens
  light chain complementarity determining region 3 for antibody 9452
MQGTNWPYT

SEQ ID NO: 18904 - protein, 8 aa, Homo sapiens
  heavy chain complementarity determining region 3 for antibody 9452
ARGNWYAG

SEQ ID NO: 18905 - protein, 9 aa, Homo sapiens
  light chain complementarity determining region 3 for antibody 9453
MQGTNWPRT

SEQ ID NO: 18906 - protein, 10 aa, Homo sapiens
  heavy chain complementarity determining region 3 for antibody 9453
VRDYWNSIDY

SEQ ID NO: 18907 - protein, 10 aa, Homo sapiens
  light chain complementarity determining region 3 for antibody 9454
MQGTNWPPIT

SEQ ID NO: 18908 - protein, 16 aa, Homo sapiens
  heavy chain complementarity determining region 3 for antibody 9454
ARHGVLPAAIHDAFDI

SEQ ID NO: 18909 - protein, 9 aa, Homo sapiens
  light chain complementarity determining region 3 for antibody 9455
MQGTNWPNT

SEQ ID NO: 18910 - protein, 11 aa, Homo sapiens
  heavy chain complementarity determining region 3 for antibody 9455
ARGDGWYGLDY

SEQ ID NO: 18911 - protein, 9 aa, Homo sapiens
  light chain complementarity determining region 3 for antibody 9456
MQGTNWPIT

SEQ ID NO: 18912 - protein, 17 aa, Homo sapiens
  heavy chain complementarity determining region 3 for antibody 9456
ARNTMVGTWQRQGNLDH

SEQ ID NO: 18913 - protein, 9 aa, Homo sapiens
  light chain complementarity determining region 3 for antibody 9457
MQGTNWPHT

SEQ ID NO: 18914 - protein, 11 aa, Homo sapiens
  heavy chain complementarity determining region 3 for antibody 9457
ATFGISWYFSG

SEQ ID NO: 18915 - protein, 9 aa, Homo sapiens
  light chain complementarity determining region 3 for antibody 9458
MQGTLWPWT

SEQ ID NO: 18916 - protein, 16 aa, Homo sapiens
  heavy chain complementarity determining region 3 for antibody 9458
ARGHTNPGERRGGSDF

SEQ ID NO: 18917 - protein, 9 aa, Homo sapiens
  light chain complementarity determining region 3 for antibody 9459
MQGTHWSHT

SEQ ID NO: 18918 - protein, 11 aa, Homo sapiens
  heavy chain complementarity determining region 3 for antibody 9459
ATFGQQWRLAH

SEQ ID NO: 18919 - protein, 9 aa, Homo sapiens
  light chain complementarity determining region 3 for antibody 9460
MQGTHWRWT

SEQ ID NO: 18920 - protein, 16 aa, Homo sapiens
  heavy chain complementarity determining region 3 for antibody 9460
ARGHTNPGERRGGSDF

SEQ ID NO: 18921 - protein, 9 aa, Homo sapiens
  light chain complementarity determining region 3 for antibody 9461
MQGTHWRGT

SEQ ID NO: 18922 - protein, 16 aa, Homo sapiens
  heavy chain complementarity determining region 3 for antibody 9461
VRDLAGFTRGGSTFDY

SEQ ID NO: 18923 - protein, 9 aa, Homo sapiens
  light chain complementarity determining region 3 for antibody 9462
MQGTHWPYT

SEQ ID NO: 18924 - protein, 12 aa, Homo sapiens
  heavy chain complementarity determining region 3 for antibody 9462
ARLDWNYRAFDI

SEQ ID NO: 18925 - protein, 9 aa, Homo sapiens
  light chain complementarity determining region 3 for antibody 9463
MQGTHWPYT

SEQ ID NO: 18926 - protein, 8 aa, Homo sapiens
  heavy chain complementarity determining region 3 for antibody 9463
ARGIWFAG

SEQ ID NO: 18927 - protein, 9 aa, Homo sapiens
  light chain complementarity determining region 3 for antibody 9464
MQGTHWPYT

SEQ ID NO: 18928 - protein, 8 aa, Homo sapiens
  heavy chain complementarity determining region 3 for antibody 9464
ARDNWYAG

SEQ ID NO: 18929 - protein, 9 aa, Homo sapiens
  light chain complementarity determining region 3 for antibody 9465
MQGTHWPYT

SEQ ID NO: 18930 - protein, 12 aa, Homo sapiens
  heavy chain complementarity determining region 3 for antibody 9465
AIVVPGRWDLDD

SEQ ID NO: 18931 - protein, 9 aa, Homo sapiens
  light chain complementarity determining region 3 for antibody 9466
MQGTHWPWT

SEQ ID NO: 18932 - protein, 11 aa, Homo sapiens
  heavy chain complementarity determining region 3 for antibody 9466
VRVSTGWNFDY

SEQ ID NO: 18933 - protein, 9 aa, Homo sapiens
  light chain complementarity determining region 3 for antibody 9467
MQGTHWPWT

SEQ ID NO: 18934 - protein, 15 aa, Homo sapiens
  heavy chain complementarity determining region 3 for antibody 9467
VRDPAGLAYFYNMEV

SEQ ID NO: 18935 - protein, 9 aa, Homo sapiens
  light chain complementarity determining region 3 for antibody 9468
MQGTHWPWT

SEQ ID NO: 18936 - protein, 12 aa, Homo sapiens
  heavy chain complementarity determining region 3 for antibody 9468
NADHGYVDGFDI

SEQ ID NO: 18937 - protein, 9 aa, Homo sapiens
  light chain complementarity determining region 3 for antibody 9469
MQGTHWPWT

SEQ ID NO: 18938 - protein, 9 aa, Homo sapiens
  heavy chain complementarity determining region 3 for antibody 9469
GSRRPYFDY

SEQ ID NO: 18939 - protein, 9 aa, Homo sapiens
  light chain complementarity determining region 3 for antibody 9470
MQGTHWPWT

SEQ ID NO: 18940 - protein, 10 aa, Homo sapiens
  heavy chain complementarity determining region 3 for antibody 9470
CRDRWGFGDV

SEQ ID NO: 18941 - protein, 9 aa, Homo sapiens
  light chain complementarity determining region 3 for antibody 9471
MQGTHWPWT

SEQ ID NO: 18942 - protein, 20 aa, Homo sapiens
  heavy chain complementarity determining region 3 for antibody 9471
ATYLPGDCSCTGCYYWYFNF

SEQ ID NO: 18943 - protein, 9 aa, Homo sapiens
  light chain complementarity determining region 3 for antibody 9472
MQGTHWPWT

SEQ ID NO: 18944 - protein, 12 aa, Homo sapiens
  heavy chain complementarity determining region 3 for antibody 9472
ASGSLREVAGMV

SEQ ID NO: 18945 - protein, 9 aa, Homo sapiens
  light chain complementarity determining region 3 for antibody 9473
MQGTHWPWT

SEQ ID NO: 18946 - protein, 15 aa, Homo sapiens
  heavy chain complementarity determining region 3 for antibody 9473
ARVGRPYHNAWYFDN

SEQ ID NO: 18947 - protein, 9 aa, Homo sapiens
  light chain complementarity determining region 3 for antibody 9474
MQGTHWPWT

SEQ ID NO: 18948 - protein, 17 aa, Homo sapiens
  heavy chain complementarity determining region 3 for antibody 9474
ARNTMVHGWQRQGSVDH

SEQ ID NO: 18949 - protein, 9 aa, Homo sapiens
  light chain complementarity determining region 3 for antibody 9475
MQGTHWPWT

SEQ ID NO: 18950 - protein, 17 aa, Homo sapiens
  heavy chain complementarity determining region 3 for antibody 9475
ARNTMVGTWQRQGNLDH

SEQ ID NO: 18951 - protein, 9 aa, Homo sapiens
  light chain complementarity determining region 3 for antibody 9476
MQGTHWPWT

SEQ ID NO: 18952 - protein, 23 aa, Homo sapiens
  heavy chain complementarity determining region 3 for antibody 9476
ARHFPMGGSTVTGTQSLLYYMDV

SEQ ID NO: 18953 - protein, 9 aa, Homo sapiens
  light chain complementarity determining region 3 for antibody 9477
MQGTHWPWT

SEQ ID NO: 18954 - protein, 16 aa, Homo sapiens
  heavy chain complementarity determining region 3 for antibody 9477
ARGPTNPGERRGGSDF

SEQ ID NO: 18955 - protein, 9 aa, Homo sapiens
  light chain complementarity determining region 3 for antibody 9478
MQGTHWPWT

SEQ ID NO: 18956 - protein, 12 aa, Homo sapiens
  heavy chain complementarity determining region 3 for antibody 9478
ARGPLKMAGGSS

SEQ ID NO: 18957 - protein, 9 aa, Homo sapiens
  light chain complementarity determining region 3 for antibody 9479
MQGTHWPWT

SEQ ID NO: 18958 - protein, 16 aa, Homo sapiens
  heavy chain complementarity determining region 3 for antibody 9479
ARGHTNTGERRGGSDF

SEQ ID NO: 18959 - protein, 9 aa, Homo sapiens
  light chain complementarity determining region 3 for antibody 9480
MQGTHWPWT

SEQ ID NO: 18960 - protein, 16 aa, Homo sapiens
  heavy chain complementarity determining region 3 for antibody 9480
ARGHTNPGERRGCSDF

SEQ ID NO: 18961 - protein, 9 aa, Homo sapiens
  light chain complementarity determining region 3 for antibody 9481
MQGTHWPWT

SEQ ID NO: 18962 - protein, 16 aa, Homo sapiens
  heavy chain complementarity determining region 3 for antibody 9481
ARGHTNAGERRGGSDF

SEQ ID NO: 18963 - protein, 9 aa, Homo sapiens
  light chain complementarity determining region 3 for antibody 9482
MQGTHWPWT

SEQ ID NO: 18964 - protein, 16 aa, Homo sapiens
  heavy chain complementarity determining region 3 for antibody 9482
ARGHTFPGERRGGSDF

SEQ ID NO: 18965 - protein, 9 aa, Homo sapiens
  light chain complementarity determining region 3 for antibody 9483
MQGTHWPWT

SEQ ID NO: 18966 - protein, 16 aa, Homo sapiens
  heavy chain complementarity determining region 3 for antibody 9483
ARGHPNPGERRGGSDF

SEQ ID NO: 18967 - protein, 9 aa, Homo sapiens
  light chain complementarity determining region 3 for antibody 9484
MQGTHWPWT

SEQ ID NO: 18968 - protein, 14 aa, Homo sapiens
  heavy chain complementarity determining region 3 for antibody 9484
ARGHFDSTGFRLDY

SEQ ID NO: 18969 - protein, 9 aa, Homo sapiens
  light chain complementarity determining region 3 for antibody 9485
MQGTHWPWT

SEQ ID NO: 18970 - protein, 16 aa, Homo sapiens
  heavy chain complementarity determining region 3 for antibody 9485
ARGDTNPGERRGGSDF

SEQ ID NO: 18971 - protein, 9 aa, Homo sapiens
  light chain complementarity determining region 3 for antibody 9486
MQGTHWPWT

SEQ ID NO: 18972 - protein, 10 aa, Homo sapiens
  heavy chain complementarity determining region 3 for antibody 9486
ARETSGAYDI

SEQ ID NO: 18973 - protein, 9 aa, Homo sapiens
  light chain complementarity determining region 3 for antibody 9487
MQGTHWPWT

SEQ ID NO: 18974 - protein, 19 aa, Homo sapiens
  heavy chain complementarity determining region 3 for antibody 9487
ARERVRCRSGICYDATFDI

SEQ ID NO: 18975 - protein, 9 aa, Homo sapiens
  light chain complementarity determining region 3 for antibody 9488
MQGTHWPWT

SEQ ID NO: 18976 - protein, 10 aa, Homo sapiens
  heavy chain complementarity determining region 3 for antibody 9488
ARERSGSYDI

SEQ ID NO: 18977 - protein, 9 aa, Homo sapiens
  light chain complementarity determining region 3 for antibody 9489
MQGTHWPWT

SEQ ID NO: 18978 - protein, 12 aa, Homo sapiens
  heavy chain complementarity determining region 3 for antibody 9489
AMVVPGRWDLDD

SEQ ID NO: 18979 - protein, 9 aa, Homo sapiens
  light chain complementarity determining region 3 for antibody 9490
MQGTHWPWT

SEQ ID NO: 18980 - protein, 12 aa, Homo sapiens
  heavy chain complementarity determining region 3 for antibody 9490
AIVVQGRWDLDD

SEQ ID NO: 18981 - protein, 9 aa, Homo sapiens
  light chain complementarity determining region 3 for antibody 9491
MQGTHWPWT

SEQ ID NO: 18982 - protein, 12 aa, Homo sapiens
  heavy chain complementarity determining region 3 for antibody 9491
AIVVPWRWDLDD

SEQ ID NO: 18983 - protein, 9 aa, Homo sapiens
  light chain complementarity determining region 3 for antibody 9492
MQGTHWPWT

SEQ ID NO: 18984 - protein, 12 aa, Homo sapiens
  heavy chain complementarity determining region 3 for antibody 9492
AIVVPGRWYLDD

SEQ ID NO: 18985 - protein, 9 aa, Homo sapiens
  light chain complementarity determining region 3 for antibody 9493
MQGTHWPWT

SEQ ID NO: 18986 - protein, 12 aa, Homo sapiens
  heavy chain complementarity determining region 3 for antibody 9493
AIVVPGRWGLDD

SEQ ID NO: 18987 - protein, 9 aa, Homo sapiens
  light chain complementarity determining region 3 for antibody 9494
MQGTHWPWT

SEQ ID NO: 18988 - protein, 12 aa, Homo sapiens
  heavy chain complementarity determining region 3 for antibody 9494
AIVVPGRWDIDD

SEQ ID NO: 18989 - protein, 9 aa, Homo sapiens
  light chain complementarity determining region 3 for antibody 9495
MQGTHWPWT

SEQ ID NO: 18990 - protein, 8 aa, Homo sapiens
  heavy chain complementarity determining region 3 for antibody 9495
AGWNDANY

SEQ ID NO: 18991 - protein, 9 aa, Homo sapiens
  light chain complementarity determining region 3 for antibody 9496
MQGTHWPWT

SEQ ID NO: 18992 - protein, 9 aa, Homo sapiens
  heavy chain complementarity determining region 3 for antibody 9496
AGWGGLSNY

SEQ ID NO: 18993 - protein, 9 aa, Homo sapiens
  light chain complementarity determining region 3 for antibody 9497
MQGTHWPWP

SEQ ID NO: 18994 - protein, 10 aa, Homo sapiens
  heavy chain complementarity determining region 3 for antibody 9497
ARGGLAGDIY

SEQ ID NO: 18995 - protein, 9 aa, Homo sapiens
  light chain complementarity determining region 3 for antibody 9498
MQGTHWPWP

SEQ ID NO: 18996 - protein, 11 aa, Homo sapiens
  heavy chain complementarity determining region 3 for antibody 9498
ARGGGVGTADY

SEQ ID NO: 18997 - protein, 9 aa, Homo sapiens
  light chain complementarity determining region 3 for antibody 9499
MQGTHWPWP

SEQ ID NO: 18998 - protein, 10 aa, Homo sapiens
  heavy chain complementarity determining region 3 for antibody 9499
ARETSGSYDI

SEQ ID NO: 18999 - protein, 9 aa, Homo sapiens
  light chain complementarity determining region 3 for antibody 9500
MQGTHWPWK

SEQ ID NO: 19000 - protein, 16 aa, Homo sapiens
  heavy chain complementarity determining region 3 for antibody 9500
ARGHTNPGERRGGSDF

SEQ ID NO: 19001 - protein, 9 aa, Homo sapiens
  light chain complementarity determining region 3 for antibody 9501
MQGTHWPWK

SEQ ID NO: 19002 - protein, 12 aa, Homo sapiens
  heavy chain complementarity determining region 3 for antibody 9501
AIVVPGRWDLDD

SEQ ID NO: 19003 - protein, 9 aa, Homo sapiens
  light chain complementarity determining region 3 for antibody 9502
MQGTHWPWG

SEQ ID NO: 19004 - protein, 12 aa, Homo sapiens
  heavy chain complementarity determining region 3 for antibody 9502
AIVVPGRWDLDD

SEQ ID NO: 19005 - protein, 8 aa, Homo sapiens
  light chain complementarity determining region 3 for antibody 9503
MQGTHWPV

SEQ ID NO: 19006 - protein, 12 aa, Homo sapiens
  heavy chain complementarity determining region 3 for antibody 9503
AIVVPGRWDLDD

SEQ ID NO: 19007 - protein, 9 aa, Homo sapiens
  light chain complementarity determining region 3 for antibody 9504
MQGTHWPTT

SEQ ID NO: 19008 - protein, 11 aa, Homo sapiens
  heavy chain complementarity determining region 3 for antibody 9504
ATFGQQWRLAH

SEQ ID NO: 19009 - protein, 9 aa, Homo sapiens
  light chain complementarity determining region 3 for antibody 9505
MQGTHWPTT

SEQ ID NO: 19010 - protein, 11 aa, Homo sapiens
  heavy chain complementarity determining region 3 for antibody 9505
ARGDGWYGLDY

SEQ ID NO: 19011 - protein, 9 aa, Homo sapiens
  light chain complementarity determining region 3 for antibody 9506
MQGTHWPST

SEQ ID NO: 19012 - protein, 8 aa, Homo sapiens
  heavy chain complementarity determining region 3 for antibody 9506
ARGVWFAG

SEQ ID NO: 19013 - protein, 9 aa, Homo sapiens
  light chain complementarity determining region 3 for antibody 9507
MQGTHWPRT

SEQ ID NO: 19014 - protein, 10 aa, Homo sapiens
  heavy chain complementarity determining region 3 for antibody 9507
VRDYWSSIDY

SEQ ID NO: 19015 - protein, 9 aa, Homo sapiens
  light chain complementarity determining region 3 for antibody 9508
MQGTHWPRT

SEQ ID NO: 19016 - protein, 13 aa, Homo sapiens
  heavy chain complementarity determining region 3 for antibody 9508
TKEGSAAGPDFVY

SEQ ID NO: 19017 - protein, 9 aa, Homo sapiens
  light chain complementarity determining region 3 for antibody 9509
MQGTHWPRT

SEQ ID NO: 19018 - protein, 13 aa, Homo sapiens
  heavy chain complementarity determining region 3 for antibody 9509
ATGAWGSSWWGDY

SEQ ID NO: 19019 - protein, 9 aa, Homo sapiens
  light chain complementarity determining region 3 for antibody 9510
MQGTHWPRP

SEQ ID NO: 19020 - protein, 10 aa, Homo sapiens
  heavy chain complementarity determining region 3 for antibody 9510
VRDYWNSIDY

SEQ ID NO: 19021 - protein, 9 aa, Homo sapiens
  light chain complementarity determining region 3 for antibody 9511
MQGTHWPQT

SEQ ID NO: 19022 - protein, 12 aa, Homo sapiens
  heavy chain complementarity determining region 3 for antibody 9511
ARLDWNYRAFDI

SEQ ID NO: 19023 - protein, 9 aa, Homo sapiens
  light chain complementarity determining region 3 for antibody 9512
MQGTHWPQP

SEQ ID NO: 19024 - protein, 11 aa, Homo sapiens
  heavy chain complementarity determining region 3 for antibody 9512
ATFGQQWRLPH

SEQ ID NO: 19025 - protein, 9 aa, Homo sapiens
  light chain complementarity determining region 3 for antibody 9513
MQGTHWPPY

SEQ ID NO: 19026 - protein, 13 aa, Homo sapiens
  heavy chain complementarity determining region 3 for antibody 9513
ARDTVTNKMGSDY

SEQ ID NO: 19027 - protein, 10 aa, Homo sapiens
  light chain complementarity determining region 3 for antibody 9514
MQGTHWPPTT

SEQ ID NO: 19028 - protein, 16 aa, Homo sapiens
  heavy chain complementarity determining region 3 for antibody 9514
ARHGVLPAAIHDAFDI

SEQ ID NO: 19029 - protein, 9 aa, Homo sapiens
  light chain complementarity determining region 3 for antibody 9515
MQGTHWPPT

SEQ ID NO: 19030 - protein, 12 aa, Homo sapiens
  heavy chain complementarity determining region 3 for antibody 9515
ARLDWNYRAFDI

SEQ ID NO: 19031 - protein, 9 aa, Homo sapiens
  light chain complementarity determining region 3 for antibody 9516
MQGTHWPPS

SEQ ID NO: 19032 - protein, 13 aa, Homo sapiens
  heavy chain complementarity determining region 3 for antibody 9516
VRDTVTNKMGSDY

SEQ ID NO: 19033 - protein, 10 aa, Homo sapiens
  light chain complementarity determining region 3 for antibody 9517
MQGTHWPPST

SEQ ID NO: 19034 - protein, 16 aa, Homo sapiens
  heavy chain complementarity determining region 3 for antibody 9517
ARHGVLPAAIHDAFDI

SEQ ID NO: 19035 - protein, 9 aa, Homo sapiens
  light chain complementarity determining region 3 for antibody 9518
MQGTHWPPS

SEQ ID NO: 19036 - protein, 14 aa, Homo sapiens
  heavy chain complementarity determining region 3 for antibody 9518
CRGWLDPATPHYDF

SEQ ID NO: 19037 - protein, 9 aa, Homo sapiens
  light chain complementarity determining region 3 for antibody 9519
MQGTHWPPS

SEQ ID NO: 19038 - protein, 13 aa, Homo sapiens
  heavy chain complementarity determining region 3 for antibody 9519
ARDTVTNKMGPDY

SEQ ID NO: 19039 - protein, 9 aa, Homo sapiens
  light chain complementarity determining region 3 for antibody 9520
MQGTHWPPS

SEQ ID NO: 19040 - protein, 13 aa, Homo sapiens
  heavy chain complementarity determining region 3 for antibody 9520
ARDTVTNKMGADY

SEQ ID NO: 19041 - protein, 9 aa, Homo sapiens
  light chain complementarity determining region 3 for antibody 9521
MQGTHWPPS

SEQ ID NO: 19042 - protein, 12 aa, Homo sapiens
  heavy chain complementarity determining region 3 for antibody 9521
ARDKGGRNGMDV

SEQ ID NO: 19043 - protein, 9 aa, Homo sapiens
  light chain complementarity determining region 3 for antibody 9522
MQGTHWPPS

SEQ ID NO: 19044 - protein, 13 aa, Homo sapiens
  heavy chain complementarity determining region 3 for antibody 9522
AGDTVTNKMGSDY

SEQ ID NO: 19045 - protein, 9 aa, Homo sapiens
  light chain complementarity determining region 3 for antibody 9523
MQGTHWPPP

SEQ ID NO: 19046 - protein, 11 aa, Homo sapiens
  heavy chain complementarity determining region 3 for antibody 9523
ATFGQQWRLAH

SEQ ID NO: 19047 - protein, 9 aa, Homo sapiens
  light chain complementarity determining region 3 for antibody 9524
MQGTHWPPP

SEQ ID NO: 19048 - protein, 10 aa, Homo sapiens
  heavy chain complementarity determining region 3 for antibody 9524
AKGGTWDSDY

SEQ ID NO: 19049 - protein, 10 aa, Homo sapiens
  light chain complementarity determining region 3 for antibody 9525
MQGTHWPPIT

SEQ ID NO: 19050 - protein, 11 aa, Homo sapiens
  heavy chain complementarity determining region 3 for antibody 9525
TGGGAGTKVDS

SEQ ID NO: 19051 - protein, 10 aa, Homo sapiens
  light chain complementarity determining region 3 for antibody 9526
MQGTHWPPIT

SEQ ID NO: 19052 - protein, 10 aa, Homo sapiens
  heavy chain complementarity determining region 3 for antibody 9526
CRDREGFGDV

SEQ ID NO: 19053 - protein, 10 aa, Homo sapiens
  light chain complementarity determining region 3 for antibody 9527
MQGTHWPPIT

SEQ ID NO: 19054 - protein, 12 aa, Homo sapiens
  heavy chain complementarity determining region 3 for antibody 9527
AIVVPGRWDLDD

SEQ ID NO: 19055 - protein, 10 aa, Homo sapiens
  light chain complementarity determining region 3 for antibody 9528
MQGTHWPPIN

SEQ ID NO: 19056 - protein, 16 aa, Homo sapiens
  heavy chain complementarity determining region 3 for antibody 9528
ARHGVLPAAIHDAFDI

SEQ ID NO: 19057 - protein, 9 aa, Homo sapiens
  light chain complementarity determining region 3 for antibody 9529
MQGTHWPNT

SEQ ID NO: 19058 - protein, 8 aa, Homo sapiens
  heavy chain complementarity determining region 3 for antibody 9529
ARGGRGDC

SEQ ID NO: 19059 - protein, 9 aa, Homo sapiens
  light chain complementarity determining region 3 for antibody 9530
MQGTHWPNN

SEQ ID NO: 19060 - protein, 11 aa, Homo sapiens
  heavy chain complementarity determining region 3 for antibody 9530
ARGDGWYGLDY

SEQ ID NO: 19061 - protein, 9 aa, Homo sapiens
  light chain complementarity determining region 3 for antibody 9531
MQGTHWPLT

SEQ ID NO: 19062 - protein, 7 aa, Homo sapiens
  heavy chain complementarity determining region 3 for antibody 9531
ASGRWND

SEQ ID NO: 19063 - protein, 9 aa, Homo sapiens
  light chain complementarity determining region 3 for antibody 9532
MQGTHWPLN

SEQ ID NO: 19064 - protein, 13 aa, Homo sapiens
  heavy chain complementarity determining region 3 for antibody 9532
AKEGSSAGPDFDY

SEQ ID NO: 19065 - protein, 9 aa, Homo sapiens
  light chain complementarity determining region 3 for antibody 9533
MQGTHWPIT

SEQ ID NO: 19066 - protein, 12 aa, Homo sapiens
  heavy chain complementarity determining region 3 for antibody 9533
NADHGYVDGFDI

SEQ ID NO: 19067 - protein, 9 aa, Homo sapiens
  light chain complementarity determining region 3 for antibody 9534
MQGTHWPIT

SEQ ID NO: 19068 - protein, 17 aa, Homo sapiens
  heavy chain complementarity determining region 3 for antibody 9534
ARSTMVGTWQRQGNLDH

SEQ ID NO: 19069 - protein, 9 aa, Homo sapiens
  light chain complementarity determining region 3 for antibody 9535
MQGTHWPIT

SEQ ID NO: 19070 - protein, 17 aa, Homo sapiens
  heavy chain complementarity determining region 3 for antibody 9535
ARNTMVGTWQRQGNLGH

SEQ ID NO: 19071 - protein, 9 aa, Homo sapiens
  light chain complementarity determining region 3 for antibody 9536
MQGTHWPIT

SEQ ID NO: 19072 - protein, 17 aa, Homo sapiens
  heavy chain complementarity determining region 3 for antibody 9536
ARNTMVGTWQRQGNLAH

SEQ ID NO: 19073 - protein, 9 aa, Homo sapiens
  light chain complementarity determining region 3 for antibody 9537
MQGTHWPIT

SEQ ID NO: 19074 - protein, 17 aa, Homo sapiens
  heavy chain complementarity determining region 3 for antibody 9537
ARNTMVGTWHRQGNLDH

SEQ ID NO: 19075 - protein, 9 aa, Homo sapiens
  light chain complementarity determining region 3 for antibody 9538
MQGTHWPIT

SEQ ID NO: 19076 - protein, 13 aa, Homo sapiens
  heavy chain complementarity determining region 3 for antibody 9538
AKEGSSPGPDFDY

SEQ ID NO: 19077 - protein, 9 aa, Homo sapiens
  light chain complementarity determining region 3 for antibody 9539
MQGTHWPIT

SEQ ID NO: 19078 - protein, 17 aa, Homo sapiens
  heavy chain complementarity determining region 3 for antibody 9539
AGNTMVGTWQRQGNLDH

SEQ ID NO: 19079 - protein, 9 aa, Homo sapiens
  light chain complementarity determining region 3 for antibody 9540
MQGTHWPIP

SEQ ID NO: 19080 - protein, 15 aa, Homo sapiens
  heavy chain complementarity determining region 3 for antibody 9540
ARIWTSSTNCRYMDV

SEQ ID NO: 19081 - protein, 9 aa, Homo sapiens
  light chain complementarity determining region 3 for antibody 9541
MQGTHWPIN

SEQ ID NO: 19082 - protein, 11 aa, Homo sapiens
  heavy chain complementarity determining region 3 for antibody 9541
ATFGQQWRLAH

SEQ ID NO: 19083 - protein, 9 aa, Homo sapiens
  light chain complementarity determining region 3 for antibody 9542
MQGTHWPIN

SEQ ID NO: 19084 - protein, 11 aa, Homo sapiens
  heavy chain complementarity determining region 3 for antibody 9542
ARRSLGGAFDY

SEQ ID NO: 19085 - protein, 9 aa, Homo sapiens
  light chain complementarity determining region 3 for antibody 9543
MQGTHWPIN

SEQ ID NO: 19086 - protein, 10 aa, Homo sapiens
  heavy chain complementarity determining region 3 for antibody 9543
ARERSGSYDI

SEQ ID NO: 19087 - protein, 9 aa, Homo sapiens
  light chain complementarity determining region 3 for antibody 9544
MQGTHWPIN

SEQ ID NO: 19088 - protein, 13 aa, Homo sapiens
  heavy chain complementarity determining region 3 for antibody 9544
AKEVSSAGPDFDY

SEQ ID NO: 19089 - protein, 9 aa, Homo sapiens
  light chain complementarity determining region 3 for antibody 9545
MQGTHWPIN

SEQ ID NO: 19090 - protein, 13 aa, Homo sapiens
  heavy chain complementarity determining region 3 for antibody 9545
AKEGSSAGPDFDS

SEQ ID NO: 19091 - protein, 9 aa, Homo sapiens
  light chain complementarity determining region 3 for antibody 9546
MQGTHWPID

SEQ ID NO: 19092 - protein, 13 aa, Homo sapiens
  heavy chain complementarity determining region 3 for antibody 9546
AKEGSSAGPDFDY

SEQ ID NO: 19093 - protein, 9 aa, Homo sapiens
  light chain complementarity determining region 3 for antibody 9547
MQGTHWPHT

SEQ ID NO: 19094 - protein, 16 aa, Homo sapiens
  heavy chain complementarity determining region 3 for antibody 9547
VRDLAGFTRGGSTFDY

SEQ ID NO: 19095 - protein, 9 aa, Homo sapiens
  light chain complementarity determining region 3 for antibody 9548
MQGTHWPHT

SEQ ID NO: 19096 - protein, 16 aa, Homo sapiens
  heavy chain complementarity determining region 3 for antibody 9548
VGPHLTYNSGWRYFDY

SEQ ID NO: 19097 - protein, 9 aa, Homo sapiens
  light chain complementarity determining region 3 for antibody 9549
MQGTHWPHT

SEQ ID NO: 19098 - protein, 14 aa, Homo sapiens
  heavy chain complementarity determining region 3 for antibody 9549
GRDVHTTGWTLGGY

SEQ ID NO: 19099 - protein, 9 aa, Homo sapiens
  light chain complementarity determining region 3 for antibody 9550
MQGTHWPHT

SEQ ID NO: 19100 - protein, 11 aa, Homo sapiens
  heavy chain complementarity determining region 3 for antibody 9550
ETFGQQWRLAH

SEQ ID NO: 19101 - protein, 9 aa, Homo sapiens
  light chain complementarity determining region 3 for antibody 9551
MQGTHWPHT

SEQ ID NO: 19102 - protein, 11 aa, Homo sapiens
  heavy chain complementarity determining region 3 for antibody 9551
ATVGISWYFSG

SEQ ID NO: 19103 - protein, 9 aa, Homo sapiens
  light chain complementarity determining region 3 for antibody 9552
MQGTHWPHT

SEQ ID NO: 19104 - protein, 11 aa, Homo sapiens
  heavy chain complementarity determining region 3 for antibody 9552
ATGGQQWRLAH

SEQ ID NO: 19105 - protein, 9 aa, Homo sapiens
  light chain complementarity determining region 3 for antibody 9553
MQGTHWPHT

SEQ ID NO: 19106 - protein, 11 aa, Homo sapiens
  heavy chain complementarity determining region 3 for antibody 9553
ATFGSSWYFSG

SEQ ID NO: 19107 - protein, 9 aa, Homo sapiens
  light chain complementarity determining region 3 for antibody 9554
MQGTHWPHT

SEQ ID NO: 19108 - protein, 11 aa, Homo sapiens
  heavy chain complementarity determining region 3 for antibody 9554
ATFGQRWRLAH

SEQ ID NO: 19109 - protein, 9 aa, Homo sapiens
  light chain complementarity determining region 3 for antibody 9555
MQGTHWPHT

SEQ ID NO: 19110 - protein, 11 aa, Homo sapiens
  heavy chain complementarity determining region 3 for antibody 9555
ATFGQQWRLAQ

SEQ ID NO: 19111 - protein, 9 aa, Homo sapiens
  light chain complementarity determining region 3 for antibody 9556
MQGTHWPHT

SEQ ID NO: 19112 - protein, 11 aa, Homo sapiens
  heavy chain complementarity determining region 3 for antibody 9556
ATFGQQWRLAD

SEQ ID NO: 19113 - protein, 9 aa, Homo sapiens
  light chain complementarity determining region 3 for antibody 9557
MQGTHWPHT

SEQ ID NO: 19114 - protein, 11 aa, Homo sapiens
  heavy chain complementarity determining region 3 for antibody 9557
ATFGQQWRIAH

SEQ ID NO: 19115 - protein, 9 aa, Homo sapiens
  light chain complementarity determining region 3 for antibody 9558
MQGTHWPHT

SEQ ID NO: 19116 - protein, 11 aa, Homo sapiens
  heavy chain complementarity determining region 3 for antibody 9558
ATFGISWYLSG

SEQ ID NO: 19117 - protein, 9 aa, Homo sapiens
  light chain complementarity determining region 3 for antibody 9559
MQGTHWPHT

SEQ ID NO: 19118 - protein, 11 aa, Homo sapiens
  heavy chain complementarity determining region 3 for antibody 9559
ATFGHQWSLAH

SEQ ID NO: 19119 - protein, 9 aa, Homo sapiens
  light chain complementarity determining region 3 for antibody 9560
MQGTHWPHT

SEQ ID NO: 19120 - protein, 11 aa, Homo sapiens
  heavy chain complementarity determining region 3 for antibody 9560
ASFGQQWRLDH

SEQ ID NO: 19121 - protein, 9 aa, Homo sapiens
  light chain complementarity determining region 3 for antibody 9561
MQGTHWPHT

SEQ ID NO: 19122 - protein, 15 aa, Homo sapiens
  heavy chain complementarity determining region 3 for antibody 9561
ARVGRPYHNAWYFDN

SEQ ID NO: 19123 - protein, 9 aa, Homo sapiens
  light chain complementarity determining region 3 for antibody 9562
MQGTHWPHT

SEQ ID NO: 19124 - protein, 11 aa, Homo sapiens
  heavy chain complementarity determining region 3 for antibody 9562
ARRSLGGAFDY

SEQ ID NO: 19125 - protein, 9 aa, Homo sapiens
  light chain complementarity determining region 3 for antibody 9563
MQGTHWPHT

SEQ ID NO: 19126 - protein, 12 aa, Homo sapiens
  heavy chain complementarity determining region 3 for antibody 9563
ARGPLKMAGGSS

SEQ ID NO: 19127 - protein, 9 aa, Homo sapiens
  light chain complementarity determining region 3 for antibody 9564
MQGTHWPHT

SEQ ID NO: 19128 - protein, 8 aa, Homo sapiens
  heavy chain complementarity determining region 3 for antibody 9564
ARGGRGDC

SEQ ID NO: 19129 - protein, 9 aa, Homo sapiens
  light chain complementarity determining region 3 for antibody 9565
MQGTHWPHT

SEQ ID NO: 19130 - protein, 18 aa, Homo sapiens
  heavy chain complementarity determining region 3 for antibody 9565
ARGDYPEARTGYFLDFDY

SEQ ID NO: 19131 - protein, 9 aa, Homo sapiens
  light chain complementarity determining region 3 for antibody 9566
MQGTHWPHT

SEQ ID NO: 19132 - protein, 11 aa, Homo sapiens
  heavy chain complementarity determining region 3 for antibody 9566
ARGDGWYGLDY

SEQ ID NO: 19133 - protein, 9 aa, Homo sapiens
  light chain complementarity determining region 3 for antibody 9567
MQGTHWPHT

SEQ ID NO: 19134 - protein, 10 aa, Homo sapiens
  heavy chain complementarity determining region 3 for antibody 9567
ARETSGSYDI

SEQ ID NO: 19135 - protein, 9 aa, Homo sapiens
  light chain complementarity determining region 3 for antibody 9568
MQGTHWPHT

SEQ ID NO: 19136 - protein, 12 aa, Homo sapiens
  heavy chain complementarity determining region 3 for antibody 9568
ARDKGGRNGMDV

SEQ ID NO: 19137 - protein, 9 aa, Homo sapiens
  light chain complementarity determining region 3 for antibody 9569
MQGTHWPHT

SEQ ID NO: 19138 - protein, 17 aa, Homo sapiens
  heavy chain complementarity determining region 3 for antibody 9569
AKRLPDLLGGGHHYIDV

SEQ ID NO: 19139 - protein, 9 aa, Homo sapiens
  light chain complementarity determining region 3 for antibody 9570
MQGTHWPHT

SEQ ID NO: 19140 - protein, 13 aa, Homo sapiens
  heavy chain complementarity determining region 3 for antibody 9570
AKEGSSPGPDFEY

SEQ ID NO: 19141 - protein, 9 aa, Homo sapiens
  light chain complementarity determining region 3 for antibody 9571
MQGTHWPHT

SEQ ID NO: 19142 - protein, 11 aa, Homo sapiens
  heavy chain complementarity determining region 3 for antibody 9571
AAVGQQWRLAH

SEQ ID NO: 19143 - protein, 9 aa, Homo sapiens
  light chain complementarity determining region 3 for antibody 9572
MQGTHWPHN

SEQ ID NO: 19144 - protein, 11 aa, Homo sapiens
  heavy chain complementarity determining region 3 for antibody 9572
ATFGISWYFSG

SEQ ID NO: 19145 - protein, 9 aa, Homo sapiens
  light chain complementarity determining region 3 for antibody 9573
MQGTHWPHA

SEQ ID NO: 19146 - protein, 11 aa, Homo sapiens
  heavy chain complementarity determining region 3 for antibody 9573
ATFGQQWRLAH

SEQ ID NO: 19147 - protein, 9 aa, Homo sapiens
  light chain complementarity determining region 3 for antibody 9574
MQGTHWPDT

SEQ ID NO: 19148 - protein, 8 aa, Homo sapiens
  heavy chain complementarity determining region 3 for antibody 9574
ARGSREHF

SEQ ID NO: 19149 - protein, 9 aa, Homo sapiens
  light chain complementarity determining region 3 for antibody 9575
MQGTHWPDT

SEQ ID NO: 19150 - protein, 8 aa, Homo sapiens
  heavy chain complementarity determining region 3 for antibody 9575
ARGNWYAG

SEQ ID NO: 19151 - protein, 10 aa, Homo sapiens
  light chain complementarity determining region 3 for antibody 9576
MQGTHWPAWT

SEQ ID NO: 19152 - protein, 12 aa, Homo sapiens
  heavy chain complementarity determining region 3 for antibody 9576
TTWIKTSVWLDS

SEQ ID NO: 19153 - protein, 10 aa, Homo sapiens
  light chain complementarity determining region 3 for antibody 9577
MQGTHWPAWT

SEQ ID NO: 19154 - protein, 12 aa, Homo sapiens
  heavy chain complementarity determining region 3 for antibody 9577
TTWIKTSAWLDY

SEQ ID NO: 19155 - protein, 10 aa, Homo sapiens
  light chain complementarity determining region 3 for antibody 9578
MQGTHWPAWT

SEQ ID NO: 19156 - protein, 12 aa, Homo sapiens
  heavy chain complementarity determining region 3 for antibody 9578
TTWIKSSVWLDY

SEQ ID NO: 19157 - protein, 10 aa, Homo sapiens
  light chain complementarity determining region 3 for antibody 9579
MQGTHWPAWT

SEQ ID NO: 19158 - protein, 12 aa, Homo sapiens
  heavy chain complementarity determining region 3 for antibody 9579
TPWIKTSVWLDY

SEQ ID NO: 19159 - protein, 10 aa, Homo sapiens
  light chain complementarity determining region 3 for antibody 9580
MQGTHWPAWT

SEQ ID NO: 19160 - protein, 12 aa, Homo sapiens
  heavy chain complementarity determining region 3 for antibody 9580
TAWIKASGWLDY

SEQ ID NO: 19161 - protein, 10 aa, Homo sapiens
  light chain complementarity determining region 3 for antibody 9581
MQGTHWPAWT

SEQ ID NO: 19162 - protein, 9 aa, Homo sapiens
  heavy chain complementarity determining region 3 for antibody 9581
ARSEYQPTY

SEQ ID NO: 19163 - protein, 10 aa, Homo sapiens
  light chain complementarity determining region 3 for antibody 9582
MQGTHWPAWT

SEQ ID NO: 19164 - protein, 10 aa, Homo sapiens
  heavy chain complementarity determining region 3 for antibody 9582
ARERSGSYDI

SEQ ID NO: 19165 - protein, 10 aa, Homo sapiens
  light chain complementarity determining region 3 for antibody 9583
MQGTHWPAWP

SEQ ID NO: 19166 - protein, 12 aa, Homo sapiens
  heavy chain complementarity determining region 3 for antibody 9583
TTWIKTSVWLDY

SEQ ID NO: 19167 - protein, 10 aa, Homo sapiens
  light chain complementarity determining region 3 for antibody 9584
MQGTHWPAWK

SEQ ID NO: 19168 - protein, 13 aa, Homo sapiens
  heavy chain complementarity determining region 3 for antibody 9584
VTWVESNTGWLDY

SEQ ID NO: 19169 - protein, 10 aa, Homo sapiens
  light chain complementarity determining region 3 for antibody 9585
MQGTHWPAWK

SEQ ID NO: 19170 - protein, 12 aa, Homo sapiens
  heavy chain complementarity determining region 3 for antibody 9585
TTWIKTSVWLDY

SEQ ID NO: 19171 - protein, 10 aa, Homo sapiens
  light chain complementarity determining region 3 for antibody 9586
MQGTHWPAGT

SEQ ID NO: 19172 - protein, 13 aa, Homo sapiens
  heavy chain complementarity determining region 3 for antibody 9586
VTWVESNTGWLDY

SEQ ID NO: 19173 - protein, 10 aa, Homo sapiens
  light chain complementarity determining region 3 for antibody 9587
MQGTHWPAGT

SEQ ID NO: 19174 - protein, 12 aa, Homo sapiens
  heavy chain complementarity determining region 3 for antibody 9587
TPWIKTSVWLDY

SEQ ID NO: 19175 - protein, 8 aa, Homo sapiens
  light chain complementarity determining region 3 for antibody 9588
MQGTHWPA

SEQ ID NO: 19176 - protein, 10 aa, Homo sapiens
  heavy chain complementarity determining region 3 for antibody 9588
CRDRWGFGDV

SEQ ID NO: 19177 - protein, 8 aa, Homo sapiens
  light chain complementarity determining region 3 for antibody 9589
MQGTHWPA

SEQ ID NO: 19178 - protein, 12 aa, Homo sapiens
  heavy chain complementarity determining region 3 for antibody 9589
AIVVPGRWDLGD

SEQ ID NO: 19179 - protein, 8 aa, Homo sapiens
  light chain complementarity determining region 3 for antibody 9590
MQGTHWPA

SEQ ID NO: 19180 - protein, 12 aa, Homo sapiens
  heavy chain complementarity determining region 3 for antibody 9590
AIVVPGGWDLDD

SEQ ID NO: 19181 - protein, 8 aa, Homo sapiens
  light chain complementarity determining region 3 for antibody 9591
MQGTHWPA

SEQ ID NO: 19182 - protein, 12 aa, Homo sapiens
  heavy chain complementarity determining region 3 for antibody 9591
AIVIPGRWDLDD

SEQ ID NO: 19183 - protein, 8 aa, Homo sapiens
  light chain complementarity determining region 3 for antibody 9592
MQGTHWPA

SEQ ID NO: 19184 - protein, 12 aa, Homo sapiens
  heavy chain complementarity determining region 3 for antibody 9592
AIVAPGRWDLDD

SEQ ID NO: 19185 - protein, 9 aa, Homo sapiens
  light chain complementarity determining region 3 for antibody 9593
MQGTHWHPS

SEQ ID NO: 19186 - protein, 13 aa, Homo sapiens
  heavy chain complementarity determining region 3 for antibody 9593
ARDTVTNKMGSDY

SEQ ID NO: 19187 - protein, 8 aa, Homo sapiens
  light chain complementarity determining region 3 for antibody 9594
MQGTHWHA

SEQ ID NO: 19188 - protein, 12 aa, Homo sapiens
  heavy chain complementarity determining region 3 for antibody 9594
AIVVPGRWDLDD

SEQ ID NO: 19189 - protein, 9 aa, Homo sapiens
  light chain complementarity determining region 3 for antibody 9595
MQGTHSPIT

SEQ ID NO: 19190 - protein, 17 aa, Homo sapiens
  heavy chain complementarity determining region 3 for antibody 9595
ARNTMVGTWQRQGNLDH

SEQ ID NO: 19191 - protein, 9 aa, Homo sapiens
  light chain complementarity determining region 3 for antibody 9596
MQGTHRPPT

SEQ ID NO: 19192 - protein, 10 aa, Homo sapiens
  heavy chain complementarity determining region 3 for antibody 9596
AKGGTWDSDY

SEQ ID NO: 19193 - protein, 9 aa, Homo sapiens
  light chain complementarity determining region 3 for antibody 9597
MQGTHRPIT

SEQ ID NO: 19194 - protein, 17 aa, Homo sapiens
  heavy chain complementarity determining region 3 for antibody 9597
ARNTMVGTWQRQGNLDH

SEQ ID NO: 19195 - protein, 9 aa, Homo sapiens
  light chain complementarity determining region 3 for antibody 9598
MQGTHGPYT

SEQ ID NO: 19196 - protein, 8 aa, Homo sapiens
  heavy chain complementarity determining region 3 for antibody 9598
ARGVWFAG

SEQ ID NO: 19197 - protein, 10 aa, Homo sapiens
  light chain complementarity determining region 3 for antibody 9599
MQGTHGPPIT

SEQ ID NO: 19198 - protein, 16 aa, Homo sapiens
  heavy chain complementarity determining region 3 for antibody 9599
ARHGVLPAAIHDAFDI

SEQ ID NO: 19199 - protein, 9 aa, Homo sapiens
  light chain complementarity determining region 3 for antibody 9600
MQGTHGPHT

SEQ ID NO: 19200 - protein, 11 aa, Homo sapiens
  heavy chain complementarity determining region 3 for antibody 9600
ATFGISWYFSG

SEQ ID NO: 19201 - protein, 8 aa, Homo sapiens
  light chain complementarity determining region 3 for antibody 9601
MQGTHGPA

SEQ ID NO: 19202 - protein, 12 aa, Homo sapiens
  heavy chain complementarity determining region 3 for antibody 9601
AIVVPGRWDLDD

SEQ ID NO: 19203 - protein, 9 aa, Homo sapiens
  light chain complementarity determining region 3 for antibody 9602
MQGTHCRGT

SEQ ID NO: 19204 - protein, 16 aa, Homo sapiens
  heavy chain complementarity determining region 3 for antibody 9602
VRDLAGFTRGGSSFDY

SEQ ID NO: 19205 - protein, 9 aa, Homo sapiens
  light chain complementarity determining region 3 for antibody 9603
MQGTHCPIN

SEQ ID NO: 19206 - protein, 13 aa, Homo sapiens
  heavy chain complementarity determining region 3 for antibody 9603
AKEGSSAGPDFDY

SEQ ID NO: 19207 - protein, 9 aa, Homo sapiens
  light chain complementarity determining region 3 for antibody 9604
MQGSHWPYT

SEQ ID NO: 19208 - protein, 10 aa, Homo sapiens
  heavy chain complementarity determining region 3 for antibody 9604
ARETSSSYDI

SEQ ID NO: 19209 - protein, 9 aa, Homo sapiens
  light chain complementarity determining region 3 for antibody 9605
MQGSHWPYT

SEQ ID NO: 19210 - protein, 10 aa, Homo sapiens
  heavy chain complementarity determining region 3 for antibody 9605
ARETSGAYDI

SEQ ID NO: 19211 - protein, 10 aa, Homo sapiens
  light chain complementarity determining region 3 for antibody 9606
MQGSHWPPYA

SEQ ID NO: 19212 - protein, 17 aa, Homo sapiens
  heavy chain complementarity determining region 3 for antibody 9606
ARGALGYFDRSGSSFDY

SEQ ID NO: 19213 - protein, 9 aa, Homo sapiens
  light chain complementarity determining region 3 for antibody 9607
MQGSHWPHT

SEQ ID NO: 19214 - protein, 11 aa, Homo sapiens
  heavy chain complementarity determining region 3 for antibody 9607
ATFGQQWRLAH

SEQ ID NO: 19215 - protein, 9 aa, Homo sapiens
  light chain complementarity determining region 3 for antibody 9608
MQGSHWPFT

SEQ ID NO: 19216 - protein, 10 aa, Homo sapiens
  heavy chain complementarity determining region 3 for antibody 9608
ARETSGSYDI

SEQ ID NO: 19217 - protein, 9 aa, Homo sapiens
  light chain complementarity determining region 3 for antibody 9609
MQGSHGPYT

SEQ ID NO: 19218 - protein, 10 aa, Homo sapiens
  heavy chain complementarity determining region 3 for antibody 9609
ARETSGSYDI

SEQ ID NO: 19219 - protein, 9 aa, Homo sapiens
  light chain complementarity determining region 3 for antibody 9610
MQGRHWPHT

SEQ ID NO: 19220 - protein, 11 aa, Homo sapiens
  heavy chain complementarity determining region 3 for antibody 9610
ATFGQQWRLAH

SEQ ID NO: 19221 - protein, 9 aa, Homo sapiens
  light chain complementarity determining region 3 for antibody 9611
MQGQHWPRT

SEQ ID NO: 19222 - protein, 10 aa, Homo sapiens
  heavy chain complementarity determining region 3 for antibody 9611
VRDYWNSIDY

SEQ ID NO: 19223 - protein, 9 aa, Homo sapiens
  light chain complementarity determining region 3 for antibody 9612
MQGPHWPYT

SEQ ID NO: 19224 - protein, 8 aa, Homo sapiens
  heavy chain complementarity determining region 3 for antibody 9612
ARGNWYAG

SEQ ID NO: 19225 - protein, 9 aa, Homo sapiens
  light chain complementarity determining region 3 for antibody 9613
MQGPHWPWT

SEQ ID NO: 19226 - protein, 12 aa, Homo sapiens
  heavy chain complementarity determining region 3 for antibody 9613
AIVVPGRWDLDD

SEQ ID NO: 19227 - protein, 9 aa, Homo sapiens
  light chain complementarity determining region 3 for antibody 9614
MQGPHWPPT

SEQ ID NO: 19228 - protein, 11 aa, Homo sapiens
  heavy chain complementarity determining region 3 for antibody 9614
ATFGQQWRLAH

SEQ ID NO: 19229 - protein, 10 aa, Homo sapiens
  light chain complementarity determining region 3 for antibody 9615
MQGPHWPAGT

SEQ ID NO: 19230 - protein, 12 aa, Homo sapiens
  heavy chain complementarity determining region 3 for antibody 9615
TTWIKTSVWLDY

SEQ ID NO: 19231 - protein, 9 aa, Homo sapiens
  light chain complementarity determining region 3 for antibody 9616
MQGNHWPWT

SEQ ID NO: 19232 - protein, 12 aa, Homo sapiens
  heavy chain complementarity determining region 3 for antibody 9616
AIVVPGRWDLDD

SEQ ID NO: 19233 - protein, 9 aa, Homo sapiens
  light chain complementarity determining region 3 for antibody 9617
MQGLRALPV

SEQ ID NO: 19234 - protein, 15 aa, Homo sapiens
  heavy chain complementarity determining region 3 for antibody 9617
SRDASADSYPDAFDV

SEQ ID NO: 19235 - protein, 9 aa, Homo sapiens
  light chain complementarity determining region 3 for antibody 9618
MQGLQTPYT

SEQ ID NO: 19236 - protein, 11 aa, Homo sapiens
  heavy chain complementarity determining region 3 for antibody 9618
ATFGQQWRLAH

SEQ ID NO: 19237 - protein, 9 aa, Homo sapiens
  light chain complementarity determining region 3 for antibody 9619
MQGLQTPLT

SEQ ID NO: 19238 - protein, 17 aa, Homo sapiens
  heavy chain complementarity determining region 3 for antibody 9619
ANRRPLATIYFFYGMDV

SEQ ID NO: 19239 - protein, 9 aa, Homo sapiens
  light chain complementarity determining region 3 for antibody 9620
MQGLQSPGT

SEQ ID NO: 19240 - protein, 12 aa, Homo sapiens
  heavy chain complementarity determining region 3 for antibody 9620
ARHLQWLVGLEY

SEQ ID NO: 19241 - protein, 9 aa, Homo sapiens
  light chain complementarity determining region 3 for antibody 9621
MQGLQLPLT

SEQ ID NO: 19242 - protein, 15 aa, Homo sapiens
  heavy chain complementarity determining region 3 for antibody 9621
VRDPGGLAYFYNMEV

SEQ ID NO: 19243 - protein, 9 aa, Homo sapiens
  light chain complementarity determining region 3 for antibody 9622
MQGLQAPVP

SEQ ID NO: 19244 - protein, 12 aa, Homo sapiens
  heavy chain complementarity determining region 3 for antibody 9622
MRGNPPSSSLDY

SEQ ID NO: 19245 - protein, 9 aa, Homo sapiens
  light chain complementarity determining region 3 for antibody 9623
MQGLQAPGT

SEQ ID NO: 19246 - protein, 12 aa, Homo sapiens
  heavy chain complementarity determining region 3 for antibody 9623
MRGNPPSSSLDY

SEQ ID NO: 19247 - protein, 9 aa, Homo sapiens
  light chain complementarity determining region 3 for antibody 9624
MQGLQAPAT

SEQ ID NO: 19248 - protein, 12 aa, Homo sapiens
  heavy chain complementarity determining region 3 for antibody 9624
MRGNPPSSSLDY

SEQ ID NO: 19249 - protein, 9 aa, Homo sapiens
  light chain complementarity determining region 3 for antibody 9625
MQGLHLPGT

SEQ ID NO: 19250 - protein, 13 aa, Homo sapiens
  heavy chain complementarity determining region 3 for antibody 9625
TGGPNCSAGGCLA

SEQ ID NO: 19251 - protein, 9 aa, Homo sapiens
  light chain complementarity determining region 3 for antibody 9626
MQGLHGLPV

SEQ ID NO: 19252 - protein, 15 aa, Homo sapiens
  heavy chain complementarity determining region 3 for antibody 9626
SRDASADSSPDAFDV

SEQ ID NO: 19253 - protein, 9 aa, Homo sapiens
  light chain complementarity determining region 3 for antibody 9627
MQGLHGLLV

SEQ ID NO: 19254 - protein, 15 aa, Homo sapiens
  heavy chain complementarity determining region 3 for antibody 9627
SRDASADSFPDAFDV

SEQ ID NO: 19255 - protein, 9 aa, Homo sapiens
  light chain complementarity determining region 3 for antibody 9628
MQGKHWPST

SEQ ID NO: 19256 - protein, 12 aa, Homo sapiens
  heavy chain complementarity determining region 3 for antibody 9628
ARGQKLLWFGEL

SEQ ID NO: 19257 - protein, 9 aa, Homo sapiens
  light chain complementarity determining region 3 for antibody 9629
MQGKHWPIT

SEQ ID NO: 19258 - protein, 17 aa, Homo sapiens
  heavy chain complementarity determining region 3 for antibody 9629
ARNTMVGTWQRQGNLDH

SEQ ID NO: 19259 - protein, 9 aa, Homo sapiens
  light chain complementarity determining region 3 for antibody 9630
MQGKHWPHP

SEQ ID NO: 19260 - protein, 11 aa, Homo sapiens
  heavy chain complementarity determining region 3 for antibody 9630
ATFGQQWRLAH

SEQ ID NO: 19261 - protein, 8 aa, Homo sapiens
  light chain complementarity determining region 3 for antibody 9631
MQGKHWPA

SEQ ID NO: 19262 - protein, 12 aa, Homo sapiens
  heavy chain complementarity determining region 3 for antibody 9631
AIVVPGRWDLDD

SEQ ID NO: 19263 - protein, 9 aa, Homo sapiens
  light chain complementarity determining region 3 for antibody 9632
MQGKEGPYT

SEQ ID NO: 19264 - protein, 12 aa, Homo sapiens
  heavy chain complementarity determining region 3 for antibody 9632
AIVVPGRWDLDD

SEQ ID NO: 19265 - protein, 9 aa, Homo sapiens
  light chain complementarity determining region 3 for antibody 9633
MQGINWPWT

SEQ ID NO: 19266 - protein, 12 aa, Homo sapiens
  heavy chain complementarity determining region 3 for antibody 9633
TRDPEGDEDFDY

SEQ ID NO: 19267 - protein, 9 aa, Homo sapiens
  light chain complementarity determining region 3 for antibody 9634
MQGIHWPWT

SEQ ID NO: 19268 - protein, 10 aa, Homo sapiens
  heavy chain complementarity determining region 3 for antibody 9634
CRDREGFGDV

SEQ ID NO: 19269 - protein, 9 aa, Homo sapiens
  light chain complementarity determining region 3 for antibody 9635
MQGIHWPWT

SEQ ID NO: 19270 - protein, 11 aa, Homo sapiens
  heavy chain complementarity determining region 3 for antibody 9635
ARSPATGTPDY

SEQ ID NO: 19271 - protein, 9 aa, Homo sapiens
  light chain complementarity determining region 3 for antibody 9636
MQGIHWPWT

SEQ ID NO: 19272 - protein, 11 aa, Homo sapiens
  heavy chain complementarity determining region 3 for antibody 9636
ARSLATGTTDY

SEQ ID NO: 19273 - protein, 9 aa, Homo sapiens
  light chain complementarity determining region 3 for antibody 9637
MQGIHWPWT

SEQ ID NO: 19274 - protein, 16 aa, Homo sapiens
  heavy chain complementarity determining region 3 for antibody 9637
ARGHTNPGERRGGSDF

SEQ ID NO: 19275 - protein, 9 aa, Homo sapiens
  light chain complementarity determining region 3 for antibody 9638
MQGIHWPWT

SEQ ID NO: 19276 - protein, 14 aa, Homo sapiens
  heavy chain complementarity determining region 3 for antibody 9638
AKDEYWAAAGPLDY

SEQ ID NO: 19277 - protein, 9 aa, Homo sapiens
  light chain complementarity determining region 3 for antibody 9639
MQGIHWPWP

SEQ ID NO: 19278 - protein, 11 aa, Homo sapiens
  heavy chain complementarity determining region 3 for antibody 9639
ARSPATGTTDY

SEQ ID NO: 19279 - protein, 9 aa, Homo sapiens
  light chain complementarity determining region 3 for antibody 9640
MQGIHWPWA

SEQ ID NO: 19280 - protein, 12 aa, Homo sapiens
  heavy chain complementarity determining region 3 for antibody 9640
TRDPEGDEDFDY

SEQ ID NO: 19281 - protein, 9 aa, Homo sapiens
  light chain complementarity determining region 3 for antibody 9641
MQGIHWPGT

SEQ ID NO: 19282 - protein, 12 aa, Homo sapiens
  heavy chain complementarity determining region 3 for antibody 9641
TRDPEGDEDFDY

SEQ ID NO: 19283 - protein, 9 aa, Homo sapiens
  light chain complementarity determining region 3 for antibody 9642
MQGIHWPGT

SEQ ID NO: 19284 - protein, 14 aa, Homo sapiens
  heavy chain complementarity determining region 3 for antibody 9642
ANYRASIGANCFDP

SEQ ID NO: 19285 - protein, 9 aa, Homo sapiens
  light chain complementarity determining region 3 for antibody 9643
MQGIHGPWT

SEQ ID NO: 19286 - protein, 11 aa, Homo sapiens
  heavy chain complementarity determining region 3 for antibody 9643
ARSPATGTTDY

SEQ ID NO: 19287 - protein, 9 aa, Homo sapiens
  light chain complementarity determining region 3 for antibody 9644
MQGIHGPGT

SEQ ID NO: 19288 - protein, 11 aa, Homo sapiens
  heavy chain complementarity determining region 3 for antibody 9644
ARSPATGTTDY

SEQ ID NO: 19289 - protein, 8 aa, Homo sapiens
  light chain complementarity determining region 3 for antibody 9645
MQGAQGPT

SEQ ID NO: 19290 - protein, 18 aa, Homo sapiens
  heavy chain complementarity determining region 3 for antibody 9645
AGGDYPEARTGYYLDFDY

SEQ ID NO: 19291 - protein, 9 aa, Homo sapiens
  light chain complementarity determining region 3 for antibody 9646
MQGAHWPWT

SEQ ID NO: 19292 - protein, 16 aa, Homo sapiens
  heavy chain complementarity determining region 3 for antibody 9646
ARGHTNPGERRGGSDF

SEQ ID NO: 19293 - protein, 9 aa, Homo sapiens
  light chain complementarity determining region 3 for antibody 9647
MQFRQTPLT

SEQ ID NO: 19294 - protein, 10 aa, Homo sapiens
  heavy chain complementarity determining region 3 for antibody 9647
ARERSGSYDI

SEQ ID NO: 19295 - protein, 9 aa, Homo sapiens
  light chain complementarity determining region 3 for antibody 9648
MQFLQTTLT

SEQ ID NO: 19296 - protein, 10 aa, Homo sapiens
  heavy chain complementarity determining region 3 for antibody 9648
ARERSGSYDI

SEQ ID NO: 19297 - protein, 9 aa, Homo sapiens
  light chain complementarity determining region 3 for antibody 9649
MQFLQTPPT

SEQ ID NO: 19298 - protein, 9 aa, Homo sapiens
  heavy chain complementarity determining region 3 for antibody 9649
ARSEYQPTY

SEQ ID NO: 19299 - protein, 9 aa, Homo sapiens
  light chain complementarity determining region 3 for antibody 9650
MQFLQTPPT

SEQ ID NO: 19300 - protein, 10 aa, Homo sapiens
  heavy chain complementarity determining region 3 for antibody 9650
ARERSGSYDV

SEQ ID NO: 19301 - protein, 9 aa, Homo sapiens
  light chain complementarity determining region 3 for antibody 9651
MQFLQTPPT

SEQ ID NO: 19302 - protein, 10 aa, Homo sapiens
  heavy chain complementarity determining region 3 for antibody 9651
ARERSGSFDI

SEQ ID NO: 19303 - protein, 9 aa, Homo sapiens
  light chain complementarity determining region 3 for antibody 9652
MQFLQTPLT

SEQ ID NO: 19304 - protein, 10 aa, Homo sapiens
  heavy chain complementarity determining region 3 for antibody 9652
VRETSGSYDI

SEQ ID NO: 19305 - protein, 9 aa, Homo sapiens
  light chain complementarity determining region 3 for antibody 9653
MQFLQTPLT

SEQ ID NO: 19306 - protein, 10 aa, Homo sapiens
  heavy chain complementarity determining region 3 for antibody 9653
VGGEGWLTDF

SEQ ID NO: 19307 - protein, 9 aa, Homo sapiens
  light chain complementarity determining region 3 for antibody 9654
MQFLQTPLT

SEQ ID NO: 19308 - protein, 13 aa, Homo sapiens
  heavy chain complementarity determining region 3 for antibody 9654
TKEGSSAGPDFVY

SEQ ID NO: 19309 - protein, 9 aa, Homo sapiens
  light chain complementarity determining region 3 for antibody 9655
MQFLQTPLT

SEQ ID NO: 19310 - protein, 10 aa, Homo sapiens
  heavy chain complementarity determining region 3 for antibody 9655
SRERSGSYDI

SEQ ID NO: 19311 - protein, 9 aa, Homo sapiens
  light chain complementarity determining region 3 for antibody 9656
MQFLQTPLT

SEQ ID NO: 19312 - protein, 16 aa, Homo sapiens
  heavy chain complementarity determining region 3 for antibody 9656
ASLNRGDKEFGVPPAL

SEQ ID NO: 19313 - protein, 9 aa, Homo sapiens
  light chain complementarity determining region 3 for antibody 9657
MQFLQTPLT

SEQ ID NO: 19314 - protein, 9 aa, Homo sapiens
  heavy chain complementarity determining region 3 for antibody 9657
ARSEYQPTY

SEQ ID NO: 19315 - protein, 9 aa, Homo sapiens
  light chain complementarity determining region 3 for antibody 9658
MQFLQTPLT

SEQ ID NO: 19316 - protein, 11 aa, Homo sapiens
  heavy chain complementarity determining region 3 for antibody 9658
ARRSLGGAFDY

SEQ ID NO: 19317 - protein, 9 aa, Homo sapiens
  light chain complementarity determining region 3 for antibody 9659
MQFLQTPLT

SEQ ID NO: 19318 - protein, 10 aa, Homo sapiens
  heavy chain complementarity determining region 3 for antibody 9659
ARQRSGSYDI

SEQ ID NO: 19319 - protein, 9 aa, Homo sapiens
  light chain complementarity determining region 3 for antibody 9660
MQFLQTPLT

SEQ ID NO: 19320 - protein, 10 aa, Homo sapiens
  heavy chain complementarity determining region 3 for antibody 9660
ARKRSGSYDI

SEQ ID NO: 19321 - protein, 9 aa, Homo sapiens
  light chain complementarity determining region 3 for antibody 9661
MQFLQTPLT

SEQ ID NO: 19322 - protein, 10 aa, Homo sapiens
  heavy chain complementarity determining region 3 for antibody 9661
ARERSVSYDI

SEQ ID NO: 19323 - protein, 9 aa, Homo sapiens
  light chain complementarity determining region 3 for antibody 9662
MQFLQTPLT

SEQ ID NO: 19324 - protein, 10 aa, Homo sapiens
  heavy chain complementarity determining region 3 for antibody 9662
ARERSGSYEI

SEQ ID NO: 19325 - protein, 9 aa, Homo sapiens
  light chain complementarity determining region 3 for antibody 9663
MQFLQTPLT

SEQ ID NO: 19326 - protein, 10 aa, Homo sapiens
  heavy chain complementarity determining region 3 for antibody 9663
ARERSGSYDS

SEQ ID NO: 19327 - protein, 9 aa, Homo sapiens
  light chain complementarity determining region 3 for antibody 9664
MQFLQTPLT

SEQ ID NO: 19328 - protein, 10 aa, Homo sapiens
  heavy chain complementarity determining region 3 for antibody 9664
ARERSGSSDI

SEQ ID NO: 19329 - protein, 9 aa, Homo sapiens
  light chain complementarity determining region 3 for antibody 9665
MQFLQTPLT

SEQ ID NO: 19330 - protein, 10 aa, Homo sapiens
  heavy chain complementarity determining region 3 for antibody 9665
AREKSGSYDI

SEQ ID NO: 19331 - protein, 9 aa, Homo sapiens
  light chain complementarity determining region 3 for antibody 9666
MQFLQTPLT

SEQ ID NO: 19332 - protein, 19 aa, Homo sapiens
  heavy chain complementarity determining region 3 for antibody 9666
AREAVRCRDGVCYNATFDI

SEQ ID NO: 19333 - protein, 9 aa, Homo sapiens
  light chain complementarity determining region 3 for antibody 9667
MQFLQTPLT

SEQ ID NO: 19334 - protein, 12 aa, Homo sapiens
  heavy chain complementarity determining region 3 for antibody 9667
ARDKGGLNGMDV

SEQ ID NO: 19335 - protein, 9 aa, Homo sapiens
  light chain complementarity determining region 3 for antibody 9668
MQFLQTPLT

SEQ ID NO: 19336 - protein, 14 aa, Homo sapiens
  heavy chain complementarity determining region 3 for antibody 9668
ARASGGDTDFLIDF

SEQ ID NO: 19337 - protein, 9 aa, Homo sapiens
  light chain complementarity determining region 3 for antibody 9669
MQFLQTPLT

SEQ ID NO: 19338 - protein, 10 aa, Homo sapiens
  heavy chain complementarity determining region 3 for antibody 9669
AKERSGSYDI

SEQ ID NO: 19339 - protein, 9 aa, Homo sapiens
  light chain complementarity determining region 3 for antibody 9670
MQFLQTPLT

SEQ ID NO: 19340 - protein, 13 aa, Homo sapiens
  heavy chain complementarity determining region 3 for antibody 9670
AKEGVGGGLDLDY

SEQ ID NO: 19341 - protein, 9 aa, Homo sapiens
  light chain complementarity determining region 3 for antibody 9671
MQFLQTPLT

SEQ ID NO: 19342 - protein, 8 aa, Homo sapiens
  heavy chain complementarity determining region 3 for antibody 9671
AGWGYGNY

SEQ ID NO: 19343 - protein, 9 aa, Homo sapiens
  light chain complementarity determining region 3 for antibody 9672
MQFLQTPLI

SEQ ID NO: 19344 - protein, 10 aa, Homo sapiens
  heavy chain complementarity determining region 3 for antibody 9672
ARERSGSYDI

SEQ ID NO: 19345 - protein, 9 aa, Homo sapiens
  light chain complementarity determining region 3 for antibody 9673
MQFLQTPIT

SEQ ID NO: 19346 - protein, 10 aa, Homo sapiens
  heavy chain complementarity determining region 3 for antibody 9673
ARERSGSYDI

SEQ ID NO: 19347 - protein, 9 aa, Homo sapiens
  light chain complementarity determining region 3 for antibody 9674
MQFLKTPLP

SEQ ID NO: 19348 - protein, 10 aa, Homo sapiens
  heavy chain complementarity determining region 3 for antibody 9674
ARERSGSYDI

SEQ ID NO: 19349 - protein, 9 aa, Homo sapiens
  light chain complementarity determining region 3 for antibody 9675
MQDTHWPVG

SEQ ID NO: 19350 - protein, 8 aa, Homo sapiens
  heavy chain complementarity determining region 3 for antibody 9675
VRGPSAQY

SEQ ID NO: 19351 - protein, 9 aa, Homo sapiens
  light chain complementarity determining region 3 for antibody 9676
MQDTHWPRT

SEQ ID NO: 19352 - protein, 12 aa, Homo sapiens
  heavy chain complementarity determining region 3 for antibody 9676
STDVETTFPSVS

SEQ ID NO: 19353 - protein, 9 aa, Homo sapiens
  light chain complementarity determining region 3 for antibody 9677
MQAVQTPHT

SEQ ID NO: 19354 - protein, 10 aa, Homo sapiens
  heavy chain complementarity determining region 3 for antibody 9677
ARDGGSGTAR

SEQ ID NO: 19355 - protein, 9 aa, Homo sapiens
  light chain complementarity determining region 3 for antibody 9678
MQATYWPWT

SEQ ID NO: 19356 - protein, 12 aa, Homo sapiens
  heavy chain complementarity determining region 3 for antibody 9678
ARGPLRMAAGTS

SEQ ID NO: 19357 - protein, 9 aa, Homo sapiens
  light chain complementarity determining region 3 for antibody 9679
MQATQFPRT

SEQ ID NO: 19358 - protein, 10 aa, Homo sapiens
  heavy chain complementarity determining region 3 for antibody 9679
VRGGLAGEIC

SEQ ID NO: 19359 - protein, 9 aa, Homo sapiens
  light chain complementarity determining region 3 for antibody 9680
MQATPWPWT

SEQ ID NO: 19360 - protein, 12 aa, Homo sapiens
  heavy chain complementarity determining region 3 for antibody 9680
ARGPLKMAGGSS

SEQ ID NO: 19361 - protein, 9 aa, Homo sapiens
  light chain complementarity determining region 3 for antibody 9681
MQATNWPRT

SEQ ID NO: 19362 - protein, 12 aa, Homo sapiens
  heavy chain complementarity determining region 3 for antibody 9681
STDVETTFPSVS

SEQ ID NO: 19363 - protein, 9 aa, Homo sapiens
  light chain complementarity determining region 3 for antibody 9682
MQATHWQWT

SEQ ID NO: 19364 - protein, 12 aa, Homo sapiens
  heavy chain complementarity determining region 3 for antibody 9682
ARGPLKMAGGSS

SEQ ID NO: 19365 - protein, 9 aa, Homo sapiens
  light chain complementarity determining region 3 for antibody 9683
MQATHWPWT

SEQ ID NO: 19366 - protein, 14 aa, Homo sapiens
  heavy chain complementarity determining region 3 for antibody 9683
VRGYCSGGTCYSGS

SEQ ID NO: 19367 - protein, 9 aa, Homo sapiens
  light chain complementarity determining region 3 for antibody 9684
MQATHWPWT

SEQ ID NO: 19368 - protein, 14 aa, Homo sapiens
  heavy chain complementarity determining region 3 for antibody 9684
VRDYCSGGTRYSGS

SEQ ID NO: 19369 - protein, 9 aa, Homo sapiens
  light chain complementarity determining region 3 for antibody 9685
MQATHWPWT

SEQ ID NO: 19370 - protein, 11 aa, Homo sapiens
  heavy chain complementarity determining region 3 for antibody 9685
ATFGQQWRLAH

SEQ ID NO: 19371 - protein, 9 aa, Homo sapiens
  light chain complementarity determining region 3 for antibody 9686
MQATHWPWT

SEQ ID NO: 19372 - protein, 12 aa, Homo sapiens
  heavy chain complementarity determining region 3 for antibody 9686
ARLDWNYRAFDI

SEQ ID NO: 19373 - protein, 9 aa, Homo sapiens
  light chain complementarity determining region 3 for antibody 9687
MQATHWPWT

SEQ ID NO: 19374 - protein, 12 aa, Homo sapiens
  heavy chain complementarity determining region 3 for antibody 9687
ARGTLKMAGGSS

SEQ ID NO: 19375 - protein, 9 aa, Homo sapiens
  light chain complementarity determining region 3 for antibody 9688
MQATHWPWT

SEQ ID NO: 19376 - protein, 12 aa, Homo sapiens
  heavy chain complementarity determining region 3 for antibody 9688
ARGPLKRAGGSS

SEQ ID NO: 19377 - protein, 9 aa, Homo sapiens
  light chain complementarity determining region 3 for antibody 9689
MQATHWPWT

SEQ ID NO: 19378 - protein, 12 aa, Homo sapiens
  heavy chain complementarity determining region 3 for antibody 9689
ARGPLKMAGSSS

SEQ ID NO: 19379 - protein, 9 aa, Homo sapiens
  light chain complementarity determining region 3 for antibody 9690
MQATHWPWT

SEQ ID NO: 19380 - protein, 12 aa, Homo sapiens
  heavy chain complementarity determining region 3 for antibody 9690
ARGPLKMAGGSR

SEQ ID NO: 19381 - protein, 9 aa, Homo sapiens
  light chain complementarity determining region 3 for antibody 9691
MQATHWPWT

SEQ ID NO: 19382 - protein, 12 aa, Homo sapiens
  heavy chain complementarity determining region 3 for antibody 9691
ARGPLKMACGSS

SEQ ID NO: 19383 - protein, 9 aa, Homo sapiens
  light chain complementarity determining region 3 for antibody 9692
MQATHWPWT

SEQ ID NO: 19384 - protein, 13 aa, Homo sapiens
  heavy chain complementarity determining region 3 for antibody 9692
ARGINILSNNFLH

SEQ ID NO: 19385 - protein, 9 aa, Homo sapiens
  light chain complementarity determining region 3 for antibody 9693
MQATHWPWT

SEQ ID NO: 19386 - protein, 13 aa, Homo sapiens
  heavy chain complementarity determining region 3 for antibody 9693
ARGHGPGSLLIDY

SEQ ID NO: 19387 - protein, 9 aa, Homo sapiens
  light chain complementarity determining region 3 for antibody 9694
MQATHWPWT

SEQ ID NO: 19388 - protein, 14 aa, Homo sapiens
  heavy chain complementarity determining region 3 for antibody 9694
ARGHFDSTGFRLDY

SEQ ID NO: 19389 - protein, 9 aa, Homo sapiens
  light chain complementarity determining region 3 for antibody 9695
MQATHWPWT

SEQ ID NO: 19390 - protein, 13 aa, Homo sapiens
  heavy chain complementarity determining region 3 for antibody 9695
AKEGSSPGPDFDY

SEQ ID NO: 19391 - protein, 9 aa, Homo sapiens
  light chain complementarity determining region 3 for antibody 9696
MQATHWPWP

SEQ ID NO: 19392 - protein, 14 aa, Homo sapiens
  heavy chain complementarity determining region 3 for antibody 9696
VRDYCSGGTCYSGS

SEQ ID NO: 19393 - protein, 9 aa, Homo sapiens
  light chain complementarity determining region 3 for antibody 9697
MQATHWPRT

SEQ ID NO: 19394 - protein, 12 aa, Homo sapiens
  heavy chain complementarity determining region 3 for antibody 9697
STDVETTSPSVS

SEQ ID NO: 19395 - protein, 9 aa, Homo sapiens
  light chain complementarity determining region 3 for antibody 9698
MQATHWPRT

SEQ ID NO: 19396 - protein, 12 aa, Homo sapiens
  heavy chain complementarity determining region 3 for antibody 9698
STDVETTFHSVS

SEQ ID NO: 19397 - protein, 9 aa, Homo sapiens
  light chain complementarity determining region 3 for antibody 9699
MQATHWPRT

SEQ ID NO: 19398 - protein, 12 aa, Homo sapiens
  heavy chain complementarity determining region 3 for antibody 9699
STDVETPFPSVA

SEQ ID NO: 19399 - protein, 9 aa, Homo sapiens
  light chain complementarity determining region 3 for antibody 9700
MQATHWPRT

SEQ ID NO: 19400 - protein, 12 aa, Homo sapiens
  heavy chain complementarity determining region 3 for antibody 9700
STDVEATFPSVS

SEQ ID NO: 19401 - protein, 9 aa, Homo sapiens
  light chain complementarity determining region 3 for antibody 9701
MQATHWPRT

SEQ ID NO: 19402 - protein, 12 aa, Homo sapiens
  heavy chain complementarity determining region 3 for antibody 9701
SPDVETTFPSVS

SEQ ID NO: 19403 - protein, 9 aa, Homo sapiens
  light chain complementarity determining region 3 for antibody 9702
MQATHWPRT

SEQ ID NO: 19404 - protein, 10 aa, Homo sapiens
  heavy chain complementarity determining region 3 for antibody 9702
ASEISGAYGV

SEQ ID NO: 19405 - protein, 9 aa, Homo sapiens
  light chain complementarity determining region 3 for antibody 9703
MQATHWPRT

SEQ ID NO: 19406 - protein, 9 aa, Homo sapiens
  heavy chain complementarity determining region 3 for antibody 9703
ARSEYQPTY

SEQ ID NO: 19407 - protein, 9 aa, Homo sapiens
  light chain complementarity determining region 3 for antibody 9704
MQATHWPRT

SEQ ID NO: 19408 - protein, 12 aa, Homo sapiens
  heavy chain complementarity determining region 3 for antibody 9704
ARLDWNYRAFDI

SEQ ID NO: 19409 - protein, 9 aa, Homo sapiens
  light chain complementarity determining region 3 for antibody 9705
MQATHWPRT

SEQ ID NO: 19410 - protein, 12 aa, Homo sapiens
  heavy chain complementarity determining region 3 for antibody 9705
ARGPLKMAGGSS

SEQ ID NO: 19411 - protein, 9 aa, Homo sapiens
  light chain complementarity determining region 3 for antibody 9706
MQATHWPRT

SEQ ID NO: 19412 - protein, 10 aa, Homo sapiens
  heavy chain complementarity determining region 3 for antibody 9706
ARERSGSYDI

SEQ ID NO: 19413 - protein, 9 aa, Homo sapiens
  light chain complementarity determining region 3 for antibody 9707
MQATHWPRT

SEQ ID NO: 19414 - protein, 12 aa, Homo sapiens
  heavy chain complementarity determining region 3 for antibody 9707
ARDKGGRNGMDV

SEQ ID NO: 19415 - protein, 9 aa, Homo sapiens
  light chain complementarity determining region 3 for antibody 9708
MQATHWPRT

SEQ ID NO: 19416 - protein, 12 aa, Homo sapiens
  heavy chain complementarity determining region 3 for antibody 9708
AGSRSAGGSVDF

SEQ ID NO: 19417 - protein, 9 aa, Homo sapiens
  light chain complementarity determining region 3 for antibody 9709
MQATHWPRT

SEQ ID NO: 19418 - protein, 12 aa, Homo sapiens
  heavy chain complementarity determining region 3 for antibody 9709
AGSRAVGGSVDF

SEQ ID NO: 19419 - protein, 9 aa, Homo sapiens
  light chain complementarity determining region 3 for antibody 9710
MQATHWPRP

SEQ ID NO: 19420 - protein, 12 aa, Homo sapiens
  heavy chain complementarity determining region 3 for antibody 9710
AGSRSVGGSVDF

SEQ ID NO: 19421 - protein, 10 aa, Homo sapiens
  light chain complementarity determining region 3 for antibody 9711
MQATHWPPVT

SEQ ID NO: 19422 - protein, 8 aa, Homo sapiens
  heavy chain complementarity determining region 3 for antibody 9711
ARDASGSI

SEQ ID NO: 19423 - protein, 9 aa, Homo sapiens
  light chain complementarity determining region 3 for antibody 9712
MQATHWPPT

SEQ ID NO: 19424 - protein, 10 aa, Homo sapiens
  heavy chain complementarity determining region 3 for antibody 9712
ARDYYRSIDY

SEQ ID NO: 19425 - protein, 9 aa, Homo sapiens
  light chain complementarity determining region 3 for antibody 9713
MQATHRPRT

SEQ ID NO: 19426 - protein, 12 aa, Homo sapiens
  heavy chain complementarity determining region 3 for antibody 9713
STDVETTFPSVS

SEQ ID NO: 19427 - protein, 9 aa, Homo sapiens
  light chain complementarity determining region 3 for antibody 9714
MQATHLPRT

SEQ ID NO: 19428 - protein, 12 aa, Homo sapiens
  heavy chain complementarity determining region 3 for antibody 9714
AGSRSVGGSVDF

SEQ ID NO: 19429 - protein, 9 aa, Homo sapiens
  light chain complementarity determining region 3 for antibody 9715
MQATHGPRT

SEQ ID NO: 19430 - protein, 12 aa, Homo sapiens
  heavy chain complementarity determining region 3 for antibody 9715
AGSRSVGGSVDF

SEQ ID NO: 19431 - protein, 9 aa, Homo sapiens
  light chain complementarity determining region 3 for antibody 9716
MQATHCPRT

SEQ ID NO: 19432 - protein, 12 aa, Homo sapiens
  heavy chain complementarity determining region 3 for antibody 9716
STDVETTFPSVS

SEQ ID NO: 19433 - protein, 9 aa, Homo sapiens
  light chain complementarity determining region 3 for antibody 9717
MQASYWPNT

SEQ ID NO: 19434 - protein, 11 aa, Homo sapiens
  heavy chain complementarity determining region 3 for antibody 9717
ARGDGRNGLEY

SEQ ID NO: 19435 - protein, 9 aa, Homo sapiens
  light chain complementarity determining region 3 for antibody 9718
MQASHWPGT

SEQ ID NO: 19436 - protein, 10 aa, Homo sapiens
  heavy chain complementarity determining region 3 for antibody 9718
ARDVRWSYAF

SEQ ID NO: 19437 - protein, 9 aa, Homo sapiens
  light chain complementarity determining region 3 for antibody 9719
MQAPHWPWT

SEQ ID NO: 19438 - protein, 14 aa, Homo sapiens
  heavy chain complementarity determining region 3 for antibody 9719
VRDYCSGGTCYSGS

SEQ ID NO: 19439 - protein, 9 aa, Homo sapiens
  light chain complementarity determining region 3 for antibody 9720
MQAPHWPRT

SEQ ID NO: 19440 - protein, 12 aa, Homo sapiens
  heavy chain complementarity determining region 3 for antibody 9720
STDVETTFPSVS

SEQ ID NO: 19441 - protein, 8 aa, Homo sapiens
  light chain complementarity determining region 3 for antibody 9721
MQAPHRLT

SEQ ID NO: 19442 - protein, 8 aa, Homo sapiens
  heavy chain complementarity determining region 3 for antibody 9721
VSQTGHNY

SEQ ID NO: 19443 - protein, 9 aa, Homo sapiens
  light chain complementarity determining region 3 for antibody 9722
MQALRTPYT

SEQ ID NO: 19444 - protein, 15 aa, Homo sapiens
  heavy chain complementarity determining region 3 for antibody 9722
ARERRMFGELRGFDV

SEQ ID NO: 19445 - protein, 9 aa, Homo sapiens
  light chain complementarity determining region 3 for antibody 9723
MQALQTQYT

SEQ ID NO: 19446 - protein, 10 aa, Homo sapiens
  heavy chain complementarity determining region 3 for antibody 9723
AKDLSGGGGY

SEQ ID NO: 19447 - protein, 9 aa, Homo sapiens
  light chain complementarity determining region 3 for antibody 9724
MQALQTPYT

SEQ ID NO: 19448 - protein, 13 aa, Homo sapiens
  heavy chain complementarity determining region 3 for antibody 9724
TKEGSSAGPDFVY

SEQ ID NO: 19449 - protein, 9 aa, Homo sapiens
  light chain complementarity determining region 3 for antibody 9725
MQALQTPYT

SEQ ID NO: 19450 - protein, 17 aa, Homo sapiens
  heavy chain complementarity determining region 3 for antibody 9725
ARNTMVGTWQRQGNLDH

SEQ ID NO: 19451 - protein, 9 aa, Homo sapiens
  light chain complementarity determining region 3 for antibody 9726
MQALQTPYT

SEQ ID NO: 19452 - protein, 16 aa, Homo sapiens
  heavy chain complementarity determining region 3 for antibody 9726
ARGHTNPGERRGGSDF

SEQ ID NO: 19453 - protein, 9 aa, Homo sapiens
  light chain complementarity determining region 3 for antibody 9727
MQALQTPYT

SEQ ID NO: 19454 - protein, 14 aa, Homo sapiens
  heavy chain complementarity determining region 3 for antibody 9727
ARGHFDSTGFRLDY

SEQ ID NO: 19455 - protein, 9 aa, Homo sapiens
  light chain complementarity determining region 3 for antibody 9728
MQALQTPYT

SEQ ID NO: 19456 - protein, 19 aa, Homo sapiens
  heavy chain complementarity determining region 3 for antibody 9728
ARERVRCRSGICYDATFDI

SEQ ID NO: 19457 - protein, 9 aa, Homo sapiens
  light chain complementarity determining region 3 for antibody 9729
MQALQTPYT

SEQ ID NO: 19458 - protein, 15 aa, Homo sapiens
  heavy chain complementarity determining region 3 for antibody 9729
ARERRMFGELRGLDV

SEQ ID NO: 19459 - protein, 9 aa, Homo sapiens
  light chain complementarity determining region 3 for antibody 9730
MQALQTPYT

SEQ ID NO: 19460 - protein, 17 aa, Homo sapiens
  heavy chain complementarity determining region 3 for antibody 9730
AKRLPDLLGGGHHYIDV

SEQ ID NO: 19461 - protein, 9 aa, Homo sapiens
  light chain complementarity determining region 3 for antibody 9731
MQALQTPYT

SEQ ID NO: 19462 - protein, 13 aa, Homo sapiens
  heavy chain complementarity determining region 3 for antibody 9731
AKEGSAPGPDFEY

SEQ ID NO: 19463 - protein, 9 aa, Homo sapiens
  light chain complementarity determining region 3 for antibody 9732
MQALQTPYT

SEQ ID NO: 19464 - protein, 10 aa, Homo sapiens
  heavy chain complementarity determining region 3 for antibody 9732
AKDRSGGCGY

SEQ ID NO: 19465 - protein, 9 aa, Homo sapiens
  light chain complementarity determining region 3 for antibody 9733
MQALQTPYT

SEQ ID NO: 19466 - protein, 10 aa, Homo sapiens
  heavy chain complementarity determining region 3 for antibody 9733
AKDLTGGGGY

SEQ ID NO: 19467 - protein, 9 aa, Homo sapiens
  light chain complementarity determining region 3 for antibody 9734
MQALQTPYT

SEQ ID NO: 19468 - protein, 10 aa, Homo sapiens
  heavy chain complementarity determining region 3 for antibody 9734
AKDLSGGGSY

SEQ ID NO: 19469 - protein, 9 aa, Homo sapiens
  light chain complementarity determining region 3 for antibody 9735
MQALQTPYT

SEQ ID NO: 19470 - protein, 10 aa, Homo sapiens
  heavy chain complementarity determining region 3 for antibody 9735
AKDLSGGGDY

SEQ ID NO: 19471 - protein, 9 aa, Homo sapiens
  light chain complementarity determining region 3 for antibody 9736
MQALQTPYT

SEQ ID NO: 19472 - protein, 10 aa, Homo sapiens
  heavy chain complementarity determining region 3 for antibody 9736
AKDISGGGGY

SEQ ID NO: 19473 - protein, 9 aa, Homo sapiens
  light chain complementarity determining region 3 for antibody 9737
MQALQTPYT

SEQ ID NO: 19474 - protein, 12 aa, Homo sapiens
  heavy chain complementarity determining region 3 for antibody 9737
AIVVPGRWDLDD

SEQ ID NO: 19475 - protein, 9 aa, Homo sapiens
  light chain complementarity determining region 3 for antibody 9738
MQALQTPYP

SEQ ID NO: 19476 - protein, 11 aa, Homo sapiens
  heavy chain complementarity determining region 3 for antibody 9738
ATFGQQWRLAH

SEQ ID NO: 19477 - protein, 9 aa, Homo sapiens
  light chain complementarity determining region 3 for antibody 9739
MQALQTPYN

SEQ ID NO: 19478 - protein, 10 aa, Homo sapiens
  heavy chain complementarity determining region 3 for antibody 9739
AKDLSGGGGY

SEQ ID NO: 19479 - protein, 9 aa, Homo sapiens
  light chain complementarity determining region 3 for antibody 9740
MQALQTPST

SEQ ID NO: 19480 - protein, 10 aa, Homo sapiens
  heavy chain complementarity determining region 3 for antibody 9740
AKDLSGGGGY

SEQ ID NO: 19481 - protein, 9 aa, Homo sapiens
  light chain complementarity determining region 3 for antibody 9741
MQALQTPRT

SEQ ID NO: 19482 - protein, 16 aa, Homo sapiens
  heavy chain complementarity determining region 3 for antibody 9741
ARRERITLMVPGAFDI

SEQ ID NO: 19483 - protein, 9 aa, Homo sapiens
  light chain complementarity determining region 3 for antibody 9742
MQALQTPRT

SEQ ID NO: 19484 - protein, 12 aa, Homo sapiens
  heavy chain complementarity determining region 3 for antibody 9742
ARLDWNYRAFDI

SEQ ID NO: 19485 - protein, 9 aa, Homo sapiens
  light chain complementarity determining region 3 for antibody 9743
MQALQTPPT

SEQ ID NO: 19486 - protein, 16 aa, Homo sapiens
  heavy chain complementarity determining region 3 for antibody 9743
AKEWGYSSGWYGELDY

SEQ ID NO: 19487 - protein, 9 aa, Homo sapiens
  light chain complementarity determining region 3 for antibody 9744
MQALQTPHT

SEQ ID NO: 19488 - protein, 10 aa, Homo sapiens
  heavy chain complementarity determining region 3 for antibody 9744
AKDLSGGGGY

SEQ ID NO: 19489 - protein, 9 aa, Homo sapiens
  light chain complementarity determining region 3 for antibody 9745
MQALQTPGT

SEQ ID NO: 19490 - protein, 12 aa, Homo sapiens
  heavy chain complementarity determining region 3 for antibody 9745
ARLDWNYRAFDI

SEQ ID NO: 19491 - protein, 9 aa, Homo sapiens
  light chain complementarity determining region 3 for antibody 9746
MQALQTPGT

SEQ ID NO: 19492 - protein, 10 aa, Homo sapiens
  heavy chain complementarity determining region 3 for antibody 9746
AHRINRAFDI

SEQ ID NO: 19493 - protein, 9 aa, Homo sapiens
  light chain complementarity determining region 3 for antibody 9747
MQALQTPGR

SEQ ID NO: 19494 - protein, 17 aa, Homo sapiens
  heavy chain complementarity determining region 3 for antibody 9747
ARAGIEGTTIRMAFFDY

SEQ ID NO: 19495 - protein, 9 aa, Homo sapiens
  light chain complementarity determining region 3 for antibody 9748
MQALQTPDT

SEQ ID NO: 19496 - protein, 15 aa, Homo sapiens
  heavy chain complementarity determining region 3 for antibody 9748
ARERRMFGELRGFDV

SEQ ID NO: 19497 - protein, 9 aa, Homo sapiens
  light chain complementarity determining region 3 for antibody 9749
MQALQTLYT

SEQ ID NO: 19498 - protein, 18 aa, Homo sapiens
  heavy chain complementarity determining region 3 for antibody 9749
ARHSPIAFGAVSHYGMDV

SEQ ID NO: 19499 - protein, 8 aa, Homo sapiens
  light chain complementarity determining region 3 for antibody 9750
MQALQTFP

SEQ ID NO: 19500 - protein, 18 aa, Homo sapiens
  heavy chain complementarity determining region 3 for antibody 9750
TRRSRDDWTSPRGRAFDI

SEQ ID NO: 19501 - protein, 9 aa, Homo sapiens
  light chain complementarity determining region 3 for antibody 9751
MQALQPPYT

SEQ ID NO: 19502 - protein, 10 aa, Homo sapiens
  heavy chain complementarity determining region 3 for antibody 9751
AKDLSGGGGY

SEQ ID NO: 19503 - protein, 9 aa, Homo sapiens
  light chain complementarity determining region 3 for antibody 9752
MQALQLPLT

SEQ ID NO: 19504 - protein, 13 aa, Homo sapiens
  heavy chain complementarity determining region 3 for antibody 9752
AKRYSTNWGHFDY

SEQ ID NO: 19505 - protein, 9 aa, Homo sapiens
  light chain complementarity determining region 3 for antibody 9753
MQALQLPLP

SEQ ID NO: 19506 - protein, 15 aa, Homo sapiens
  heavy chain complementarity determining region 3 for antibody 9753
VRDPGGLAYFYNMEV

SEQ ID NO: 19507 - protein, 9 aa, Homo sapiens
  light chain complementarity determining region 3 for antibody 9754
MQALQGPPT

SEQ ID NO: 19508 - protein, 10 aa, Homo sapiens
  heavy chain complementarity determining region 3 for antibody 9754
TRHYNWHFDH

SEQ ID NO: 19509 - protein, 9 aa, Homo sapiens
  light chain complementarity determining region 3 for antibody 9755
MQALQAPLT

SEQ ID NO: 19510 - protein, 10 aa, Homo sapiens
  heavy chain complementarity determining region 3 for antibody 9755
CRDREGFGDV

SEQ ID NO: 19511 - protein, 9 aa, Homo sapiens
  light chain complementarity determining region 3 for antibody 9756
MQALQAPLT

SEQ ID NO: 19512 - protein, 14 aa, Homo sapiens
  heavy chain complementarity determining region 3 for antibody 9756
ARNAFTGSVYAITY

SEQ ID NO: 19513 - protein, 9 aa, Homo sapiens
  light chain complementarity determining region 3 for antibody 9757
MQALQAPLT

SEQ ID NO: 19514 - protein, 14 aa, Homo sapiens
  heavy chain complementarity determining region 3 for antibody 9757
ARNAFTGGVYANTY

SEQ ID NO: 19515 - protein, 8 aa, Homo sapiens
  light chain complementarity determining region 3 for antibody 9758
MQALPRLT

SEQ ID NO: 19516 - protein, 8 aa, Homo sapiens
  heavy chain complementarity determining region 3 for antibody 9758
VSQTGRNY

SEQ ID NO: 19517 - protein, 9 aa, Homo sapiens
  light chain complementarity determining region 3 for antibody 9759
MQALNLPLT

SEQ ID NO: 19518 - protein, 15 aa, Homo sapiens
  heavy chain complementarity determining region 3 for antibody 9759
VRDPAGLAYFYNMEV

SEQ ID NO: 19519 - protein, 9 aa, Homo sapiens
  light chain complementarity determining region 3 for antibody 9760
MQALLGPPT

SEQ ID NO: 19520 - protein, 10 aa, Homo sapiens
  heavy chain complementarity determining region 3 for antibody 9760
TRHYNWHFDY

SEQ ID NO: 19521 - protein, 9 aa, Homo sapiens
  light chain complementarity determining region 3 for antibody 9761
MQALHTPNT

SEQ ID NO: 19522 - protein, 12 aa, Homo sapiens
  heavy chain complementarity determining region 3 for antibody 9761
TKDSEMKWEMRD

SEQ ID NO: 19523 - protein, 8 aa, Homo sapiens
  light chain complementarity determining region 3 for antibody 9762
MQALHRVT

SEQ ID NO: 19524 - protein, 8 aa, Homo sapiens
  heavy chain complementarity determining region 3 for antibody 9762
VSQTGQNY

SEQ ID NO: 19525 - protein, 8 aa, Homo sapiens
  light chain complementarity determining region 3 for antibody 9763
MQALHRLT

SEQ ID NO: 19526 - protein, 8 aa, Homo sapiens
  heavy chain complementarity determining region 3 for antibody 9763
VSQAGRNY

SEQ ID NO: 19527 - protein, 8 aa, Homo sapiens
  light chain complementarity determining region 3 for antibody 9764
MQALHRLT

SEQ ID NO: 19528 - protein, 11 aa, Homo sapiens
  heavy chain complementarity determining region 3 for antibody 9764
VRVSTGWNFDY

SEQ ID NO: 19529 - protein, 8 aa, Homo sapiens
  light chain complementarity determining region 3 for antibody 9765
MQALHRLT

SEQ ID NO: 19530 - protein, 9 aa, Homo sapiens
  heavy chain complementarity determining region 3 for antibody 9765
GSRRPYFDS

SEQ ID NO: 19531 - protein, 8 aa, Homo sapiens
  light chain complementarity determining region 3 for antibody 9766
MQALHRLT

SEQ ID NO: 19532 - protein, 8 aa, Homo sapiens
  heavy chain complementarity determining region 3 for antibody 9766
GSQTGHNY

SEQ ID NO: 19533 - protein, 8 aa, Homo sapiens
  light chain complementarity determining region 3 for antibody 9767
MQALHRLP

SEQ ID NO: 19534 - protein, 8 aa, Homo sapiens
  heavy chain complementarity determining region 3 for antibody 9767
VSQTGQNY

SEQ ID NO: 19535 - protein, 8 aa, Homo sapiens
  light chain complementarity determining region 3 for antibody 9768
MQALHRLA

SEQ ID NO: 19536 - protein, 8 aa, Homo sapiens
  heavy chain complementarity determining region 3 for antibody 9768
VSQTGQNY

SEQ ID NO: 19537 - protein, 9 aa, Homo sapiens
  light chain complementarity determining region 3 for antibody 9769
MQALHLPLT

SEQ ID NO: 19538 - protein, 15 aa, Homo sapiens
  heavy chain complementarity determining region 3 for antibody 9769
VRGPAGLAYFYNMEV

SEQ ID NO: 19539 - protein, 9 aa, Homo sapiens
  light chain complementarity determining region 3 for antibody 9770
MQALHLPLT

SEQ ID NO: 19540 - protein, 15 aa, Homo sapiens
  heavy chain complementarity determining region 3 for antibody 9770
VREPAGLAYFYNMEV

SEQ ID NO: 19541 - protein, 9 aa, Homo sapiens
  light chain complementarity determining region 3 for antibody 9771
MQALHLPLT

SEQ ID NO: 19542 - protein, 15 aa, Homo sapiens
  heavy chain complementarity determining region 3 for antibody 9771
VRDPAGLAYFYNMEL

SEQ ID NO: 19543 - protein, 9 aa, Homo sapiens
  light chain complementarity determining region 3 for antibody 9772
MQALHLPLT

SEQ ID NO: 19544 - protein, 15 aa, Homo sapiens
  heavy chain complementarity determining region 3 for antibody 9772
VRDPAGLAYFYNMEA

SEQ ID NO: 19545 - protein, 9 aa, Homo sapiens
  light chain complementarity determining region 3 for antibody 9773
MQALHLPLT

SEQ ID NO: 19546 - protein, 15 aa, Homo sapiens
  heavy chain complementarity determining region 3 for antibody 9773
VRDPAGLAYCYNMEV

SEQ ID NO: 19547 - protein, 9 aa, Homo sapiens
  light chain complementarity determining region 3 for antibody 9774
MQALHLPLT

SEQ ID NO: 19548 - protein, 15 aa, Homo sapiens
  heavy chain complementarity determining region 3 for antibody 9774
VRDPAGLACFYNMEV

SEQ ID NO: 19549 - protein, 9 aa, Homo sapiens
  light chain complementarity determining region 3 for antibody 9775
MQALHLPLH

SEQ ID NO: 19550 - protein, 15 aa, Homo sapiens
  heavy chain complementarity determining region 3 for antibody 9775
VRDPAGLAYFYNMEV

SEQ ID NO: 19551 - protein, 9 aa, Homo sapiens
  light chain complementarity determining region 3 for antibody 9776
MQALHIPLT

SEQ ID NO: 19552 - protein, 15 aa, Homo sapiens
  heavy chain complementarity determining region 3 for antibody 9776
VRDPAGLAYFYNMEV

SEQ ID NO: 19553 - protein, 9 aa, Homo sapiens
  light chain complementarity determining region 3 for antibody 9777
MQALHFPLT

SEQ ID NO: 19554 - protein, 15 aa, Homo sapiens
  heavy chain complementarity determining region 3 for antibody 9777
VRDPAGLAYFYNMEV

SEQ ID NO: 19555 - protein, 9 aa, Homo sapiens
  light chain complementarity determining region 3 for antibody 9778
MQAKHWPRT

SEQ ID NO: 19556 - protein, 12 aa, Homo sapiens
  heavy chain complementarity determining region 3 for antibody 9778
STDVETTFPSVS

SEQ ID NO: 19557 - protein, 9 aa, Homo sapiens
  light chain complementarity determining region 3 for antibody 9779
MQAIQLPLT

SEQ ID NO: 19558 - protein, 15 aa, Homo sapiens
  heavy chain complementarity determining region 3 for antibody 9779
VRDPGGLAYFYNMEV

SEQ ID NO: 19559 - protein, 9 aa, Homo sapiens
  light chain complementarity determining region 3 for antibody 9780
MQAIQFPRT

SEQ ID NO: 19560 - protein, 10 aa, Homo sapiens
  heavy chain complementarity determining region 3 for antibody 9780
ATGGLSGETS

SEQ ID NO: 19561 - protein, 9 aa, Homo sapiens
  light chain complementarity determining region 3 for antibody 9781
MPTVQTPGT

SEQ ID NO: 19562 - protein, 12 aa, Homo sapiens
  heavy chain complementarity determining region 3 for antibody 9781
ARLDWNYRAFDI

SEQ ID NO: 19563 - protein, 9 aa, Homo sapiens
  light chain complementarity determining region 3 for antibody 9782
MPGTHWPHT

SEQ ID NO: 19564 - protein, 11 aa, Homo sapiens
  heavy chain complementarity determining region 3 for antibody 9782
ATFGQQWRLDH

SEQ ID NO: 19565 - protein, 9 aa, Homo sapiens
  light chain complementarity determining region 3 for antibody 9783
MPATHWPWT

SEQ ID NO: 19566 - protein, 12 aa, Homo sapiens
  heavy chain complementarity determining region 3 for antibody 9783
ARGPLKMAGGSS

SEQ ID NO: 19567 - protein, 9 aa, Homo sapiens
  light chain complementarity determining region 3 for antibody 9784
MPATHWPRT

SEQ ID NO: 19568 - protein, 12 aa, Homo sapiens
  heavy chain complementarity determining region 3 for antibody 9784
AGSRSVGGSVDF

SEQ ID NO: 19569 - protein, 9 aa, Homo sapiens
  light chain complementarity determining region 3 for antibody 9785
MPALQTPWT

SEQ ID NO: 19570 - protein, 20 aa, Homo sapiens
  heavy chain complementarity determining region 3 for antibody 9785
AKAGGQYYYSSGSHSGGMDV

SEQ ID NO: 19571 - protein, 9 aa, Homo sapiens
  light chain complementarity determining region 3 for antibody 9786
MLTLQTPWT

SEQ ID NO: 19572 - protein, 12 aa, Homo sapiens
  heavy chain complementarity determining region 3 for antibody 9786
ARLDWNYRAFDI

SEQ ID NO: 19573 - protein, 9 aa, Homo sapiens
  light chain complementarity determining region 3 for antibody 9787
MKTLQTPGT

SEQ ID NO: 19574 - protein, 12 aa, Homo sapiens
  heavy chain complementarity determining region 3 for antibody 9787
ARLDWNYRAFDI

SEQ ID NO: 19575 - protein, 9 aa, Homo sapiens
  light chain complementarity determining region 3 for antibody 9788
MKFLQTPLT

SEQ ID NO: 19576 - protein, 10 aa, Homo sapiens
  heavy chain complementarity determining region 3 for antibody 9788
ARERSGSYDI

SEQ ID NO: 19577 - protein, 9 aa, Homo sapiens
  light chain complementarity determining region 3 for antibody 9789
MHYTHWPHT

SEQ ID NO: 19578 - protein, 8 aa, Homo sapiens
  heavy chain complementarity determining region 3 for antibody 9789
AGWNDANY

SEQ ID NO: 19579 - protein, 9 aa, Homo sapiens
  light chain complementarity determining region 3 for antibody 9790
MHTLQTPWT

SEQ ID NO: 19580 - protein, 12 aa, Homo sapiens
  heavy chain complementarity determining region 3 for antibody 9790
ARWDWNYRAFDI

SEQ ID NO: 19581 - protein, 9 aa, Homo sapiens
  light chain complementarity determining region 3 for antibody 9791
MHTLQTPGT

SEQ ID NO: 19582 - protein, 12 aa, Homo sapiens
  heavy chain complementarity determining region 3 for antibody 9791
ARLDWNYRAFDI

SEQ ID NO: 19583 - protein, 9 aa, Homo sapiens
  light chain complementarity determining region 3 for antibody 9792
MHGTHWPRT

SEQ ID NO: 19584 - protein, 9 aa, Homo sapiens
  heavy chain complementarity determining region 3 for antibody 9792
ARDSHSFSY

SEQ ID NO: 19585 - protein, 9 aa, Homo sapiens
  light chain complementarity determining region 3 for antibody 9793
MHGIHWPWT

SEQ ID NO: 19586 - protein, 11 aa, Homo sapiens
  heavy chain complementarity determining region 3 for antibody 9793
ARSPATGTTDY

SEQ ID NO: 19587 - protein, 9 aa, Homo sapiens
  light chain complementarity determining region 3 for antibody 9794
MHFLQTPPT

SEQ ID NO: 19588 - protein, 10 aa, Homo sapiens
  heavy chain complementarity determining region 3 for antibody 9794
ARERSGSYDI

SEQ ID NO: 19589 - protein, 9 aa, Homo sapiens
  light chain complementarity determining region 3 for antibody 9795
MHATQWPLT

SEQ ID NO: 19590 - protein, 10 aa, Homo sapiens
  heavy chain complementarity determining region 3 for antibody 9795
VKDFWSSVHY

SEQ ID NO: 19591 - protein, 9 aa, Homo sapiens
  light chain complementarity determining region 3 for antibody 9796
MHATEWPLT

SEQ ID NO: 19592 - protein, 10 aa, Homo sapiens
  heavy chain complementarity determining region 3 for antibody 9796
VRDFWTNFHY

SEQ ID NO: 19593 - protein, 9 aa, Homo sapiens
  light chain complementarity determining region 3 for antibody 9797
MHAIQFPYT

SEQ ID NO: 19594 - protein, 11 aa, Homo sapiens
  heavy chain complementarity determining region 3 for antibody 9797
ATNHNGRGYEF

SEQ ID NO: 19595 - protein, 9 aa, Homo sapiens
  light chain complementarity determining region 3 for antibody 9798
METLQTPWT

SEQ ID NO: 19596 - protein, 12 aa, Homo sapiens
  heavy chain complementarity determining region 3 for antibody 9798
ARLDWNYRAFDI

SEQ ID NO: 19597 - protein, 9 aa, Homo sapiens
  light chain complementarity determining region 3 for antibody 9799
MEGTHWPHT

SEQ ID NO: 19598 - protein, 11 aa, Homo sapiens
  heavy chain complementarity determining region 3 for antibody 9799
ATFGQQWRLAH

SEQ ID NO: 19599 - protein, 9 aa, Homo sapiens
  light chain complementarity determining region 3 for antibody 9800
MEFLQTPLT

SEQ ID NO: 19600 - protein, 10 aa, Homo sapiens
  heavy chain complementarity determining region 3 for antibody 9800
ARERSGSYDI

SEQ ID NO: 19601 - protein, 9 aa, Homo sapiens
  light chain complementarity determining region 3 for antibody 9801
LRHNSYPLT

SEQ ID NO: 19602 - protein, 10 aa, Homo sapiens
  heavy chain complementarity determining region 3 for antibody 9801
CRDRWGFGDV

SEQ ID NO: 19603 - protein, 9 aa, Homo sapiens
  light chain complementarity determining region 3 for antibody 9802
LRDYTYPFS

SEQ ID NO: 19604 - protein, 16 aa, Homo sapiens
  heavy chain complementarity determining region 3 for antibody 9802
ATDVGDHSDRFTTLDY

SEQ ID NO: 19605 - protein, 9 aa, Homo sapiens
  light chain complementarity determining region 3 for antibody 9803
LRDRKYPFS

SEQ ID NO: 19606 - protein, 16 aa, Homo sapiens
  heavy chain complementarity determining region 3 for antibody 9803
GADLGDHGDAYATLDS

SEQ ID NO: 19607 - protein, 9 aa, Homo sapiens
  light chain complementarity determining region 3 for antibody 9804
LQYYTSPWT

SEQ ID NO: 19608 - protein, 17 aa, Homo sapiens
  heavy chain complementarity determining region 3 for antibody 9804
SRDGRIIWPGSQGSLDS

SEQ ID NO: 19609 - protein, 9 aa, Homo sapiens
  light chain complementarity determining region 3 for antibody 9805
LQYYTSPWA

SEQ ID NO: 19610 - protein, 17 aa, Homo sapiens
  heavy chain complementarity determining region 3 for antibody 9805
CRDGRIIWPGSQGSLDS

SEQ ID NO: 19611 - protein, 9 aa, Homo sapiens
  light chain complementarity determining region 3 for antibody 9806
LQYYTAPWT

SEQ ID NO: 19612 - protein, 17 aa, Homo sapiens
  heavy chain complementarity determining region 3 for antibody 9806
SRDGRREWPGSQGSLDS

SEQ ID NO: 19613 - protein, 9 aa, Homo sapiens
  light chain complementarity determining region 3 for antibody 9807
LQYYTAPWT

SEQ ID NO: 19614 - protein, 17 aa, Homo sapiens
  heavy chain complementarity determining region 3 for antibody 9807
SRDGRIIWPGSHGSLDS

SEQ ID NO: 19615 - protein, 9 aa, Homo sapiens
  light chain complementarity determining region 3 for antibody 9808
LQYYTAPWT

SEQ ID NO: 19616 - protein, 17 aa, Homo sapiens
  heavy chain complementarity determining region 3 for antibody 9808
SRDGRIEWPGSQGRLDS

SEQ ID NO: 19617 - protein, 9 aa, Homo sapiens
  light chain complementarity determining region 3 for antibody 9809
LQYYTAPWT

SEQ ID NO: 19618 - protein, 17 aa, Homo sapiens
  heavy chain complementarity determining region 3 for antibody 9809
SRDGRIEWPGPQGSLDS

SEQ ID NO: 19619 - protein, 9 aa, Homo sapiens
  light chain complementarity determining region 3 for antibody 9810
LQYYTAPWS

SEQ ID NO: 19620 - protein, 17 aa, Homo sapiens
  heavy chain complementarity determining region 3 for antibody 9810
SRDGRIIWPGSQGSLDS

SEQ ID NO: 19621 - protein, 9 aa, Homo sapiens
  light chain complementarity determining region 3 for antibody 9811
LQYYTAPWS

SEQ ID NO: 19622 - protein, 17 aa, Homo sapiens
  heavy chain complementarity determining region 3 for antibody 9811
ARDGRIEWPGSQGSLDS

SEQ ID NO: 19623 - protein, 9 aa, Homo sapiens
  light chain complementarity determining region 3 for antibody 9812
LQYYTAPWM

SEQ ID NO: 19624 - protein, 17 aa, Homo sapiens
  heavy chain complementarity determining region 3 for antibody 9812
SRDGRIVWPGSQGTLDS

SEQ ID NO: 19625 - protein, 9 aa, Homo sapiens
  light chain complementarity determining region 3 for antibody 9813
LQYYTAPWA

SEQ ID NO: 19626 - protein, 17 aa, Homo sapiens
  heavy chain complementarity determining region 3 for antibody 9813
SRDGRTVWPGSQGPLDS

SEQ ID NO: 19627 - protein, 9 aa, Homo sapiens
  light chain complementarity determining region 3 for antibody 9814
LQYYTAPWA

SEQ ID NO: 19628 - protein, 17 aa, Homo sapiens
  heavy chain complementarity determining region 3 for antibody 9814
SRDGKIVWPGSQGTLDS

SEQ ID NO: 19629 - protein, 9 aa, Homo sapiens
  light chain complementarity determining region 3 for antibody 9815
LQYYTAPWA

SEQ ID NO: 19630 - protein, 9 aa, Homo sapiens
  heavy chain complementarity determining region 3 for antibody 9815
ARGHYGPDY

SEQ ID NO: 19631 - protein, 9 aa, Homo sapiens
  light chain complementarity determining region 3 for antibody 9816
LQYYTAPWA

SEQ ID NO: 19632 - protein, 17 aa, Homo sapiens
  heavy chain complementarity determining region 3 for antibody 9816
ARDGRIIWPGAQGSLDS

SEQ ID NO: 19633 - protein, 9 aa, Homo sapiens
  light chain complementarity determining region 3 for antibody 9817
LQYYTAPCT

SEQ ID NO: 19634 - protein, 17 aa, Homo sapiens
  heavy chain complementarity determining region 3 for antibody 9817
SRDGRTIWPGSQGSLDS

SEQ ID NO: 19635 - protein, 9 aa, Homo sapiens
  light chain complementarity determining region 3 for antibody 9818
LQYYNHVGT

SEQ ID NO: 19636 - protein, 9 aa, Homo sapiens
  heavy chain complementarity determining region 3 for antibody 9818
GSRRPYFDS

SEQ ID NO: 19637 - protein, 9 aa, Homo sapiens
  light chain complementarity determining region 3 for antibody 9819
LQYQTLPFT

SEQ ID NO: 19638 - protein, 9 aa, Homo sapiens
  heavy chain complementarity determining region 3 for antibody 9819
STDRFWVDP

SEQ ID NO: 19639 - protein, 9 aa, Homo sapiens
  light chain complementarity determining region 3 for antibody 9820
LQYNTYPWT

SEQ ID NO: 19640 - protein, 9 aa, Homo sapiens
  heavy chain complementarity determining region 3 for antibody 9820
GRGHYGRDY

SEQ ID NO: 19641 - protein, 9 aa, Homo sapiens
  light chain complementarity determining region 3 for antibody 9821
LQYNTYPWT

SEQ ID NO: 19642 - protein, 9 aa, Homo sapiens
  heavy chain complementarity determining region 3 for antibody 9821
GRGHYGHDY

SEQ ID NO: 19643 - protein, 9 aa, Homo sapiens
  light chain complementarity determining region 3 for antibody 9822
LQYNSYPPT

SEQ ID NO: 19644 - protein, 10 aa, Homo sapiens
  heavy chain complementarity determining region 3 for antibody 9822
ARDSLWAFEI

SEQ ID NO: 19645 - protein, 9 aa, Homo sapiens
  light chain complementarity determining region 3 for antibody 9823
LQYNSYPPT

SEQ ID NO: 19646 - protein, 13 aa, Homo sapiens
  heavy chain complementarity determining region 3 for antibody 9823
AKEGSSPGPDFEY

SEQ ID NO: 19647 - protein, 9 aa, Homo sapiens
  light chain complementarity determining region 3 for antibody 9824
LQYNSSPHT

SEQ ID NO: 19648 - protein, 10 aa, Homo sapiens
  heavy chain complementarity determining region 3 for antibody 9824
ARDSLWAFEI

SEQ ID NO: 19649 - protein, 9 aa, Homo sapiens
  light chain complementarity determining region 3 for antibody 9825
LQYNNYPWT

SEQ ID NO: 19650 - protein, 9 aa, Homo sapiens
  heavy chain complementarity determining region 3 for antibody 9825
GRGHYGPDY

SEQ ID NO: 19651 - protein, 9 aa, Homo sapiens
  light chain complementarity determining region 3 for antibody 9826
LQYNNYPRT

SEQ ID NO: 19652 - protein, 11 aa, Homo sapiens
  heavy chain complementarity determining region 3 for antibody 9826
AEVSGLGNFEY

SEQ ID NO: 19653 - protein, 10 aa, Homo sapiens
  light chain complementarity determining region 3 for antibody 9827
LQYNNWPPRT

SEQ ID NO: 19654 - protein, 19 aa, Homo sapiens
  heavy chain complementarity determining region 3 for antibody 9827
VHPTQHCSGAFCKLPIFDY

SEQ ID NO: 19655 - protein, 9 aa, Homo sapiens
  light chain complementarity determining region 3 for antibody 9828
LQYITYPFT

SEQ ID NO: 19656 - protein, 11 aa, Homo sapiens
  heavy chain complementarity determining region 3 for antibody 9828
ATFGQQWRLAH

SEQ ID NO: 19657 - protein, 9 aa, Homo sapiens
  light chain complementarity determining region 3 for antibody 9829
LQYHSYPLT

SEQ ID NO: 19658 - protein, 16 aa, Homo sapiens
  heavy chain complementarity determining region 3 for antibody 9829
GRGNPPSCSGGPCFDY

SEQ ID NO: 19659 - protein, 9 aa, Homo sapiens
  light chain complementarity determining region 3 for antibody 9830
LQYHKYPFT

SEQ ID NO: 19660 - protein, 13 aa, Homo sapiens
  heavy chain complementarity determining region 3 for antibody 9830
AGEGPAPGPDFDY

SEQ ID NO: 19661 - protein, 9 aa, Homo sapiens
  light chain complementarity determining region 3 for antibody 9831
LQYDSYPWT

SEQ ID NO: 19662 - protein, 11 aa, Homo sapiens
  heavy chain complementarity determining region 3 for antibody 9831
VRVSTGWNFDY

SEQ ID NO: 19663 - protein, 9 aa, Homo sapiens
  light chain complementarity determining region 3 for antibody 9832
LQYDSYPWT

SEQ ID NO: 19664 - protein, 16 aa, Homo sapiens
  heavy chain complementarity determining region 3 for antibody 9832
VRDLAGFTRGGSTFDY

SEQ ID NO: 19665 - protein, 9 aa, Homo sapiens
  light chain complementarity determining region 3 for antibody 9833
LQYDSYPWT

SEQ ID NO: 19666 - protein, 17 aa, Homo sapiens
  heavy chain complementarity determining region 3 for antibody 9833
ARNTMVHGWQRQGSVDH

SEQ ID NO: 19667 - protein, 9 aa, Homo sapiens
  light chain complementarity determining region 3 for antibody 9834
LQYDSYPWT

SEQ ID NO: 19668 - protein, 9 aa, Homo sapiens
  heavy chain complementarity determining region 3 for antibody 9834
ARGQYGPDY

SEQ ID NO: 19669 - protein, 9 aa, Homo sapiens
  light chain complementarity determining region 3 for antibody 9835
LQYDSYPWT

SEQ ID NO: 19670 - protein, 9 aa, Homo sapiens
  heavy chain complementarity determining region 3 for antibody 9835
ARGHYGPDS

SEQ ID NO: 19671 - protein, 9 aa, Homo sapiens
  light chain complementarity determining region 3 for antibody 9836
LQYDSYPWT

SEQ ID NO: 19672 - protein, 9 aa, Homo sapiens
  heavy chain complementarity determining region 3 for antibody 9836
ARGHYEPDY

SEQ ID NO: 19673 - protein, 9 aa, Homo sapiens
  light chain complementarity determining region 3 for antibody 9837
LQYDSYPWT

SEQ ID NO: 19674 - protein, 15 aa, Homo sapiens
  heavy chain complementarity determining region 3 for antibody 9837
ARDLFSGSYAYGDDY

SEQ ID NO: 19675 - protein, 9 aa, Homo sapiens
  light chain complementarity determining region 3 for antibody 9838
LQYDSYPWT

SEQ ID NO: 19676 - protein, 12 aa, Homo sapiens
  heavy chain complementarity determining region 3 for antibody 9838
ARDKGGRNGMDV

SEQ ID NO: 19677 - protein, 9 aa, Homo sapiens
  light chain complementarity determining region 3 for antibody 9839
LQYANWPHT

SEQ ID NO: 19678 - protein, 9 aa, Homo sapiens
  heavy chain complementarity determining region 3 for antibody 9839
AGWGGTSNY

SEQ ID NO: 19679 - protein, 9 aa, Homo sapiens
  light chain complementarity determining region 3 for antibody 9840
LQYAHWPRT

SEQ ID NO: 19680 - protein, 9 aa, Homo sapiens
  heavy chain complementarity determining region 3 for antibody 9840
AGWGGTSNY

SEQ ID NO: 19681 - protein, 9 aa, Homo sapiens
  light chain complementarity determining region 3 for antibody 9841
LQYAHWPPT

SEQ ID NO: 19682 - protein, 9 aa, Homo sapiens
  heavy chain complementarity determining region 3 for antibody 9841
AGWGGASNY

SEQ ID NO: 19683 - protein, 9 aa, Homo sapiens
  light chain complementarity determining region 3 for antibody 9842
LQYAHWPLT

SEQ ID NO: 19684 - protein, 15 aa, Homo sapiens
  heavy chain complementarity determining region 3 for antibody 9842
ARVGRPYHNAWYFDN

SEQ ID NO: 19685 - protein, 9 aa, Homo sapiens
  light chain complementarity determining region 3 for antibody 9843
LQYAHWPHT

SEQ ID NO: 19686 - protein, 15 aa, Homo sapiens
  heavy chain complementarity determining region 3 for antibody 9843
VRVGRPYHNAWYFDN

SEQ ID NO: 19687 - protein, 9 aa, Homo sapiens
  light chain complementarity determining region 3 for antibody 9844
LQYAHWPHT

SEQ ID NO: 19688 - protein, 16 aa, Homo sapiens
  heavy chain complementarity determining region 3 for antibody 9844
VRDLAGFTRGGSTFDY

SEQ ID NO: 19689 - protein, 9 aa, Homo sapiens
  light chain complementarity determining region 3 for antibody 9845
LQYAHWPHT

SEQ ID NO: 19690 - protein, 18 aa, Homo sapiens
  heavy chain complementarity determining region 3 for antibody 9845
TTVLSQLLAGDWHLYFQH

SEQ ID NO: 19691 - protein, 9 aa, Homo sapiens
  light chain complementarity determining region 3 for antibody 9846
LQYAHWPHT

SEQ ID NO: 19692 - protein, 10 aa, Homo sapiens
  heavy chain complementarity determining region 3 for antibody 9846
CRDHEGFGDV

SEQ ID NO: 19693 - protein, 9 aa, Homo sapiens
  light chain complementarity determining region 3 for antibody 9847
LQYAHWPHT

SEQ ID NO: 19694 - protein, 15 aa, Homo sapiens
  heavy chain complementarity determining region 3 for antibody 9847
ARVRRPYHNAWYFDN

SEQ ID NO: 19695 - protein, 9 aa, Homo sapiens
  light chain complementarity determining region 3 for antibody 9848
LQYAHWPHT

SEQ ID NO: 19696 - protein, 15 aa, Homo sapiens
  heavy chain complementarity determining region 3 for antibody 9848
ARVGRPYYNAWYFDN

SEQ ID NO: 19697 - protein, 9 aa, Homo sapiens
  light chain complementarity determining region 3 for antibody 9849
LQYAHWPHT

SEQ ID NO: 19698 - protein, 15 aa, Homo sapiens
  heavy chain complementarity determining region 3 for antibody 9849
ARVGRPYLNAWYFDN

SEQ ID NO: 19699 - protein, 9 aa, Homo sapiens
  light chain complementarity determining region 3 for antibody 9850
LQYAHWPHT

SEQ ID NO: 19700 - protein, 15 aa, Homo sapiens
  heavy chain complementarity determining region 3 for antibody 9850
ARVGRPYHTAWYFDN

SEQ ID NO: 19701 - protein, 9 aa, Homo sapiens
  light chain complementarity determining region 3 for antibody 9851
LQYAHWPHT

SEQ ID NO: 19702 - protein, 15 aa, Homo sapiens
  heavy chain complementarity determining region 3 for antibody 9851
ARVGRPYHNTWYFDN

SEQ ID NO: 19703 - protein, 9 aa, Homo sapiens
  light chain complementarity determining region 3 for antibody 9852
LQYAHWPHT

SEQ ID NO: 19704 - protein, 15 aa, Homo sapiens
  heavy chain complementarity determining region 3 for antibody 9852
ARVGRPYHNDWYFDN

SEQ ID NO: 19705 - protein, 9 aa, Homo sapiens
  light chain complementarity determining region 3 for antibody 9853
LQYAHWPHT

SEQ ID NO: 19706 - protein, 15 aa, Homo sapiens
  heavy chain complementarity determining region 3 for antibody 9853
ARVGRPYHNAWYFDK

SEQ ID NO: 19707 - protein, 9 aa, Homo sapiens
  light chain complementarity determining region 3 for antibody 9854
LQYAHWPHT

SEQ ID NO: 19708 - protein, 15 aa, Homo sapiens
  heavy chain complementarity determining region 3 for antibody 9854
ARVGRPYHNAWYFDI

SEQ ID NO: 19709 - protein, 9 aa, Homo sapiens
  light chain complementarity determining region 3 for antibody 9855
LQYAHWPHT

SEQ ID NO: 19710 - protein, 15 aa, Homo sapiens
  heavy chain complementarity determining region 3 for antibody 9855
ARVGRPYHNAWFFDN

SEQ ID NO: 19711 - protein, 9 aa, Homo sapiens
  light chain complementarity determining region 3 for antibody 9856
LQYAHWPHT

SEQ ID NO: 19712 - protein, 15 aa, Homo sapiens
  heavy chain complementarity determining region 3 for antibody 9856
ARVGRPYHNAGYFDN

SEQ ID NO: 19713 - protein, 9 aa, Homo sapiens
  light chain complementarity determining region 3 for antibody 9857
LQYAHWPHT

SEQ ID NO: 19714 - protein, 15 aa, Homo sapiens
  heavy chain complementarity determining region 3 for antibody 9857
ARVGRPYHDAWYFDN

SEQ ID NO: 19715 - protein, 9 aa, Homo sapiens
  light chain complementarity determining region 3 for antibody 9858
LQYAHWPHT

SEQ ID NO: 19716 - protein, 15 aa, Homo sapiens
  heavy chain complementarity determining region 3 for antibody 9858
ARVGRPHHNAWYFDN

SEQ ID NO: 19717 - protein, 9 aa, Homo sapiens
  light chain complementarity determining region 3 for antibody 9859
LQYAHWPHT

SEQ ID NO: 19718 - protein, 9 aa, Homo sapiens
  heavy chain complementarity determining region 3 for antibody 9859
ARSEYQPTY

SEQ ID NO: 19719 - protein, 9 aa, Homo sapiens
  light chain complementarity determining region 3 for antibody 9860
LQYAHWPHT

SEQ ID NO: 19720 - protein, 14 aa, Homo sapiens
  heavy chain complementarity determining region 3 for antibody 9860
ARLHGSGLGRWLDP

SEQ ID NO: 19721 - protein, 9 aa, Homo sapiens
  light chain complementarity determining region 3 for antibody 9861
LQYAHWPHT

SEQ ID NO: 19722 - protein, 11 aa, Homo sapiens
  heavy chain complementarity determining region 3 for antibody 9861
ARIVARKPDDY

SEQ ID NO: 19723 - protein, 9 aa, Homo sapiens
  light chain complementarity determining region 3 for antibody 9862
LQYAHWPHT

SEQ ID NO: 19724 - protein, 10 aa, Homo sapiens
  heavy chain complementarity determining region 3 for antibody 9862
ARETSGSYDI

SEQ ID NO: 19725 - protein, 9 aa, Homo sapiens
  light chain complementarity determining region 3 for antibody 9863
LQYAHWPHT

SEQ ID NO: 19726 - protein, 12 aa, Homo sapiens
  heavy chain complementarity determining region 3 for antibody 9863
ARDYSCCNGFDP

SEQ ID NO: 19727 - protein, 9 aa, Homo sapiens
  light chain complementarity determining region 3 for antibody 9864
LQYAHWPHT

SEQ ID NO: 19728 - protein, 15 aa, Homo sapiens
  heavy chain complementarity determining region 3 for antibody 9864
AKVGRPYHNAWYFDN

SEQ ID NO: 19729 - protein, 9 aa, Homo sapiens
  light chain complementarity determining region 3 for antibody 9865
LQYAHWPHT

SEQ ID NO: 19730 - protein, 13 aa, Homo sapiens
  heavy chain complementarity determining region 3 for antibody 9865
AKRYSTNWGHFDY

SEQ ID NO: 19731 - protein, 9 aa, Homo sapiens
  light chain complementarity determining region 3 for antibody 9866
LQYAHWPHT

SEQ ID NO: 19732 - protein, 17 aa, Homo sapiens
  heavy chain complementarity determining region 3 for antibody 9866
AKRLPDLLGGGHHYIDV

SEQ ID NO: 19733 - protein, 9 aa, Homo sapiens
  light chain complementarity determining region 3 for antibody 9867
LQYAHWPHT

SEQ ID NO: 19734 - protein, 13 aa, Homo sapiens
  heavy chain complementarity determining region 3 for antibody 9867
AKEGSAPGPDFEY

SEQ ID NO: 19735 - protein, 9 aa, Homo sapiens
  light chain complementarity determining region 3 for antibody 9868
LQYAHWPHT

SEQ ID NO: 19736 - protein, 15 aa, Homo sapiens
  heavy chain complementarity determining region 3 for antibody 9868
AIVGRPYHNAWYFDN

SEQ ID NO: 19737 - protein, 9 aa, Homo sapiens
  light chain complementarity determining region 3 for antibody 9869
LQYAHWPHT

SEQ ID NO: 19738 - protein, 9 aa, Homo sapiens
  heavy chain complementarity determining region 3 for antibody 9869
AGWGGTSNS

SEQ ID NO: 19739 - protein, 9 aa, Homo sapiens
  light chain complementarity determining region 3 for antibody 9870
LQYAHWPHT

SEQ ID NO: 19740 - protein, 9 aa, Homo sapiens
  heavy chain complementarity determining region 3 for antibody 9870
AGWGGTSDY

SEQ ID NO: 19741 - protein, 9 aa, Homo sapiens
  light chain complementarity determining region 3 for antibody 9871
LQYAHWPHT

SEQ ID NO: 19742 - protein, 9 aa, Homo sapiens
  heavy chain complementarity determining region 3 for antibody 9871
AGWGGTPNY

SEQ ID NO: 19743 - protein, 9 aa, Homo sapiens
  light chain complementarity determining region 3 for antibody 9872
LQYAHWPHT

SEQ ID NO: 19744 - protein, 9 aa, Homo sapiens
  heavy chain complementarity determining region 3 for antibody 9872
AGWGGLSNY

SEQ ID NO: 19745 - protein, 9 aa, Homo sapiens
  light chain complementarity determining region 3 for antibody 9873
LQYAHWPHT

SEQ ID NO: 19746 - protein, 9 aa, Homo sapiens
  heavy chain complementarity determining region 3 for antibody 9873
AGLGGTSNY

SEQ ID NO: 19747 - protein, 9 aa, Homo sapiens
  light chain complementarity determining region 3 for antibody 9874
LQYAHWPHT

SEQ ID NO: 19748 - protein, 11 aa, Homo sapiens
  heavy chain complementarity determining region 3 for antibody 9874
AAVDSWGTLVY

SEQ ID NO: 19749 - protein, 9 aa, Homo sapiens
  light chain complementarity determining region 3 for antibody 9875
LQYAHWLHT

SEQ ID NO: 19750 - protein, 15 aa, Homo sapiens
  heavy chain complementarity determining region 3 for antibody 9875
ARVGRPYHNAWYFDN

SEQ ID NO: 19751 - protein, 9 aa, Homo sapiens
  light chain complementarity determining region 3 for antibody 9876
LQYAHRPHT

SEQ ID NO: 19752 - protein, 15 aa, Homo sapiens
  heavy chain complementarity determining region 3 for antibody 9876
ARVGRPYHNAWYFDN

SEQ ID NO: 19753 - protein, 9 aa, Homo sapiens
  light chain complementarity determining region 3 for antibody 9877
LQYAHGPHT

SEQ ID NO: 19754 - protein, 8 aa, Homo sapiens
  heavy chain complementarity determining region 3 for antibody 9877
AGWGYGNY

SEQ ID NO: 19755 - protein, 9 aa, Homo sapiens
  light chain complementarity determining region 3 for antibody 9878
LQTLQTPGT

SEQ ID NO: 19756 - protein, 12 aa, Homo sapiens
  heavy chain complementarity determining region 3 for antibody 9878
ARLDWNYRAFDI

SEQ ID NO: 19757 - protein, 9 aa, Homo sapiens
  light chain complementarity determining region 3 for antibody 9879
LQTIHWPWT

SEQ ID NO: 19758 - protein, 10 aa, Homo sapiens
  heavy chain complementarity determining region 3 for antibody 9879
TSLPNRASDF

SEQ ID NO: 19759 - protein, 9 aa, Homo sapiens
  light chain complementarity determining region 3 for antibody 9880
LQTIHWPWT

SEQ ID NO: 19760 - protein, 10 aa, Homo sapiens
  heavy chain complementarity determining region 3 for antibody 9880
TRIPSRASDF

SEQ ID NO: 19761 - protein, 9 aa, Homo sapiens
  light chain complementarity determining region 3 for antibody 9881
LQTATSPRP

SEQ ID NO: 19762 - protein, 13 aa, Homo sapiens
  heavy chain complementarity determining region 3 for antibody 9881
ARGSTATSWNIDY

SEQ ID NO: 19763 - protein, 9 aa, Homo sapiens
  light chain complementarity determining region 3 for antibody 9882
LQRNSYPWT

SEQ ID NO: 19764 - protein, 18 aa, Homo sapiens
  heavy chain complementarity determining region 3 for antibody 9882
TRGPSGVPGAMAYYYLDV

SEQ ID NO: 19765 - protein, 9 aa, Homo sapiens
  light chain complementarity determining region 3 for antibody 9883
LQPNTYPWT

SEQ ID NO: 19766 - protein, 12 aa, Homo sapiens
  heavy chain complementarity determining region 3 for antibody 9883
ARDLAGAPYVDS

SEQ ID NO: 19767 - protein, 9 aa, Homo sapiens
  light chain complementarity determining region 3 for antibody 9884
LQPNSYPWT

SEQ ID NO: 19768 - protein, 15 aa, Homo sapiens
  heavy chain complementarity determining region 3 for antibody 9884
ATDLAGITPDGYCDN

SEQ ID NO: 19769 - protein, 9 aa, Homo sapiens
  light chain complementarity determining region 3 for antibody 9885
LQPNSYPRT

SEQ ID NO: 19770 - protein, 13 aa, Homo sapiens
  heavy chain complementarity determining region 3 for antibody 9885
ANGGIMAAPSFDP

SEQ ID NO: 19771 - protein, 9 aa, Homo sapiens
  light chain complementarity determining region 3 for antibody 9886
LQPATSPRT

SEQ ID NO: 19772 - protein, 13 aa, Homo sapiens
  heavy chain complementarity determining region 3 for antibody 9886
ARGSTATSWNIDY

SEQ ID NO: 19773 - protein, 9 aa, Homo sapiens
  light chain complementarity determining region 3 for antibody 9887
LQNYNHVGT

SEQ ID NO: 19774 - protein, 9 aa, Homo sapiens
  heavy chain complementarity determining region 3 for antibody 9887
GSRRPYFDS

SEQ ID NO: 19775 - protein, 9 aa, Homo sapiens
  light chain complementarity determining region 3 for antibody 9888
LQNTNWPPP

SEQ ID NO: 19776 - protein, 10 aa, Homo sapiens
  heavy chain complementarity determining region 3 for antibody 9888
ARDHWFSLDL

SEQ ID NO: 19777 - protein, 9 aa, Homo sapiens
  light chain complementarity determining region 3 for antibody 9889
LQNTHWPWT

SEQ ID NO: 19778 - protein, 16 aa, Homo sapiens
  heavy chain complementarity determining region 3 for antibody 9889
ARGHTFPGERRGGSDF

SEQ ID NO: 19779 - protein, 9 aa, Homo sapiens
  light chain complementarity determining region 3 for antibody 9890
LQNIHWPWT

SEQ ID NO: 19780 - protein, 10 aa, Homo sapiens
  heavy chain complementarity determining region 3 for antibody 9890
TRLPSRASDF

SEQ ID NO: 19781 - protein, 9 aa, Homo sapiens
  light chain complementarity determining region 3 for antibody 9891
LQNATSPRT

SEQ ID NO: 19782 - protein, 13 aa, Homo sapiens
  heavy chain complementarity determining region 3 for antibody 9891
ARGSTATSWNIDY

SEQ ID NO: 19783 - protein, 9 aa, Homo sapiens
  light chain complementarity determining region 3 for antibody 9892
LQLSNAPLT

SEQ ID NO: 19784 - protein, 17 aa, Homo sapiens
  heavy chain complementarity determining region 3 for antibody 9892
AKRLPDLLGGGHHYIDV

SEQ ID NO: 19785 - protein, 9 aa, Homo sapiens
  light chain complementarity determining region 3 for antibody 9893
LQLHSSPYT

SEQ ID NO: 19786 - protein, 14 aa, Homo sapiens
  heavy chain complementarity determining region 3 for antibody 9893
ARGHFDSTGFRLDY

SEQ ID NO: 19787 - protein, 9 aa, Homo sapiens
  light chain complementarity determining region 3 for antibody 9894
LQHYTYPWT

SEQ ID NO: 19788 - protein, 12 aa, Homo sapiens
  heavy chain complementarity determining region 3 for antibody 9894
ARDLAGAPYIDS

SEQ ID NO: 19789 - protein, 9 aa, Homo sapiens
  light chain complementarity determining region 3 for antibody 9895
LQHYTVPWT

SEQ ID NO: 19790 - protein, 17 aa, Homo sapiens
  heavy chain complementarity determining region 3 for antibody 9895
SRDGRIIWPGSQGSLDS

SEQ ID NO: 19791 - protein, 9 aa, Homo sapiens
  light chain complementarity determining region 3 for antibody 9896
LQHYTAPWT

SEQ ID NO: 19792 - protein, 17 aa, Homo sapiens
  heavy chain complementarity determining region 3 for antibody 9896
SRDGRIIWPGSQGRLDS

SEQ ID NO: 19793 - protein, 9 aa, Homo sapiens
  light chain complementarity determining region 3 for antibody 9897
LQHYTAPWT

SEQ ID NO: 19794 - protein, 17 aa, Homo sapiens
  heavy chain complementarity determining region 3 for antibody 9897
RRDGRIIWPGSQGSLDS

SEQ ID NO: 19795 - protein, 9 aa, Homo sapiens
  light chain complementarity determining region 3 for antibody 9898
LQHYTAPWT

SEQ ID NO: 19796 - protein, 12 aa, Homo sapiens
  heavy chain complementarity determining region 3 for antibody 9898
ARDKGGRNGMDV

SEQ ID NO: 19797 - protein, 9 aa, Homo sapiens
  light chain complementarity determining region 3 for antibody 9899
LQHYTAPWP

SEQ ID NO: 19798 - protein, 17 aa, Homo sapiens
  heavy chain complementarity determining region 3 for antibody 9899
SRDGRIIWPGSQGSLDS

SEQ ID NO: 19799 - protein, 9 aa, Homo sapiens
  light chain complementarity determining region 3 for antibody 9900
LQHYTAPWA

SEQ ID NO: 19800 - protein, 17 aa, Homo sapiens
  heavy chain complementarity determining region 3 for antibody 9900
ARDGRIEWPGSQGSLDS

SEQ ID NO: 19801 - protein, 9 aa, Homo sapiens
  light chain complementarity determining region 3 for antibody 9901
LQHTSYPWT

SEQ ID NO: 19802 - protein, 17 aa, Homo sapiens
  heavy chain complementarity determining region 3 for antibody 9901
ARNTMVGTWQRQGNLDH

SEQ ID NO: 19803 - protein, 9 aa, Homo sapiens
  light chain complementarity determining region 3 for antibody 9902
LQHTSYPWT

SEQ ID NO: 19804 - protein, 13 aa, Homo sapiens
  heavy chain complementarity determining region 3 for antibody 9902
AKEGSSPGPDFDY

SEQ ID NO: 19805 - protein, 9 aa, Homo sapiens
  light chain complementarity determining region 3 for antibody 9903
LQHSSYPYT

SEQ ID NO: 19806 - protein, 12 aa, Homo sapiens
  heavy chain complementarity determining region 3 for antibody 9903
TVRLVDPGYLDF

SEQ ID NO: 19807 - protein, 9 aa, Homo sapiens
  light chain complementarity determining region 3 for antibody 9904
LQHSSYPST

SEQ ID NO: 19808 - protein, 12 aa, Homo sapiens
  heavy chain complementarity determining region 3 for antibody 9904
TVRLVDPGYFDF

SEQ ID NO: 19809 - protein, 10 aa, Homo sapiens
  light chain complementarity determining region 3 for antibody 9905
LQHSSYPMYT

SEQ ID NO: 19810 - protein, 12 aa, Homo sapiens
  heavy chain complementarity determining region 3 for antibody 9905
AREGMTTKEFFY

SEQ ID NO: 19811 - protein, 9 aa, Homo sapiens
  light chain complementarity determining region 3 for antibody 9906
LQHSSSPLT

SEQ ID NO: 19812 - protein, 11 aa, Homo sapiens
  heavy chain complementarity determining region 3 for antibody 9906
VRVSTGWNFDY

SEQ ID NO: 19813 - protein, 9 aa, Homo sapiens
  light chain complementarity determining region 3 for antibody 9907
LQHRSYPWT

SEQ ID NO: 19814 - protein, 18 aa, Homo sapiens
  heavy chain complementarity determining region 3 for antibody 9907
VRGPSVAPGAMAYYYLDV

SEQ ID NO: 19815 - protein, 9 aa, Homo sapiens
  light chain complementarity determining region 3 for antibody 9908
LQHRSYPWT

SEQ ID NO: 19816 - protein, 18 aa, Homo sapiens
  heavy chain complementarity determining region 3 for antibody 9908
VRGPSGAPGAMAYYYLGV

SEQ ID NO: 19817 - protein, 9 aa, Homo sapiens
  light chain complementarity determining region 3 for antibody 9909
LQHRSYPWT

SEQ ID NO: 19818 - protein, 18 aa, Homo sapiens
  heavy chain complementarity determining region 3 for antibody 9909
VRGPSGAPGAMADYYLDV

SEQ ID NO: 19819 - protein, 9 aa, Homo sapiens
  light chain complementarity determining region 3 for antibody 9910
LQHRSYPWT

SEQ ID NO: 19820 - protein, 15 aa, Homo sapiens
  heavy chain complementarity determining region 3 for antibody 9910
GKEGPGSSGWLTGHY

SEQ ID NO: 19821 - protein, 9 aa, Homo sapiens
  light chain complementarity determining region 3 for antibody 9911
LQHRSYPWT

SEQ ID NO: 19822 - protein, 18 aa, Homo sapiens
  heavy chain complementarity determining region 3 for antibody 9911
ARGPSGAPGAMAYYYLDV

SEQ ID NO: 19823 - protein, 9 aa, Homo sapiens
  light chain complementarity determining region 3 for antibody 9912
LQHRSHPWT

SEQ ID NO: 19824 - protein, 18 aa, Homo sapiens
  heavy chain complementarity determining region 3 for antibody 9912
VRGPSGAPGAMAYYYLDV

SEQ ID NO: 19825 - protein, 9 aa, Homo sapiens
  light chain complementarity determining region 3 for antibody 9913
LQHNTYPWT

SEQ ID NO: 19826 - protein, 12 aa, Homo sapiens
  heavy chain complementarity determining region 3 for antibody 9913
TRNAAGRDCLDY

SEQ ID NO: 19827 - protein, 9 aa, Homo sapiens
  light chain complementarity determining region 3 for antibody 9914
LQHNTYPWT

SEQ ID NO: 19828 - protein, 15 aa, Homo sapiens
  heavy chain complementarity determining region 3 for antibody 9914
GKEGPGSSGWLTGHY

SEQ ID NO: 19829 - protein, 9 aa, Homo sapiens
  light chain complementarity determining region 3 for antibody 9915
LQHNTYPWT

SEQ ID NO: 19830 - protein, 12 aa, Homo sapiens
  heavy chain complementarity determining region 3 for antibody 9915
ARLDWNYRAFDI

SEQ ID NO: 19831 - protein, 9 aa, Homo sapiens
  light chain complementarity determining region 3 for antibody 9916
LQHNTYPWT

SEQ ID NO: 19832 - protein, 12 aa, Homo sapiens
  heavy chain complementarity determining region 3 for antibody 9916
ARGLAGAPYVDS

SEQ ID NO: 19833 - protein, 9 aa, Homo sapiens
  light chain complementarity determining region 3 for antibody 9917
LQHNTYPWT

SEQ ID NO: 19834 - protein, 11 aa, Homo sapiens
  heavy chain complementarity determining region 3 for antibody 9917
AREQHGQAPDY

SEQ ID NO: 19835 - protein, 9 aa, Homo sapiens
  light chain complementarity determining region 3 for antibody 9918
LQHNTYPWT

SEQ ID NO: 19836 - protein, 12 aa, Homo sapiens
  heavy chain complementarity determining region 3 for antibody 9918
ARDVAGAPYVDS

SEQ ID NO: 19837 - protein, 9 aa, Homo sapiens
  light chain complementarity determining region 3 for antibody 9919
LQHNTYPWT

SEQ ID NO: 19838 - protein, 12 aa, Homo sapiens
  heavy chain complementarity determining region 3 for antibody 9919
ARDLAGAPDVDS

SEQ ID NO: 19839 - protein, 9 aa, Homo sapiens
  light chain complementarity determining region 3 for antibody 9920
LQHNTYPWT

SEQ ID NO: 19840 - protein, 10 aa, Homo sapiens
  heavy chain complementarity determining region 3 for antibody 9920
ARALGGPPEY

SEQ ID NO: 19841 - protein, 9 aa, Homo sapiens
  light chain complementarity determining region 3 for antibody 9921
LQHNTYPWT

SEQ ID NO: 19842 - protein, 10 aa, Homo sapiens
  heavy chain complementarity determining region 3 for antibody 9921
ARALGGAPEY

SEQ ID NO: 19843 - protein, 9 aa, Homo sapiens
  light chain complementarity determining region 3 for antibody 9922
LQHNTYPWT

SEQ ID NO: 19844 - protein, 16 aa, Homo sapiens
  heavy chain complementarity determining region 3 for antibody 9922
AGQILQYNSGWSYFDY

SEQ ID NO: 19845 - protein, 9 aa, Homo sapiens
  light chain complementarity determining region 3 for antibody 9923
LQHNTYPWA

SEQ ID NO: 19846 - protein, 18 aa, Homo sapiens
  heavy chain complementarity determining region 3 for antibody 9923
IRGPSGAPGAMAYYYLDV

SEQ ID NO: 19847 - protein, 9 aa, Homo sapiens
  light chain complementarity determining region 3 for antibody 9924
LQHNTYPRT

SEQ ID NO: 19848 - protein, 12 aa, Homo sapiens
  heavy chain complementarity determining region 3 for antibody 9924
TRNAAGRDYLDY

SEQ ID NO: 19849 - protein, 9 aa, Homo sapiens
  light chain complementarity determining region 3 for antibody 9925
LQHNSYTWT

SEQ ID NO: 19850 - protein, 17 aa, Homo sapiens
  heavy chain complementarity determining region 3 for antibody 9925
ARNTMVGTWQRQGNLDH

SEQ ID NO: 19851 - protein, 9 aa, Homo sapiens
  light chain complementarity determining region 3 for antibody 9926
LQHNSYSWT

SEQ ID NO: 19852 - protein, 18 aa, Homo sapiens
  heavy chain complementarity determining region 3 for antibody 9926
VRGPSGAPGAMAYYYLDV

SEQ ID NO: 19853 - protein, 9 aa, Homo sapiens
  light chain complementarity determining region 3 for antibody 9927
LQHNSYPYT

SEQ ID NO: 19854 - protein, 12 aa, Homo sapiens
  heavy chain complementarity determining region 3 for antibody 9927
ARERSADYWLGP

SEQ ID NO: 19855 - protein, 9 aa, Homo sapiens
  light chain complementarity determining region 3 for antibody 9928
LQHNSYPWT

SEQ ID NO: 19856 - protein, 18 aa, Homo sapiens
  heavy chain complementarity determining region 3 for antibody 9928
VRGPSGAPGAMAYYYLDF

SEQ ID NO: 19857 - protein, 9 aa, Homo sapiens
  light chain complementarity determining region 3 for antibody 9929
LQHNSYPWT

SEQ ID NO: 19858 - protein, 18 aa, Homo sapiens
  heavy chain complementarity determining region 3 for antibody 9929
VRGPSGAPGAMAYYCLDV

SEQ ID NO: 19859 - protein, 9 aa, Homo sapiens
  light chain complementarity determining region 3 for antibody 9930
LQHNSYPWT

SEQ ID NO: 19860 - protein, 16 aa, Homo sapiens
  heavy chain complementarity determining region 3 for antibody 9930
VRDLAGFTRGGSTFDY

SEQ ID NO: 19861 - protein, 9 aa, Homo sapiens
  light chain complementarity determining region 3 for antibody 9931
LQHNSYPWT

SEQ ID NO: 19862 - protein, 7 aa, Homo sapiens
  heavy chain complementarity determining region 3 for antibody 9931
TTGDLRN

SEQ ID NO: 19863 - protein, 9 aa, Homo sapiens
  light chain complementarity determining region 3 for antibody 9932
LQHNSYPWT

SEQ ID NO: 19864 - protein, 15 aa, Homo sapiens
  heavy chain complementarity determining region 3 for antibody 9932
GKEGPGSSGWLTGHY

SEQ ID NO: 19865 - protein, 9 aa, Homo sapiens
  light chain complementarity determining region 3 for antibody 9933
LQHNSYPWT

SEQ ID NO: 19866 - protein, 10 aa, Homo sapiens
  heavy chain complementarity determining region 3 for antibody 9933
CRDRWGFGDV

SEQ ID NO: 19867 - protein, 9 aa, Homo sapiens
  light chain complementarity determining region 3 for antibody 9934
LQHNSYPWT

SEQ ID NO: 19868 - protein, 15 aa, Homo sapiens
  heavy chain complementarity determining region 3 for antibody 9934
ATDMAGVAPDGYCDY

SEQ ID NO: 19869 - protein, 9 aa, Homo sapiens
  light chain complementarity determining region 3 for antibody 9935
LQHNSYPWT

SEQ ID NO: 19870 - protein, 17 aa, Homo sapiens
  heavy chain complementarity determining region 3 for antibody 9935
ARTTMVGTWQRQGNLDH

SEQ ID NO: 19871 - protein, 9 aa, Homo sapiens
  light chain complementarity determining region 3 for antibody 9936
LQHNSYPWT

SEQ ID NO: 19872 - protein, 17 aa, Homo sapiens
  heavy chain complementarity determining region 3 for antibody 9936
ARNTVVGTWQRQGNLDH

SEQ ID NO: 19873 - protein, 9 aa, Homo sapiens
  light chain complementarity determining region 3 for antibody 9937
LQHNSYPWT

SEQ ID NO: 19874 - protein, 17 aa, Homo sapiens
  heavy chain complementarity determining region 3 for antibody 9937
ARNTMVGTWQRQGTLDH

SEQ ID NO: 19875 - protein, 9 aa, Homo sapiens
  light chain complementarity determining region 3 for antibody 9938
LQHNSYPWT

SEQ ID NO: 19876 - protein, 17 aa, Homo sapiens
  heavy chain complementarity determining region 3 for antibody 9938
ARNTMVGTWQRQGNRDH

SEQ ID NO: 19877 - protein, 9 aa, Homo sapiens
  light chain complementarity determining region 3 for antibody 9939
LQHNSYPWT

SEQ ID NO: 19878 - protein, 17 aa, Homo sapiens
  heavy chain complementarity determining region 3 for antibody 9939
ARNTMVGTWQRQCNLDH

SEQ ID NO: 19879 - protein, 9 aa, Homo sapiens
  light chain complementarity determining region 3 for antibody 9940
LQHNSYPWT

SEQ ID NO: 19880 - protein, 17 aa, Homo sapiens
  heavy chain complementarity determining region 3 for antibody 9940
ARNTMVGPWQRQGNLDH

SEQ ID NO: 19881 - protein, 9 aa, Homo sapiens
  light chain complementarity determining region 3 for antibody 9941
LQHNSYPWT

SEQ ID NO: 19882 - protein, 12 aa, Homo sapiens
  heavy chain complementarity determining region 3 for antibody 9941
ARLDWNYRAFDI

SEQ ID NO: 19883 - protein, 9 aa, Homo sapiens
  light chain complementarity determining region 3 for antibody 9942
LQHNSYPWT

SEQ ID NO: 19884 - protein, 11 aa, Homo sapiens
  heavy chain complementarity determining region 3 for antibody 9942
AREQHGQAPDY

SEQ ID NO: 19885 - protein, 9 aa, Homo sapiens
  light chain complementarity determining region 3 for antibody 9943
LQHNSYPWT

SEQ ID NO: 19886 - protein, 14 aa, Homo sapiens
  heavy chain complementarity determining region 3 for antibody 9943
ANYRASIGTRCFDP

SEQ ID NO: 19887 - protein, 9 aa, Homo sapiens
  light chain complementarity determining region 3 for antibody 9944
LQHNSYPWT

SEQ ID NO: 19888 - protein, 14 aa, Homo sapiens
  heavy chain complementarity determining region 3 for antibody 9944
ANYRASIGARCCDP

SEQ ID NO: 19889 - protein, 9 aa, Homo sapiens
  light chain complementarity determining region 3 for antibody 9945
LQHNSYPWT

SEQ ID NO: 19890 - protein, 13 aa, Homo sapiens
  heavy chain complementarity determining region 3 for antibody 9945
AKEGSSPGPDFEY

SEQ ID NO: 19891 - protein, 9 aa, Homo sapiens
  light chain complementarity determining region 3 for antibody 9946
LQHNSYPWT

SEQ ID NO: 19892 - protein, 13 aa, Homo sapiens
  heavy chain complementarity determining region 3 for antibody 9946
AKEGPYPGLDLDY

SEQ ID NO: 19893 - protein, 9 aa, Homo sapiens
  light chain complementarity determining region 3 for antibody 9947
LQHNSYPWT

SEQ ID NO: 19894 - protein, 10 aa, Homo sapiens
  heavy chain complementarity determining region 3 for antibody 9947
AHRVNRAFHI

SEQ ID NO: 19895 - protein, 9 aa, Homo sapiens
  light chain complementarity determining region 3 for antibody 9948
LQHNSYPWR

SEQ ID NO: 19896 - protein, 15 aa, Homo sapiens
  heavy chain complementarity determining region 3 for antibody 9948
ATDMAGVTPDGYCDY

SEQ ID NO: 19897 - protein, 9 aa, Homo sapiens
  light chain complementarity determining region 3 for antibody 9949
LQHNSYPWP

SEQ ID NO: 19898 - protein, 14 aa, Homo sapiens
  heavy chain complementarity determining region 3 for antibody 9949
ANYRASIGARCFDP

SEQ ID NO: 19899 - protein, 9 aa, Homo sapiens
  light chain complementarity determining region 3 for antibody 9950
LQHNSYPWK

SEQ ID NO: 19900 - protein, 15 aa, Homo sapiens
  heavy chain complementarity determining region 3 for antibody 9950
ATDMAGVTPDGYCDY

SEQ ID NO: 19901 - protein, 10 aa, Homo sapiens
  light chain complementarity determining region 3 for antibody 9951
LQHNSYPVYT

SEQ ID NO: 19902 - protein, 12 aa, Homo sapiens
  heavy chain complementarity determining region 3 for antibody 9951
AREGMTTKEFFY

SEQ ID NO: 19903 - protein, 9 aa, Homo sapiens
  light chain complementarity determining region 3 for antibody 9952
LQHNSYPRT

SEQ ID NO: 19904 - protein, 11 aa, Homo sapiens
  heavy chain complementarity determining region 3 for antibody 9952
VRVSTGWSFDY

SEQ ID NO: 19905 - protein, 11 aa, Homo sapiens
  light chain complementarity determining region 3 for antibody 9953
LQHNSYPPTYT

SEQ ID NO: 19906 - protein, 13 aa, Homo sapiens
  heavy chain complementarity determining region 3 for antibody 9953
AKEGSSPGPDFEY

SEQ ID NO: 19907 - protein, 9 aa, Homo sapiens
  light chain complementarity determining region 3 for antibody 9954
LQHNSYPPT

SEQ ID NO: 19908 - protein, 10 aa, Homo sapiens
  heavy chain complementarity determining region 3 for antibody 9954
CRDRWGFGDV

SEQ ID NO: 19909 - protein, 9 aa, Homo sapiens
  light chain complementarity determining region 3 for antibody 9955
LQHNSYPPT

SEQ ID NO: 19910 - protein, 13 aa, Homo sapiens
  heavy chain complementarity determining region 3 for antibody 9955
ANGGIMAAPSFDP

SEQ ID NO: 19911 - protein, 9 aa, Homo sapiens
  light chain complementarity determining region 3 for antibody 9956
LQHNSYPPP

SEQ ID NO: 19912 - protein, 10 aa, Homo sapiens
  heavy chain complementarity determining region 3 for antibody 9956
TTGSGPTNDY

SEQ ID NO: 19913 - protein, 11 aa, Homo sapiens
  light chain complementarity determining region 3 for antibody 9957
LQHNSYPPMYT

SEQ ID NO: 19914 - protein, 15 aa, Homo sapiens
  heavy chain complementarity determining region 3 for antibody 9957
ARVGRPYHNAWYFDN

SEQ ID NO: 19915 - protein, 11 aa, Homo sapiens
  light chain complementarity determining region 3 for antibody 9958
LQHNSYPPMYT

SEQ ID NO: 19916 - protein, 10 aa, Homo sapiens
  heavy chain complementarity determining region 3 for antibody 9958
ARERSGSYDI

SEQ ID NO: 19917 - protein, 11 aa, Homo sapiens
  light chain complementarity determining region 3 for antibody 9959
LQHNSYPPMYT

SEQ ID NO: 19918 - protein, 15 aa, Homo sapiens
  heavy chain complementarity determining region 3 for antibody 9959
ARDRGDPQLYNWFDP

SEQ ID NO: 19919 - protein, 11 aa, Homo sapiens
  light chain complementarity determining region 3 for antibody 9960
LQHNSYPPMYT

SEQ ID NO: 19920 - protein, 13 aa, Homo sapiens
  heavy chain complementarity determining region 3 for antibody 9960
AKERSSPGPDFEY

SEQ ID NO: 19921 - protein, 11 aa, Homo sapiens
  light chain complementarity determining region 3 for antibody 9961
LQHNSYPPMYT

SEQ ID NO: 19922 - protein, 13 aa, Homo sapiens
  heavy chain complementarity determining region 3 for antibody 9961
AKEGSSPGPDLEY

SEQ ID NO: 19923 - protein, 11 aa, Homo sapiens
  light chain complementarity determining region 3 for antibody 9962
LQHNSYPPMYT

SEQ ID NO: 19924 - protein, 13 aa, Homo sapiens
  heavy chain complementarity determining region 3 for antibody 9962
AKEGSSPGPDFES

SEQ ID NO: 19925 - protein, 11 aa, Homo sapiens
  light chain complementarity determining region 3 for antibody 9963
LQHNSYPPMYT

SEQ ID NO: 19926 - protein, 13 aa, Homo sapiens
  heavy chain complementarity determining region 3 for antibody 9963
AKEGSSPGPDCEY

SEQ ID NO: 19927 - protein, 11 aa, Homo sapiens
  light chain complementarity determining region 3 for antibody 9964
LQHNSYPPMYT

SEQ ID NO: 19928 - protein, 13 aa, Homo sapiens
  heavy chain complementarity determining region 3 for antibody 9964
AKEGSSPGADFEY

SEQ ID NO: 19929 - protein, 11 aa, Homo sapiens
  light chain complementarity determining region 3 for antibody 9965
LQHNSYPPMYT

SEQ ID NO: 19930 - protein, 13 aa, Homo sapiens
  heavy chain complementarity determining region 3 for antibody 9965
AKEGSSPDPDFEY

SEQ ID NO: 19931 - protein, 11 aa, Homo sapiens
  light chain complementarity determining region 3 for antibody 9966
LQHNSYPPMYT

SEQ ID NO: 19932 - protein, 13 aa, Homo sapiens
  heavy chain complementarity determining region 3 for antibody 9966
AKEGSPPGPDFEY

SEQ ID NO: 19933 - protein, 11 aa, Homo sapiens
  light chain complementarity determining region 3 for antibody 9967
LQHNSYPPMYT

SEQ ID NO: 19934 - protein, 13 aa, Homo sapiens
  heavy chain complementarity determining region 3 for antibody 9967
AKDGSSPGPDFEY

SEQ ID NO: 19935 - protein, 11 aa, Homo sapiens
  light chain complementarity determining region 3 for antibody 9968
LQHNSYPPMYT

SEQ ID NO: 19936 - protein, 12 aa, Homo sapiens
  heavy chain complementarity determining region 3 for antibody 9968
AIVVPGRWDLDD

SEQ ID NO: 19937 - protein, 11 aa, Homo sapiens
  light chain complementarity determining region 3 for antibody 9969
LQHNSYPPMYP

SEQ ID NO: 19938 - protein, 13 aa, Homo sapiens
  heavy chain complementarity determining region 3 for antibody 9969
AKEGSSPGPDFEY

SEQ ID NO: 19939 - protein, 10 aa, Homo sapiens
  light chain complementarity determining region 3 for antibody 9970
LQHNSYPMYT

SEQ ID NO: 19940 - protein, 10 aa, Homo sapiens
  heavy chain complementarity determining region 3 for antibody 9970
ARERSGSYDI

SEQ ID NO: 19941 - protein, 10 aa, Homo sapiens
  light chain complementarity determining region 3 for antibody 9971
LQHNSYPMYT

SEQ ID NO: 19942 - protein, 12 aa, Homo sapiens
  heavy chain complementarity determining region 3 for antibody 9971
AREGMTTKECFY

SEQ ID NO: 19943 - protein, 10 aa, Homo sapiens
  light chain complementarity determining region 3 for antibody 9972
LQHNSYPMYT

SEQ ID NO: 19944 - protein, 12 aa, Homo sapiens
  heavy chain complementarity determining region 3 for antibody 9972
AREGMTTEEFFY

SEQ ID NO: 19945 - protein, 10 aa, Homo sapiens
  light chain complementarity determining region 3 for antibody 9973
LQHNSYPMYT

SEQ ID NO: 19946 - protein, 12 aa, Homo sapiens
  heavy chain complementarity determining region 3 for antibody 9973
AREGMSTKEFFY

SEQ ID NO: 19947 - protein, 10 aa, Homo sapiens
  light chain complementarity determining region 3 for antibody 9974
LQHNSYPMYT

SEQ ID NO: 19948 - protein, 12 aa, Homo sapiens
  heavy chain complementarity determining region 3 for antibody 9974
AREGMATKEFFY

SEQ ID NO: 19949 - protein, 9 aa, Homo sapiens
  light chain complementarity determining region 3 for antibody 9975
LQHNSYPLT

SEQ ID NO: 19950 - protein, 10 aa, Homo sapiens
  heavy chain complementarity determining region 3 for antibody 9975
YRDRWGFGDV

SEQ ID NO: 19951 - protein, 9 aa, Homo sapiens
  light chain complementarity determining region 3 for antibody 9976
LQHNSYPLT

SEQ ID NO: 19952 - protein, 10 aa, Homo sapiens
  heavy chain complementarity determining region 3 for antibody 9976
WRDRWGFGDV

SEQ ID NO: 19953 - protein, 9 aa, Homo sapiens
  light chain complementarity determining region 3 for antibody 9977
LQHNSYPLT

SEQ ID NO: 19954 - protein, 11 aa, Homo sapiens
  heavy chain complementarity determining region 3 for antibody 9977
VRVSTGWRFDY

SEQ ID NO: 19955 - protein, 9 aa, Homo sapiens
  light chain complementarity determining region 3 for antibody 9978
LQHNSYPLT

SEQ ID NO: 19956 - protein, 11 aa, Homo sapiens
  heavy chain complementarity determining region 3 for antibody 9978
VRVSTGWNVDY

SEQ ID NO: 19957 - protein, 9 aa, Homo sapiens
  light chain complementarity determining region 3 for antibody 9979
LQHNSYPLT

SEQ ID NO: 19958 - protein, 11 aa, Homo sapiens
  heavy chain complementarity determining region 3 for antibody 9979
VRVSTGWNFYY

SEQ ID NO: 19959 - protein, 9 aa, Homo sapiens
  light chain complementarity determining region 3 for antibody 9980
LQHNSYPLT

SEQ ID NO: 19960 - protein, 11 aa, Homo sapiens
  heavy chain complementarity determining region 3 for antibody 9980
VRVSTGWNFDC

SEQ ID NO: 19961 - protein, 9 aa, Homo sapiens
  light chain complementarity determining region 3 for antibody 9981
LQHNSYPLT

SEQ ID NO: 19962 - protein, 14 aa, Homo sapiens
  heavy chain complementarity determining region 3 for antibody 9981
VREQGSGYYRTADY

SEQ ID NO: 19963 - protein, 9 aa, Homo sapiens
  light chain complementarity determining region 3 for antibody 9982
LQHNSYPLT

SEQ ID NO: 19964 - protein, 11 aa, Homo sapiens
  heavy chain complementarity determining region 3 for antibody 9982
VRDSTGWNFDY

SEQ ID NO: 19965 - protein, 9 aa, Homo sapiens
  light chain complementarity determining region 3 for antibody 9983
LQHNSYPLT

SEQ ID NO: 19966 - protein, 11 aa, Homo sapiens
  heavy chain complementarity determining region 3 for antibody 9983
VKVSTGWNFDY

SEQ ID NO: 19967 - protein, 9 aa, Homo sapiens
  light chain complementarity determining region 3 for antibody 9984
LQHNSYPLT

SEQ ID NO: 19968 - protein, 11 aa, Homo sapiens
  heavy chain complementarity determining region 3 for antibody 9984
VIVSTGWNFDY

SEQ ID NO: 19969 - protein, 9 aa, Homo sapiens
  light chain complementarity determining region 3 for antibody 9985
LQHNSYPLT

SEQ ID NO: 19970 - protein, 16 aa, Homo sapiens
  heavy chain complementarity determining region 3 for antibody 9985
VGPHLTYNSGWRYFDY

SEQ ID NO: 19971 - protein, 9 aa, Homo sapiens
  light chain complementarity determining region 3 for antibody 9986
LQHNSYPLT

SEQ ID NO: 19972 - protein, 17 aa, Homo sapiens
  heavy chain complementarity determining region 3 for antibody 9986
SRDGRIIWPGSQGSLDS

SEQ ID NO: 19973 - protein, 9 aa, Homo sapiens
  light chain complementarity determining region 3 for antibody 9987
LQHNSYPLT

SEQ ID NO: 19974 - protein, 10 aa, Homo sapiens
  heavy chain complementarity determining region 3 for antibody 9987
RRDRWGFGDV

SEQ ID NO: 19975 - protein, 9 aa, Homo sapiens
  light chain complementarity determining region 3 for antibody 9988
LQHNSYPLT

SEQ ID NO: 19976 - protein, 16 aa, Homo sapiens
  heavy chain complementarity determining region 3 for antibody 9988
GRQVISATKWPNRLDY

SEQ ID NO: 19977 - protein, 9 aa, Homo sapiens
  light chain complementarity determining region 3 for antibody 9989
LQHNSYPLT

SEQ ID NO: 19978 - protein, 10 aa, Homo sapiens
  heavy chain complementarity determining region 3 for antibody 9989
GRDRWGFGDV

SEQ ID NO: 19979 - protein, 9 aa, Homo sapiens
  light chain complementarity determining region 3 for antibody 9990
LQHNSYPLT

SEQ ID NO: 19980 - protein, 10 aa, Homo sapiens
  heavy chain complementarity determining region 3 for antibody 9990
CRDRWGVGDV

SEQ ID NO: 19981 - protein, 9 aa, Homo sapiens
  light chain complementarity determining region 3 for antibody 9991
LQHNSYPLT

SEQ ID NO: 19982 - protein, 10 aa, Homo sapiens
  heavy chain complementarity determining region 3 for antibody 9991
CRDRWGFGHV

SEQ ID NO: 19983 - protein, 9 aa, Homo sapiens
  light chain complementarity determining region 3 for antibody 9992
LQHNSYPLT

SEQ ID NO: 19984 - protein, 15 aa, Homo sapiens
  heavy chain complementarity determining region 3 for antibody 9992
ATVTCTNGWYNAFDI

SEQ ID NO: 19985 - protein, 9 aa, Homo sapiens
  light chain complementarity determining region 3 for antibody 9993
LQHNSYPLT

SEQ ID NO: 19986 - protein, 11 aa, Homo sapiens
  heavy chain complementarity determining region 3 for antibody 9993
ATNSRGQGYEY

SEQ ID NO: 19987 - protein, 9 aa, Homo sapiens
  light chain complementarity determining region 3 for antibody 9994
LQHNSYPLT

SEQ ID NO: 19988 - protein, 16 aa, Homo sapiens
  heavy chain complementarity determining region 3 for antibody 9994
ASPNTLGRLVGVAFDY

SEQ ID NO: 19989 - protein, 9 aa, Homo sapiens
  light chain complementarity determining region 3 for antibody 9995
LQHNSYPLT

SEQ ID NO: 19990 - protein, 16 aa, Homo sapiens
  heavy chain complementarity determining region 3 for antibody 9995
ARWFSRSSTGVSYMDV

SEQ ID NO: 19991 - protein, 9 aa, Homo sapiens
  light chain complementarity determining region 3 for antibody 9996
LQHNSYPLT

SEQ ID NO: 19992 - protein, 13 aa, Homo sapiens
  heavy chain complementarity determining region 3 for antibody 9996
ARVNRGIFDAFDN

SEQ ID NO: 19993 - protein, 9 aa, Homo sapiens
  light chain complementarity determining region 3 for antibody 9997
LQHNSYPLT

SEQ ID NO: 19994 - protein, 15 aa, Homo sapiens
  heavy chain complementarity determining region 3 for antibody 9997
ARSMVSGTTDDAFDI

SEQ ID NO: 19995 - protein, 9 aa, Homo sapiens
  light chain complementarity determining region 3 for antibody 9998
LQHNSYPLT

SEQ ID NO: 19996 - protein, 13 aa, Homo sapiens
  heavy chain complementarity determining region 3 for antibody 9998
ARPYGDYGWAFNI

SEQ ID NO: 19997 - protein, 9 aa, Homo sapiens
  light chain complementarity determining region 3 for antibody 9999
LQHNSYPLT

SEQ ID NO: 19998 - protein, 17 aa, Homo sapiens
  heavy chain complementarity determining region 3 for antibody 9999
ARNTMVHGWQRQGSVDH

SEQ ID NO: 19999 - protein, 9 aa, Homo sapiens
  light chain complementarity determining region 3 for antibody 10000
LQHNSYPLT

SEQ ID NO: 20000 - protein, 10 aa, Homo sapiens
  heavy chain complementarity determining region 3 for antibody 10000
ARLHYYYMDI

SEQ ID NO: 20001 - protein, 9 aa, Homo sapiens
  light chain complementarity determining region 3 for antibody 10001
LQHNSYPLT

SEQ ID NO: 20002 - protein, 12 aa, Homo sapiens
  heavy chain complementarity determining region 3 for antibody 10001
ARLDWNYRAFDI

SEQ ID NO: 20003 - protein, 9 aa, Homo sapiens
  light chain complementarity determining region 3 for antibody 10002
LQHNSYPLT

SEQ ID NO: 20004 - protein, 15 aa, Homo sapiens
  heavy chain complementarity determining region 3 for antibody 10002
ARIWTSSTTCRYMDV

SEQ ID NO: 20005 - protein, 9 aa, Homo sapiens
  light chain complementarity determining region 3 for antibody 10003
LQHNSYPLT

SEQ ID NO: 20006 - protein, 11 aa, Homo sapiens
  heavy chain complementarity determining region 3 for antibody 10003
ARIVARKPDDY

SEQ ID NO: 20007 - protein, 9 aa, Homo sapiens
  light chain complementarity determining region 3 for antibody 10004
LQHNSYPLT

SEQ ID NO: 20008 - protein, 9 aa, Homo sapiens
  heavy chain complementarity determining region 3 for antibody 10004
ARGRNNFRY

SEQ ID NO: 20009 - protein, 9 aa, Homo sapiens
  light chain complementarity determining region 3 for antibody 10005
LQHNSYPLT

SEQ ID NO: 20010 - protein, 10 aa, Homo sapiens
  heavy chain complementarity determining region 3 for antibody 10005
ARETSGSYDI

SEQ ID NO: 20011 - protein, 9 aa, Homo sapiens
  light chain complementarity determining region 3 for antibody 10006
LQHNSYPLT

SEQ ID NO: 20012 - protein, 10 aa, Homo sapiens
  heavy chain complementarity determining region 3 for antibody 10006
ARETSGAYDI

SEQ ID NO: 20013 - protein, 9 aa, Homo sapiens
  light chain complementarity determining region 3 for antibody 10007
LQHNSYPLT

SEQ ID NO: 20014 - protein, 10 aa, Homo sapiens
  heavy chain complementarity determining region 3 for antibody 10007
ARATYWAYDS

SEQ ID NO: 20015 - protein, 9 aa, Homo sapiens
  light chain complementarity determining region 3 for antibody 10008
LQHNSYPLT

SEQ ID NO: 20016 - protein, 17 aa, Homo sapiens
  heavy chain complementarity determining region 3 for antibody 10008
AKRLPDLLGGGHHYIDV

SEQ ID NO: 20017 - protein, 9 aa, Homo sapiens
  light chain complementarity determining region 3 for antibody 10009
LQHNSYPLT

SEQ ID NO: 20018 - protein, 13 aa, Homo sapiens
  heavy chain complementarity determining region 3 for antibody 10009
AKEGSSPGPDFDY

SEQ ID NO: 20019 - protein, 9 aa, Homo sapiens
  light chain complementarity determining region 3 for antibody 10010
LQHNSYPLT

SEQ ID NO: 20020 - protein, 13 aa, Homo sapiens
  heavy chain complementarity determining region 3 for antibody 10010
AKEGSSPGPDFDS

SEQ ID NO: 20021 - protein, 9 aa, Homo sapiens
  light chain complementarity determining region 3 for antibody 10011
LQHNSYPLT

SEQ ID NO: 20022 - protein, 13 aa, Homo sapiens
  heavy chain complementarity determining region 3 for antibody 10011
AKEGSAPGPDFEY

SEQ ID NO: 20023 - protein, 9 aa, Homo sapiens
  light chain complementarity determining region 3 for antibody 10012
LQHNSYPLT

SEQ ID NO: 20024 - protein, 13 aa, Homo sapiens
  heavy chain complementarity determining region 3 for antibody 10012
AKDRGSGWYAWGY

SEQ ID NO: 20025 - protein, 9 aa, Homo sapiens
  light chain complementarity determining region 3 for antibody 10013
LQHNSYPLT

SEQ ID NO: 20026 - protein, 9 aa, Homo sapiens
  heavy chain complementarity determining region 3 for antibody 10013
AGWGGTSNY

SEQ ID NO: 20027 - protein, 9 aa, Homo sapiens
  light chain complementarity determining region 3 for antibody 10014
LQHNSYPLP

SEQ ID NO: 20028 - protein, 10 aa, Homo sapiens
  heavy chain complementarity determining region 3 for antibody 10014
CRDRWGFGDV

SEQ ID NO: 20029 - protein, 9 aa, Homo sapiens
  light chain complementarity determining region 3 for antibody 10015
LQHNSYPLI

SEQ ID NO: 20030 - protein, 11 aa, Homo sapiens
  heavy chain complementarity determining region 3 for antibody 10015
VRVSTGWSFDY

SEQ ID NO: 20031 - protein, 9 aa, Homo sapiens
  light chain complementarity determining region 3 for antibody 10016
LQHNSYPHT

SEQ ID NO: 20032 - protein, 11 aa, Homo sapiens
  heavy chain complementarity determining region 3 for antibody 10016
VRVSTGWNFDY

SEQ ID NO: 20033 - protein, 9 aa, Homo sapiens
  light chain complementarity determining region 3 for antibody 10017
LQHNSYHWT

SEQ ID NO: 20034 - protein, 17 aa, Homo sapiens
  heavy chain complementarity determining region 3 for antibody 10017
ARNTMVGTWQRQGNLDH

SEQ ID NO: 20035 - protein, 9 aa, Homo sapiens
  light chain complementarity determining region 3 for antibody 10018
LQHNSCPLT

SEQ ID NO: 20036 - protein, 10 aa, Homo sapiens
  heavy chain complementarity determining region 3 for antibody 10018
CRDRWGFGDV

SEQ ID NO: 20037 - protein, 9 aa, Homo sapiens
  light chain complementarity determining region 3 for antibody 10019
LQHNNYSLS

SEQ ID NO: 20038 - protein, 11 aa, Homo sapiens
  heavy chain complementarity determining region 3 for antibody 10019
VRVSTGWYFDY

SEQ ID NO: 20039 - protein, 9 aa, Homo sapiens
  light chain complementarity determining region 3 for antibody 10020
LQHNNYPLS

SEQ ID NO: 20040 - protein, 11 aa, Homo sapiens
  heavy chain complementarity determining region 3 for antibody 10020
VWVSTGWYFDY

SEQ ID NO: 20041 - protein, 9 aa, Homo sapiens
  light chain complementarity determining region 3 for antibody 10021
LQHNNYPLS

SEQ ID NO: 20042 - protein, 11 aa, Homo sapiens
  heavy chain complementarity determining region 3 for antibody 10021
VRVSTGWYVDY

SEQ ID NO: 20043 - protein, 9 aa, Homo sapiens
  light chain complementarity determining region 3 for antibody 10022
LQHNNYPLS

SEQ ID NO: 20044 - protein, 11 aa, Homo sapiens
  heavy chain complementarity determining region 3 for antibody 10022
VRVSPGWYFDY

SEQ ID NO: 20045 - protein, 9 aa, Homo sapiens
  light chain complementarity determining region 3 for antibody 10023
LQHNNYPLS

SEQ ID NO: 20046 - protein, 12 aa, Homo sapiens
  heavy chain complementarity determining region 3 for antibody 10023
AIVVPGRWDLDD

SEQ ID NO: 20047 - protein, 9 aa, Homo sapiens
  light chain complementarity determining region 3 for antibody 10024
LQHNNCPLS

SEQ ID NO: 20048 - protein, 11 aa, Homo sapiens
  heavy chain complementarity determining region 3 for antibody 10024
VRVSTGWYFDY

SEQ ID NO: 20049 - protein, 9 aa, Homo sapiens
  light chain complementarity determining region 3 for antibody 10025
LQHNAYPLS

SEQ ID NO: 20050 - protein, 11 aa, Homo sapiens
  heavy chain complementarity determining region 3 for antibody 10025
VRVSIGWCLDY

SEQ ID NO: 20051 - protein, 9 aa, Homo sapiens
  light chain complementarity determining region 3 for antibody 10026
LQHLTYPYT

SEQ ID NO: 20052 - protein, 13 aa, Homo sapiens
  heavy chain complementarity determining region 3 for antibody 10026
AKDNPSAPGVFDQ

SEQ ID NO: 20053 - protein, 9 aa, Homo sapiens
  light chain complementarity determining region 3 for antibody 10027
LQHHSYPLT

SEQ ID NO: 20054 - protein, 10 aa, Homo sapiens
  heavy chain complementarity determining region 3 for antibody 10027
CRDRWGFGDV

SEQ ID NO: 20055 - protein, 9 aa, Homo sapiens
  light chain complementarity determining region 3 for antibody 10028
LQHDYFPWT

SEQ ID NO: 20056 - protein, 19 aa, Homo sapiens
  heavy chain complementarity determining region 3 for antibody 10028
ASWAGYCPSANCHTTTFDD

SEQ ID NO: 20057 - protein, 9 aa, Homo sapiens
  light chain complementarity determining region 3 for antibody 10029
LQHDYFPWT

SEQ ID NO: 20058 - protein, 19 aa, Homo sapiens
  heavy chain complementarity determining region 3 for antibody 10029
ASWAGYCPSANCHTPTFDY

SEQ ID NO: 20059 - protein, 9 aa, Homo sapiens
  light chain complementarity determining region 3 for antibody 10030
LQHDSSPYT

SEQ ID NO: 20060 - protein, 16 aa, Homo sapiens
  heavy chain complementarity determining region 3 for antibody 10030
TGDFRYGSSIWYWGAV

SEQ ID NO: 20061 - protein, 9 aa, Homo sapiens
  light chain complementarity determining region 3 for antibody 10031
LQHDSSPYT

SEQ ID NO: 20062 - protein, 16 aa, Homo sapiens
  heavy chain complementarity determining region 3 for antibody 10031
ASDVRYGSSIWYWGAV

SEQ ID NO: 20063 - protein, 9 aa, Homo sapiens
  light chain complementarity determining region 3 for antibody 10032
LQHDSSPST

SEQ ID NO: 20064 - protein, 16 aa, Homo sapiens
  heavy chain complementarity determining region 3 for antibody 10032
TSDFRYGSSIWYWGAV

SEQ ID NO: 20065 - protein, 9 aa, Homo sapiens
  light chain complementarity determining region 3 for antibody 10033
LQHDSSPDT

SEQ ID NO: 20066 - protein, 16 aa, Homo sapiens
  heavy chain complementarity determining region 3 for antibody 10033
TSDFRYGSSIWYWGAV

SEQ ID NO: 20067 - protein, 9 aa, Homo sapiens
  light chain complementarity determining region 3 for antibody 10034
LQHDGSPYT

SEQ ID NO: 20068 - protein, 16 aa, Homo sapiens
  heavy chain complementarity determining region 3 for antibody 10034
TSDCRYGSSIWYWGAV

SEQ ID NO: 20069 - protein, 9 aa, Homo sapiens
  light chain complementarity determining region 3 for antibody 10035
LQGVQVPFT

SEQ ID NO: 20070 - protein, 11 aa, Homo sapiens
  heavy chain complementarity determining region 3 for antibody 10035
GRDVDYSAPGF

SEQ ID NO: 20071 - protein, 9 aa, Homo sapiens
  light chain complementarity determining region 3 for antibody 10036
LQGVQGPFT

SEQ ID NO: 20072 - protein, 11 aa, Homo sapiens
  heavy chain complementarity determining region 3 for antibody 10036
GRDVDYSTPGF

SEQ ID NO: 20073 - protein, 9 aa, Homo sapiens
  light chain complementarity determining region 3 for antibody 10037
LQGTYWPYT

SEQ ID NO: 20074 - protein, 11 aa, Homo sapiens
  heavy chain complementarity determining region 3 for antibody 10037
AREGWGSLLDY

SEQ ID NO: 20075 - protein, 9 aa, Homo sapiens
  light chain complementarity determining region 3 for antibody 10038
LQGTYWPRT

SEQ ID NO: 20076 - protein, 10 aa, Homo sapiens
  heavy chain complementarity determining region 3 for antibody 10038
ARDFREGEVY

SEQ ID NO: 20077 - protein, 9 aa, Homo sapiens
  light chain complementarity determining region 3 for antibody 10039
LQGTYWPKT

SEQ ID NO: 20078 - protein, 14 aa, Homo sapiens
  heavy chain complementarity determining region 3 for antibody 10039
VKDAYCYNGLCYDY

SEQ ID NO: 20079 - protein, 9 aa, Homo sapiens
  light chain complementarity determining region 3 for antibody 10040
LQGTYWPKT

SEQ ID NO: 20080 - protein, 15 aa, Homo sapiens
  heavy chain complementarity determining region 3 for antibody 10040
TRDQHTGGLIESFDI

SEQ ID NO: 20081 - protein, 9 aa, Homo sapiens
  light chain complementarity determining region 3 for antibody 10041
LQGTYWPKT

SEQ ID NO: 20082 - protein, 12 aa, Homo sapiens
  heavy chain complementarity determining region 3 for antibody 10041
ARDKGGRNGMDV

SEQ ID NO: 20083 - protein, 9 aa, Homo sapiens
  light chain complementarity determining region 3 for antibody 10042
LQGTYWPKT

SEQ ID NO: 20084 - protein, 10 aa, Homo sapiens
  heavy chain complementarity determining region 3 for antibody 10042
ARDFREVEVY

SEQ ID NO: 20085 - protein, 9 aa, Homo sapiens
  light chain complementarity determining region 3 for antibody 10043
LQGTYWPHT

SEQ ID NO: 20086 - protein, 11 aa, Homo sapiens
  heavy chain complementarity determining region 3 for antibody 10043
VSFGQQWGLAY

SEQ ID NO: 20087 - protein, 10 aa, Homo sapiens
  light chain complementarity determining region 3 for antibody 10044
LQGTHWPPIT

SEQ ID NO: 20088 - protein, 16 aa, Homo sapiens
  heavy chain complementarity determining region 3 for antibody 10044
ARHGVLPAAIHDAFDI

SEQ ID NO: 20089 - protein, 9 aa, Homo sapiens
  light chain complementarity determining region 3 for antibody 10045
LQGTHWPHT

SEQ ID NO: 20090 - protein, 12 aa, Homo sapiens
  heavy chain complementarity determining region 3 for antibody 10045
ARLDWNYRAFDI

SEQ ID NO: 20091 - protein, 10 aa, Homo sapiens
  light chain complementarity determining region 3 for antibody 10046
LQGSHWPPFP

SEQ ID NO: 20092 - protein, 9 aa, Homo sapiens
  heavy chain complementarity determining region 3 for antibody 10046
VRNNYWMDV

SEQ ID NO: 20093 - protein, 9 aa, Homo sapiens
  light chain complementarity determining region 3 for antibody 10047
LQGLRGPFT

SEQ ID NO: 20094 - protein, 11 aa, Homo sapiens
  heavy chain complementarity determining region 3 for antibody 10047
GRDVDYSTPAF

SEQ ID NO: 20095 - protein, 9 aa, Homo sapiens
  light chain complementarity determining region 3 for antibody 10048
LQGLQDPFT

SEQ ID NO: 20096 - protein, 11 aa, Homo sapiens
  heavy chain complementarity determining region 3 for antibody 10048
GRDVDYSTPGF

SEQ ID NO: 20097 - protein, 9 aa, Homo sapiens
  light chain complementarity determining region 3 for antibody 10049
LQGLQAPST

SEQ ID NO: 20098 - protein, 11 aa, Homo sapiens
  heavy chain complementarity determining region 3 for antibody 10049
GRDVDYSTPGF

SEQ ID NO: 20099 - protein, 9 aa, Homo sapiens
  light chain complementarity determining region 3 for antibody 10050
LQGLQAPLT

SEQ ID NO: 20100 - protein, 11 aa, Homo sapiens
  heavy chain complementarity determining region 3 for antibody 10050
GRDVDYSTPGF

SEQ ID NO: 20101 - protein, 9 aa, Homo sapiens
  light chain complementarity determining region 3 for antibody 10051
LQGLQAPFT

SEQ ID NO: 20102 - protein, 11 aa, Homo sapiens
  heavy chain complementarity determining region 3 for antibody 10051
VRVSTGWNFDY

SEQ ID NO: 20103 - protein, 9 aa, Homo sapiens
  light chain complementarity determining region 3 for antibody 10052
LQGLQAPFT

SEQ ID NO: 20104 - protein, 11 aa, Homo sapiens
  heavy chain complementarity determining region 3 for antibody 10052
GREVDYSTPGF

SEQ ID NO: 20105 - protein, 9 aa, Homo sapiens
  light chain complementarity determining region 3 for antibody 10053
LQGLQAPFT

SEQ ID NO: 20106 - protein, 11 aa, Homo sapiens
  heavy chain complementarity determining region 3 for antibody 10053
GRDVGYSTPGF

SEQ ID NO: 20107 - protein, 9 aa, Homo sapiens
  light chain complementarity determining region 3 for antibody 10054
LQGLQAPFT

SEQ ID NO: 20108 - protein, 11 aa, Homo sapiens
  heavy chain complementarity determining region 3 for antibody 10054
GRDVDYRTPGF

SEQ ID NO: 20109 - protein, 9 aa, Homo sapiens
  light chain complementarity determining region 3 for antibody 10055
LQGLQAPFT

SEQ ID NO: 20110 - protein, 11 aa, Homo sapiens
  heavy chain complementarity determining region 3 for antibody 10055
GGDVDYSTPGF

SEQ ID NO: 20111 - protein, 9 aa, Homo sapiens
  light chain complementarity determining region 3 for antibody 10056
LQGLQAPFT

SEQ ID NO: 20112 - protein, 9 aa, Homo sapiens
  heavy chain complementarity determining region 3 for antibody 10056
ARGHYGPDY

SEQ ID NO: 20113 - protein, 9 aa, Homo sapiens
  light chain complementarity determining region 3 for antibody 10057
LQGLHVPFT

SEQ ID NO: 20114 - protein, 11 aa, Homo sapiens
  heavy chain complementarity determining region 3 for antibody 10057
GRDVDYSTPAF

SEQ ID NO: 20115 - protein, 9 aa, Homo sapiens
  light chain complementarity determining region 3 for antibody 10058
LQGHKYPFT

SEQ ID NO: 20116 - protein, 16 aa, Homo sapiens
  heavy chain complementarity determining region 3 for antibody 10058
AADLGDHTDAYATLDN

SEQ ID NO: 20117 - protein, 9 aa, Homo sapiens
  light chain complementarity determining region 3 for antibody 10059
LQFYTSPWT

SEQ ID NO: 20118 - protein, 17 aa, Homo sapiens
  heavy chain complementarity determining region 3 for antibody 10059
SRDVRIEWPGSHGSLDS

SEQ ID NO: 20119 - protein, 9 aa, Homo sapiens
  light chain complementarity determining region 3 for antibody 10060
LQFYTAPWT

SEQ ID NO: 20120 - protein, 17 aa, Homo sapiens
  heavy chain complementarity determining region 3 for antibody 10060
SRDGGIIWPGSQGSLDS

SEQ ID NO: 20121 - protein, 9 aa, Homo sapiens
  light chain complementarity determining region 3 for antibody 10061
LQFYTAPWA

SEQ ID NO: 20122 - protein, 17 aa, Homo sapiens
  heavy chain complementarity determining region 3 for antibody 10061
TRDGRIIWPVSQGSLDS

SEQ ID NO: 20123 - protein, 9 aa, Homo sapiens
  light chain complementarity determining region 3 for antibody 10062
LQFYTAPWA

SEQ ID NO: 20124 - protein, 17 aa, Homo sapiens
  heavy chain complementarity determining region 3 for antibody 10062
TRDGRIIWPGSLGSLDS

SEQ ID NO: 20125 - protein, 9 aa, Homo sapiens
  light chain complementarity determining region 3 for antibody 10063
LQFYTAPWA

SEQ ID NO: 20126 - protein, 17 aa, Homo sapiens
  heavy chain complementarity determining region 3 for antibody 10063
TRDGRIIGPGSQGSLDS

SEQ ID NO: 20127 - protein, 9 aa, Homo sapiens
  light chain complementarity determining region 3 for antibody 10064
LQFYTAPWA

SEQ ID NO: 20128 - protein, 17 aa, Homo sapiens
  heavy chain complementarity determining region 3 for antibody 10064
SRDGRIIWPGSRGSLDS

SEQ ID NO: 20129 - protein, 9 aa, Homo sapiens
  light chain complementarity determining region 3 for antibody 10065
LQFYTAPWA

SEQ ID NO: 20130 - protein, 17 aa, Homo sapiens
  heavy chain complementarity determining region 3 for antibody 10065
SRDGRIIWPGSQGRLDS

SEQ ID NO: 20131 - protein, 9 aa, Homo sapiens
  light chain complementarity determining region 3 for antibody 10066
LQFYTAPWA

SEQ ID NO: 20132 - protein, 17 aa, Homo sapiens
  heavy chain complementarity determining region 3 for antibody 10066
SRDGRIIWPGSHGSLDS

SEQ ID NO: 20133 - protein, 9 aa, Homo sapiens
  light chain complementarity determining region 3 for antibody 10067
LQFYTAPWA

SEQ ID NO: 20134 - protein, 17 aa, Homo sapiens
  heavy chain complementarity determining region 3 for antibody 10067
GRDGRIIWPGSQGSLDS

SEQ ID NO: 20135 - protein, 9 aa, Homo sapiens
  light chain complementarity determining region 3 for antibody 10068
LQFYTAPWA

SEQ ID NO: 20136 - protein, 10 aa, Homo sapiens
  heavy chain complementarity determining region 3 for antibody 10068
CRDRWGFGDV

SEQ ID NO: 20137 - protein, 9 aa, Homo sapiens
  light chain complementarity determining region 3 for antibody 10069
LQFYTAPWA

SEQ ID NO: 20138 - protein, 15 aa, Homo sapiens
  heavy chain complementarity determining region 3 for antibody 10069
ARVGRPYHNAWYFDN

SEQ ID NO: 20139 - protein, 9 aa, Homo sapiens
  light chain complementarity determining region 3 for antibody 10070
LQFYTAPWA

SEQ ID NO: 20140 - protein, 15 aa, Homo sapiens
  heavy chain complementarity determining region 3 for antibody 10070
ARSMVSGTTDDAFDI

SEQ ID NO: 20141 - protein, 9 aa, Homo sapiens
  light chain complementarity determining region 3 for antibody 10071
LQFYTAPWA

SEQ ID NO: 20142 - protein, 9 aa, Homo sapiens
  heavy chain complementarity determining region 3 for antibody 10071
ARSEYQPTY

SEQ ID NO: 20143 - protein, 9 aa, Homo sapiens
  light chain complementarity determining region 3 for antibody 10072
LQFYTAPWA

SEQ ID NO: 20144 - protein, 12 aa, Homo sapiens
  heavy chain complementarity determining region 3 for antibody 10072
ARLDWNYRAFDI

SEQ ID NO: 20145 - protein, 9 aa, Homo sapiens
  light chain complementarity determining region 3 for antibody 10073
LQFYTAPWA

SEQ ID NO: 20146 - protein, 12 aa, Homo sapiens
  heavy chain complementarity determining region 3 for antibody 10073
ARELQIPNYFDY

SEQ ID NO: 20147 - protein, 9 aa, Homo sapiens
  light chain complementarity determining region 3 for antibody 10074
LQFYTAPWA

SEQ ID NO: 20148 - protein, 12 aa, Homo sapiens
  heavy chain complementarity determining region 3 for antibody 10074
ARDKGGRNGMDV

SEQ ID NO: 20149 - protein, 9 aa, Homo sapiens
  light chain complementarity determining region 3 for antibody 10075
LQFYTAPSA

SEQ ID NO: 20150 - protein, 17 aa, Homo sapiens
  heavy chain complementarity determining region 3 for antibody 10075
TRDGRIIWPGSQGSLDS

SEQ ID NO: 20151 - protein, 9 aa, Homo sapiens
  light chain complementarity determining region 3 for antibody 10076
LQFYTAPLA

SEQ ID NO: 20152 - protein, 17 aa, Homo sapiens
  heavy chain complementarity determining region 3 for antibody 10076
ARDGRIEWPGSHGSLDS

SEQ ID NO: 20153 - protein, 9 aa, Homo sapiens
  light chain complementarity determining region 3 for antibody 10077
LQFYTAPCA

SEQ ID NO: 20154 - protein, 17 aa, Homo sapiens
  heavy chain complementarity determining region 3 for antibody 10077
TRDGRIIWPGSQGSLDS

SEQ ID NO: 20155 - protein, 9 aa, Homo sapiens
  light chain complementarity determining region 3 for antibody 10078
LQFYAAPWA

SEQ ID NO: 20156 - protein, 17 aa, Homo sapiens
  heavy chain complementarity determining region 3 for antibody 10078
ARDGRIEWPGSHGSLDS

SEQ ID NO: 20157 - protein, 9 aa, Homo sapiens
  light chain complementarity determining region 3 for antibody 10079
LQFSTAPWA

SEQ ID NO: 20158 - protein, 17 aa, Homo sapiens
  heavy chain complementarity determining region 3 for antibody 10079
SRDGRITWPGSQGSLDS

SEQ ID NO: 20159 - protein, 9 aa, Homo sapiens
  light chain complementarity determining region 3 for antibody 10080
LQFQTFPLT

SEQ ID NO: 20160 - protein, 13 aa, Homo sapiens
  heavy chain complementarity determining region 3 for antibody 10080
AREGVEGGLDLNY

SEQ ID NO: 20161 - protein, 9 aa, Homo sapiens
  light chain complementarity determining region 3 for antibody 10081
LQFPHWPHT

SEQ ID NO: 20162 - protein, 9 aa, Homo sapiens
  heavy chain complementarity determining region 3 for antibody 10081
AGWGGLSNY

SEQ ID NO: 20163 - protein, 9 aa, Homo sapiens
  light chain complementarity determining region 3 for antibody 10082
LQFGHWPHT

SEQ ID NO: 20164 - protein, 9 aa, Homo sapiens
  heavy chain complementarity determining region 3 for antibody 10082
AGWGGLSNY

SEQ ID NO: 20165 - protein, 9 aa, Homo sapiens
  light chain complementarity determining region 3 for antibody 10083
LQFGHWPHN

SEQ ID NO: 20166 - protein, 9 aa, Homo sapiens
  heavy chain complementarity determining region 3 for antibody 10083
AGWGGLSNY

SEQ ID NO: 20167 - protein, 9 aa, Homo sapiens
  light chain complementarity determining region 3 for antibody 10084
LQFAHWTHT

SEQ ID NO: 20168 - protein, 9 aa, Homo sapiens
  heavy chain complementarity determining region 3 for antibody 10084
AGWGGLSNY

SEQ ID NO: 20169 - protein, 9 aa, Homo sapiens
  light chain complementarity determining region 3 for antibody 10085
LQFAHWRHT

SEQ ID NO: 20170 - protein, 9 aa, Homo sapiens
  heavy chain complementarity determining region 3 for antibody 10085
AGWGGLSNY

SEQ ID NO: 20171 - protein, 9 aa, Homo sapiens
  light chain complementarity determining region 3 for antibody 10086
LQFAHWPYT

SEQ ID NO: 20172 - protein, 9 aa, Homo sapiens
  heavy chain complementarity determining region 3 for antibody 10086
AGWGGLSNY

SEQ ID NO: 20173 - protein, 9 aa, Homo sapiens
  light chain complementarity determining region 3 for antibody 10087
LQFAHWPHT

SEQ ID NO: 20174 - protein, 14 aa, Homo sapiens
  heavy chain complementarity determining region 3 for antibody 10087
TRGHFDSTGFRLDY

SEQ ID NO: 20175 - protein, 9 aa, Homo sapiens
  light chain complementarity determining region 3 for antibody 10088
LQFAHWPHT

SEQ ID NO: 20176 - protein, 9 aa, Homo sapiens
  heavy chain complementarity determining region 3 for antibody 10088
EGWGGLSNY

SEQ ID NO: 20177 - protein, 9 aa, Homo sapiens
  light chain complementarity determining region 3 for antibody 10089
LQFAHWPHT

SEQ ID NO: 20178 - protein, 11 aa, Homo sapiens
  heavy chain complementarity determining region 3 for antibody 10089
ATFGQQWRLAH

SEQ ID NO: 20179 - protein, 9 aa, Homo sapiens
  light chain complementarity determining region 3 for antibody 10090
LQFAHWPHT

SEQ ID NO: 20180 - protein, 15 aa, Homo sapiens
  heavy chain complementarity determining region 3 for antibody 10090
ARSMVSGTTDDAFDI

SEQ ID NO: 20181 - protein, 9 aa, Homo sapiens
  light chain complementarity determining region 3 for antibody 10091
LQFAHWPHT

SEQ ID NO: 20182 - protein, 12 aa, Homo sapiens
  heavy chain complementarity determining region 3 for antibody 10091
ARLDWNYRAFDI

SEQ ID NO: 20183 - protein, 9 aa, Homo sapiens
  light chain complementarity determining region 3 for antibody 10092
LQFAHWPHT

SEQ ID NO: 20184 - protein, 9 aa, Homo sapiens
  heavy chain complementarity determining region 3 for antibody 10092
ARGHYGPDY

SEQ ID NO: 20185 - protein, 9 aa, Homo sapiens
  light chain complementarity determining region 3 for antibody 10093
LQFAHWPHT

SEQ ID NO: 20186 - protein, 16 aa, Homo sapiens
  heavy chain complementarity determining region 3 for antibody 10093
ARGHTNPGERRGGSDF

SEQ ID NO: 20187 - protein, 9 aa, Homo sapiens
  light chain complementarity determining region 3 for antibody 10094
LQFAHWPHT

SEQ ID NO: 20188 - protein, 18 aa, Homo sapiens
  heavy chain complementarity determining region 3 for antibody 10094
ARGDYPEGRTGYFLDFDY

SEQ ID NO: 20189 - protein, 9 aa, Homo sapiens
  light chain complementarity determining region 3 for antibody 10095
LQFAHWPHT

SEQ ID NO: 20190 - protein, 13 aa, Homo sapiens
  heavy chain complementarity determining region 3 for antibody 10095
AKEGSSPGPDFDY

SEQ ID NO: 20191 - protein, 9 aa, Homo sapiens
  light chain complementarity determining region 3 for antibody 10096
LQFAHWPHT

SEQ ID NO: 20192 - protein, 8 aa, Homo sapiens
  heavy chain complementarity determining region 3 for antibody 10096
AGWGYANY

SEQ ID NO: 20193 - protein, 9 aa, Homo sapiens
  light chain complementarity determining region 3 for antibody 10097
LQFAHWPHT

SEQ ID NO: 20194 - protein, 9 aa, Homo sapiens
  heavy chain complementarity determining region 3 for antibody 10097
AGWGGLSKY

SEQ ID NO: 20195 - protein, 9 aa, Homo sapiens
  light chain complementarity determining region 3 for antibody 10098
LQFAHWPHT

SEQ ID NO: 20196 - protein, 9 aa, Homo sapiens
  heavy chain complementarity determining region 3 for antibody 10098
AGWGGLSDY

SEQ ID NO: 20197 - protein, 9 aa, Homo sapiens
  light chain complementarity determining region 3 for antibody 10099
LQFAHWPHT

SEQ ID NO: 20198 - protein, 9 aa, Homo sapiens
  heavy chain complementarity determining region 3 for antibody 10099
AGWGGLPNY

SEQ ID NO: 20199 - protein, 9 aa, Homo sapiens
  light chain complementarity determining region 3 for antibody 10100
LQFAHWPHT

SEQ ID NO: 20200 - protein, 9 aa, Homo sapiens
  heavy chain complementarity determining region 3 for antibody 10100
ACWGGLSNY

SEQ ID NO: 20201 - protein, 9 aa, Homo sapiens
  light chain complementarity determining region 3 for antibody 10101
LQFAHWLHT

SEQ ID NO: 20202 - protein, 9 aa, Homo sapiens
  heavy chain complementarity determining region 3 for antibody 10101
AGWGGLSNY

SEQ ID NO: 20203 - protein, 9 aa, Homo sapiens
  light chain complementarity determining region 3 for antibody 10102
LQFAHCPHT

SEQ ID NO: 20204 - protein, 9 aa, Homo sapiens
  heavy chain complementarity determining region 3 for antibody 10102
AGWGGLSNY

SEQ ID NO: 20205 - protein, 9 aa, Homo sapiens
  light chain complementarity determining region 3 for antibody 10103
LQDYTYPFT

SEQ ID NO: 20206 - protein, 18 aa, Homo sapiens
  heavy chain complementarity determining region 3 for antibody 10103
ARGVDTVMNGDYHYGMDV

SEQ ID NO: 20207 - protein, 9 aa, Homo sapiens
  light chain complementarity determining region 3 for antibody 10104
LQDYTYPFS

SEQ ID NO: 20208 - protein, 16 aa, Homo sapiens
  heavy chain complementarity determining region 3 for antibody 10104
VTGVGDHRDSYTTLDY

SEQ ID NO: 20209 - protein, 9 aa, Homo sapiens
  light chain complementarity determining region 3 for antibody 10105
LQDYTYPFS

SEQ ID NO: 20210 - protein, 16 aa, Homo sapiens
  heavy chain complementarity determining region 3 for antibody 10105
VTDLGDHRDSYTTLDY

SEQ ID NO: 20211 - protein, 9 aa, Homo sapiens
  light chain complementarity determining region 3 for antibody 10106
LQDYTYPFS

SEQ ID NO: 20212 - protein, 16 aa, Homo sapiens
  heavy chain complementarity determining region 3 for antibody 10106
VTDDGDHRDSYTTLDY

SEQ ID NO: 20213 - protein, 9 aa, Homo sapiens
  light chain complementarity determining region 3 for antibody 10107
LQDYTYPFS

SEQ ID NO: 20214 - protein, 16 aa, Homo sapiens
  heavy chain complementarity determining region 3 for antibody 10107
VKDVGDHRDSYTTLDY

SEQ ID NO: 20215 - protein, 9 aa, Homo sapiens
  light chain complementarity determining region 3 for antibody 10108
LQDYTYPFS

SEQ ID NO: 20216 - protein, 16 aa, Homo sapiens
  heavy chain complementarity determining region 3 for antibody 10108
ATEVGDHSDRFTTLDY

SEQ ID NO: 20217 - protein, 9 aa, Homo sapiens
  light chain complementarity determining region 3 for antibody 10109
LQDYTYPFS

SEQ ID NO: 20218 - protein, 16 aa, Homo sapiens
  heavy chain complementarity determining region 3 for antibody 10109
ATDVGVHSDRFTTLDY

SEQ ID NO: 20219 - protein, 9 aa, Homo sapiens
  light chain complementarity determining region 3 for antibody 10110
LQDYTYPFS

SEQ ID NO: 20220 - protein, 16 aa, Homo sapiens
  heavy chain complementarity determining region 3 for antibody 10110
ATDVGGHSDRFTTLDY

SEQ ID NO: 20221 - protein, 9 aa, Homo sapiens
  light chain complementarity determining region 3 for antibody 10111
LQDYTYPFS

SEQ ID NO: 20222 - protein, 16 aa, Homo sapiens
  heavy chain complementarity determining region 3 for antibody 10111
ATDVGDHSGRFTTLDY

SEQ ID NO: 20223 - protein, 9 aa, Homo sapiens
  light chain complementarity determining region 3 for antibody 10112
LQDYTYPFS

SEQ ID NO: 20224 - protein, 16 aa, Homo sapiens
  heavy chain complementarity determining region 3 for antibody 10112
ATDVGDHSDRSTTLDY

SEQ ID NO: 20225 - protein, 9 aa, Homo sapiens
  light chain complementarity determining region 3 for antibody 10113
LQDYTYPFS

SEQ ID NO: 20226 - protein, 16 aa, Homo sapiens
  heavy chain complementarity determining region 3 for antibody 10113
ATDVGDHSDRFSTLDY

SEQ ID NO: 20227 - protein, 9 aa, Homo sapiens
  light chain complementarity determining region 3 for antibody 10114
LQDYTYPFS

SEQ ID NO: 20228 - protein, 16 aa, Homo sapiens
  heavy chain complementarity determining region 3 for antibody 10114
ATDVGDHGDRFTTLDY

SEQ ID NO: 20229 - protein, 9 aa, Homo sapiens
  light chain complementarity determining region 3 for antibody 10115
LQDYTYPFS

SEQ ID NO: 20230 - protein, 16 aa, Homo sapiens
  heavy chain complementarity determining region 3 for antibody 10115
ATDVGAHSDRFTTLDY

SEQ ID NO: 20231 - protein, 9 aa, Homo sapiens
  light chain complementarity determining region 3 for antibody 10116
LQDYTYPFS

SEQ ID NO: 20232 - protein, 13 aa, Homo sapiens
  heavy chain complementarity determining region 3 for antibody 10116
AKEGSSAGPDFDY

SEQ ID NO: 20233 - protein, 9 aa, Homo sapiens
  light chain complementarity determining region 3 for antibody 10117
LQDYSYPWT

SEQ ID NO: 20234 - protein, 14 aa, Homo sapiens
  heavy chain complementarity determining region 3 for antibody 10117
CRGWLDPATPHYDF

SEQ ID NO: 20235 - protein, 9 aa, Homo sapiens
  light chain complementarity determining region 3 for antibody 10118
LQDYSYPRT

SEQ ID NO: 20236 - protein, 15 aa, Homo sapiens
  heavy chain complementarity determining region 3 for antibody 10118
AKDRAAGAFADAFDI

SEQ ID NO: 20237 - protein, 9 aa, Homo sapiens
  light chain complementarity determining region 3 for antibody 10119
LQDYSYPLS

SEQ ID NO: 20238 - protein, 16 aa, Homo sapiens
  heavy chain complementarity determining region 3 for antibody 10119
VSDVGDHRDRYTTLDY

SEQ ID NO: 20239 - protein, 9 aa, Homo sapiens
  light chain complementarity determining region 3 for antibody 10120
LQDYSYPLS

SEQ ID NO: 20240 - protein, 16 aa, Homo sapiens
  heavy chain complementarity determining region 3 for antibody 10120
TAGGGDHRDRYVTLDH

SEQ ID NO: 20241 - protein, 9 aa, Homo sapiens
  light chain complementarity determining region 3 for antibody 10121
LQDYSYPLS

SEQ ID NO: 20242 - protein, 16 aa, Homo sapiens
  heavy chain complementarity determining region 3 for antibody 10121
TADVGDHRDRYVTLDR

SEQ ID NO: 20243 - protein, 9 aa, Homo sapiens
  light chain complementarity determining region 3 for antibody 10122
LQDYSYPLS

SEQ ID NO: 20244 - protein, 16 aa, Homo sapiens
  heavy chain complementarity determining region 3 for antibody 10122
TADVGDHRDRCVTLDH

SEQ ID NO: 20245 - protein, 9 aa, Homo sapiens
  light chain complementarity determining region 3 for antibody 10123
LQDYSYPLS

SEQ ID NO: 20246 - protein, 16 aa, Homo sapiens
  heavy chain complementarity determining region 3 for antibody 10123
SSDVGDHRDRYVTLDH

SEQ ID NO: 20247 - protein, 9 aa, Homo sapiens
  light chain complementarity determining region 3 for antibody 10124
LQDYSYPLS

SEQ ID NO: 20248 - protein, 16 aa, Homo sapiens
  heavy chain complementarity determining region 3 for antibody 10124
IADVGDHRDRYVTLDH

SEQ ID NO: 20249 - protein, 9 aa, Homo sapiens
  light chain complementarity determining region 3 for antibody 10125
LQDYSYPLS

SEQ ID NO: 20250 - protein, 16 aa, Homo sapiens
  heavy chain complementarity determining region 3 for antibody 10125
IADVGDHRDRYVPLDH

SEQ ID NO: 20251 - protein, 9 aa, Homo sapiens
  light chain complementarity determining region 3 for antibody 10126
LQDYSYPLS

SEQ ID NO: 20252 - protein, 14 aa, Homo sapiens
  heavy chain complementarity determining region 3 for antibody 10126
ARLHGSGLGRWLDP

SEQ ID NO: 20253 - protein, 9 aa, Homo sapiens
  light chain complementarity determining region 3 for antibody 10127
LQDYSYPLS

SEQ ID NO: 20254 - protein, 13 aa, Homo sapiens
  heavy chain complementarity determining region 3 for antibody 10127
AKEGSSPGPDFEY

SEQ ID NO: 20255 - protein, 9 aa, Homo sapiens
  light chain complementarity determining region 3 for antibody 10128
LQDYSYPLP

SEQ ID NO: 20256 - protein, 16 aa, Homo sapiens
  heavy chain complementarity determining region 3 for antibody 10128
TADVGDHRDRYVTLDH

SEQ ID NO: 20257 - protein, 9 aa, Homo sapiens
  light chain complementarity determining region 3 for antibody 10129
LQDYSHVGT

SEQ ID NO: 20258 - protein, 9 aa, Homo sapiens
  heavy chain complementarity determining region 3 for antibody 10129
GSRRPYFDS

SEQ ID NO: 20259 - protein, 9 aa, Homo sapiens
  light chain complementarity determining region 3 for antibody 10130
LQDYNYPFT

SEQ ID NO: 20260 - protein, 16 aa, Homo sapiens
  heavy chain complementarity determining region 3 for antibody 10130
SADVGDHVDYYATLDY

SEQ ID NO: 20261 - protein, 9 aa, Homo sapiens
  light chain complementarity determining region 3 for antibody 10131
LQDYNYPFT

SEQ ID NO: 20262 - protein, 16 aa, Homo sapiens
  heavy chain complementarity determining region 3 for antibody 10131
SADLGDHVDYYASLDY

SEQ ID NO: 20263 - protein, 9 aa, Homo sapiens
  light chain complementarity determining region 3 for antibody 10132
LQDYNYPFT

SEQ ID NO: 20264 - protein, 16 aa, Homo sapiens
  heavy chain complementarity determining region 3 for antibody 10132
SADLGDDVDYYATLDY

SEQ ID NO: 20265 - protein, 9 aa, Homo sapiens
  light chain complementarity determining region 3 for antibody 10133
LQDYNYPFT

SEQ ID NO: 20266 - protein, 16 aa, Homo sapiens
  heavy chain complementarity determining region 3 for antibody 10133
AADLGDHADAYATLDS

SEQ ID NO: 20267 - protein, 9 aa, Homo sapiens
  light chain complementarity determining region 3 for antibody 10134
LQDYNYPFS

SEQ ID NO: 20268 - protein, 16 aa, Homo sapiens
  heavy chain complementarity determining region 3 for antibody 10134
AADLGDHADAYAALDS

SEQ ID NO: 20269 - protein, 9 aa, Homo sapiens
  light chain complementarity determining region 3 for antibody 10135
LQDYNNVGT

SEQ ID NO: 20270 - protein, 9 aa, Homo sapiens
  heavy chain complementarity determining region 3 for antibody 10135
GSRRPYFDY

SEQ ID NO: 20271 - protein, 9 aa, Homo sapiens
  light chain complementarity determining region 3 for antibody 10136
LQDYNHVWT

SEQ ID NO: 20272 - protein, 9 aa, Homo sapiens
  heavy chain complementarity determining region 3 for antibody 10136
GSRRPYFDS

SEQ ID NO: 20273 - protein, 9 aa, Homo sapiens
  light chain complementarity determining region 3 for antibody 10137
LQDYNHVVT

SEQ ID NO: 20274 - protein, 9 aa, Homo sapiens
  heavy chain complementarity determining region 3 for antibody 10137
GSRRPYFDS

SEQ ID NO: 20275 - protein, 9 aa, Homo sapiens
  light chain complementarity determining region 3 for antibody 10138
LQDYNHVRT

SEQ ID NO: 20276 - protein, 9 aa, Homo sapiens
  heavy chain complementarity determining region 3 for antibody 10138
GSRRPYFDY

SEQ ID NO: 20277 - protein, 9 aa, Homo sapiens
  light chain complementarity determining region 3 for antibody 10139
LQDYNHVGT

SEQ ID NO: 20278 - protein, 16 aa, Homo sapiens
  heavy chain complementarity determining region 3 for antibody 10139
VGPHLTYNSGWRYFDY

SEQ ID NO: 20279 - protein, 9 aa, Homo sapiens
  light chain complementarity determining region 3 for antibody 10140
LQDYNHVGT

SEQ ID NO: 20280 - protein, 14 aa, Homo sapiens
  heavy chain complementarity determining region 3 for antibody 10140
TRGHFDSTGFRLDY

SEQ ID NO: 20281 - protein, 9 aa, Homo sapiens
  light chain complementarity determining region 3 for antibody 10141
LQDYNHVGT

SEQ ID NO: 20282 - protein, 13 aa, Homo sapiens
  heavy chain complementarity determining region 3 for antibody 10141
TREGDSSGPDFHL

SEQ ID NO: 20283 - protein, 9 aa, Homo sapiens
  light chain complementarity determining region 3 for antibody 10142
LQDYNHVGT

SEQ ID NO: 20284 - protein, 13 aa, Homo sapiens
  heavy chain complementarity determining region 3 for antibody 10142
TKEGSSAGPDFVY

SEQ ID NO: 20285 - protein, 9 aa, Homo sapiens
  light chain complementarity determining region 3 for antibody 10143
LQDYNHVGT

SEQ ID NO: 20286 - protein, 12 aa, Homo sapiens
  heavy chain complementarity determining region 3 for antibody 10143
STDVETTFPSVS

SEQ ID NO: 20287 - protein, 9 aa, Homo sapiens
  light chain complementarity determining region 3 for antibody 10144
LQDYNHVGT

SEQ ID NO: 20288 - protein, 12 aa, Homo sapiens
  heavy chain complementarity determining region 3 for antibody 10144
SRDKGGRNGMDV

SEQ ID NO: 20289 - protein, 9 aa, Homo sapiens
  light chain complementarity determining region 3 for antibody 10145
LQDYNHVGT

SEQ ID NO: 20290 - protein, 9 aa, Homo sapiens
  heavy chain complementarity determining region 3 for antibody 10145
GSRRQYFDS

SEQ ID NO: 20291 - protein, 9 aa, Homo sapiens
  light chain complementarity determining region 3 for antibody 10146
LQDYNHVGT

SEQ ID NO: 20292 - protein, 9 aa, Homo sapiens
  heavy chain complementarity determining region 3 for antibody 10146
GSRRPYLDY

SEQ ID NO: 20293 - protein, 9 aa, Homo sapiens
  light chain complementarity determining region 3 for antibody 10147
LQDYNHVGT

SEQ ID NO: 20294 - protein, 9 aa, Homo sapiens
  heavy chain complementarity determining region 3 for antibody 10147
GSRRPYLDS

SEQ ID NO: 20295 - protein, 9 aa, Homo sapiens
  light chain complementarity determining region 3 for antibody 10148
LQDYNHVGT

SEQ ID NO: 20296 - protein, 9 aa, Homo sapiens
  heavy chain complementarity determining region 3 for antibody 10148
GSRRPYFVS

SEQ ID NO: 20297 - protein, 9 aa, Homo sapiens
  light chain complementarity determining region 3 for antibody 10149
LQDYNHVGT

SEQ ID NO: 20298 - protein, 9 aa, Homo sapiens
  heavy chain complementarity determining region 3 for antibody 10149
GSRRPYFHS

SEQ ID NO: 20299 - protein, 9 aa, Homo sapiens
  light chain complementarity determining region 3 for antibody 10150
LQDYNHVGT

SEQ ID NO: 20300 - protein, 9 aa, Homo sapiens
  heavy chain complementarity determining region 3 for antibody 10150
GSRRPYCDS

SEQ ID NO: 20301 - protein, 9 aa, Homo sapiens
  light chain complementarity determining region 3 for antibody 10151
LQDYNHVGT

SEQ ID NO: 20302 - protein, 9 aa, Homo sapiens
  heavy chain complementarity determining region 3 for antibody 10151
GRRRPYFDS

SEQ ID NO: 20303 - protein, 9 aa, Homo sapiens
  light chain complementarity determining region 3 for antibody 10152
LQDYNHVGT

SEQ ID NO: 20304 - protein, 14 aa, Homo sapiens
  heavy chain complementarity determining region 3 for antibody 10152
GRDVHTTGWTLGGY

SEQ ID NO: 20305 - protein, 9 aa, Homo sapiens
  light chain complementarity determining region 3 for antibody 10153
LQDYNHVGT

SEQ ID NO: 20306 - protein, 9 aa, Homo sapiens
  heavy chain complementarity determining region 3 for antibody 10153
ESRRPYFDS

SEQ ID NO: 20307 - protein, 9 aa, Homo sapiens
  light chain complementarity determining region 3 for antibody 10154
LQDYNHVGT

SEQ ID NO: 20308 - protein, 9 aa, Homo sapiens
  heavy chain complementarity determining region 3 for antibody 10154
ASRRPYFDS

SEQ ID NO: 20309 - protein, 9 aa, Homo sapiens
  light chain complementarity determining region 3 for antibody 10155
LQDYNHVGT

SEQ ID NO: 20310 - protein, 15 aa, Homo sapiens
  heavy chain complementarity determining region 3 for antibody 10155
ARVGRPYHNAWYFDN

SEQ ID NO: 20311 - protein, 9 aa, Homo sapiens
  light chain complementarity determining region 3 for antibody 10156
LQDYNHVGT

SEQ ID NO: 20312 - protein, 17 aa, Homo sapiens
  heavy chain complementarity determining region 3 for antibody 10156
ARNTMVHGWQRQGSVDH

SEQ ID NO: 20313 - protein, 9 aa, Homo sapiens
  light chain complementarity determining region 3 for antibody 10157
LQDYNHVGT

SEQ ID NO: 20314 - protein, 14 aa, Homo sapiens
  heavy chain complementarity determining region 3 for antibody 10157
ARLHGSGLGRWLDP

SEQ ID NO: 20315 - protein, 9 aa, Homo sapiens
  light chain complementarity determining region 3 for antibody 10158
LQDYNHVGT

SEQ ID NO: 20316 - protein, 9 aa, Homo sapiens
  heavy chain complementarity determining region 3 for antibody 10158
ARGSGYNYY

SEQ ID NO: 20317 - protein, 9 aa, Homo sapiens
  light chain complementarity determining region 3 for antibody 10159
LQDYNHVGT

SEQ ID NO: 20318 - protein, 14 aa, Homo sapiens
  heavy chain complementarity determining region 3 for antibody 10159
ARGHFDSTGFRLDY

SEQ ID NO: 20319 - protein, 9 aa, Homo sapiens
  light chain complementarity determining region 3 for antibody 10160
LQDYNHVGT

SEQ ID NO: 20320 - protein, 10 aa, Homo sapiens
  heavy chain complementarity determining region 3 for antibody 10160
ARETSGSYDI

SEQ ID NO: 20321 - protein, 9 aa, Homo sapiens
  light chain complementarity determining region 3 for antibody 10161
LQDYNHVGT

SEQ ID NO: 20322 - protein, 13 aa, Homo sapiens
  heavy chain complementarity determining region 3 for antibody 10161
AKEGSSPGPDFEY

SEQ ID NO: 20323 - protein, 9 aa, Homo sapiens
  light chain complementarity determining region 3 for antibody 10162
LQDYNHVGT

SEQ ID NO: 20324 - protein, 13 aa, Homo sapiens
  heavy chain complementarity determining region 3 for antibody 10162
AKEGSSPGPDFDY

SEQ ID NO: 20325 - protein, 9 aa, Homo sapiens
  light chain complementarity determining region 3 for antibody 10163
LQDYNHVGK

SEQ ID NO: 20326 - protein, 9 aa, Homo sapiens
  heavy chain complementarity determining region 3 for antibody 10163
GSRRPYFDY

SEQ ID NO: 20327 - protein, 9 aa, Homo sapiens
  light chain complementarity determining region 3 for antibody 10164
LQDYNHVGA

SEQ ID NO: 20328 - protein, 9 aa, Homo sapiens
  heavy chain complementarity determining region 3 for antibody 10164
GSRRPYFDS

SEQ ID NO: 20329 - protein, 9 aa, Homo sapiens
  light chain complementarity determining region 3 for antibody 10165
LQDYNHSAV

SEQ ID NO: 20330 - protein, 9 aa, Homo sapiens
  heavy chain complementarity determining region 3 for antibody 10165
GSRRPYFDS

SEQ ID NO: 20331 - protein, 9 aa, Homo sapiens
  light chain complementarity determining region 3 for antibody 10166
LQDYNHSAV

SEQ ID NO: 20332 - protein, 12 aa, Homo sapiens
  heavy chain complementarity determining region 3 for antibody 10166
ARGNITGYKGDY

SEQ ID NO: 20333 - protein, 9 aa, Homo sapiens
  light chain complementarity determining region 3 for antibody 10167
LQDYNHSAV

SEQ ID NO: 20334 - protein, 12 aa, Homo sapiens
  heavy chain complementarity determining region 3 for antibody 10167
ARGHIAGYKGDY

SEQ ID NO: 20335 - protein, 9 aa, Homo sapiens
  light chain complementarity determining region 3 for antibody 10168
LQDYNHSAI

SEQ ID NO: 20336 - protein, 12 aa, Homo sapiens
  heavy chain complementarity determining region 3 for antibody 10168
ARGHITGYKGDY

SEQ ID NO: 20337 - protein, 9 aa, Homo sapiens
  light chain complementarity determining region 3 for antibody 10169
LQDYNHLGT

SEQ ID NO: 20338 - protein, 9 aa, Homo sapiens
  heavy chain complementarity determining region 3 for antibody 10169
ARRRPYLDY

SEQ ID NO: 20339 - protein, 9 aa, Homo sapiens
  light chain complementarity determining region 3 for antibody 10170
LQDYNHLGT

SEQ ID NO: 20340 - protein, 10 aa, Homo sapiens
  heavy chain complementarity determining region 3 for antibody 10170
ARERSGSYDI

SEQ ID NO: 20341 - protein, 9 aa, Homo sapiens
  light chain complementarity determining region 3 for antibody 10171
LQDYNHLGP

SEQ ID NO: 20342 - protein, 9 aa, Homo sapiens
  heavy chain complementarity determining region 3 for antibody 10171
ASRRPYLDY

SEQ ID NO: 20343 - protein, 9 aa, Homo sapiens
  light chain complementarity determining region 3 for antibody 10172
LQDYNHLGK

SEQ ID NO: 20344 - protein, 9 aa, Homo sapiens
  heavy chain complementarity determining region 3 for antibody 10172
ASRRPYLDY

SEQ ID NO: 20345 - protein, 9 aa, Homo sapiens
  light chain complementarity determining region 3 for antibody 10173
LQDYNFPRT

SEQ ID NO: 20346 - protein, 16 aa, Homo sapiens
  heavy chain complementarity determining region 3 for antibody 10173
AREQKWLQENPHAFDI

SEQ ID NO: 20347 - protein, 9 aa, Homo sapiens
  light chain complementarity determining region 3 for antibody 10174
LQDYNFPRT

SEQ ID NO: 20348 - protein, 19 aa, Homo sapiens
  heavy chain complementarity determining region 3 for antibody 10174
AREIVVPTADNGNRDAFDL

SEQ ID NO: 20349 - protein, 9 aa, Homo sapiens
  light chain complementarity determining region 3 for antibody 10175
LQDYKYPFS

SEQ ID NO: 20350 - protein, 11 aa, Homo sapiens
  heavy chain complementarity determining region 3 for antibody 10175
VRVSTGWNFDY

SEQ ID NO: 20351 - protein, 9 aa, Homo sapiens
  light chain complementarity determining region 3 for antibody 10176
LQDYKYPFS

SEQ ID NO: 20352 - protein, 16 aa, Homo sapiens
  heavy chain complementarity determining region 3 for antibody 10176
DADLGDHADAYATLDS

SEQ ID NO: 20353 - protein, 9 aa, Homo sapiens
  light chain complementarity determining region 3 for antibody 10177
LQDYKYPFS

SEQ ID NO: 20354 - protein, 16 aa, Homo sapiens
  heavy chain complementarity determining region 3 for antibody 10177
AAELGDHADAYATLDS

SEQ ID NO: 20355 - protein, 9 aa, Homo sapiens
  light chain complementarity determining region 3 for antibody 10178
LQDYKYPFS

SEQ ID NO: 20356 - protein, 16 aa, Homo sapiens
  heavy chain complementarity determining region 3 for antibody 10178
AADSGDHADAYATLDS

SEQ ID NO: 20357 - protein, 9 aa, Homo sapiens
  light chain complementarity determining region 3 for antibody 10179
LQDYKYPFS

SEQ ID NO: 20358 - protein, 16 aa, Homo sapiens
  heavy chain complementarity determining region 3 for antibody 10179
AADLSDHADAYATLDS

SEQ ID NO: 20359 - protein, 9 aa, Homo sapiens
  light chain complementarity determining region 3 for antibody 10180
LQDYKYPFS

SEQ ID NO: 20360 - protein, 16 aa, Homo sapiens
  heavy chain complementarity determining region 3 for antibody 10180
AADLGGHADAYATLDS

SEQ ID NO: 20361 - protein, 9 aa, Homo sapiens
  light chain complementarity determining region 3 for antibody 10181
LQDYKYPFS

SEQ ID NO: 20362 - protein, 16 aa, Homo sapiens
  heavy chain complementarity determining region 3 for antibody 10181
AADLGDHADAYATLDA

SEQ ID NO: 20363 - protein, 9 aa, Homo sapiens
  light chain complementarity determining region 3 for antibody 10182
LQDYKYPFS

SEQ ID NO: 20364 - protein, 16 aa, Homo sapiens
  heavy chain complementarity determining region 3 for antibody 10182
AADLGDHADAYATFDS

SEQ ID NO: 20365 - protein, 9 aa, Homo sapiens
  light chain complementarity determining region 3 for antibody 10183
LQDYKYPFG

SEQ ID NO: 20366 - protein, 16 aa, Homo sapiens
  heavy chain complementarity determining region 3 for antibody 10183
AADLGDHADAYATLDS

SEQ ID NO: 20367 - protein, 9 aa, Homo sapiens
  light chain complementarity determining region 3 for antibody 10184
LQDYIYPFS

SEQ ID NO: 20368 - protein, 16 aa, Homo sapiens
  heavy chain complementarity determining region 3 for antibody 10184
VSDEAAHRDIYTTLDY

SEQ ID NO: 20369 - protein, 9 aa, Homo sapiens
  light chain complementarity determining region 3 for antibody 10185
LQDYIYPFS

SEQ ID NO: 20370 - protein, 16 aa, Homo sapiens
  heavy chain complementarity determining region 3 for antibody 10185
TSDVGDHRDSYTPLDF

SEQ ID NO: 20371 - protein, 9 aa, Homo sapiens
  light chain complementarity determining region 3 for antibody 10186
LQDYIYPFS

SEQ ID NO: 20372 - protein, 16 aa, Homo sapiens
  heavy chain complementarity determining region 3 for antibody 10186
FTDVGDHRDTYTTLDY

SEQ ID NO: 20373 - protein, 9 aa, Homo sapiens
  light chain complementarity determining region 3 for antibody 10187
LQDYIYPFS

SEQ ID NO: 20374 - protein, 16 aa, Homo sapiens
  heavy chain complementarity determining region 3 for antibody 10187
FTDEGDHRDIYTTLDY

SEQ ID NO: 20375 - protein, 9 aa, Homo sapiens
  light chain complementarity determining region 3 for antibody 10188
LQDYIYPFS

SEQ ID NO: 20376 - protein, 16 aa, Homo sapiens
  heavy chain complementarity determining region 3 for antibody 10188
FSNDGAPRDIYTTLDY

SEQ ID NO: 20377 - protein, 9 aa, Homo sapiens
  light chain complementarity determining region 3 for antibody 10189
LQDYIYPFS

SEQ ID NO: 20378 - protein, 16 aa, Homo sapiens
  heavy chain complementarity determining region 3 for antibody 10189
FSNDAATPDIYTTLDY

SEQ ID NO: 20379 - protein, 9 aa, Homo sapiens
  light chain complementarity determining region 3 for antibody 10190
LQDYIYPFS

SEQ ID NO: 20380 - protein, 16 aa, Homo sapiens
  heavy chain complementarity determining region 3 for antibody 10190
FSNDAAPPDIYTTLDY

SEQ ID NO: 20381 - protein, 9 aa, Homo sapiens
  light chain complementarity determining region 3 for antibody 10191
LQDYIYPFS

SEQ ID NO: 20382 - protein, 16 aa, Homo sapiens
  heavy chain complementarity determining region 3 for antibody 10191
FSDVGDHRDIYTTLDY

SEQ ID NO: 20383 - protein, 9 aa, Homo sapiens
  light chain complementarity determining region 3 for antibody 10192
LQDYIYPFS

SEQ ID NO: 20384 - protein, 16 aa, Homo sapiens
  heavy chain complementarity determining region 3 for antibody 10192
FSDEGDHRDIYTTLDY

SEQ ID NO: 20385 - protein, 9 aa, Homo sapiens
  light chain complementarity determining region 3 for antibody 10193
LQDYIYPFS

SEQ ID NO: 20386 - protein, 16 aa, Homo sapiens
  heavy chain complementarity determining region 3 for antibody 10193
FSDDGDPRDIYTTLDY

SEQ ID NO: 20387 - protein, 9 aa, Homo sapiens
  light chain complementarity determining region 3 for antibody 10194
LQDYIYPFS

SEQ ID NO: 20388 - protein, 16 aa, Homo sapiens
  heavy chain complementarity determining region 3 for antibody 10194
FLNEGATTDIYTTLDY

SEQ ID NO: 20389 - protein, 9 aa, Homo sapiens
  light chain complementarity determining region 3 for antibody 10195
LQDYIYPFS

SEQ ID NO: 20390 - protein, 16 aa, Homo sapiens
  heavy chain complementarity determining region 3 for antibody 10195
FFNDAATTDIYTTLDY

SEQ ID NO: 20391 - protein, 9 aa, Homo sapiens
  light chain complementarity determining region 3 for antibody 10196
LQDYIYPFS

SEQ ID NO: 20392 - protein, 12 aa, Homo sapiens
  heavy chain complementarity determining region 3 for antibody 10196
ARDKGGRNGMDV

SEQ ID NO: 20393 - protein, 8 aa, Homo sapiens
  light chain complementarity determining region 3 for antibody 10197
LQDYIFAS

SEQ ID NO: 20394 - protein, 7 aa, Homo sapiens
  heavy chain complementarity determining region 3 for antibody 10197
RWITNDY

SEQ ID NO: 20395 - protein, 8 aa, Homo sapiens
  light chain complementarity determining region 3 for antibody 10198
LQDYIFAS

SEQ ID NO: 20396 - protein, 7 aa, Homo sapiens
  heavy chain complementarity determining region 3 for antibody 10198
LWITTDY

SEQ ID NO: 20397 - protein, 8 aa, Homo sapiens
  light chain complementarity determining region 3 for antibody 10199
LQDYIFAS

SEQ ID NO: 20398 - protein, 7 aa, Homo sapiens
  heavy chain complementarity determining region 3 for antibody 10199
LWIANDY

SEQ ID NO: 20399 - protein, 9 aa, Homo sapiens
  light chain complementarity determining region 3 for antibody 10200
LQDYEYPFS

SEQ ID NO: 20400 - protein, 16 aa, Homo sapiens
  heavy chain complementarity determining region 3 for antibody 10200
TSDVGDHRDSYTTLDI

SEQ ID NO: 20401 - protein, 9 aa, Homo sapiens
  light chain complementarity determining region 3 for antibody 10201
LQDYEYPFS

SEQ ID NO: 20402 - protein, 16 aa, Homo sapiens
  heavy chain complementarity determining region 3 for antibody 10201
AADLGDHADAYATLDS

SEQ ID NO: 20403 - protein, 9 aa, Homo sapiens
  light chain complementarity determining region 3 for antibody 10202
LQDRTYPYT

SEQ ID NO: 20404 - protein, 16 aa, Homo sapiens
  heavy chain complementarity determining region 3 for antibody 10202
ARDRLAADGPHVEFNV

SEQ ID NO: 20405 - protein, 9 aa, Homo sapiens
  light chain complementarity determining region 3 for antibody 10203
LQDRKYPVS

SEQ ID NO: 20406 - protein, 16 aa, Homo sapiens
  heavy chain complementarity determining region 3 for antibody 10203
GADLGDHGDAYATLDS

SEQ ID NO: 20407 - protein, 9 aa, Homo sapiens
  light chain complementarity determining region 3 for antibody 10204
LQDNSYPFT

SEQ ID NO: 20408 - protein, 15 aa, Homo sapiens
  heavy chain complementarity determining region 3 for antibody 10204
TRDEFAGSHIEAFDI

SEQ ID NO: 20409 - protein, 9 aa, Homo sapiens
  light chain complementarity determining region 3 for antibody 10205
LQDNSYPFT

SEQ ID NO: 20410 - protein, 15 aa, Homo sapiens
  heavy chain complementarity determining region 3 for antibody 10205
TRDECTGSHIEAFDI

SEQ ID NO: 20411 - protein, 9 aa, Homo sapiens
  light chain complementarity determining region 3 for antibody 10206
LQDNSYPFT

SEQ ID NO: 20412 - protein, 14 aa, Homo sapiens
  heavy chain complementarity determining region 3 for antibody 10206
CRGWLDPATPHYDF

SEQ ID NO: 20413 - protein, 9 aa, Homo sapiens
  light chain complementarity determining region 3 for antibody 10207
LQDNSYPFT

SEQ ID NO: 20414 - protein, 15 aa, Homo sapiens
  heavy chain complementarity determining region 3 for antibody 10207
ARIWTSSTNCRYMDV

SEQ ID NO: 20415 - protein, 9 aa, Homo sapiens
  light chain complementarity determining region 3 for antibody 10208
LQDNKYPFT

SEQ ID NO: 20416 - protein, 16 aa, Homo sapiens
  heavy chain complementarity determining region 3 for antibody 10208
AADLGDHTDAYATLDN

SEQ ID NO: 20417 - protein, 9 aa, Homo sapiens
  light chain complementarity determining region 3 for antibody 10209
LQDNGYPRT

SEQ ID NO: 20418 - protein, 15 aa, Homo sapiens
  heavy chain complementarity determining region 3 for antibody 10209
ARLGLLAGGPNWFDP

SEQ ID NO: 20419 - protein, 9 aa, Homo sapiens
  light chain complementarity determining region 3 for antibody 10210
LQDHTYPFS

SEQ ID NO: 20420 - protein, 16 aa, Homo sapiens
  heavy chain complementarity determining region 3 for antibody 10210
AADLGDHSDAYATLDY

SEQ ID NO: 20421 - protein, 9 aa, Homo sapiens
  light chain complementarity determining region 3 for antibody 10211
LQDHNYPFT

SEQ ID NO: 20422 - protein, 12 aa, Homo sapiens
  heavy chain complementarity determining region 3 for antibody 10211
ARDKGGRNGMDV

SEQ ID NO: 20423 - protein, 9 aa, Homo sapiens
  light chain complementarity determining region 3 for antibody 10212
LQDHNYPFT

SEQ ID NO: 20424 - protein, 16 aa, Homo sapiens
  heavy chain complementarity determining region 3 for antibody 10212
AADVGDHSDAYASLDS

SEQ ID NO: 20425 - protein, 9 aa, Homo sapiens
  light chain complementarity determining region 3 for antibody 10213
LQDHNYPFT

SEQ ID NO: 20426 - protein, 16 aa, Homo sapiens
  heavy chain complementarity determining region 3 for antibody 10213
AADLGDHADVYASLDS

SEQ ID NO: 20427 - protein, 9 aa, Homo sapiens
  light chain complementarity determining region 3 for antibody 10214
LQDHNYPFS

SEQ ID NO: 20428 - protein, 16 aa, Homo sapiens
  heavy chain complementarity determining region 3 for antibody 10214
AADLGDHTDPYATLDS

SEQ ID NO: 20429 - protein, 9 aa, Homo sapiens
  light chain complementarity determining region 3 for antibody 10215
LQDHNYPFS

SEQ ID NO: 20430 - protein, 16 aa, Homo sapiens
  heavy chain complementarity determining region 3 for antibody 10215
AADLGDHADAYAPLDN

SEQ ID NO: 20431 - protein, 9 aa, Homo sapiens
  light chain complementarity determining region 3 for antibody 10216
LQDHNYPFS

SEQ ID NO: 20432 - protein, 16 aa, Homo sapiens
  heavy chain complementarity determining region 3 for antibody 10216
AADLDDHTDAYATLES

SEQ ID NO: 20433 - protein, 9 aa, Homo sapiens
  light chain complementarity determining region 3 for antibody 10217
LQDHNYPFS

SEQ ID NO: 20434 - protein, 16 aa, Homo sapiens
  heavy chain complementarity determining region 3 for antibody 10217
AADLDDHTDAYAALDS

SEQ ID NO: 20435 - protein, 9 aa, Homo sapiens
  light chain complementarity determining region 3 for antibody 10218
LQDHNYPFA

SEQ ID NO: 20436 - protein, 16 aa, Homo sapiens
  heavy chain complementarity determining region 3 for antibody 10218
AADVGDHIDVYASLDY

SEQ ID NO: 20437 - protein, 9 aa, Homo sapiens
  light chain complementarity determining region 3 for antibody 10219
LQDHNYPFA

SEQ ID NO: 20438 - protein, 16 aa, Homo sapiens
  heavy chain complementarity determining region 3 for antibody 10219
AADVGDHIDVYAPLDY

SEQ ID NO: 20439 - protein, 9 aa, Homo sapiens
  light chain complementarity determining region 3 for antibody 10220
LQDHNSPFS

SEQ ID NO: 20440 - protein, 16 aa, Homo sapiens
  heavy chain complementarity determining region 3 for antibody 10220
AADLDDHTDAYATLDS

SEQ ID NO: 20441 - protein, 9 aa, Homo sapiens
  light chain complementarity determining region 3 for antibody 10221
LQDHKYPLS

SEQ ID NO: 20442 - protein, 16 aa, Homo sapiens
  heavy chain complementarity determining region 3 for antibody 10221
AADLGDHADAYATLDS

SEQ ID NO: 20443 - protein, 9 aa, Homo sapiens
  light chain complementarity determining region 3 for antibody 10222
LQDHKYPFT

SEQ ID NO: 20444 - protein, 16 aa, Homo sapiens
  heavy chain complementarity determining region 3 for antibody 10222
VRDLAGFTRGGSTFDY

SEQ ID NO: 20445 - protein, 9 aa, Homo sapiens
  light chain complementarity determining region 3 for antibody 10223
LQDHKYPFT

SEQ ID NO: 20446 - protein, 16 aa, Homo sapiens
  heavy chain complementarity determining region 3 for antibody 10223
TADLGDHSDVYATLDS

SEQ ID NO: 20447 - protein, 9 aa, Homo sapiens
  light chain complementarity determining region 3 for antibody 10224
LQDHKYPFT

SEQ ID NO: 20448 - protein, 17 aa, Homo sapiens
  heavy chain complementarity determining region 3 for antibody 10224
ARNTMVGTWQRQGNLDH

SEQ ID NO: 20449 - protein, 9 aa, Homo sapiens
  light chain complementarity determining region 3 for antibody 10225
LQDHKYPFT

SEQ ID NO: 20450 - protein, 8 aa, Homo sapiens
  heavy chain complementarity determining region 3 for antibody 10225
AGWGYGNY

SEQ ID NO: 20451 - protein, 9 aa, Homo sapiens
  light chain complementarity determining region 3 for antibody 10226
LQDHKYPFT

SEQ ID NO: 20452 - protein, 13 aa, Homo sapiens
  heavy chain complementarity determining region 3 for antibody 10226
AGEGPAPGPGFDY

SEQ ID NO: 20453 - protein, 9 aa, Homo sapiens
  light chain complementarity determining region 3 for antibody 10227
LQDHKYPFT

SEQ ID NO: 20454 - protein, 13 aa, Homo sapiens
  heavy chain complementarity determining region 3 for antibody 10227
AGEGPAPGPDSDY

SEQ ID NO: 20455 - protein, 9 aa, Homo sapiens
  light chain complementarity determining region 3 for antibody 10228
LQDHKYPFT

SEQ ID NO: 20456 - protein, 16 aa, Homo sapiens
  heavy chain complementarity determining region 3 for antibody 10228
AADLGVHTDAYATLDN

SEQ ID NO: 20457 - protein, 9 aa, Homo sapiens
  light chain complementarity determining region 3 for antibody 10229
LQDHKYPFT

SEQ ID NO: 20458 - protein, 16 aa, Homo sapiens
  heavy chain complementarity determining region 3 for antibody 10229
AADLGNHTDAYATLDN

SEQ ID NO: 20459 - protein, 9 aa, Homo sapiens
  light chain complementarity determining region 3 for antibody 10230
LQDHKYPFT

SEQ ID NO: 20460 - protein, 16 aa, Homo sapiens
  heavy chain complementarity determining region 3 for antibody 10230
AADLGGHTDAYATLDN

SEQ ID NO: 20461 - protein, 9 aa, Homo sapiens
  light chain complementarity determining region 3 for antibody 10231
LQDHKYPFT

SEQ ID NO: 20462 - protein, 16 aa, Homo sapiens
  heavy chain complementarity determining region 3 for antibody 10231
AADLGDLTDAYATLDN

SEQ ID NO: 20463 - protein, 9 aa, Homo sapiens
  light chain complementarity determining region 3 for antibody 10232
LQDHKYPFT

SEQ ID NO: 20464 - protein, 16 aa, Homo sapiens
  heavy chain complementarity determining region 3 for antibody 10232
AADLGDHTGAYATLDN

SEQ ID NO: 20465 - protein, 9 aa, Homo sapiens
  light chain complementarity determining region 3 for antibody 10233
LQDHKYPFT

SEQ ID NO: 20466 - protein, 16 aa, Homo sapiens
  heavy chain complementarity determining region 3 for antibody 10233
AADLGDHTDTYATLDN

SEQ ID NO: 20467 - protein, 9 aa, Homo sapiens
  light chain complementarity determining region 3 for antibody 10234
LQDHKYPFT

SEQ ID NO: 20468 - protein, 16 aa, Homo sapiens
  heavy chain complementarity determining region 3 for antibody 10234
AADLGDHTDAYATWDN

SEQ ID NO: 20469 - protein, 9 aa, Homo sapiens
  light chain complementarity determining region 3 for antibody 10235
LQDHKYPFT

SEQ ID NO: 20470 - protein, 16 aa, Homo sapiens
  heavy chain complementarity determining region 3 for antibody 10235
AADLGDHTAAYATLDN

SEQ ID NO: 20471 - protein, 9 aa, Homo sapiens
  light chain complementarity determining region 3 for antibody 10236
LQDHKYPFT

SEQ ID NO: 20472 - protein, 16 aa, Homo sapiens
  heavy chain complementarity determining region 3 for antibody 10236
AADLGDHNDAYATLDN

SEQ ID NO: 20473 - protein, 9 aa, Homo sapiens
  light chain complementarity determining region 3 for antibody 10237
LQDHKYPFT

SEQ ID NO: 20474 - protein, 16 aa, Homo sapiens
  heavy chain complementarity determining region 3 for antibody 10237
AADLGAHTDAYASLDN

SEQ ID NO: 20475 - protein, 9 aa, Homo sapiens
  light chain complementarity determining region 3 for antibody 10238
LQDHKYPFT

SEQ ID NO: 20476 - protein, 16 aa, Homo sapiens
  heavy chain complementarity determining region 3 for antibody 10238
AADLGAHSDVYATLDS

SEQ ID NO: 20477 - protein, 9 aa, Homo sapiens
  light chain complementarity determining region 3 for antibody 10239
LQDHKYPFT

SEQ ID NO: 20478 - protein, 16 aa, Homo sapiens
  heavy chain complementarity determining region 3 for antibody 10239
AADLDDHTDAYATLDN

SEQ ID NO: 20479 - protein, 9 aa, Homo sapiens
  light chain complementarity determining region 3 for antibody 10240
LQDHKYPFS

SEQ ID NO: 20480 - protein, 9 aa, Homo sapiens
  heavy chain complementarity determining region 3 for antibody 10240
ARSEYQPTY

SEQ ID NO: 20481 - protein, 9 aa, Homo sapiens
  light chain complementarity determining region 3 for antibody 10241
LQDHKYPFS

SEQ ID NO: 20482 - protein, 13 aa, Homo sapiens
  heavy chain complementarity determining region 3 for antibody 10241
AKEGSAPGPDFEY

SEQ ID NO: 20483 - protein, 9 aa, Homo sapiens
  light chain complementarity determining region 3 for antibody 10242
LQDHKYPFS

SEQ ID NO: 20484 - protein, 16 aa, Homo sapiens
  heavy chain complementarity determining region 3 for antibody 10242
AADLGGHADAYATLDS

SEQ ID NO: 20485 - protein, 9 aa, Homo sapiens
  light chain complementarity determining region 3 for antibody 10243
LQDHKYPFS

SEQ ID NO: 20486 - protein, 16 aa, Homo sapiens
  heavy chain complementarity determining region 3 for antibody 10243
AADLGDRADAYATLDS

SEQ ID NO: 20487 - protein, 9 aa, Homo sapiens
  light chain complementarity determining region 3 for antibody 10244
LQDHKYPFS

SEQ ID NO: 20488 - protein, 16 aa, Homo sapiens
  heavy chain complementarity determining region 3 for antibody 10244
AADLGDHTDAYATLDS

SEQ ID NO: 20489 - protein, 9 aa, Homo sapiens
  light chain complementarity determining region 3 for antibody 10245
LQDHKYPFS

SEQ ID NO: 20490 - protein, 16 aa, Homo sapiens
  heavy chain complementarity determining region 3 for antibody 10245
AADLGDHADAYAPLDS

SEQ ID NO: 20491 - protein, 9 aa, Homo sapiens
  light chain complementarity determining region 3 for antibody 10246
LQDHKYPFN

SEQ ID NO: 20492 - protein, 16 aa, Homo sapiens
  heavy chain complementarity determining region 3 for antibody 10246
AADLGDHTDAYATLDN

SEQ ID NO: 20493 - protein, 9 aa, Homo sapiens
  light chain complementarity determining region 3 for antibody 10247
LQDHKDPFS

SEQ ID NO: 20494 - protein, 16 aa, Homo sapiens
  heavy chain complementarity determining region 3 for antibody 10247
AADLGDHADAYATLDS

SEQ ID NO: 20495 - protein, 9 aa, Homo sapiens
  light chain complementarity determining region 3 for antibody 10248
LQDHKCPFT

SEQ ID NO: 20496 - protein, 16 aa, Homo sapiens
  heavy chain complementarity determining region 3 for antibody 10248
AADLGDHTDAYATLDN

SEQ ID NO: 20497 - protein, 9 aa, Homo sapiens
  light chain complementarity determining region 3 for antibody 10249
LQDHIYPSS

SEQ ID NO: 20498 - protein, 16 aa, Homo sapiens
  heavy chain complementarity determining region 3 for antibody 10249
AADLDDHSDAFATLDD

SEQ ID NO: 20499 - protein, 9 aa, Homo sapiens
  light chain complementarity determining region 3 for antibody 10250
LQDHIYPFS

SEQ ID NO: 20500 - protein, 16 aa, Homo sapiens
  heavy chain complementarity determining region 3 for antibody 10250
AADLDDHSDAFAPLDD

SEQ ID NO: 20501 - protein, 9 aa, Homo sapiens
  light chain complementarity determining region 3 for antibody 10251
LQDFSYPFS

SEQ ID NO: 20502 - protein, 16 aa, Homo sapiens
  heavy chain complementarity determining region 3 for antibody 10251
VTGVGDHRDTYTTLDY

SEQ ID NO: 20503 - protein, 9 aa, Homo sapiens
  light chain complementarity determining region 3 for antibody 10252
LQDFSYPFS

SEQ ID NO: 20504 - protein, 16 aa, Homo sapiens
  heavy chain complementarity determining region 3 for antibody 10252
FTYVGDHRDTYTTLDY

SEQ ID NO: 20505 - protein, 9 aa, Homo sapiens
  light chain complementarity determining region 3 for antibody 10253
LQDFSYPFS

SEQ ID NO: 20506 - protein, 16 aa, Homo sapiens
  heavy chain complementarity determining region 3 for antibody 10253
FTEVGDHRDTYTTLDY

SEQ ID NO: 20507 - protein, 9 aa, Homo sapiens
  light chain complementarity determining region 3 for antibody 10254
LQDFSYPFS

SEQ ID NO: 20508 - protein, 16 aa, Homo sapiens
  heavy chain complementarity determining region 3 for antibody 10254
FSDVGDHRDTYTTLDY

SEQ ID NO: 20509 - protein, 9 aa, Homo sapiens
  light chain complementarity determining region 3 for antibody 10255
LQDFSYPFS

SEQ ID NO: 20510 - protein, 16 aa, Homo sapiens
  heavy chain complementarity determining region 3 for antibody 10255
FSDVGAHRDTYTTLDY

SEQ ID NO: 20511 - protein, 9 aa, Homo sapiens
  light chain complementarity determining region 3 for antibody 10256
LQDFSHPFS

SEQ ID NO: 20512 - protein, 16 aa, Homo sapiens
  heavy chain complementarity determining region 3 for antibody 10256
VKDVGDHRDTYTTLDY

SEQ ID NO: 20513 - protein, 9 aa, Homo sapiens
  light chain complementarity determining region 3 for antibody 10257
LQDDSYPWT

SEQ ID NO: 20514 - protein, 9 aa, Homo sapiens
  heavy chain complementarity determining region 3 for antibody 10257
ARGHYGPDY

SEQ ID NO: 20515 - protein, 9 aa, Homo sapiens
  light chain complementarity determining region 3 for antibody 10258
LQCDSYPWT

SEQ ID NO: 20516 - protein, 9 aa, Homo sapiens
  heavy chain complementarity determining region 3 for antibody 10258
ARGHYGPDY

SEQ ID NO: 20517 - protein, 9 aa, Homo sapiens
  light chain complementarity determining region 3 for antibody 10259
LQAYYTPRT

SEQ ID NO: 20518 - protein, 11 aa, Homo sapiens
  heavy chain complementarity determining region 3 for antibody 10259
TRRSLGGAFDY

SEQ ID NO: 20519 - protein, 9 aa, Homo sapiens
  light chain complementarity determining region 3 for antibody 10260
LQAYNHSAV

SEQ ID NO: 20520 - protein, 12 aa, Homo sapiens
  heavy chain complementarity determining region 3 for antibody 10260
ARGHITGYKGDY

SEQ ID NO: 20521 - protein, 9 aa, Homo sapiens
  light chain complementarity determining region 3 for antibody 10261
LQAYNHLGT

SEQ ID NO: 20522 - protein, 9 aa, Homo sapiens
  heavy chain complementarity determining region 3 for antibody 10261
ASRRPYLDY

SEQ ID NO: 20523 - protein, 9 aa, Homo sapiens
  light chain complementarity determining region 3 for antibody 10262
LQAYKYPFS

SEQ ID NO: 20524 - protein, 16 aa, Homo sapiens
  heavy chain complementarity determining region 3 for antibody 10262
AADLGDHADAYATLDS

SEQ ID NO: 20525 - protein, 9 aa, Homo sapiens
  light chain complementarity determining region 3 for antibody 10263
LQATQWPPT

SEQ ID NO: 20526 - protein, 13 aa, Homo sapiens
  heavy chain complementarity determining region 3 for antibody 10263
TREGDSSGPDFHH

SEQ ID NO: 20527 - protein, 9 aa, Homo sapiens
  light chain complementarity determining region 3 for antibody 10264
LQATNWPRT

SEQ ID NO: 20528 - protein, 12 aa, Homo sapiens
  heavy chain complementarity determining region 3 for antibody 10264
STDVETTFPSVS

SEQ ID NO: 20529 - protein, 9 aa, Homo sapiens
  light chain complementarity determining region 3 for antibody 10265
LQATHWPRT

SEQ ID NO: 20530 - protein, 16 aa, Homo sapiens
  heavy chain complementarity determining region 3 for antibody 10265
VRDLAGFTRGGSTFDY

SEQ ID NO: 20531 - protein, 9 aa, Homo sapiens
  light chain complementarity determining region 3 for antibody 10266
LQATHWPLT

SEQ ID NO: 20532 - protein, 7 aa, Homo sapiens
  heavy chain complementarity determining region 3 for antibody 10266
VTERWND

SEQ ID NO: 20533 - protein, 9 aa, Homo sapiens
  light chain complementarity determining region 3 for antibody 10267
LQALQTPYT

SEQ ID NO: 20534 - protein, 10 aa, Homo sapiens
  heavy chain complementarity determining region 3 for antibody 10267
AKDLSGGGGY

SEQ ID NO: 20535 - protein, 9 aa, Homo sapiens
  light chain complementarity determining region 3 for antibody 10268
LQALQIPYT

SEQ ID NO: 20536 - protein, 13 aa, Homo sapiens
  heavy chain complementarity determining region 3 for antibody 10268
VHSGSYYNPQFEY

SEQ ID NO: 20537 - protein, 8 aa, Homo sapiens
  light chain complementarity determining region 3 for antibody 10269
LQALHRLT

SEQ ID NO: 20538 - protein, 8 aa, Homo sapiens
  heavy chain complementarity determining region 3 for antibody 10269
VSQTGQNY

SEQ ID NO: 20539 - protein, 9 aa, Homo sapiens
  light chain complementarity determining region 3 for antibody 10270
LQAKHWPRT

SEQ ID NO: 20540 - protein, 8 aa, Homo sapiens
  heavy chain complementarity determining region 3 for antibody 10270
GRDRWWSG

SEQ ID NO: 20541 - protein, 9 aa, Homo sapiens
  light chain complementarity determining region 3 for antibody 10271
LPDHKYPFT

SEQ ID NO: 20542 - protein, 16 aa, Homo sapiens
  heavy chain complementarity determining region 3 for antibody 10271
AADLGDHTDAYATLDN

SEQ ID NO: 20543 - protein, 10 aa, Homo sapiens
  light chain complementarity determining region 3 for antibody 10272
LPATQWPPWT

SEQ ID NO: 20544 - protein, 11 aa, Homo sapiens
  heavy chain complementarity determining region 3 for antibody 10272
SRGRAWNDGDY

SEQ ID NO: 20545 - protein, 9 aa, Homo sapiens
  light chain complementarity determining region 3 for antibody 10273
LKYDSYPWT

SEQ ID NO: 20546 - protein, 9 aa, Homo sapiens
  heavy chain complementarity determining region 3 for antibody 10273
ARGHYGPDY

SEQ ID NO: 20547 - protein, 9 aa, Homo sapiens
  light chain complementarity determining region 3 for antibody 10274
LKYAHWPHT

SEQ ID NO: 20548 - protein, 9 aa, Homo sapiens
  heavy chain complementarity determining region 3 for antibody 10274
AGWGGTSNY

SEQ ID NO: 20549 - protein, 11 aa, Homo sapiens
  light chain complementarity determining region 3 for antibody 10275
LKNDNFPLMWN

SEQ ID NO: 20550 - protein, 15 aa, Homo sapiens
  heavy chain complementarity determining region 3 for antibody 10275
ARVRTNNYDSSGYDV

SEQ ID NO: 20551 - protein, 9 aa, Homo sapiens
  light chain complementarity determining region 3 for antibody 10276
LKGTYWPKT

SEQ ID NO: 20552 - protein, 10 aa, Homo sapiens
  heavy chain complementarity determining region 3 for antibody 10276
ARDFREGEVY

SEQ ID NO: 20553 - protein, 9 aa, Homo sapiens
  light chain complementarity determining region 3 for antibody 10277
LKFAHWPHT

SEQ ID NO: 20554 - protein, 9 aa, Homo sapiens
  heavy chain complementarity determining region 3 for antibody 10277
AGWGGLSNY

SEQ ID NO: 20555 - protein, 11 aa, Homo sapiens
  light chain complementarity determining region 3 for antibody 10278
LHYDNLPPYLT

SEQ ID NO: 20556 - protein, 16 aa, Homo sapiens
  heavy chain complementarity determining region 3 for antibody 10278
AKCPASSSCFGLSLES

SEQ ID NO: 20557 - protein, 9 aa, Homo sapiens
  light chain complementarity determining region 3 for antibody 10279
LHTIHWPWT

SEQ ID NO: 20558 - protein, 10 aa, Homo sapiens
  heavy chain complementarity determining region 3 for antibody 10279
TRLPSRASDF

SEQ ID NO: 20559 - protein, 9 aa, Homo sapiens
  light chain complementarity determining region 3 for antibody 10280
LHTFTAPRT

SEQ ID NO: 20560 - protein, 15 aa, Homo sapiens
  heavy chain complementarity determining region 3 for antibody 10280
SRDYIEASNPLRLEY

SEQ ID NO: 20561 - protein, 9 aa, Homo sapiens
  light chain complementarity determining region 3 for antibody 10281
LHGTYWPKT

SEQ ID NO: 20562 - protein, 10 aa, Homo sapiens
  heavy chain complementarity determining region 3 for antibody 10281
ARDFREGEVY

SEQ ID NO: 20563 - protein, 9 aa, Homo sapiens
  light chain complementarity determining region 3 for antibody 10282
LHDYNYHLT

SEQ ID NO: 20564 - protein, 18 aa, Homo sapiens
  heavy chain complementarity determining region 3 for antibody 10282
ARVENHHDSGNYFWALDI

SEQ ID NO: 20565 - protein, 9 aa, Homo sapiens
  light chain complementarity determining region 3 for antibody 10283
LHAFTAPRT

SEQ ID NO: 20566 - protein, 15 aa, Homo sapiens
  heavy chain complementarity determining region 3 for antibody 10283
SRDYIEASNLLRLDY

SEQ ID NO: 20567 - protein, 8 aa, Homo sapiens
  light chain complementarity determining region 3 for antibody 10284
LEYGDSFP

SEQ ID NO: 20568 - protein, 16 aa, Homo sapiens
  heavy chain complementarity determining region 3 for antibody 10284
AIWAAVSSGWSGPFDF

SEQ ID NO: 20569 - protein, 9 aa, Homo sapiens
  light chain complementarity determining region 3 for antibody 10285
KVYKSAPHT

SEQ ID NO: 20570 - protein, 14 aa, Homo sapiens
  heavy chain complementarity determining region 3 for antibody 10285
CRGWLDPATPHYDF

SEQ ID NO: 20571 - protein, 9 aa, Homo sapiens
  light chain complementarity determining region 3 for antibody 10286
KQYNSYPWT

SEQ ID NO: 20572 - protein, 15 aa, Homo sapiens
  heavy chain complementarity determining region 3 for antibody 10286
GKEGPGSSGWLTGHY

SEQ ID NO: 20573 - protein, 9 aa, Homo sapiens
  light chain complementarity determining region 3 for antibody 10287
KQYNSYPWT

SEQ ID NO: 20574 - protein, 11 aa, Homo sapiens
  heavy chain complementarity determining region 3 for antibody 10287
ARIVARKPDDY

SEQ ID NO: 20575 - protein, 9 aa, Homo sapiens
  light chain complementarity determining region 3 for antibody 10288
KQYHRYSHT

SEQ ID NO: 20576 - protein, 14 aa, Homo sapiens
  heavy chain complementarity determining region 3 for antibody 10288
GRDVHTTGWTLGGY

SEQ ID NO: 20577 - protein, 9 aa, Homo sapiens
  light chain complementarity determining region 3 for antibody 10289
KQYGSSPWT

SEQ ID NO: 20578 - protein, 12 aa, Homo sapiens
  heavy chain complementarity determining region 3 for antibody 10289
ARDKGGRNGMDV

SEQ ID NO: 20579 - protein, 9 aa, Homo sapiens
  light chain complementarity determining region 3 for antibody 10290
KQTYRTPYT

SEQ ID NO: 20580 - protein, 14 aa, Homo sapiens
  heavy chain complementarity determining region 3 for antibody 10290
ARLHGSGLGRWLDP

SEQ ID NO: 20581 - protein, 9 aa, Homo sapiens
  light chain complementarity determining region 3 for antibody 10291
KQRSNWPIT

SEQ ID NO: 20582 - protein, 12 aa, Homo sapiens
  heavy chain complementarity determining region 3 for antibody 10291
NADHGYVDGFDI

SEQ ID NO: 20583 - protein, 9 aa, Homo sapiens
  light chain complementarity determining region 3 for antibody 10292
KQLYNYPIT

SEQ ID NO: 20584 - protein, 14 aa, Homo sapiens
  heavy chain complementarity determining region 3 for antibody 10292
ARDTTYNWNDGGIS

SEQ ID NO: 20585 - protein, 9 aa, Homo sapiens
  light chain complementarity determining region 3 for antibody 10293
KQLNSDPYT

SEQ ID NO: 20586 - protein, 14 aa, Homo sapiens
  heavy chain complementarity determining region 3 for antibody 10293
ARGHFDSTGFRLDY

SEQ ID NO: 20587 - protein, 9 aa, Homo sapiens
  light chain complementarity determining region 3 for antibody 10294
KLSGSSLLT

SEQ ID NO: 20588 - protein, 12 aa, Homo sapiens
  heavy chain complementarity determining region 3 for antibody 10294
ALDEWHPSWYKY

SEQ ID NO: 20589 - protein, 9 aa, Homo sapiens
  light chain complementarity determining region 3 for antibody 10295
IQYDTYPWT

SEQ ID NO: 20590 - protein, 13 aa, Homo sapiens
  heavy chain complementarity determining region 3 for antibody 10295
AKEGSSPGPDFEY

SEQ ID NO: 20591 - protein, 9 aa, Homo sapiens
  light chain complementarity determining region 3 for antibody 10296
IQYDTYPWP

SEQ ID NO: 20592 - protein, 9 aa, Homo sapiens
  heavy chain complementarity determining region 3 for antibody 10296
GRGHYGPDY

SEQ ID NO: 20593 - protein, 9 aa, Homo sapiens
  light chain complementarity determining region 3 for antibody 10297
IQYAHGPHT

SEQ ID NO: 20594 - protein, 8 aa, Homo sapiens
  heavy chain complementarity determining region 3 for antibody 10297
AGWGYGNY

SEQ ID NO: 20595 - protein, 9 aa, Homo sapiens
  light chain complementarity determining region 3 for antibody 10298
IQGTHWPHT

SEQ ID NO: 20596 - protein, 11 aa, Homo sapiens
  heavy chain complementarity determining region 3 for antibody 10298
ATFGQQWRLAH

SEQ ID NO: 20597 - protein, 9 aa, Homo sapiens
  light chain complementarity determining region 3 for antibody 10299
IQGLQIPRT

SEQ ID NO: 20598 - protein, 13 aa, Homo sapiens
  heavy chain complementarity determining region 3 for antibody 10299
AGDHTYSVPRGGY

SEQ ID NO: 20599 - protein, 9 aa, Homo sapiens
  light chain complementarity determining region 3 for antibody 10300
IQATHWPFP

SEQ ID NO: 20600 - protein, 9 aa, Homo sapiens
  heavy chain complementarity determining region 3 for antibody 10300
VRVGYGYDY

SEQ ID NO: 20601 - protein, 7 aa, Homo sapiens
  light chain complementarity determining region 3 for antibody 10301
HSRDNWG

SEQ ID NO: 20602 - protein, 10 aa, Homo sapiens
  heavy chain complementarity determining region 3 for antibody 10301
ARERSGSYDI

SEQ ID NO: 20603 - protein, 9 aa, Homo sapiens
  light chain complementarity determining region 3 for antibody 10302
HRHGTTPGT

SEQ ID NO: 20604 - protein, 18 aa, Homo sapiens
  heavy chain complementarity determining region 3 for antibody 10302
ASWAGYCGGDCSSVSLDY

SEQ ID NO: 20605 - protein, 9 aa, Homo sapiens
  light chain complementarity determining region 3 for antibody 10303
HQYYTSPLT

SEQ ID NO: 20606 - protein, 10 aa, Homo sapiens
  heavy chain complementarity determining region 3 for antibody 10303
VGGEGWLTAF

SEQ ID NO: 20607 - protein, 9 aa, Homo sapiens
  light chain complementarity determining region 3 for antibody 10304
HQYYTSPLT

SEQ ID NO: 20608 - protein, 10 aa, Homo sapiens
  heavy chain complementarity determining region 3 for antibody 10304
VGGEGWLPDF

SEQ ID NO: 20609 - protein, 9 aa, Homo sapiens
  light chain complementarity determining region 3 for antibody 10305
HQYYTSPLT

SEQ ID NO: 20610 - protein, 10 aa, Homo sapiens
  heavy chain complementarity determining region 3 for antibody 10305
VGGEGWLNDF

SEQ ID NO: 20611 - protein, 9 aa, Homo sapiens
  light chain complementarity determining region 3 for antibody 10306
HQYYTSPLT

SEQ ID NO: 20612 - protein, 15 aa, Homo sapiens
  heavy chain complementarity determining region 3 for antibody 10306
GKEGPGSSGWLTGHY

SEQ ID NO: 20613 - protein, 9 aa, Homo sapiens
  light chain complementarity determining region 3 for antibody 10307
HQYYTSPLT

SEQ ID NO: 20614 - protein, 16 aa, Homo sapiens
  heavy chain complementarity determining region 3 for antibody 10307
ASLNRGDKEFGVPPAL

SEQ ID NO: 20615 - protein, 9 aa, Homo sapiens
  light chain complementarity determining region 3 for antibody 10308
HQYYTSPLT

SEQ ID NO: 20616 - protein, 16 aa, Homo sapiens
  heavy chain complementarity determining region 3 for antibody 10308
ARSYDRSNTKVWYFDL

SEQ ID NO: 20617 - protein, 9 aa, Homo sapiens
  light chain complementarity determining region 3 for antibody 10309
HQYYTSPLT

SEQ ID NO: 20618 - protein, 14 aa, Homo sapiens
  heavy chain complementarity determining region 3 for antibody 10309
ARGHFDSTGFRLDY

SEQ ID NO: 20619 - protein, 9 aa, Homo sapiens
  light chain complementarity determining region 3 for antibody 10310
HQYYTSPLT

SEQ ID NO: 20620 - protein, 10 aa, Homo sapiens
  heavy chain complementarity determining region 3 for antibody 10310
AAGSGWLIDY

SEQ ID NO: 20621 - protein, 9 aa, Homo sapiens
  light chain complementarity determining region 3 for antibody 10311
HQYYTSPLP

SEQ ID NO: 20622 - protein, 12 aa, Homo sapiens
  heavy chain complementarity determining region 3 for antibody 10311
ARLDWNYRAFDI

SEQ ID NO: 20623 - protein, 9 aa, Homo sapiens
  light chain complementarity determining region 3 for antibody 10312
HQYYTFPPT

SEQ ID NO: 20624 - protein, 10 aa, Homo sapiens
  heavy chain complementarity determining region 3 for antibody 10312
AAGSGWLIEY

SEQ ID NO: 20625 - protein, 9 aa, Homo sapiens
  light chain complementarity determining region 3 for antibody 10313
HQYYSSPRT

SEQ ID NO: 20626 - protein, 8 aa, Homo sapiens
  heavy chain complementarity determining region 3 for antibody 10313
ARENYLDV

SEQ ID NO: 20627 - protein, 9 aa, Homo sapiens
  light chain complementarity determining region 3 for antibody 10314
HQYYSSPRP

SEQ ID NO: 20628 - protein, 9 aa, Homo sapiens
  heavy chain complementarity determining region 3 for antibody 10314
ARENYYLDV

SEQ ID NO: 20629 - protein, 9 aa, Homo sapiens
  light chain complementarity determining region 3 for antibody 10315
HQYYRSPLT

SEQ ID NO: 20630 - protein, 10 aa, Homo sapiens
  heavy chain complementarity determining region 3 for antibody 10315
TSVNWATSVY

SEQ ID NO: 20631 - protein, 9 aa, Homo sapiens
  light chain complementarity determining region 3 for antibody 10316
HQYSTSPLT

SEQ ID NO: 20632 - protein, 10 aa, Homo sapiens
  heavy chain complementarity determining region 3 for antibody 10316
VGGEGWLTDF

SEQ ID NO: 20633 - protein, 9 aa, Homo sapiens
  light chain complementarity determining region 3 for antibody 10317
HQYSSIPFT

SEQ ID NO: 20634 - protein, 12 aa, Homo sapiens
  heavy chain complementarity determining region 3 for antibody 10317
ARGLTEGAACDV

SEQ ID NO: 20635 - protein, 9 aa, Homo sapiens
  light chain complementarity determining region 3 for antibody 10318
HQYSRIPFT

SEQ ID NO: 20636 - protein, 12 aa, Homo sapiens
  heavy chain complementarity determining region 3 for antibody 10318
ARGLTEGAAFDV

SEQ ID NO: 20637 - protein, 9 aa, Homo sapiens
  light chain complementarity determining region 3 for antibody 10319
HQYNYFPYT

SEQ ID NO: 20638 - protein, 17 aa, Homo sapiens
  heavy chain complementarity determining region 3 for antibody 10319
ARGDWNDVDLRLFYLDY

SEQ ID NO: 20639 - protein, 9 aa, Homo sapiens
  light chain complementarity determining region 3 for antibody 10320
HQYNYFPYP

SEQ ID NO: 20640 - protein, 17 aa, Homo sapiens
  heavy chain complementarity determining region 3 for antibody 10320
AREDWNDVDLRLFYLDY

SEQ ID NO: 20641 - protein, 7 aa, Homo sapiens
  light chain complementarity determining region 3 for antibody 10321
HQYNTWT

SEQ ID NO: 20642 - protein, 12 aa, Homo sapiens
  heavy chain complementarity determining region 3 for antibody 10321
SRDKGGRNGMDV

SEQ ID NO: 20643 - protein, 10 aa, Homo sapiens
  light chain complementarity determining region 3 for antibody 10322
HQYNSYSPRP

SEQ ID NO: 20644 - protein, 15 aa, Homo sapiens
  heavy chain complementarity determining region 3 for antibody 10322
ARVGRPYHNAWYFDN

SEQ ID NO: 20645 - protein, 9 aa, Homo sapiens
  light chain complementarity determining region 3 for antibody 10323
HQYNSYPWT

SEQ ID NO: 20646 - protein, 14 aa, Homo sapiens
  heavy chain complementarity determining region 3 for antibody 10323
VREEGSGYYRTADY

SEQ ID NO: 20647 - protein, 9 aa, Homo sapiens
  light chain complementarity determining region 3 for antibody 10324
HQYNSYPWT

SEQ ID NO: 20648 - protein, 15 aa, Homo sapiens
  heavy chain complementarity determining region 3 for antibody 10324
GKEGPGSSGWLTGHY

SEQ ID NO: 20649 - protein, 9 aa, Homo sapiens
  light chain complementarity determining region 3 for antibody 10325
HQYNSYPWT

SEQ ID NO: 20650 - protein, 14 aa, Homo sapiens
  heavy chain complementarity determining region 3 for antibody 10325
ATGGGSGFEGAFDV

SEQ ID NO: 20651 - protein, 9 aa, Homo sapiens
  light chain complementarity determining region 3 for antibody 10326
HQYNDWPWT

SEQ ID NO: 20652 - protein, 9 aa, Homo sapiens
  heavy chain complementarity determining region 3 for antibody 10326
AGRPDSLGM

SEQ ID NO: 20653 - protein, 9 aa, Homo sapiens
  light chain complementarity determining region 3 for antibody 10327
HQYKIYPWT

SEQ ID NO: 20654 - protein, 13 aa, Homo sapiens
  heavy chain complementarity determining region 3 for antibody 10327
AKEGSSPGPDFDY

SEQ ID NO: 20655 - protein, 9 aa, Homo sapiens
  light chain complementarity determining region 3 for antibody 10328
HQYHNWPRT

SEQ ID NO: 20656 - protein, 18 aa, Homo sapiens
  heavy chain complementarity determining region 3 for antibody 10328
AKDLSGTPSKHTSSSQSY

SEQ ID NO: 20657 - protein, 9 aa, Homo sapiens
  light chain complementarity determining region 3 for antibody 10329
HQYHDWPWT

SEQ ID NO: 20658 - protein, 10 aa, Homo sapiens
  heavy chain complementarity determining region 3 for antibody 10329
ARGGLAGDVY

SEQ ID NO: 20659 - protein, 9 aa, Homo sapiens
  light chain complementarity determining region 3 for antibody 10330
HQYGSSRIT

SEQ ID NO: 20660 - protein, 14 aa, Homo sapiens
  heavy chain complementarity determining region 3 for antibody 10330
EKSRCSTSCYGGDY

SEQ ID NO: 20661 - protein, 9 aa, Homo sapiens
  light chain complementarity determining region 3 for antibody 10331
HQYGSSPRT

SEQ ID NO: 20662 - protein, 12 aa, Homo sapiens
  heavy chain complementarity determining region 3 for antibody 10331
ARSRDLWTPFGY

SEQ ID NO: 20663 - protein, 9 aa, Homo sapiens
  light chain complementarity determining region 3 for antibody 10332
HQYGSLPLT

SEQ ID NO: 20664 - protein, 13 aa, Homo sapiens
  heavy chain complementarity determining region 3 for antibody 10332
AKRYSTNWGHFDY

SEQ ID NO: 20665 - protein, 9 aa, Homo sapiens
  light chain complementarity determining region 3 for antibody 10333
HQYGSLPLT

SEQ ID NO: 20666 - protein, 13 aa, Homo sapiens
  heavy chain complementarity determining region 3 for antibody 10333
AKDRSSGWYALGY

SEQ ID NO: 20667 - protein, 9 aa, Homo sapiens
  light chain complementarity determining region 3 for antibody 10334
HQYGSLPLT

SEQ ID NO: 20668 - protein, 13 aa, Homo sapiens
  heavy chain complementarity determining region 3 for antibody 10334
AKDRASGWYAWDY

SEQ ID NO: 20669 - protein, 9 aa, Homo sapiens
  light chain complementarity determining region 3 for antibody 10335
HQYGSLPLT

SEQ ID NO: 20670 - protein, 13 aa, Homo sapiens
  heavy chain complementarity determining region 3 for antibody 10335
AKDRASGWCAWGY

SEQ ID NO: 20671 - protein, 9 aa, Homo sapiens
  light chain complementarity determining region 3 for antibody 10336
HQYGSLPLT

SEQ ID NO: 20672 - protein, 13 aa, Homo sapiens
  heavy chain complementarity determining region 3 for antibody 10336
AEDRASGWYAWGY

SEQ ID NO: 20673 - protein, 9 aa, Homo sapiens
  light chain complementarity determining region 3 for antibody 10337
HQYGSLPLP

SEQ ID NO: 20674 - protein, 13 aa, Homo sapiens
  heavy chain complementarity determining region 3 for antibody 10337
AKDRASGWYAWGY

SEQ ID NO: 20675 - protein, 9 aa, Homo sapiens
  light chain complementarity determining region 3 for antibody 10338
HQYFTSPPT

SEQ ID NO: 20676 - protein, 10 aa, Homo sapiens
  heavy chain complementarity determining region 3 for antibody 10338
AAGSGWLIEY

SEQ ID NO: 20677 - protein, 9 aa, Homo sapiens
  light chain complementarity determining region 3 for antibody 10339
HQYFTSPLT

SEQ ID NO: 20678 - protein, 10 aa, Homo sapiens
  heavy chain complementarity determining region 3 for antibody 10339
AAGSGWLIEY

SEQ ID NO: 20679 - protein, 9 aa, Homo sapiens
  light chain complementarity determining region 3 for antibody 10340
HQYDNWPWT

SEQ ID NO: 20680 - protein, 17 aa, Homo sapiens
  heavy chain complementarity determining region 3 for antibody 10340
VTHYYHDSGIYHDFFNY

SEQ ID NO: 20681 - protein, 9 aa, Homo sapiens
  light chain complementarity determining region 3 for antibody 10341
HQYATSPWT

SEQ ID NO: 20682 - protein, 14 aa, Homo sapiens
  heavy chain complementarity determining region 3 for antibody 10341
ARFGWLDYYYGMDV

SEQ ID NO: 20683 - protein, 9 aa, Homo sapiens
  light chain complementarity determining region 3 for antibody 10342
HQYATSPPT

SEQ ID NO: 20684 - protein, 15 aa, Homo sapiens
  heavy chain complementarity determining region 3 for antibody 10342
VKTYWAVDFDWLLYY

SEQ ID NO: 20685 - protein, 9 aa, Homo sapiens
  light chain complementarity determining region 3 for antibody 10343
HQYANTPGT

SEQ ID NO: 20686 - protein, 11 aa, Homo sapiens
  heavy chain complementarity determining region 3 for antibody 10343
ARGRDQSKLGY

SEQ ID NO: 20687 - protein, 9 aa, Homo sapiens
  light chain complementarity determining region 3 for antibody 10344
HQYANSPRT

SEQ ID NO: 20688 - protein, 13 aa, Homo sapiens
  heavy chain complementarity determining region 3 for antibody 10344
ARGATATSWNIDY

SEQ ID NO: 20689 - protein, 9 aa, Homo sapiens
  light chain complementarity determining region 3 for antibody 10345
HQYAITPGT

SEQ ID NO: 20690 - protein, 11 aa, Homo sapiens
  heavy chain complementarity determining region 3 for antibody 10345
ARGRDQSKLGY

SEQ ID NO: 20691 - protein, 9 aa, Homo sapiens
  light chain complementarity determining region 3 for antibody 10346
HQYAHSPRT

SEQ ID NO: 20692 - protein, 13 aa, Homo sapiens
  heavy chain complementarity determining region 3 for antibody 10346
ARGTTATSWNIDY

SEQ ID NO: 20693 - protein, 9 aa, Homo sapiens
  light chain complementarity determining region 3 for antibody 10347
HQVKSYPWA

SEQ ID NO: 20694 - protein, 13 aa, Homo sapiens
  heavy chain complementarity determining region 3 for antibody 10347
AKATVPTGGHFDH

SEQ ID NO: 20695 - protein, 9 aa, Homo sapiens
  light chain complementarity determining region 3 for antibody 10348
HQSYTSPLT

SEQ ID NO: 20696 - protein, 10 aa, Homo sapiens
  heavy chain complementarity determining region 3 for antibody 10348
AAGSGWLIEY

SEQ ID NO: 20697 - protein, 10 aa, Homo sapiens
  light chain complementarity determining region 3 for antibody 10349
HQSYSTPLFT

SEQ ID NO: 20698 - protein, 23 aa, Homo sapiens
  heavy chain complementarity determining region 3 for antibody 10349
ARHFPKGGSGVTGTQSLLYYMDV

SEQ ID NO: 20699 - protein, 9 aa, Homo sapiens
  light chain complementarity determining region 3 for antibody 10350
HQSYSSPRT

SEQ ID NO: 20700 - protein, 12 aa, Homo sapiens
  heavy chain complementarity determining region 3 for antibody 10350
NADHGYVDGFDI

SEQ ID NO: 20701 - protein, 9 aa, Homo sapiens
  light chain complementarity determining region 3 for antibody 10351
HQSYSAPCT

SEQ ID NO: 20702 - protein, 13 aa, Homo sapiens
  heavy chain complementarity determining region 3 for antibody 10351
ARGIGTVVTPFQF

SEQ ID NO: 20703 - protein, 9 aa, Homo sapiens
  light chain complementarity determining region 3 for antibody 10352
HQSYNSHPT

SEQ ID NO: 20704 - protein, 19 aa, Homo sapiens
  heavy chain complementarity determining region 3 for antibody 10352
AHTKYFYDSTGYYYADFDY

SEQ ID NO: 20705 - protein, 9 aa, Homo sapiens
  light chain complementarity determining region 3 for antibody 10353
HQSSTLSHT

SEQ ID NO: 20706 - protein, 10 aa, Homo sapiens
  heavy chain complementarity determining region 3 for antibody 10353
ARETSGAYDI

SEQ ID NO: 20707 - protein, 9 aa, Homo sapiens
  light chain complementarity determining region 3 for antibody 10354
HQSSTLPHT

SEQ ID NO: 20708 - protein, 10 aa, Homo sapiens
  heavy chain complementarity determining region 3 for antibody 10354
ATAPDDDRDY

SEQ ID NO: 20709 - protein, 9 aa, Homo sapiens
  light chain complementarity determining region 3 for antibody 10355
HQSSTLPHT

SEQ ID NO: 20710 - protein, 10 aa, Homo sapiens
  heavy chain complementarity determining region 3 for antibody 10355
ARETAGAYDI

SEQ ID NO: 20711 - protein, 9 aa, Homo sapiens
  light chain complementarity determining region 3 for antibody 10356
HQSSTLPHT

SEQ ID NO: 20712 - protein, 13 aa, Homo sapiens
  heavy chain complementarity determining region 3 for antibody 10356
AKEGSSPGPDFEY

SEQ ID NO: 20713 - protein, 9 aa, Homo sapiens
  light chain complementarity determining region 3 for antibody 10357
HQSDSLPWT

SEQ ID NO: 20714 - protein, 13 aa, Homo sapiens
  heavy chain complementarity determining region 3 for antibody 10357
AKEGSSPGPDFDY

SEQ ID NO: 20715 - protein, 9 aa, Homo sapiens
  light chain complementarity determining region 3 for antibody 10358
HQSANSPRT

SEQ ID NO: 20716 - protein, 13 aa, Homo sapiens
  heavy chain complementarity determining region 3 for antibody 10358
ARGATATSWNSDY

SEQ ID NO: 20717 - protein, 9 aa, Homo sapiens
  light chain complementarity determining region 3 for antibody 10359
HQSANSPRT

SEQ ID NO: 20718 - protein, 13 aa, Homo sapiens
  heavy chain complementarity determining region 3 for antibody 10359
ARGATATSWNMDY

SEQ ID NO: 20719 - protein, 9 aa, Homo sapiens
  light chain complementarity determining region 3 for antibody 10360
HQSANSPRT

SEQ ID NO: 20720 - protein, 13 aa, Homo sapiens
  heavy chain complementarity determining region 3 for antibody 10360
ARGATATSWNIDS

SEQ ID NO: 20721 - protein, 9 aa, Homo sapiens
  light chain complementarity determining region 3 for antibody 10361
HQSANSPRT

SEQ ID NO: 20722 - protein, 13 aa, Homo sapiens
  heavy chain complementarity determining region 3 for antibody 10361
ARGATATSWNIDH

SEQ ID NO: 20723 - protein, 9 aa, Homo sapiens
  light chain complementarity determining region 3 for antibody 10362
HQSANSPRT

SEQ ID NO: 20724 - protein, 13 aa, Homo sapiens
  heavy chain complementarity determining region 3 for antibody 10362
ARGATAPSWNIDY

SEQ ID NO: 20725 - protein, 9 aa, Homo sapiens
  light chain complementarity determining region 3 for antibody 10363
HQSANSPRT

SEQ ID NO: 20726 - protein, 13 aa, Homo sapiens
  heavy chain complementarity determining region 3 for antibody 10363
ARCATATSWNIDY

SEQ ID NO: 20727 - protein, 9 aa, Homo sapiens
  light chain complementarity determining region 3 for antibody 10364
HQSANSPRT

SEQ ID NO: 20728 - protein, 17 aa, Homo sapiens
  heavy chain complementarity determining region 3 for antibody 10364
AKRLPDLLGGGHHYIDV

SEQ ID NO: 20729 - protein, 9 aa, Homo sapiens
  light chain complementarity determining region 3 for antibody 10365
HQSANSPRT

SEQ ID NO: 20730 - protein, 17 aa, Homo sapiens
  heavy chain complementarity determining region 3 for antibody 10365
AKGRGSVAMALIYYLDL

SEQ ID NO: 20731 - protein, 9 aa, Homo sapiens
  light chain complementarity determining region 3 for antibody 10366
HQSANSPRT

SEQ ID NO: 20732 - protein, 13 aa, Homo sapiens
  heavy chain complementarity determining region 3 for antibody 10366
AGGATATSWNIDY

SEQ ID NO: 20733 - protein, 9 aa, Homo sapiens
  light chain complementarity determining region 3 for antibody 10367
HQSANSPPT

SEQ ID NO: 20734 - protein, 13 aa, Homo sapiens
  heavy chain complementarity determining region 3 for antibody 10367
ARGATATSWNIDY

SEQ ID NO: 20735 - protein, 9 aa, Homo sapiens
  light chain complementarity determining region 3 for antibody 10368
HQSANSHRT

SEQ ID NO: 20736 - protein, 13 aa, Homo sapiens
  heavy chain complementarity determining region 3 for antibody 10368
ARGATATSWNIDY

SEQ ID NO: 20737 - protein, 9 aa, Homo sapiens
  light chain complementarity determining region 3 for antibody 10369
HQSAKSPRT

SEQ ID NO: 20738 - protein, 13 aa, Homo sapiens
  heavy chain complementarity determining region 3 for antibody 10369
AKEGSAPGPDFEY

SEQ ID NO: 20739 - protein, 9 aa, Homo sapiens
  light chain complementarity determining region 3 for antibody 10370
HQSAHSPRT

SEQ ID NO: 20740 - protein, 13 aa, Homo sapiens
  heavy chain complementarity determining region 3 for antibody 10370
ARGTTAKSWNIDY

SEQ ID NO: 20741 - protein, 9 aa, Homo sapiens
  light chain complementarity determining region 3 for antibody 10371
HQSAHSPRT

SEQ ID NO: 20742 - protein, 13 aa, Homo sapiens
  heavy chain complementarity determining region 3 for antibody 10371
ARGATATSWNIDY

SEQ ID NO: 20743 - protein, 9 aa, Homo sapiens
  light chain complementarity determining region 3 for antibody 10372
HQSAHSPRP

SEQ ID NO: 20744 - protein, 13 aa, Homo sapiens
  heavy chain complementarity determining region 3 for antibody 10372
ARGTTATSWNIDY

SEQ ID NO: 20745 - protein, 9 aa, Homo sapiens
  light chain complementarity determining region 3 for antibody 10373
HQRSTLPHT

SEQ ID NO: 20746 - protein, 10 aa, Homo sapiens
  heavy chain complementarity determining region 3 for antibody 10373
ARETSGAYDI

SEQ ID NO: 20747 - protein, 11 aa, Homo sapiens
  light chain complementarity determining region 3 for antibody 10374
HQRSRWPPAFT

SEQ ID NO: 20748 - protein, 15 aa, Homo sapiens
  heavy chain complementarity determining region 3 for antibody 10374
ARDGGSGTSQTYLDY

SEQ ID NO: 20749 - protein, 9 aa, Homo sapiens
  light chain complementarity determining region 3 for antibody 10375
HQRSNWPIT

SEQ ID NO: 20750 - protein, 12 aa, Homo sapiens
  heavy chain complementarity determining region 3 for antibody 10375
NADHGYVDGFDI

SEQ ID NO: 20751 - protein, 9 aa, Homo sapiens
  light chain complementarity determining region 3 for antibody 10376
HQRGTTPGT

SEQ ID NO: 20752 - protein, 18 aa, Homo sapiens
  heavy chain complementarity determining region 3 for antibody 10376
ASWAGYCGGDCSSVSLDY

SEQ ID NO: 20753 - protein, 9 aa, Homo sapiens
  light chain complementarity determining region 3 for antibody 10377
HQPGTTPGT

SEQ ID NO: 20754 - protein, 18 aa, Homo sapiens
  heavy chain complementarity determining region 3 for antibody 10377
ASWAGYCGGDCASVSLDY

SEQ ID NO: 20755 - protein, 9 aa, Homo sapiens
  light chain complementarity determining region 3 for antibody 10378
HQPANSPRT

SEQ ID NO: 20756 - protein, 13 aa, Homo sapiens
  heavy chain complementarity determining region 3 for antibody 10378
ARGATATSWNIDY

SEQ ID NO: 20757 - protein, 9 aa, Homo sapiens
  light chain complementarity determining region 3 for antibody 10379
HQNGSLPLT

SEQ ID NO: 20758 - protein, 13 aa, Homo sapiens
  heavy chain complementarity determining region 3 for antibody 10379
AKDRASGWYAWGY

SEQ ID NO: 20759 - protein, 9 aa, Homo sapiens
  light chain complementarity determining region 3 for antibody 10380
HQLNSYPYT

SEQ ID NO: 20760 - protein, 10 aa, Homo sapiens
  heavy chain complementarity determining region 3 for antibody 10380
ARETSGAYDI

SEQ ID NO: 20761 - protein, 9 aa, Homo sapiens
  light chain complementarity determining region 3 for antibody 10381
HQLNSSPYT

SEQ ID NO: 20762 - protein, 14 aa, Homo sapiens
  heavy chain complementarity determining region 3 for antibody 10381
ARGHFDSTGFRLDY

SEQ ID NO: 20763 - protein, 9 aa, Homo sapiens
  light chain complementarity determining region 3 for antibody 10382
HQLMSYPYT

SEQ ID NO: 20764 - protein, 17 aa, Homo sapiens
  heavy chain complementarity determining region 3 for antibody 10382
ARNTMVHGWQRQGSVDH

SEQ ID NO: 20765 - protein, 9 aa, Homo sapiens
  light chain complementarity determining region 3 for antibody 10383
HQHGTTPGT

SEQ ID NO: 20766 - protein, 17 aa, Homo sapiens
  heavy chain complementarity determining region 3 for antibody 10383
VTHYYHDSGIYHDFFNY

SEQ ID NO: 20767 - protein, 9 aa, Homo sapiens
  light chain complementarity determining region 3 for antibody 10384
HQHGTTPGT

SEQ ID NO: 20768 - protein, 16 aa, Homo sapiens
  heavy chain complementarity determining region 3 for antibody 10384
VRDLAGFTRGGSTFDY

SEQ ID NO: 20769 - protein, 9 aa, Homo sapiens
  light chain complementarity determining region 3 for antibody 10385
HQHGTTPGT

SEQ ID NO: 20770 - protein, 18 aa, Homo sapiens
  heavy chain complementarity determining region 3 for antibody 10385
ASWAGYCGGDCSTVSLDY

SEQ ID NO: 20771 - protein, 9 aa, Homo sapiens
  light chain complementarity determining region 3 for antibody 10386
HQHGTTPGT

SEQ ID NO: 20772 - protein, 18 aa, Homo sapiens
  heavy chain complementarity determining region 3 for antibody 10386
ASWAGYCGGDCSSVPLDY

SEQ ID NO: 20773 - protein, 9 aa, Homo sapiens
  light chain complementarity determining region 3 for antibody 10387
HQHGTTPGT

SEQ ID NO: 20774 - protein, 18 aa, Homo sapiens
  heavy chain complementarity determining region 3 for antibody 10387
ASRAGYCGGDCSSVSLDY

SEQ ID NO: 20775 - protein, 9 aa, Homo sapiens
  light chain complementarity determining region 3 for antibody 10388
HQHGTTPGT

SEQ ID NO: 20776 - protein, 10 aa, Homo sapiens
  heavy chain complementarity determining region 3 for antibody 10388
ARTRGFLFDY

SEQ ID NO: 20777 - protein, 9 aa, Homo sapiens
  light chain complementarity determining region 3 for antibody 10389
HQHGTTPGA

SEQ ID NO: 20778 - protein, 18 aa, Homo sapiens
  heavy chain complementarity determining region 3 for antibody 10389
ASWAGYCGGDCSSVSLDY

SEQ ID NO: 20779 - protein, 9 aa, Homo sapiens
  light chain complementarity determining region 3 for antibody 10390
HQHGTTHGT

SEQ ID NO: 20780 - protein, 18 aa, Homo sapiens
  heavy chain complementarity determining region 3 for antibody 10390
ASWAGYCGGDCSSVSLDY

SEQ ID NO: 20781 - protein, 9 aa, Homo sapiens
  light chain complementarity determining region 3 for antibody 10391
HQHGTPPGT

SEQ ID NO: 20782 - protein, 18 aa, Homo sapiens
  heavy chain complementarity determining region 3 for antibody 10391
ARWAGYCGGDCSSVSLDY

SEQ ID NO: 20783 - protein, 9 aa, Homo sapiens
  light chain complementarity determining region 3 for antibody 10392
HQHDTTPGT

SEQ ID NO: 20784 - protein, 18 aa, Homo sapiens
  heavy chain complementarity determining region 3 for antibody 10392
ASWAGYCGGDCSSVSLDY

SEQ ID NO: 20785 - protein, 9 aa, Homo sapiens
  light chain complementarity determining region 3 for antibody 10393
HQHAYAPIT

SEQ ID NO: 20786 - protein, 10 aa, Homo sapiens
  heavy chain complementarity determining region 3 for antibody 10393
AKGEGWLVAH

SEQ ID NO: 20787 - protein, 9 aa, Homo sapiens
  light chain complementarity determining region 3 for antibody 10394
HQFNTYPLT

SEQ ID NO: 20788 - protein, 20 aa, Homo sapiens
  heavy chain complementarity determining region 3 for antibody 10394
ARNLQYCSGGSCYGPFYFDY

SEQ ID NO: 20789 - protein, 9 aa, Homo sapiens
  light chain complementarity determining region 3 for antibody 10395
HQFKSYPLA

SEQ ID NO: 20790 - protein, 13 aa, Homo sapiens
  heavy chain complementarity determining region 3 for antibody 10395
AKATVPTGGHFDH

SEQ ID NO: 20791 - protein, 9 aa, Homo sapiens
  light chain complementarity determining region 3 for antibody 10396
HQFFNTPWT

SEQ ID NO: 20792 - protein, 18 aa, Homo sapiens
  heavy chain complementarity determining region 3 for antibody 10396
ARAADCIGDKCYQSYFDF

SEQ ID NO: 20793 - protein, 9 aa, Homo sapiens
  light chain complementarity determining region 3 for antibody 10397
HQDGSSRIT

SEQ ID NO: 20794 - protein, 14 aa, Homo sapiens
  heavy chain complementarity determining region 3 for antibody 10397
AKSRCSTSCYGGDY

SEQ ID NO: 20795 - protein, 9 aa, Homo sapiens
  light chain complementarity determining region 3 for antibody 10398
HQDGSLPLT

SEQ ID NO: 20796 - protein, 13 aa, Homo sapiens
  heavy chain complementarity determining region 3 for antibody 10398
AKDRSSGWYAWGY

SEQ ID NO: 20797 - protein, 9 aa, Homo sapiens
  light chain complementarity determining region 3 for antibody 10399
HQDGSLPLT

SEQ ID NO: 20798 - protein, 13 aa, Homo sapiens
  heavy chain complementarity determining region 3 for antibody 10399
AKDRASGWYAWGY

SEQ ID NO: 20799 - protein, 9 aa, Homo sapiens
  light chain complementarity determining region 3 for antibody 10400
HQCGTSPKT

SEQ ID NO: 20800 - protein, 13 aa, Homo sapiens
  heavy chain complementarity determining region 3 for antibody 10400
ARDGSSGWYELAY

SEQ ID NO: 20801 - protein, 9 aa, Homo sapiens
  light chain complementarity determining region 3 for antibody 10401
HQCGTSPKT

SEQ ID NO: 20802 - protein, 13 aa, Homo sapiens
  heavy chain complementarity determining region 3 for antibody 10401
ARDGRSDWYELAY

SEQ ID NO: 20803 - protein, 9 aa, Homo sapiens
  light chain complementarity determining region 3 for antibody 10402
HQCGSSPTT

SEQ ID NO: 20804 - protein, 13 aa, Homo sapiens
  heavy chain complementarity determining region 3 for antibody 10402
ARDGDSDWYELAY

SEQ ID NO: 20805 - protein, 9 aa, Homo sapiens
  light chain complementarity determining region 3 for antibody 10403
HQCGSSPKT

SEQ ID NO: 20806 - protein, 13 aa, Homo sapiens
  heavy chain complementarity determining region 3 for antibody 10403
ARDGDSDWYELDY

SEQ ID NO: 20807 - protein, 9 aa, Homo sapiens
  light chain complementarity determining region 3 for antibody 10404
HQANSLPLT

SEQ ID NO: 20808 - protein, 17 aa, Homo sapiens
  heavy chain complementarity determining region 3 for antibody 10404
ARGTGIGSGSYYADFDY

SEQ ID NO: 20809 - protein, 9 aa, Homo sapiens
  light chain complementarity determining region 3 for antibody 10405
HPYYTSPPT

SEQ ID NO: 20810 - protein, 10 aa, Homo sapiens
  heavy chain complementarity determining region 3 for antibody 10405
AAGSGWLIEY

SEQ ID NO: 20811 - protein, 9 aa, Homo sapiens
  light chain complementarity determining region 3 for antibody 10406
HLSGSSLLT

SEQ ID NO: 20812 - protein, 12 aa, Homo sapiens
  heavy chain complementarity determining region 3 for antibody 10406
ALDEWHPSWYKY

SEQ ID NO: 20813 - protein, 9 aa, Homo sapiens
  light chain complementarity determining region 3 for antibody 10407
HHLGSATGT

SEQ ID NO: 20814 - protein, 13 aa, Homo sapiens
  heavy chain complementarity determining region 3 for antibody 10407
AKEGSSPGPDFEY

SEQ ID NO: 20815 - protein, 9 aa, Homo sapiens
  light chain complementarity determining region 3 for antibody 10408
HHFGSTTGT

SEQ ID NO: 20816 - protein, 13 aa, Homo sapiens
  heavy chain complementarity determining region 3 for antibody 10408
AKEGSSPGPDFEY

SEQ ID NO: 20817 - protein, 9 aa, Homo sapiens
  light chain complementarity determining region 3 for antibody 10409
HHFGSPPGT

SEQ ID NO: 20818 - protein, 13 aa, Homo sapiens
  heavy chain complementarity determining region 3 for antibody 10409
AKEGSSPGPDFEY

SEQ ID NO: 20819 - protein, 9 aa, Homo sapiens
  light chain complementarity determining region 3 for antibody 10410
HHFGSATRT

SEQ ID NO: 20820 - protein, 13 aa, Homo sapiens
  heavy chain complementarity determining region 3 for antibody 10410
AKEGSSPGPDFEY

SEQ ID NO: 20821 - protein, 9 aa, Homo sapiens
  light chain complementarity determining region 3 for antibody 10411
HHFGSATGT

SEQ ID NO: 20822 - protein, 13 aa, Homo sapiens
  heavy chain complementarity determining region 3 for antibody 10411
VKEGSSPGPDFEY

SEQ ID NO: 20823 - protein, 9 aa, Homo sapiens
  light chain complementarity determining region 3 for antibody 10412
HHFGSATGT

SEQ ID NO: 20824 - protein, 9 aa, Homo sapiens
  heavy chain complementarity determining region 3 for antibody 10412
GSRRPYFDS

SEQ ID NO: 20825 - protein, 9 aa, Homo sapiens
  light chain complementarity determining region 3 for antibody 10413
HHFGSATGT

SEQ ID NO: 20826 - protein, 13 aa, Homo sapiens
  heavy chain complementarity determining region 3 for antibody 10413
DKEGSSPGPDFEY

SEQ ID NO: 20827 - protein, 9 aa, Homo sapiens
  light chain complementarity determining region 3 for antibody 10414
HHFGSATGT

SEQ ID NO: 20828 - protein, 10 aa, Homo sapiens
  heavy chain complementarity determining region 3 for antibody 10414
CRDREGFGDV

SEQ ID NO: 20829 - protein, 9 aa, Homo sapiens
  light chain complementarity determining region 3 for antibody 10415
HHFGSATGT

SEQ ID NO: 20830 - protein, 17 aa, Homo sapiens
  heavy chain complementarity determining region 3 for antibody 10415
ARNTMVGTWQRQGNLDH

SEQ ID NO: 20831 - protein, 9 aa, Homo sapiens
  light chain complementarity determining region 3 for antibody 10416
HHFGSATGT

SEQ ID NO: 20832 - protein, 12 aa, Homo sapiens
  heavy chain complementarity determining region 3 for antibody 10416
ARLDWNYRAFDI

SEQ ID NO: 20833 - protein, 9 aa, Homo sapiens
  light chain complementarity determining region 3 for antibody 10417
HHFGSATGT

SEQ ID NO: 20834 - protein, 9 aa, Homo sapiens
  heavy chain complementarity determining region 3 for antibody 10417
ARGRNNFRY

SEQ ID NO: 20835 - protein, 9 aa, Homo sapiens
  light chain complementarity determining region 3 for antibody 10418
HHFGSATGT

SEQ ID NO: 20836 - protein, 12 aa, Homo sapiens
  heavy chain complementarity determining region 3 for antibody 10418
ARGPLKMAGGSS

SEQ ID NO: 20837 - protein, 9 aa, Homo sapiens
  light chain complementarity determining region 3 for antibody 10419
HHFGSATGT

SEQ ID NO: 20838 - protein, 14 aa, Homo sapiens
  heavy chain complementarity determining region 3 for antibody 10419
ARGHFDSTGFRLDY

SEQ ID NO: 20839 - protein, 9 aa, Homo sapiens
  light chain complementarity determining region 3 for antibody 10420
HHFGSATGT

SEQ ID NO: 20840 - protein, 10 aa, Homo sapiens
  heavy chain complementarity determining region 3 for antibody 10420
ARETSGSYDI

SEQ ID NO: 20841 - protein, 9 aa, Homo sapiens
  light chain complementarity determining region 3 for antibody 10421
HHFGSATGT

SEQ ID NO: 20842 - protein, 10 aa, Homo sapiens
  heavy chain complementarity determining region 3 for antibody 10421
ARERSGSYDI

SEQ ID NO: 20843 - protein, 9 aa, Homo sapiens
  light chain complementarity determining region 3 for antibody 10422
HHFGSATGT

SEQ ID NO: 20844 - protein, 13 aa, Homo sapiens
  heavy chain complementarity determining region 3 for antibody 10422
AREGSSPGPDFEY

SEQ ID NO: 20845 - protein, 9 aa, Homo sapiens
  light chain complementarity determining region 3 for antibody 10423
HHFGSATGT

SEQ ID NO: 20846 - protein, 12 aa, Homo sapiens
  heavy chain complementarity determining region 3 for antibody 10423
ARDKGGRNGMDV

SEQ ID NO: 20847 - protein, 9 aa, Homo sapiens
  light chain complementarity determining region 3 for antibody 10424
HHFGSATGT

SEQ ID NO: 20848 - protein, 13 aa, Homo sapiens
  heavy chain complementarity determining region 3 for antibody 10424
AKKGSSPGPDFEY

SEQ ID NO: 20849 - protein, 9 aa, Homo sapiens
  light chain complementarity determining region 3 for antibody 10425
HHFGSATGT

SEQ ID NO: 20850 - protein, 13 aa, Homo sapiens
  heavy chain complementarity determining region 3 for antibody 10425
AKEVSSPGPDFEY

SEQ ID NO: 20851 - protein, 9 aa, Homo sapiens
  light chain complementarity determining region 3 for antibody 10426
HHFGSATGT

SEQ ID NO: 20852 - protein, 13 aa, Homo sapiens
  heavy chain complementarity determining region 3 for antibody 10426
AKERSSPGPDFEY

SEQ ID NO: 20853 - protein, 9 aa, Homo sapiens
  light chain complementarity determining region 3 for antibody 10427
HHFGSATGT

SEQ ID NO: 20854 - protein, 13 aa, Homo sapiens
  heavy chain complementarity determining region 3 for antibody 10427
AKEGYSPGPDFEY

SEQ ID NO: 20855 - protein, 9 aa, Homo sapiens
  light chain complementarity determining region 3 for antibody 10428
HHFGSATGT

SEQ ID NO: 20856 - protein, 13 aa, Homo sapiens
  heavy chain complementarity determining region 3 for antibody 10428
AKEGSSPRPDFEY

SEQ ID NO: 20857 - protein, 9 aa, Homo sapiens
  light chain complementarity determining region 3 for antibody 10429
HHFGSATGT

SEQ ID NO: 20858 - protein, 13 aa, Homo sapiens
  heavy chain complementarity determining region 3 for antibody 10429
AKEGSSPGTDFEY

SEQ ID NO: 20859 - protein, 9 aa, Homo sapiens
  light chain complementarity determining region 3 for antibody 10430
HHFGSATGT

SEQ ID NO: 20860 - protein, 13 aa, Homo sapiens
  heavy chain complementarity determining region 3 for antibody 10430
AKEGSSPGPGFEY

SEQ ID NO: 20861 - protein, 9 aa, Homo sapiens
  light chain complementarity determining region 3 for antibody 10431
HHFGSATGT

SEQ ID NO: 20862 - protein, 13 aa, Homo sapiens
  heavy chain complementarity determining region 3 for antibody 10431
AKEGSSPGPDFGY

SEQ ID NO: 20863 - protein, 9 aa, Homo sapiens
  light chain complementarity determining region 3 for antibody 10432
HHFGSATGT

SEQ ID NO: 20864 - protein, 13 aa, Homo sapiens
  heavy chain complementarity determining region 3 for antibody 10432
AKEGSSPGHDFEY

SEQ ID NO: 20865 - protein, 9 aa, Homo sapiens
  light chain complementarity determining region 3 for antibody 10433
HHFGSATGT

SEQ ID NO: 20866 - protein, 13 aa, Homo sapiens
  heavy chain complementarity determining region 3 for antibody 10433
AKEGSSPAPDFEY

SEQ ID NO: 20867 - protein, 9 aa, Homo sapiens
  light chain complementarity determining region 3 for antibody 10434
HHFGSATGT

SEQ ID NO: 20868 - protein, 13 aa, Homo sapiens
  heavy chain complementarity determining region 3 for antibody 10434
AKDRGSGWFAWGY

SEQ ID NO: 20869 - protein, 9 aa, Homo sapiens
  light chain complementarity determining region 3 for antibody 10435
HHFGSATGQ

SEQ ID NO: 20870 - protein, 13 aa, Homo sapiens
  heavy chain complementarity determining region 3 for antibody 10435
AKEGSSPGPDFEY

SEQ ID NO: 20871 - protein, 9 aa, Homo sapiens
  light chain complementarity determining region 3 for antibody 10436
HHFGSATGK

SEQ ID NO: 20872 - protein, 13 aa, Homo sapiens
  heavy chain complementarity determining region 3 for antibody 10436
AKEGSSPGPDFEY

SEQ ID NO: 20873 - protein, 9 aa, Homo sapiens
  light chain complementarity determining region 3 for antibody 10437
HHFGSAKGT

SEQ ID NO: 20874 - protein, 13 aa, Homo sapiens
  heavy chain complementarity determining region 3 for antibody 10437
AKEGSSPGPDFEY

SEQ ID NO: 20875 - protein, 9 aa, Homo sapiens
  light chain complementarity determining region 3 for antibody 10438
HHFGIATGT

SEQ ID NO: 20876 - protein, 13 aa, Homo sapiens
  heavy chain complementarity determining region 3 for antibody 10438
AKEGSSPGPDFEY

SEQ ID NO: 20877 - protein, 9 aa, Homo sapiens
  light chain complementarity determining region 3 for antibody 10439
HERSTWPGS

SEQ ID NO: 20878 - protein, 13 aa, Homo sapiens
  heavy chain complementarity determining region 3 for antibody 10439
ATGAWGSSWWGDY

SEQ ID NO: 20879 - protein, 7 aa, Homo sapiens
  light chain complementarity determining region 3 for antibody 10440
HCRDCWV

SEQ ID NO: 20880 - protein, 9 aa, Homo sapiens
  heavy chain complementarity determining region 3 for antibody 10440
ARSEYQPTY

SEQ ID NO: 20881 - protein, 9 aa, Homo sapiens
  light chain complementarity determining region 3 for antibody 10441
FQRNSWPLT

SEQ ID NO: 20882 - protein, 10 aa, Homo sapiens
  heavy chain complementarity determining region 3 for antibody 10441
GRDRLRAHDI

SEQ ID NO: 20883 - protein, 9 aa, Homo sapiens
  light chain complementarity determining region 3 for antibody 10442
FQHNTYPWT

SEQ ID NO: 20884 - protein, 12 aa, Homo sapiens
  heavy chain complementarity determining region 3 for antibody 10442
ARWDWNYRAFDI

SEQ ID NO: 20885 - protein, 9 aa, Homo sapiens
  light chain complementarity determining region 3 for antibody 10443
FQHNTYPWT

SEQ ID NO: 20886 - protein, 12 aa, Homo sapiens
  heavy chain complementarity determining region 3 for antibody 10443
ARLDWNYGAFDI

SEQ ID NO: 20887 - protein, 9 aa, Homo sapiens
  light chain complementarity determining region 3 for antibody 10444
FQHNTYPWA

SEQ ID NO: 20888 - protein, 12 aa, Homo sapiens
  heavy chain complementarity determining region 3 for antibody 10444
ARLDWNYRAFDI

SEQ ID NO: 20889 - protein, 9 aa, Homo sapiens
  light chain complementarity determining region 3 for antibody 10445
FQGTHWPRT

SEQ ID NO: 20890 - protein, 9 aa, Homo sapiens
  heavy chain complementarity determining region 3 for antibody 10445
ARSEYQPTY

SEQ ID NO: 20891 - protein, 9 aa, Homo sapiens
  light chain complementarity determining region 3 for antibody 10446
FQGTHWPGP

SEQ ID NO: 20892 - protein, 8 aa, Homo sapiens
  heavy chain complementarity determining region 3 for antibody 10446
GRDRWWSG

SEQ ID NO: 20893 - protein, 9 aa, Homo sapiens
  light chain complementarity determining region 3 for antibody 10447
FQGTHCPRT

SEQ ID NO: 20894 - protein, 8 aa, Homo sapiens
  heavy chain complementarity determining region 3 for antibody 10447
GRDRWWSG

SEQ ID NO: 20895 - protein, 10 aa, Homo sapiens
  light chain complementarity determining region 3 for antibody 10448
FQGSHWPPFT

SEQ ID NO: 20896 - protein, 9 aa, Homo sapiens
  heavy chain complementarity determining region 3 for antibody 10448
VRNNCHMDV

SEQ ID NO: 20897 - protein, 10 aa, Homo sapiens
  light chain complementarity determining region 3 for antibody 10449
FQGSHWPPFT

SEQ ID NO: 20898 - protein, 9 aa, Homo sapiens
  heavy chain complementarity determining region 3 for antibody 10449
GRNNYWMDV

SEQ ID NO: 20899 - protein, 10 aa, Homo sapiens
  light chain complementarity determining region 3 for antibody 10450
FQGSHWPPFT

SEQ ID NO: 20900 - protein, 10 aa, Homo sapiens
  heavy chain complementarity determining region 3 for antibody 10450
CRDREGFGDV

SEQ ID NO: 20901 - protein, 10 aa, Homo sapiens
  light chain complementarity determining region 3 for antibody 10451
FQGSHWPPFP

SEQ ID NO: 20902 - protein, 9 aa, Homo sapiens
  heavy chain complementarity determining region 3 for antibody 10451
VRNNYWMDV

SEQ ID NO: 20903 - protein, 10 aa, Homo sapiens
  light chain complementarity determining region 3 for antibody 10452
FQGSHWPPFP

SEQ ID NO: 20904 - protein, 9 aa, Homo sapiens
  heavy chain complementarity determining region 3 for antibody 10452
VRNNYHMDV

SEQ ID NO: 20905 - protein, 10 aa, Homo sapiens
  light chain complementarity determining region 3 for antibody 10453
FQGSHRPPFT

SEQ ID NO: 20906 - protein, 9 aa, Homo sapiens
  heavy chain complementarity determining region 3 for antibody 10453
VRNNYHMDV

SEQ ID NO: 20907 - protein, 10 aa, Homo sapiens
  light chain complementarity determining region 3 for antibody 10454
FQGSHLPPFT

SEQ ID NO: 20908 - protein, 9 aa, Homo sapiens
  heavy chain complementarity determining region 3 for antibody 10454
VRNNYYMDV

SEQ ID NO: 20909 - protein, 10 aa, Homo sapiens
  light chain complementarity determining region 3 for antibody 10455
FQGSHLPPFT

SEQ ID NO: 20910 - protein, 9 aa, Homo sapiens
  heavy chain complementarity determining region 3 for antibody 10455
VRNNYHMDV

SEQ ID NO: 20911 - protein, 9 aa, Homo sapiens
  light chain complementarity determining region 3 for antibody 10456
FQFAHWPHT

SEQ ID NO: 20912 - protein, 9 aa, Homo sapiens
  heavy chain complementarity determining region 3 for antibody 10456
AGWGGLSNY

SEQ ID NO: 20913 - protein, 10 aa, Homo sapiens
  light chain complementarity determining region 3 for antibody 10457
FPGSHWPPFT

SEQ ID NO: 20914 - protein, 9 aa, Homo sapiens
  heavy chain complementarity determining region 3 for antibody 10457
VRNNYHMDV

SEQ ID NO: 20915 - protein, 10 aa, Homo sapiens
  light chain complementarity determining region 3 for antibody 10458
FHGSHWPPFT

SEQ ID NO: 20916 - protein, 9 aa, Homo sapiens
  heavy chain complementarity determining region 3 for antibody 10458
VRNNYHMDV

SEQ ID NO: 20917 - protein, 10 aa, Homo sapiens
  light chain complementarity determining region 3 for antibody 10459
EHYGSSQGIT

SEQ ID NO: 20918 - protein, 17 aa, Homo sapiens
  heavy chain complementarity determining region 3 for antibody 10459
ARGTGIGSGSYYADFDY

SEQ ID NO: 20919 - protein, 11 aa, Homo sapiens
  light chain complementarity determining region 3 for antibody 10460
AQYGSSSGSGT

SEQ ID NO: 20920 - protein, 10 aa, Homo sapiens
  heavy chain complementarity determining region 3 for antibody 10460
ARAAYWAYDS

SEQ ID NO: 20921 - protein, 9 aa, Homo sapiens
  light chain complementarity determining region 3 for antibody 10461
AQVSYWPAS

SEQ ID NO: 20922 - protein, 10 aa, Homo sapiens
  heavy chain complementarity determining region 3 for antibody 10461
CRDREGFGDV

SEQ ID NO: 20923 - protein, 9 aa, Homo sapiens
  light chain complementarity determining region 3 for antibody 10462
AQGSYWRAS

SEQ ID NO: 20924 - protein, 10 aa, Homo sapiens
  heavy chain complementarity determining region 3 for antibody 10462
CRDREGFGDV

SEQ ID NO: 20925 - protein, 9 aa, Homo sapiens
  light chain complementarity determining region 3 for antibody 10463
AQGSYWPTS

SEQ ID NO: 20926 - protein, 10 aa, Homo sapiens
  heavy chain complementarity determining region 3 for antibody 10463
CRDREGFGDV

SEQ ID NO: 20927 - protein, 9 aa, Homo sapiens
  light chain complementarity determining region 3 for antibody 10464
AQGSYWPGS

SEQ ID NO: 20928 - protein, 10 aa, Homo sapiens
  heavy chain complementarity determining region 3 for antibody 10464
CRDRWGFGDV

SEQ ID NO: 20929 - protein, 9 aa, Homo sapiens
  light chain complementarity determining region 3 for antibody 10465
AQGSYWPGS

SEQ ID NO: 20930 - protein, 10 aa, Homo sapiens
  heavy chain complementarity determining region 3 for antibody 10465
CRDRRGFGDV

SEQ ID NO: 20931 - protein, 9 aa, Homo sapiens
  light chain complementarity determining region 3 for antibody 10466
AQGSYWPAS

SEQ ID NO: 20932 - protein, 10 aa, Homo sapiens
  heavy chain complementarity determining region 3 for antibody 10466
YRDRWGFGDV

SEQ ID NO: 20933 - protein, 9 aa, Homo sapiens
  light chain complementarity determining region 3 for antibody 10467
AQGSYWPAS

SEQ ID NO: 20934 - protein, 10 aa, Homo sapiens
  heavy chain complementarity determining region 3 for antibody 10467
YRDREGFGDV

SEQ ID NO: 20935 - protein, 9 aa, Homo sapiens
  light chain complementarity determining region 3 for antibody 10468
AQGSYWPAS

SEQ ID NO: 20936 - protein, 17 aa, Homo sapiens
  heavy chain complementarity determining region 3 for antibody 10468
VTHYYHDSGIYYDFFNY

SEQ ID NO: 20937 - protein, 9 aa, Homo sapiens
  light chain complementarity determining region 3 for antibody 10469
AQGSYWPAS

SEQ ID NO: 20938 - protein, 10 aa, Homo sapiens
  heavy chain complementarity determining region 3 for antibody 10469
VRSDSPGDDS

SEQ ID NO: 20939 - protein, 9 aa, Homo sapiens
  light chain complementarity determining region 3 for antibody 10470
AQGSYWPAS

SEQ ID NO: 20940 - protein, 10 aa, Homo sapiens
  heavy chain complementarity determining region 3 for antibody 10470
VREGNWNLDY

SEQ ID NO: 20941 - protein, 9 aa, Homo sapiens
  light chain complementarity determining region 3 for antibody 10471
AQGSYWPAS

SEQ ID NO: 20942 - protein, 12 aa, Homo sapiens
  heavy chain complementarity determining region 3 for antibody 10471
TTWIKTSVWLDY

SEQ ID NO: 20943 - protein, 9 aa, Homo sapiens
  light chain complementarity determining region 3 for antibody 10472
AQGSYWPAS

SEQ ID NO: 20944 - protein, 14 aa, Homo sapiens
  heavy chain complementarity determining region 3 for antibody 10472
TRGHFDSTGFRLDY

SEQ ID NO: 20945 - protein, 9 aa, Homo sapiens
  light chain complementarity determining region 3 for antibody 10473
AQGSYWPAS

SEQ ID NO: 20946 - protein, 12 aa, Homo sapiens
  heavy chain complementarity determining region 3 for antibody 10473
TRDPEGDEDFDY

SEQ ID NO: 20947 - protein, 9 aa, Homo sapiens
  light chain complementarity determining region 3 for antibody 10474
AQGSYWPAS

SEQ ID NO: 20948 - protein, 14 aa, Homo sapiens
  heavy chain complementarity determining region 3 for antibody 10474
GRDVHTTGWTLGGY

SEQ ID NO: 20949 - protein, 9 aa, Homo sapiens
  light chain complementarity determining region 3 for antibody 10475
AQGSYWPAS

SEQ ID NO: 20950 - protein, 10 aa, Homo sapiens
  heavy chain complementarity determining region 3 for antibody 10475
FRDREGFGDV

SEQ ID NO: 20951 - protein, 9 aa, Homo sapiens
  light chain complementarity determining region 3 for antibody 10476
AQGSYWPAS

SEQ ID NO: 20952 - protein, 10 aa, Homo sapiens
  heavy chain complementarity determining region 3 for antibody 10476
CRYREGFGDV

SEQ ID NO: 20953 - protein, 9 aa, Homo sapiens
  light chain complementarity determining region 3 for antibody 10477
AQGSYWPAS

SEQ ID NO: 20954 - protein, 10 aa, Homo sapiens
  heavy chain complementarity determining region 3 for antibody 10477
CRVREGFGDV

SEQ ID NO: 20955 - protein, 9 aa, Homo sapiens
  light chain complementarity determining region 3 for antibody 10478
AQGSYWPAS

SEQ ID NO: 20956 - protein, 10 aa, Homo sapiens
  heavy chain complementarity determining region 3 for antibody 10478
CRNREGFGDV

SEQ ID NO: 20957 - protein, 9 aa, Homo sapiens
  light chain complementarity determining region 3 for antibody 10479
AQGSYWPAS

SEQ ID NO: 20958 - protein, 10 aa, Homo sapiens
  heavy chain complementarity determining region 3 for antibody 10479
CRHREGFGDV

SEQ ID NO: 20959 - protein, 9 aa, Homo sapiens
  light chain complementarity determining region 3 for antibody 10480
AQGSYWPAS

SEQ ID NO: 20960 - protein, 14 aa, Homo sapiens
  heavy chain complementarity determining region 3 for antibody 10480
CRGWLDPATPHYDF

SEQ ID NO: 20961 - protein, 9 aa, Homo sapiens
  light chain complementarity determining region 3 for antibody 10481
AQGSYWPAS

SEQ ID NO: 20962 - protein, 10 aa, Homo sapiens
  heavy chain complementarity determining region 3 for antibody 10481
CRDRWGFGGV

SEQ ID NO: 20963 - protein, 9 aa, Homo sapiens
  light chain complementarity determining region 3 for antibody 10482
AQGSYWPAS

SEQ ID NO: 20964 - protein, 10 aa, Homo sapiens
  heavy chain complementarity determining region 3 for antibody 10482
CRDRWGFGDA

SEQ ID NO: 20965 - protein, 9 aa, Homo sapiens
  light chain complementarity determining region 3 for antibody 10483
AQGSYWPAS

SEQ ID NO: 20966 - protein, 10 aa, Homo sapiens
  heavy chain complementarity determining region 3 for antibody 10483
CRDRRGFGDA

SEQ ID NO: 20967 - protein, 9 aa, Homo sapiens
  light chain complementarity determining region 3 for antibody 10484
AQGSYWPAS

SEQ ID NO: 20968 - protein, 10 aa, Homo sapiens
  heavy chain complementarity determining region 3 for antibody 10484
CRDREVFGDV

SEQ ID NO: 20969 - protein, 9 aa, Homo sapiens
  light chain complementarity determining region 3 for antibody 10485
AQGSYWPAS

SEQ ID NO: 20970 - protein, 10 aa, Homo sapiens
  heavy chain complementarity determining region 3 for antibody 10485
CRDREGFRDV

SEQ ID NO: 20971 - protein, 9 aa, Homo sapiens
  light chain complementarity determining region 3 for antibody 10486
AQGSYWPAS

SEQ ID NO: 20972 - protein, 10 aa, Homo sapiens
  heavy chain complementarity determining region 3 for antibody 10486
CRDREGFEDV

SEQ ID NO: 20973 - protein, 9 aa, Homo sapiens
  light chain complementarity determining region 3 for antibody 10487
AQGSYWPAS

SEQ ID NO: 20974 - protein, 10 aa, Homo sapiens
  heavy chain complementarity determining region 3 for antibody 10487
CRDREEFGDV

SEQ ID NO: 20975 - protein, 9 aa, Homo sapiens
  light chain complementarity determining region 3 for antibody 10488
AQGSYWPAS

SEQ ID NO: 20976 - protein, 10 aa, Homo sapiens
  heavy chain complementarity determining region 3 for antibody 10488
CRDRDGFGDV

SEQ ID NO: 20977 - protein, 9 aa, Homo sapiens
  light chain complementarity determining region 3 for antibody 10489
AQGSYWPAS

SEQ ID NO: 20978 - protein, 10 aa, Homo sapiens
  heavy chain complementarity determining region 3 for antibody 10489
CRDHEGFVDV

SEQ ID NO: 20979 - protein, 9 aa, Homo sapiens
  light chain complementarity determining region 3 for antibody 10490
AQGSYWPAS

SEQ ID NO: 20980 - protein, 10 aa, Homo sapiens
  heavy chain complementarity determining region 3 for antibody 10490
CRDHEGFGGV

SEQ ID NO: 20981 - protein, 9 aa, Homo sapiens
  light chain complementarity determining region 3 for antibody 10491
AQGSYWPAS

SEQ ID NO: 20982 - protein, 10 aa, Homo sapiens
  heavy chain complementarity determining region 3 for antibody 10491
CRAREGFGDV

SEQ ID NO: 20983 - protein, 9 aa, Homo sapiens
  light chain complementarity determining region 3 for antibody 10492
AQGSYWPAS

SEQ ID NO: 20984 - protein, 10 aa, Homo sapiens
  heavy chain complementarity determining region 3 for antibody 10492
CIDREGFGDV

SEQ ID NO: 20985 - protein, 9 aa, Homo sapiens
  light chain complementarity determining region 3 for antibody 10493
AQGSYWPAS

SEQ ID NO: 20986 - protein, 13 aa, Homo sapiens
  heavy chain complementarity determining region 3 for antibody 10493
ATGAWGSSWWGDY

SEQ ID NO: 20987 - protein, 9 aa, Homo sapiens
  light chain complementarity determining region 3 for antibody 10494
AQGSYWPAS

SEQ ID NO: 20988 - protein, 10 aa, Homo sapiens
  heavy chain complementarity determining region 3 for antibody 10494
ARRWERYFDY

SEQ ID NO: 20989 - protein, 9 aa, Homo sapiens
  light chain complementarity determining region 3 for antibody 10495
AQGSYWPAS

SEQ ID NO: 20990 - protein, 12 aa, Homo sapiens
  heavy chain complementarity determining region 3 for antibody 10495
ARLNWGSRAFDH

SEQ ID NO: 20991 - protein, 9 aa, Homo sapiens
  light chain complementarity determining region 3 for antibody 10496
AQGSYWPAS

SEQ ID NO: 20992 - protein, 14 aa, Homo sapiens
  heavy chain complementarity determining region 3 for antibody 10496
ARLHGSGLGRWLDP

SEQ ID NO: 20993 - protein, 9 aa, Homo sapiens
  light chain complementarity determining region 3 for antibody 10497
AQGSYWPAS

SEQ ID NO: 20994 - protein, 11 aa, Homo sapiens
  heavy chain complementarity determining region 3 for antibody 10497
ARIVARKPDDY

SEQ ID NO: 20995 - protein, 9 aa, Homo sapiens
  light chain complementarity determining region 3 for antibody 10498
AQGSYWPAS

SEQ ID NO: 20996 - protein, 12 aa, Homo sapiens
  heavy chain complementarity determining region 3 for antibody 10498
ARGPLKMAGGSS

SEQ ID NO: 20997 - protein, 9 aa, Homo sapiens
  light chain complementarity determining region 3 for antibody 10499
AQGSYWPAS

SEQ ID NO: 20998 - protein, 9 aa, Homo sapiens
  heavy chain complementarity determining region 3 for antibody 10499
ARGHYGPDY

SEQ ID NO: 20999 - protein, 9 aa, Homo sapiens
  light chain complementarity determining region 3 for antibody 10500
AQGSYWPAS

SEQ ID NO: 21000 - protein, 15 aa, Homo sapiens
  heavy chain complementarity determining region 3 for antibody 10500
ARGDYGDYKGVPFDY

SEQ ID NO: 21001 - protein, 9 aa, Homo sapiens
  light chain complementarity determining region 3 for antibody 10501
AQGSYWPAS

SEQ ID NO: 21002 - protein, 11 aa, Homo sapiens
  heavy chain complementarity determining region 3 for antibody 10501
ARGDGWYGLDY

SEQ ID NO: 21003 - protein, 9 aa, Homo sapiens
  light chain complementarity determining region 3 for antibody 10502
AQGSYWPAS

SEQ ID NO: 21004 - protein, 9 aa, Homo sapiens
  heavy chain complementarity determining region 3 for antibody 10502
ARFWTYGRK

SEQ ID NO: 21005 - protein, 9 aa, Homo sapiens
  light chain complementarity determining region 3 for antibody 10503
AQGSYWPAS

SEQ ID NO: 21006 - protein, 10 aa, Homo sapiens
  heavy chain complementarity determining region 3 for antibody 10503
ARETSGSYDI

SEQ ID NO: 21007 - protein, 9 aa, Homo sapiens
  light chain complementarity determining region 3 for antibody 10504
AQGSYWPAS

SEQ ID NO: 21008 - protein, 10 aa, Homo sapiens
  heavy chain complementarity determining region 3 for antibody 10504
AREKLANYDC

SEQ ID NO: 21009 - protein, 9 aa, Homo sapiens
  light chain complementarity determining region 3 for antibody 10505
AQGSYWPAS

SEQ ID NO: 21010 - protein, 12 aa, Homo sapiens
  heavy chain complementarity determining region 3 for antibody 10505
ARDFTANYCPDY

SEQ ID NO: 21011 - protein, 9 aa, Homo sapiens
  light chain complementarity determining region 3 for antibody 10506
AQGSYWPAS

SEQ ID NO: 21012 - protein, 13 aa, Homo sapiens
  heavy chain complementarity determining region 3 for antibody 10506
AKRYSTNWGHFDY

SEQ ID NO: 21013 - protein, 9 aa, Homo sapiens
  light chain complementarity determining region 3 for antibody 10507
AQGSYWPAS

SEQ ID NO: 21014 - protein, 11 aa, Homo sapiens
  heavy chain complementarity determining region 3 for antibody 10507
AKGGFYFLTGD

SEQ ID NO: 21015 - protein, 9 aa, Homo sapiens
  light chain complementarity determining region 3 for antibody 10508
AQGSYWPAS

SEQ ID NO: 21016 - protein, 10 aa, Homo sapiens
  heavy chain complementarity determining region 3 for antibody 10508
AHRINRAFDI

SEQ ID NO: 21017 - protein, 9 aa, Homo sapiens
  light chain complementarity determining region 3 for antibody 10509
AQGSYWPAS

SEQ ID NO: 21018 - protein, 9 aa, Homo sapiens
  heavy chain complementarity determining region 3 for antibody 10509
AGWGGTSNY

SEQ ID NO: 21019 - protein, 9 aa, Homo sapiens
  light chain complementarity determining region 3 for antibody 10510
AQGSYWPAS

SEQ ID NO: 21020 - protein, 16 aa, Homo sapiens
  heavy chain complementarity determining region 3 for antibody 10510
AADLGDHADAYATLDS

SEQ ID NO: 21021 - protein, 9 aa, Homo sapiens
  light chain complementarity determining region 3 for antibody 10511
AQGSYWPAS

SEQ ID NO: 21022 - protein, 13 aa, Homo sapiens
  heavy chain complementarity determining region 3 for antibody 10511
AADGPYGSSAFDY

SEQ ID NO: 21023 - protein, 9 aa, Homo sapiens
  light chain complementarity determining region 3 for antibody 10512
AQGSYWPAA

SEQ ID NO: 21024 - protein, 10 aa, Homo sapiens
  heavy chain complementarity determining region 3 for antibody 10512
CRDRRGFGDV

SEQ ID NO: 21025 - protein, 9 aa, Homo sapiens
  light chain complementarity determining region 3 for antibody 10513
AQGSYLPAS

SEQ ID NO: 21026 - protein, 10 aa, Homo sapiens
  heavy chain complementarity determining region 3 for antibody 10513
CRDREGFGDV

SEQ ID NO: 21027 - protein, 9 aa, Homo sapiens
  light chain complementarity determining region 3 for antibody 10514
AQGSYGPAS

SEQ ID NO: 21028 - protein, 10 aa, Homo sapiens
  heavy chain complementarity determining region 3 for antibody 10514
CREREGFGDV

SEQ ID NO: 21029 - protein, 9 aa, Homo sapiens
  light chain complementarity determining region 3 for antibody 10515
AQGSYCPAS

SEQ ID NO: 21030 - protein, 10 aa, Homo sapiens
  heavy chain complementarity determining region 3 for antibody 10515
CRDRRGFGDV

SEQ ID NO: 21031 - protein, 9 aa, Homo sapiens
  light chain complementarity determining region 3 for antibody 10516
AQGSNWPAS

SEQ ID NO: 21032 - protein, 10 aa, Homo sapiens
  heavy chain complementarity determining region 3 for antibody 10516
CRDREGFGDV

SEQ ID NO: 21033 - protein, 9 aa, Homo sapiens
  light chain complementarity determining region 3 for antibody 10517
AQGSFWSAS

SEQ ID NO: 21034 - protein, 10 aa, Homo sapiens
  heavy chain complementarity determining region 3 for antibody 10517
CRDREGFGDV

SEQ ID NO: 21035 - protein, 9 aa, Homo sapiens
  light chain complementarity determining region 3 for antibody 10518
AQGSFWPAT

SEQ ID NO: 21036 - protein, 20 aa, Homo sapiens
  heavy chain complementarity determining region 3 for antibody 10518
STYLPGDCTCSYCFYWYSDV

SEQ ID NO: 21037 - protein, 9 aa, Homo sapiens
  light chain complementarity determining region 3 for antibody 10519
AQGSFWPAT

SEQ ID NO: 21038 - protein, 20 aa, Homo sapiens
  heavy chain complementarity determining region 3 for antibody 10519
STSLPGDCTCTYCFYWYSDV

SEQ ID NO: 21039 - protein, 9 aa, Homo sapiens
  light chain complementarity determining region 3 for antibody 10520
AQGSFWPAS

SEQ ID NO: 21040 - protein, 14 aa, Homo sapiens
  heavy chain complementarity determining region 3 for antibody 10520
VREEGSGYYRTADY

SEQ ID NO: 21041 - protein, 9 aa, Homo sapiens
  light chain complementarity determining region 3 for antibody 10521
AQGSFWPAS

SEQ ID NO: 21042 - protein, 16 aa, Homo sapiens
  heavy chain complementarity determining region 3 for antibody 10521
VRDLAGFTRGGSTFDY

SEQ ID NO: 21043 - protein, 9 aa, Homo sapiens
  light chain complementarity determining region 3 for antibody 10522
AQGSFWPAS

SEQ ID NO: 21044 - protein, 10 aa, Homo sapiens
  heavy chain complementarity determining region 3 for antibody 10522
RRDREGFGDV

SEQ ID NO: 21045 - protein, 9 aa, Homo sapiens
  light chain complementarity determining region 3 for antibody 10523
AQGSFWPAS

SEQ ID NO: 21046 - protein, 10 aa, Homo sapiens
  heavy chain complementarity determining region 3 for antibody 10523
CRDRGGFGDV

SEQ ID NO: 21047 - protein, 9 aa, Homo sapiens
  light chain complementarity determining region 3 for antibody 10524
AQGSFWPAS

SEQ ID NO: 21048 - protein, 10 aa, Homo sapiens
  heavy chain complementarity determining region 3 for antibody 10524
CRDREGFGGV

SEQ ID NO: 21049 - protein, 9 aa, Homo sapiens
  light chain complementarity determining region 3 for antibody 10525
AQGSFWPAS

SEQ ID NO: 21050 - protein, 10 aa, Homo sapiens
  heavy chain complementarity determining region 3 for antibody 10525
CKDREGFGDV

SEQ ID NO: 21051 - protein, 9 aa, Homo sapiens
  light chain complementarity determining region 3 for antibody 10526
AQGSFWPAS

SEQ ID NO: 21052 - protein, 10 aa, Homo sapiens
  heavy chain complementarity determining region 3 for antibody 10526
CGDREGFGDV

SEQ ID NO: 21053 - protein, 9 aa, Homo sapiens
  light chain complementarity determining region 3 for antibody 10527
AQGSFWPAS

SEQ ID NO: 21054 - protein, 11 aa, Homo sapiens
  heavy chain complementarity determining region 3 for antibody 10527
ATFGQQWRLAH

SEQ ID NO: 21055 - protein, 9 aa, Homo sapiens
  light chain complementarity determining region 3 for antibody 10528
AQGSFWPAS

SEQ ID NO: 21056 - protein, 11 aa, Homo sapiens
  heavy chain complementarity determining region 3 for antibody 10528
ARRSLGGAFDY

SEQ ID NO: 21057 - protein, 9 aa, Homo sapiens
  light chain complementarity determining region 3 for antibody 10529
AQGSFRPAS

SEQ ID NO: 21058 - protein, 10 aa, Homo sapiens
  heavy chain complementarity determining region 3 for antibody 10529
CRDREGFGDV

SEQ ID NO: 21059 - protein, 9 aa, Homo sapiens
  light chain complementarity determining region 3 for antibody 10530
AQGSFCPAS

SEQ ID NO: 21060 - protein, 10 aa, Homo sapiens
  heavy chain complementarity determining region 3 for antibody 10530
CREREGFGDV

SEQ ID NO: 21061 - protein, 9 aa, Homo sapiens
  light chain complementarity determining region 3 for antibody 10531
AQGSDWPAS

SEQ ID NO: 21062 - protein, 10 aa, Homo sapiens
  heavy chain complementarity determining region 3 for antibody 10531
CRDREGFGDV

SEQ ID NO: 21063 - protein, 11 aa, Homo sapiens
  light chain complementarity determining region 3 for antibody 10532
APYGSSSGSGT

SEQ ID NO: 21064 - protein, 10 aa, Homo sapiens
  heavy chain complementarity determining region 3 for antibody 10532
ARATYWAYDS

SEQ ID NO: 21065 - protein, 9 aa, Homo sapiens
  light chain complementarity determining region 3 for antibody 10533
APGSYWPSS

SEQ ID NO: 21066 - protein, 10 aa, Homo sapiens
  heavy chain complementarity determining region 3 for antibody 10533
CRDREGFGDV

SEQ ID NO: 21067 - protein, 9 aa, Homo sapiens
  light chain complementarity determining region 3 for antibody 10534
APGSYWPAS

SEQ ID NO: 21068 - protein, 10 aa, Homo sapiens
  heavy chain complementarity determining region 3 for antibody 10534
CRDRRGFGDV

SEQ ID NO: 21069 - protein, 9 aa, Homo sapiens
  light chain complementarity determining region 3 for antibody 10535
APGSYWPAS

SEQ ID NO: 21070 - protein, 10 aa, Homo sapiens
  heavy chain complementarity determining region 3 for antibody 10535
CRDHEGFGDV

SEQ ID NO: 21071 - protein, 11 aa, Homo sapiens
  light chain complementarity determining region 3 for antibody 10536
AHYGSSSGSGT

SEQ ID NO: 21072 - protein, 10 aa, Homo sapiens
  heavy chain complementarity determining region 3 for antibody 10536
ARATYWAHDS

SEQ ID NO: 21073 - protein, 9 aa, Homo sapiens
  light chain complementarity determining region 3 for antibody 10537
AHGSYWPAS

SEQ ID NO: 21074 - protein, 10 aa, Homo sapiens
  heavy chain complementarity determining region 3 for antibody 10537
CRDREGFGDV

SEQ ID NO: 21075 - protein, 10 aa, Homo sapiens
  light chain complementarity determining region 3 for antibody 10538
QYHGYSPLYT

SEQ ID NO: 21076 - protein, 12 aa, Homo sapiens
  heavy chain complementarity determining region 3 for antibody 10538
AKGILGRGGMDV

SEQ ID NO: 21077 - protein, 9 aa, Homo sapiens
  light chain complementarity determining region 3 for antibody 10539
QQAYRFPLS

SEQ ID NO: 21078 - protein, 13 aa, Homo sapiens
  heavy chain complementarity determining region 3 for antibody 10539
TRTYGSGRNWFDP

SEQ ID NO: 21079 - protein, 9 aa, Homo sapiens
  light chain complementarity determining region 3 for antibody 10540
QQFHSYPIT

SEQ ID NO: 21080 - protein, 16 aa, Homo sapiens
  heavy chain complementarity determining region 3 for antibody 10540
ARTQGTRDYYYYAMDV

SEQ ID NO: 21081 - protein, 9 aa, Homo sapiens
  light chain complementarity determining region 3 for antibody 10541
QQYNSYWYT

SEQ ID NO: 21082 - protein, 20 aa, Homo sapiens
  heavy chain complementarity determining region 3 for antibody 10541
AGTYGSGTYSPDYYYFGMDV

SEQ ID NO: 21083 - protein, 8 aa, Homo sapiens
  light chain complementarity determining region 3 for antibody 10542
QQAHSFPP

SEQ ID NO: 21084 - protein, 22 aa, Homo sapiens
  heavy chain complementarity determining region 3 for antibody 10542
ARHSGYSNTWYMNYYYYYGMDV

SEQ ID NO: 21085 - protein, 9 aa, Homo sapiens
  light chain complementarity determining region 3 for antibody 10543
QHNYRPSPA

SEQ ID NO: 21086 - protein, 11 aa, Homo sapiens
  heavy chain complementarity determining region 3 for antibody 10543
TRDPPGNGMDV

SEQ ID NO: 21087 - protein, 9 aa, Homo sapiens
  light chain complementarity determining region 3 for antibody 10544
QQSYSTPRT

SEQ ID NO: 21088 - protein, 14 aa, Homo sapiens
  heavy chain complementarity determining region 3 for antibody 10544
ARVQVDYSNYGCDS

SEQ ID NO: 21089 - protein, 10 aa, Homo sapiens
  light chain complementarity determining region 3 for antibody 10545
QQYVSSELFT

SEQ ID NO: 21090 - protein, 16 aa, Homo sapiens
  heavy chain complementarity determining region 3 for antibody 10545
AREIFKGEIDYYAMDV

SEQ ID NO: 21091 - protein, 9 aa, Homo sapiens
  light chain complementarity determining region 3 for antibody 10546
QQYDSLPLT

SEQ ID NO: 21092 - protein, 18 aa, Homo sapiens
  heavy chain complementarity determining region 3 for antibody 10546
ARAPGDYDMLRRGYYFDH

SEQ ID NO: 21093 - protein, 9 aa, Homo sapiens
  light chain complementarity determining region 3 for antibody 10547
QQFNTYPLT

SEQ ID NO: 21094 - protein, 17 aa, Homo sapiens
  heavy chain complementarity determining region 3 for antibody 10547
AKDLSGVHYDIHHGLDV

SEQ ID NO: 21095 - protein, 9 aa, Homo sapiens
  light chain complementarity determining region 3 for antibody 10548
QQYNNLPYT

SEQ ID NO: 21096 - protein, 13 aa, Homo sapiens
  heavy chain complementarity determining region 3 for antibody 10548
ARAKWDLFGYFDF

SEQ ID NO: 21097 - protein, 9 aa, Homo sapiens
  light chain complementarity determining region 3 for antibody 10549
LQDYKYPRT

SEQ ID NO: 21098 - protein, 18 aa, Homo sapiens
  heavy chain complementarity determining region 3 for antibody 10549
ARDTSPGDSSAWYDAFDI

SEQ ID NO: 21099 - protein, 9 aa, Homo sapiens
  light chain complementarity determining region 3 for antibody 10550
QQRNNWGLT

SEQ ID NO: 21100 - protein, 22 aa, Homo sapiens
  heavy chain complementarity determining region 3 for antibody 10550
ARHSGYSNTWYMNYYYYYGMDV

SEQ ID NO: 21101 - protein, 10 aa, Homo sapiens
  light chain complementarity determining region 3 for antibody 10551
QQYSSSPQLT

SEQ ID NO: 21102 - protein, 13 aa, Homo sapiens
  heavy chain complementarity determining region 3 for antibody 10551
ARSAGYYPNWLES

SEQ ID NO: 21103 - protein, 9 aa, Homo sapiens
  light chain complementarity determining region 3 for antibody 10552
QRCNSYPYT

SEQ ID NO: 21104 - protein, 9 aa, Homo sapiens
  heavy chain complementarity determining region 3 for antibody 10552
VAYLAGYPR

SEQ ID NO: 21105 - protein, 10 aa, Homo sapiens
  light chain complementarity determining region 3 for antibody 10553
QQRSNWPIFT

SEQ ID NO: 21106 - protein, 14 aa, Homo sapiens
  heavy chain complementarity determining region 3 for antibody 10553
ARLNKMTRIRYFDS

SEQ ID NO: 21107 - protein, 9 aa, Homo sapiens
  light chain complementarity determining region 3 for antibody 10554
QQYNSLPIT

SEQ ID NO: 21108 - protein, 19 aa, Homo sapiens
  heavy chain complementarity determining region 3 for antibody 10554
ARDRDYTIVDDYGSGVFDY

SEQ ID NO: 21109 - protein, 8 aa, Homo sapiens
  light chain complementarity determining region 3 for antibody 10555
QQYGNLLT

SEQ ID NO: 21110 - protein, 20 aa, Homo sapiens
  heavy chain complementarity determining region 3 for antibody 10555
SKDRSVNAAMDYYYYSAMDV

SEQ ID NO: 21111 - protein, 9 aa, Homo sapiens
  light chain complementarity determining region 3 for antibody 10556
QQGHSLPFT

SEQ ID NO: 21112 - protein, 19 aa, Homo sapiens
  heavy chain complementarity determining region 3 for antibody 10556
ARSDYSGDTDRYYDYGMDV

SEQ ID NO: 21113 - protein, 9 aa, Homo sapiens
  light chain complementarity determining region 3 for antibody 10557
MQGLQTPLT

SEQ ID NO: 21114 - protein, 16 aa, Homo sapiens
  heavy chain complementarity determining region 3 for antibody 10557
ARGGFGELGLHNAFDV

SEQ ID NO: 21115 - protein, 9 aa, Homo sapiens
  light chain complementarity determining region 3 for antibody 10558
QQLHGYPLT

SEQ ID NO: 21116 - protein, 21 aa, Homo sapiens
  heavy chain complementarity determining region 3 for antibody 10558
ARDWAQSNGYPVGHYYYGMDV

SEQ ID NO: 21117 - protein, 9 aa, Homo sapiens
  light chain complementarity determining region 3 for antibody 10559
QQYDNLPLT

SEQ ID NO: 21118 - protein, 18 aa, Homo sapiens
  heavy chain complementarity determining region 3 for antibody 10559
ARAPGDYDMLRRGYYFDH

SEQ ID NO: 21119 - protein, 10 aa, Homo sapiens
  light chain complementarity determining region 3 for antibody 10560
QQYDNLPPFT

SEQ ID NO: 21120 - protein, 16 aa, Homo sapiens
  heavy chain complementarity determining region 3 for antibody 10560
ARELFKGEYDYYAMDV

SEQ ID NO: 21121 - protein, 9 aa, Homo sapiens
  light chain complementarity determining region 3 for antibody 10561
QQANSFPWT

SEQ ID NO: 21122 - protein, 14 aa, Homo sapiens
  heavy chain complementarity determining region 3 for antibody 10561
ARLNKMTRIRYFDS

SEQ ID NO: 21123 - protein, 9 aa, Homo sapiens
  light chain complementarity determining region 3 for antibody 10562
QHCDHFSIT

SEQ ID NO: 21124 - protein, 15 aa, Homo sapiens
  heavy chain complementarity determining region 3 for antibody 10562
ARDPTAAGFPAHFDY

SEQ ID NO: 21125 - protein, 9 aa, Homo sapiens
  light chain complementarity determining region 3 for antibody 10563
QQYDSFPYT

SEQ ID NO: 21126 - protein, 17 aa, Homo sapiens
  heavy chain complementarity determining region 3 for antibody 10563
AREDWSDVDLRAFYFDS

SEQ ID NO: 21127 - protein, 10 aa, Homo sapiens
  light chain complementarity determining region 3 for antibody 10564
QQYVSSALYT

SEQ ID NO: 21128 - protein, 16 aa, Homo sapiens
  heavy chain complementarity determining region 3 for antibody 10564
ARELFKGEYDYYAMDV

SEQ ID NO: 21129 - protein, 10 aa, Homo sapiens
  light chain complementarity determining region 3 for antibody 10565
HQSSSLPRLT

SEQ ID NO: 21130 - protein, 18 aa, Homo sapiens
  heavy chain complementarity determining region 3 for antibody 10565
ARDVGYDSNAHYHWYFDL

SEQ ID NO: 21131 - protein, 9 aa, Homo sapiens
  light chain complementarity determining region 3 for antibody 10566
LQYNNWPRT

SEQ ID NO: 21132 - protein, 16 aa, Homo sapiens
  heavy chain complementarity determining region 3 for antibody 10566
ARDSGIESRGLWYFDL

SEQ ID NO: 21133 - protein, 9 aa, Homo sapiens
  light chain complementarity determining region 3 for antibody 10567
QQSFSPPWA

SEQ ID NO: 21134 - protein, 19 aa, Homo sapiens
  heavy chain complementarity determining region 3 for antibody 10567
ATMRYGSGELTYDYYGMDV

SEQ ID NO: 21135 - protein, 9 aa, Homo sapiens
  light chain complementarity determining region 3 for antibody 10568
QQYKTDPWT

SEQ ID NO: 21136 - protein, 10 aa, Homo sapiens
  heavy chain complementarity determining region 3 for antibody 10568
IRHEEYVRPY

SEQ ID NO: 21137 - protein, 9 aa, Homo sapiens
  light chain complementarity determining region 3 for antibody 10569
QQYYTYSET

SEQ ID NO: 21138 - protein, 19 aa, Homo sapiens
  heavy chain complementarity determining region 3 for antibody 10569
ATVKGDQGELDYDYHGVDV

SEQ ID NO: 21139 - protein, 9 aa, Homo sapiens
  light chain complementarity determining region 3 for antibody 10570
QQSYNLRWT

SEQ ID NO: 21140 - protein, 14 aa, Homo sapiens
  heavy chain complementarity determining region 3 for antibody 10570
ARAGPSGTYSGFDS

SEQ ID NO: 21141 - protein, 9 aa, Homo sapiens
  light chain complementarity determining region 3 for antibody 10571
HQYSVSRGT

SEQ ID NO: 21142 - protein, 21 aa, Homo sapiens
  heavy chain complementarity determining region 3 for antibody 10571
ARDRGGDFHGDSSYYNRPFDY

SEQ ID NO: 21143 - protein, 9 aa, Homo sapiens
  light chain complementarity determining region 3 for antibody 10572
QQGNSFPFT

SEQ ID NO: 21144 - protein, 19 aa, Homo sapiens
  heavy chain complementarity determining region 3 for antibody 10572
ARTDCSGDTDRYYDFGMDV

SEQ ID NO: 21145 - protein, 9 aa, Homo sapiens
  light chain complementarity determining region 3 for antibody 10573
QQYNSYPRT

SEQ ID NO: 21146 - protein, 19 aa, Homo sapiens
  heavy chain complementarity determining region 3 for antibody 10573
ARDSPSVRKRPTEYYGMDV

SEQ ID NO: 21147 - protein, 9 aa, Homo sapiens
  light chain complementarity determining region 3 for antibody 10574
QQSYSTPYT

SEQ ID NO: 21148 - protein, 12 aa, Homo sapiens
  heavy chain complementarity determining region 3 for antibody 10574
AVELGYGDIPIA

SEQ ID NO: 21149 - protein, 9 aa, Homo sapiens
  light chain complementarity determining region 3 for antibody 10575
QQYNSYPIT

SEQ ID NO: 21150 - protein, 13 aa, Homo sapiens
  heavy chain complementarity determining region 3 for antibody 10575
ASGLHSGYDYFDY

SEQ ID NO: 21151 - protein, 9 aa, Homo sapiens
  light chain complementarity determining region 3 for antibody 10576
QQSYSTPFT

SEQ ID NO: 21152 - protein, 14 aa, Homo sapiens
  heavy chain complementarity determining region 3 for antibody 10576
ARLPGRYPRYGMDV

SEQ ID NO: 21153 - protein, 9 aa, Homo sapiens
  light chain complementarity determining region 3 for antibody 10577
QQANSLPFT

SEQ ID NO: 21154 - protein, 19 aa, Homo sapiens
  heavy chain complementarity determining region 3 for antibody 10577
ARNDYSGDTDRYYDFGMDV

SEQ ID NO: 21155 - protein, 9 aa, Homo sapiens
  light chain complementarity determining region 3 for antibody 10578
MQALQTPFT

SEQ ID NO: 21156 - protein, 19 aa, Homo sapiens
  heavy chain complementarity determining region 3 for antibody 10578
ARLDRYCTGSRCYSFWFEP

SEQ ID NO: 21157 - protein, 9 aa, Homo sapiens
  light chain complementarity determining region 3 for antibody 10579
MQGTHWPWT

SEQ ID NO: 21158 - protein, 11 aa, Homo sapiens
  heavy chain complementarity determining region 3 for antibody 10579
ARHVYYYHLDV

SEQ ID NO: 21159 - protein, 9 aa, Homo sapiens
  light chain complementarity determining region 3 for antibody 10580
QQSLTAPLT

SEQ ID NO: 21160 - protein, 17 aa, Homo sapiens
  heavy chain complementarity determining region 3 for antibody 10580
TRSIVSGSGWNAGGFDC

SEQ ID NO: 21161 - protein, 10 aa, Homo sapiens
  light chain complementarity determining region 3 for antibody 10581
QQYDNLPSVT

SEQ ID NO: 21162 - protein, 11 aa, Homo sapiens
  heavy chain complementarity determining region 3 for antibody 10581
AKSGGFWSFDY

SEQ ID NO: 21163 - protein, 9 aa, Homo sapiens
  light chain complementarity determining region 3 for antibody 10582
QQANSFPYT

SEQ ID NO: 21164 - protein, 22 aa, Homo sapiens
  heavy chain complementarity determining region 3 for antibody 10582
ARDRVGEAAAGTRYYHYYGMDV

SEQ ID NO: 21165 - protein, 9 aa, Homo sapiens
  light chain complementarity determining region 3 for antibody 10583
QQRSGWPPT

SEQ ID NO: 21166 - protein, 16 aa, Homo sapiens
  heavy chain complementarity determining region 3 for antibody 10583
ARVFYGSGPNANWFDP

SEQ ID NO: 21167 - protein, 9 aa, Homo sapiens
  light chain complementarity determining region 3 for antibody 10584
QQFNNYPQT

SEQ ID NO: 21168 - protein, 11 aa, Homo sapiens
  heavy chain complementarity determining region 3 for antibody 10584
AREATRGYSQN

SEQ ID NO: 21169 - protein, 8 aa, Homo sapiens
  light chain complementarity determining region 3 for antibody 10585
QQYNSYSA

SEQ ID NO: 21170 - protein, 15 aa, Homo sapiens
  heavy chain complementarity determining region 3 for antibody 10585
ARAYSSGWYPESFDF

SEQ ID NO: 21171 - protein, 8 aa, Homo sapiens
  light chain complementarity determining region 3 for antibody 10586
QQYHSVWT

SEQ ID NO: 21172 - protein, 13 aa, Homo sapiens
  heavy chain complementarity determining region 3 for antibody 10586
AKVRAGDYDSLDY

SEQ ID NO: 21173 - protein, 9 aa, Homo sapiens
  light chain complementarity determining region 3 for antibody 10587
QQSYSTPFT

SEQ ID NO: 21174 - protein, 14 aa, Homo sapiens
  heavy chain complementarity determining region 3 for antibody 10587
ARLPGRYPRHGFDV

SEQ ID NO: 21175 - protein, 9 aa, Homo sapiens
  light chain complementarity determining region 3 for antibody 10588
QQVNSYDYT

SEQ ID NO: 21176 - protein, 16 aa, Homo sapiens
  heavy chain complementarity determining region 3 for antibody 10588
ATTTGYSNYYYYGMDV

SEQ ID NO: 21177 - protein, 9 aa, Homo sapiens
  light chain complementarity determining region 3 for antibody 10589
HQYATSPLT

SEQ ID NO: 21178 - protein, 10 aa, Homo sapiens
  heavy chain complementarity determining region 3 for antibody 10589
GYSNGWLVHY

SEQ ID NO: 21179 - protein, 10 aa, Homo sapiens
  light chain complementarity determining region 3 for antibody 10590
QQTYSSPPPT

SEQ ID NO: 21180 - protein, 17 aa, Homo sapiens
  heavy chain complementarity determining region 3 for antibody 10590
ARLTPYTSNWNPFYCDY

SEQ ID NO: 21181 - protein, 9 aa, Homo sapiens
  light chain complementarity determining region 3 for antibody 10591
MQALQLPFT

SEQ ID NO: 21182 - protein, 19 aa, Homo sapiens
  heavy chain complementarity determining region 3 for antibody 10591
VRHDRYCSGDRCFSFWFDP

SEQ ID NO: 21183 - protein, 9 aa, Homo sapiens
  light chain complementarity determining region 3 for antibody 10592
QQYNGRSLT

SEQ ID NO: 21184 - protein, 11 aa, Homo sapiens
  heavy chain complementarity determining region 3 for antibody 10592
ARIQQLGALAH

SEQ ID NO: 21185 - protein, 9 aa, Homo sapiens
  light chain complementarity determining region 3 for antibody 10593
QHRNNWGLT

SEQ ID NO: 21186 - protein, 22 aa, Homo sapiens
  heavy chain complementarity determining region 3 for antibody 10593
ARHSGYSNTWYMNYYYYYGMDV

SEQ ID NO: 21187 - protein, 9 aa, Homo sapiens
  light chain complementarity determining region 3 for antibody 10594
QQSYNTPWT

SEQ ID NO: 21188 - protein, 14 aa, Homo sapiens
  heavy chain complementarity determining region 3 for antibody 10594
AAAKVWGYYYGMDV

SEQ ID NO: 21189 - protein, 9 aa, Homo sapiens
  light chain complementarity determining region 3 for antibody 10595
QQYHSYPLT

SEQ ID NO: 21190 - protein, 15 aa, Homo sapiens
  heavy chain complementarity determining region 3 for antibody 10595
ARGGIHYDILTGLDY

SEQ ID NO: 21191 - protein, 9 aa, Homo sapiens
  light chain complementarity determining region 3 for antibody 10596
HQRGNWPPT

SEQ ID NO: 21192 - protein, 13 aa, Homo sapiens
  heavy chain complementarity determining region 3 for antibody 10596
ARDGVWSTSSADL

SEQ ID NO: 21193 - protein, 9 aa, Homo sapiens
  light chain complementarity determining region 3 for antibody 10597
QQYGSSPYT

SEQ ID NO: 21194 - protein, 13 aa, Homo sapiens
  heavy chain complementarity determining region 3 for antibody 10597
ARGSTYGSGTYTS

SEQ ID NO: 21195 - protein, 9 aa, Homo sapiens
  light chain complementarity determining region 3 for antibody 10598
QQVMNFPIT

SEQ ID NO: 21196 - protein, 11 aa, Homo sapiens
  heavy chain complementarity determining region 3 for antibody 10598
ARNYDSSGFDY

SEQ ID NO: 21197 - protein, 8 aa, Homo sapiens
  light chain complementarity determining region 3 for antibody 10599
QHLNSHPT

SEQ ID NO: 21198 - protein, 11 aa, Homo sapiens
  heavy chain complementarity determining region 3 for antibody 10599
ARSHTENAFDV

SEQ ID NO: 21199 - protein, 8 aa, Homo sapiens
  light chain complementarity determining region 3 for antibody 10600
HQTNSFPP

SEQ ID NO: 21200 - protein, 22 aa, Homo sapiens
  heavy chain complementarity determining region 3 for antibody 10600
ARHSGYSNTWYMNYYYYYGMDV

SEQ ID NO: 21201 - protein, 9 aa, Homo sapiens
  light chain complementarity determining region 3 for antibody 10601
LQATHWPYT

SEQ ID NO: 21202 - protein, 11 aa, Homo sapiens
  heavy chain complementarity determining region 3 for antibody 10601
AKDTQWLPFDC

SEQ ID NO: 21203 - protein, 9 aa, Homo sapiens
  light chain complementarity determining region 3 for antibody 10602
QQNYNTPRT

SEQ ID NO: 21204 - protein, 20 aa, Homo sapiens
  heavy chain complementarity determining region 3 for antibody 10602
TTDDILLVPADPRDDNWVDP

SEQ ID NO: 21205 - protein, 10 aa, Homo sapiens
  light chain complementarity determining region 3 for antibody 10603
QQYFNWPLIT

SEQ ID NO: 21206 - protein, 15 aa, Homo sapiens
  heavy chain complementarity determining region 3 for antibody 10603
ASMFEFDSGTYYSNY

SEQ ID NO: 21207 - protein, 9 aa, Homo sapiens
  light chain complementarity determining region 3 for antibody 10604
QQYNSFPWT

SEQ ID NO: 21208 - protein, 17 aa, Homo sapiens
  heavy chain complementarity determining region 3 for antibody 10604
ARRSGLYYFDAHNYYDF

SEQ ID NO: 21209 - protein, 9 aa, Homo sapiens
  light chain complementarity determining region 3 for antibody 10605
QGYNNAPWT

SEQ ID NO: 21210 - protein, 15 aa, Homo sapiens
  heavy chain complementarity determining region 3 for antibody 10605
GRHRYSSSQGYGMDV

SEQ ID NO: 21211 - protein, 8 aa, Homo sapiens
  light chain complementarity determining region 3 for antibody 10606
QQYDQFPT

SEQ ID NO: 21212 - protein, 20 aa, Homo sapiens
  heavy chain complementarity determining region 3 for antibody 10606
ATDRGTYFRSGSYYHYPLDY

SEQ ID NO: 21213 - protein, 10 aa, Homo sapiens
  light chain complementarity determining region 3 for antibody 10607
QQYVPSHKYT

SEQ ID NO: 21214 - protein, 22 aa, Homo sapiens
  heavy chain complementarity determining region 3 for antibody 10607
ARHSPFLEMLGERWLQFGAFDI

SEQ ID NO: 21215 - protein, 9 aa, Homo sapiens
  light chain complementarity determining region 3 for antibody 10608
QHYDDLLFT

SEQ ID NO: 21216 - protein, 18 aa, Homo sapiens
  heavy chain complementarity determining region 3 for antibody 10608
VRLTRRFEELHTFYGMDV

SEQ ID NO: 21217 - protein, 9 aa, Homo sapiens
  light chain complementarity determining region 3 for antibody 10609
QQYGSSLWT

SEQ ID NO: 21218 - protein, 15 aa, Homo sapiens
  heavy chain complementarity determining region 3 for antibody 10609
ARNVLPDYYAGAFHL

SEQ ID NO: 21219 - protein, 10 aa, Homo sapiens
  light chain complementarity determining region 3 for antibody 10610
QQRTRWPPLT

SEQ ID NO: 21220 - protein, 12 aa, Homo sapiens
  heavy chain complementarity determining region 3 for antibody 10610
TDTHVTGGDWDY

SEQ ID NO: 21221 - protein, 9 aa, Homo sapiens
  light chain complementarity determining region 3 for antibody 10611
QQADTFPIT

SEQ ID NO: 21222 - protein, 16 aa, Homo sapiens
  heavy chain complementarity determining region 3 for antibody 10611
ARGWRQVASGWLYFDY

SEQ ID NO: 21223 - protein, 9 aa, Homo sapiens
  light chain complementarity determining region 3 for antibody 10612
QQANSLPHT

SEQ ID NO: 21224 - protein, 14 aa, Homo sapiens
  heavy chain complementarity determining region 3 for antibody 10612
ARDRSVTYGKYFGH

SEQ ID NO: 21225 - protein, 10 aa, Homo sapiens
  light chain complementarity determining region 3 for antibody 10613
QQTYSNPTWT

SEQ ID NO: 21226 - protein, 13 aa, Homo sapiens
  heavy chain complementarity determining region 3 for antibody 10613
ARVGAVAGRAFDV

SEQ ID NO: 21227 - protein, 10 aa, Homo sapiens
  light chain complementarity determining region 3 for antibody 10614
QQLNTYPPIT

SEQ ID NO: 21228 - protein, 14 aa, Homo sapiens
  heavy chain complementarity determining region 3 for antibody 10614
AGDADTPHRRAFDV

SEQ ID NO: 21229 - protein, 9 aa, Homo sapiens
  light chain complementarity determining region 3 for antibody 10615
QHFNTYPLT

SEQ ID NO: 21230 - protein, 17 aa, Homo sapiens
  heavy chain complementarity determining region 3 for antibody 10615
AKDLSGIHYDIHHGLDV

SEQ ID NO: 21231 - protein, 9 aa, Homo sapiens
  light chain complementarity determining region 3 for antibody 10616
MQGLLTPPA

SEQ ID NO: 21232 - protein, 18 aa, Homo sapiens
  heavy chain complementarity determining region 3 for antibody 10616
ARTRVGVYSGSSPFMFDP

SEQ ID NO: 21233 - protein, 9 aa, Homo sapiens
  light chain complementarity determining region 3 for antibody 10617
QQYGSSPPT

SEQ ID NO: 21234 - protein, 12 aa, Homo sapiens
  heavy chain complementarity determining region 3 for antibody 10617
ASGFLEWSLYEY

SEQ ID NO: 21235 - protein, 9 aa, Homo sapiens
  light chain complementarity determining region 3 for antibody 10618
QQYNNWPRS

SEQ ID NO: 21236 - protein, 15 aa, Homo sapiens
  heavy chain complementarity determining region 3 for antibody 10618
VKSGTYSSSSGWFDT

SEQ ID NO: 21237 - protein, 11 aa, Homo sapiens
  light chain complementarity determining region 3 for antibody 10619
QLLNSHSGGFT

SEQ ID NO: 21238 - protein, 19 aa, Homo sapiens
  heavy chain complementarity determining region 3 for antibody 10619
ARGGPCSGTTCFSYYGVDV

SEQ ID NO: 21239 - protein, 9 aa, Homo sapiens
  light chain complementarity determining region 3 for antibody 10620
QQANSFPRT

SEQ ID NO: 21240 - protein, 20 aa, Homo sapiens
  heavy chain complementarity determining region 3 for antibody 10620
ARDVVYSSRIEVYYYYGMDV

SEQ ID NO: 21241 - protein, 7 aa, Homo sapiens
  light chain complementarity determining region 3 for antibody 10621
QQYGSSR

SEQ ID NO: 21242 - protein, 16 aa, Homo sapiens
  heavy chain complementarity determining region 3 for antibody 10621
TTTYGDYPPYYYAMVV

SEQ ID NO: 21243 - protein, 8 aa, Homo sapiens
  light chain complementarity determining region 3 for antibody 10622
QQRSHWLT

SEQ ID NO: 21244 - protein, 16 aa, Homo sapiens
  heavy chain complementarity determining region 3 for antibody 10622
ARATDYTGDLPWYFDL

SEQ ID NO: 21245 - protein, 9 aa, Homo sapiens
  light chain complementarity determining region 3 for antibody 10623
VQALQTPIT

SEQ ID NO: 21246 - protein, 21 aa, Homo sapiens
  heavy chain complementarity determining region 3 for antibody 10623
VRGEAYNDILTGLPRLRRLDN

SEQ ID NO: 21247 - protein, 8 aa, Homo sapiens
  light chain complementarity determining region 3 for antibody 10624
QQSYSTLT

SEQ ID NO: 21248 - protein, 11 aa, Homo sapiens
  heavy chain complementarity determining region 3 for antibody 10624
ARHVYYYHLDV

SEQ ID NO: 21249 - protein, 9 aa, Homo sapiens
  light chain complementarity determining region 3 for antibody 10625
QRCNSYPYT

SEQ ID NO: 21250 - protein, 9 aa, Homo sapiens
  heavy chain complementarity determining region 3 for antibody 10625
VAYLSGYPR

SEQ ID NO: 21251 - protein, 9 aa, Homo sapiens
  light chain complementarity determining region 3 for antibody 10626
MQATHWPPA

SEQ ID NO: 21252 - protein, 17 aa, Homo sapiens
  heavy chain complementarity determining region 3 for antibody 10626
ARGFLDRGSGWTYYFDY

SEQ ID NO: 21253 - protein, 9 aa, Homo sapiens
  light chain complementarity determining region 3 for antibody 10627
QQSYSTLGS

SEQ ID NO: 21254 - protein, 13 aa, Homo sapiens
  heavy chain complementarity determining region 3 for antibody 10627
ASGGYSYGDVADY

SEQ ID NO: 21255 - protein, 9 aa, Homo sapiens
  light chain complementarity determining region 3 for antibody 10628
QQSYSTPRT

SEQ ID NO: 21256 - protein, 17 aa, Homo sapiens
  heavy chain complementarity determining region 3 for antibody 10628
TKDYYGDYMAQYNWFDS

SEQ ID NO: 21257 - protein, 9 aa, Homo sapiens
  light chain complementarity determining region 3 for antibody 10629
QQRSNWPLT

SEQ ID NO: 21258 - protein, 19 aa, Homo sapiens
  heavy chain complementarity determining region 3 for antibody 10629
ARGARDYGDSGFGVYYFDY

SEQ ID NO: 21259 - protein, 9 aa, Homo sapiens
  light chain complementarity determining region 3 for antibody 10630
QRTCNAPIT

SEQ ID NO: 21260 - protein, 9 aa, Homo sapiens
  heavy chain complementarity determining region 3 for antibody 10630
VRGYDVFDY

SEQ ID NO: 21261 - protein, 9 aa, Homo sapiens
  light chain complementarity determining region 3 for antibody 10631
QQYGISPYT

SEQ ID NO: 21262 - protein, 14 aa, Homo sapiens
  heavy chain complementarity determining region 3 for antibody 10631
ARGQSSVSSVPHAY

SEQ ID NO: 21263 - protein, 9 aa, Homo sapiens
  light chain complementarity determining region 3 for antibody 10632
QQTYSVPQT

SEQ ID NO: 21264 - protein, 18 aa, Homo sapiens
  heavy chain complementarity determining region 3 for antibody 10632
ARVRGEAYGSGWISVFDY

SEQ ID NO: 21265 - protein, 9 aa, Homo sapiens
  light chain complementarity determining region 3 for antibody 10633
LQHNSYPFT

SEQ ID NO: 21266 - protein, 15 aa, Homo sapiens
  heavy chain complementarity determining region 3 for antibody 10633
ARRYSSGWWALDFDY

SEQ ID NO: 21267 - protein, 10 aa, Homo sapiens
  light chain complementarity determining region 3 for antibody 10634
QLFGNSPRYT

SEQ ID NO: 21268 - protein, 20 aa, Homo sapiens
  heavy chain complementarity determining region 3 for antibody 10634
ARDRGGRSSSFTNYQYNMDV

SEQ ID NO: 21269 - protein, 9 aa, Homo sapiens
  light chain complementarity determining region 3 for antibody 10635
QQYSRYPVT

SEQ ID NO: 21270 - protein, 11 aa, Homo sapiens
  heavy chain complementarity determining region 3 for antibody 10635
AREQTGYYPLY

SEQ ID NO: 21271 - protein, 9 aa, Homo sapiens
  light chain complementarity determining region 3 for antibody 10636
QQSYSLPYT

SEQ ID NO: 21272 - protein, 15 aa, Homo sapiens
  heavy chain complementarity determining region 3 for antibody 10636
ARGGAVRPRYYGMDV

SEQ ID NO: 21273 - protein, 9 aa, Homo sapiens
  light chain complementarity determining region 3 for antibody 10637
QQANSLPFT

SEQ ID NO: 21274 - protein, 19 aa, Homo sapiens
  heavy chain complementarity determining region 3 for antibody 10637
ARTDYSGDTDRYYDYGMDV

SEQ ID NO: 21275 - protein, 9 aa, Homo sapiens
  light chain complementarity determining region 3 for antibody 10638
QQYNTYPYT

SEQ ID NO: 21276 - protein, 19 aa, Homo sapiens
  heavy chain complementarity determining region 3 for antibody 10638
ARDQSSSYGDYYYYYGMDV

SEQ ID NO: 21277 - protein, 9 aa, Homo sapiens
  light chain complementarity determining region 3 for antibody 10639
QQVNSYDYT

SEQ ID NO: 21278 - protein, 16 aa, Homo sapiens
  heavy chain complementarity determining region 3 for antibody 10639
ASTTGFSNKYYYGMDV

SEQ ID NO: 21279 - protein, 8 aa, Homo sapiens
  light chain complementarity determining region 3 for antibody 10640
QQYHTFST

SEQ ID NO: 21280 - protein, 18 aa, Homo sapiens
  heavy chain complementarity determining region 3 for antibody 10640
ARARRTQHRSDYYDGLDV

SEQ ID NO: 21281 - protein, 9 aa, Homo sapiens
  light chain complementarity determining region 3 for antibody 10641
QQGNSFPWT

SEQ ID NO: 21282 - protein, 17 aa, Homo sapiens
  heavy chain complementarity determining region 3 for antibody 10641
ARVHDSSNYYVAEYFQY

SEQ ID NO: 21283 - protein, 9 aa, Homo sapiens
  light chain complementarity determining region 3 for antibody 10642
QQRTNWPVT

SEQ ID NO: 21284 - protein, 19 aa, Homo sapiens
  heavy chain complementarity determining region 3 for antibody 10642
VRARQYRSSWYGPSDAFDI

SEQ ID NO: 21285 - protein, 8 aa, Homo sapiens
  light chain complementarity determining region 3 for antibody 10643
QQRSNWLT

SEQ ID NO: 21286 - protein, 19 aa, Homo sapiens
  heavy chain complementarity determining region 3 for antibody 10643
ARRFYPDSNGYYGTPLDDP

SEQ ID NO: 21287 - protein, 10 aa, Homo sapiens
  light chain complementarity determining region 3 for antibody 10644
QQYGNSPLIT

SEQ ID NO: 21288 - protein, 12 aa, Homo sapiens
  heavy chain complementarity determining region 3 for antibody 10644
ARGPLRGRHFDY

SEQ ID NO: 21289 - protein, 10 aa, Homo sapiens
  light chain complementarity determining region 3 for antibody 10645
QQYVRSDLFT

SEQ ID NO: 21290 - protein, 16 aa, Homo sapiens
  heavy chain complementarity determining region 3 for antibody 10645
ARELFKGQIDYYGIDV

SEQ ID NO: 21291 - protein, 9 aa, Homo sapiens
  light chain complementarity determining region 3 for antibody 10646
QRYDNVPLT

SEQ ID NO: 21292 - protein, 16 aa, Homo sapiens
  heavy chain complementarity determining region 3 for antibody 10646
GRVDRLRLGELSGRFY

SEQ ID NO: 21293 - protein, 8 aa, Homo sapiens
  light chain complementarity determining region 3 for antibody 10647
QHLNSHPT

SEQ ID NO: 21294 - protein, 11 aa, Homo sapiens
  heavy chain complementarity determining region 3 for antibody 10647
ARSHSENAFDV

SEQ ID NO: 21295 - protein, 8 aa, Homo sapiens
  light chain complementarity determining region 3 for antibody 10648
QQYLSHFT

SEQ ID NO: 21296 - protein, 11 aa, Homo sapiens
  heavy chain complementarity determining region 3 for antibody 10648
ARDRGGGALDH

SEQ ID NO: 21297 - protein, 9 aa, Homo sapiens
  light chain complementarity determining region 3 for antibody 10649
QQYDTYPLT

SEQ ID NO: 21298 - protein, 19 aa, Homo sapiens
  heavy chain complementarity determining region 3 for antibody 10649
ARDRSDTSMDPGGEGCFDH

SEQ ID NO: 21299 - protein, 9 aa, Homo sapiens
  light chain complementarity determining region 3 for antibody 10650
QQSFTIQFT

SEQ ID NO: 21300 - protein, 13 aa, Homo sapiens
  heavy chain complementarity determining region 3 for antibody 10650
TTDRCVGFSCADS

SEQ ID NO: 21301 - protein, 9 aa, Homo sapiens
  light chain complementarity determining region 3 for antibody 10651
QQYDSSPWT

SEQ ID NO: 21302 - protein, 17 aa, Homo sapiens
  heavy chain complementarity determining region 3 for antibody 10651
ARGVYGAYLGYYFGMDV

SEQ ID NO: 21303 - protein, 9 aa, Homo sapiens
  light chain complementarity determining region 3 for antibody 10652
QQYGSSPYT

SEQ ID NO: 21304 - protein, 14 aa, Homo sapiens
  heavy chain complementarity determining region 3 for antibody 10652
ARGMTSYNSAPYDP

SEQ ID NO: 21305 - protein, 11 aa, Homo sapiens
  light chain complementarity determining region 3 for antibody 10653
QQRSNWPPSVT

SEQ ID NO: 21306 - protein, 16 aa, Homo sapiens
  heavy chain complementarity determining region 3 for antibody 10653
ARGALVVLVDLNAFDI

SEQ ID NO: 21307 - protein, 9 aa, Homo sapiens
  light chain complementarity determining region 3 for antibody 10654
QQYNSFPPT

SEQ ID NO: 21308 - protein, 19 aa, Homo sapiens
  heavy chain complementarity determining region 3 for antibody 10654
AKDPHPVVVGELLEPVFDH

SEQ ID NO: 21309 - protein, 10 aa, Homo sapiens
  light chain complementarity determining region 3 for antibody 10655
QKYNNVPPFT

SEQ ID NO: 21310 - protein, 17 aa, Homo sapiens
  heavy chain complementarity determining region 3 for antibody 10655
ASDPTYGDSYYYSGMDL

SEQ ID NO: 21311 - protein, 9 aa, Homo sapiens
  light chain complementarity determining region 3 for antibody 10656
QQYKSYPRT

SEQ ID NO: 21312 - protein, 24 aa, Homo sapiens
  heavy chain complementarity determining region 3 for antibody 10656
ARGSTDGTVTTFGVPVLEYYYFDN

SEQ ID NO: 21313 - protein, 10 aa, Homo sapiens
  light chain complementarity determining region 3 for antibody 10657
QQSYSTPLLT

SEQ ID NO: 21314 - protein, 15 aa, Homo sapiens
  heavy chain complementarity determining region 3 for antibody 10657
AVWESMTEWLGPFDY

SEQ ID NO: 21315 - protein, 9 aa, Homo sapiens
  light chain complementarity determining region 3 for antibody 10658
QQGNSVPWT

SEQ ID NO: 21316 - protein, 17 aa, Homo sapiens
  heavy chain complementarity determining region 3 for antibody 10658
ARVHDSSNYHVAEYFQY

SEQ ID NO: 21317 - protein, 9 aa, Homo sapiens
  light chain complementarity determining region 3 for antibody 10659
MQAVQTPRT

SEQ ID NO: 21318 - protein, 14 aa, Homo sapiens
  heavy chain complementarity determining region 3 for antibody 10659
AREGQRQLAGDFDC

SEQ ID NO: 21319 - protein, 9 aa, Homo sapiens
  light chain complementarity determining region 3 for antibody 10660
QQYGSSPIT

SEQ ID NO: 21320 - protein, 6 aa, Homo sapiens
  heavy chain complementarity determining region 3 for antibody 10660
AITILG

SEQ ID NO: 21321 - protein, 9 aa, Homo sapiens
  light chain complementarity determining region 3 for antibody 10661
QKYNSAPIT

SEQ ID NO: 21322 - protein, 22 aa, Homo sapiens
  heavy chain complementarity determining region 3 for antibody 10661
ARGLGTINYNDILTGYFQYFDL

SEQ ID NO: 21323 - protein, 9 aa, Homo sapiens
  light chain complementarity determining region 3 for antibody 10662
MQGTHWPPT

SEQ ID NO: 21324 - protein, 15 aa, Homo sapiens
  heavy chain complementarity determining region 3 for antibody 10662
ARGRRGFQEGMGLDV

SEQ ID NO: 21325 - protein, 9 aa, Homo sapiens
  light chain complementarity determining region 3 for antibody 10663
QQYNSYPLT

SEQ ID NO: 21326 - protein, 15 aa, Homo sapiens
  heavy chain complementarity determining region 3 for antibody 10663
ARGGIYYDILTGLDS

SEQ ID NO: 21327 - protein, 9 aa, Homo sapiens
  light chain complementarity determining region 3 for antibody 10664
QQSYSTPYT

SEQ ID NO: 21328 - protein, 17 aa, Homo sapiens
  heavy chain complementarity determining region 3 for antibody 10664
ARGSYYDVDLITYYFDH

SEQ ID NO: 21329 - protein, 10 aa, Homo sapiens
  light chain complementarity determining region 3 for antibody 10665
QQYGRSPRYI

SEQ ID NO: 21330 - protein, 12 aa, Homo sapiens
  heavy chain complementarity determining region 3 for antibody 10665
TRDLGSRYGMDV

SEQ ID NO: 21331 - protein, 10 aa, Homo sapiens
  light chain complementarity determining region 3 for antibody 10666
QQANSFLSIT

SEQ ID NO: 21332 - protein, 11 aa, Homo sapiens
  heavy chain complementarity determining region 3 for antibody 10666
AREQTGYYPLY

SEQ ID NO: 21333 - protein, 6 aa, Homo sapiens
  light chain complementarity determining region 3 for antibody 10667
HYYGNS

SEQ ID NO: 21334 - protein, 18 aa, Homo sapiens
  heavy chain complementarity determining region 3 for antibody 10667
ATRHADYFNGYYYFALDV

SEQ ID NO: 21335 - protein, 9 aa, Homo sapiens
  light chain complementarity determining region 3 for antibody 10668
QQYNSYPYT

SEQ ID NO: 21336 - protein, 19 aa, Homo sapiens
  heavy chain complementarity determining region 3 for antibody 10668
ARDQSSSYGDYYYYYGMDV

SEQ ID NO: 21337 - protein, 9 aa, Homo sapiens
  light chain complementarity determining region 3 for antibody 10669
QQYDSFPYT

SEQ ID NO: 21338 - protein, 17 aa, Homo sapiens
  heavy chain complementarity determining region 3 for antibody 10669
AREDYSDVDLRAFYFDS

SEQ ID NO: 21339 - protein, 11 aa, Homo sapiens
  light chain complementarity determining region 3 for antibody 10670
QQVSHYEQGIT

SEQ ID NO: 21340 - protein, 17 aa, Homo sapiens
  heavy chain complementarity determining region 3 for antibody 10670
ARERQYCYGDRCYGEDL

SEQ ID NO: 21341 - protein, 9 aa, Homo sapiens
  light chain complementarity determining region 3 for antibody 10671
QQYHSPMYT

SEQ ID NO: 21342 - protein, 13 aa, Homo sapiens
  heavy chain complementarity determining region 3 for antibody 10671
AHIGCRGASCYPV

SEQ ID NO: 21343 - protein, 11 aa, Homo sapiens
  light chain complementarity determining region 3 for antibody 10672
QQRSNWPPVFT

SEQ ID NO: 21344 - protein, 16 aa, Homo sapiens
  heavy chain complementarity determining region 3 for antibody 10672
ARRLGETAMALDAFDI

SEQ ID NO: 21345 - protein, 9 aa, Homo sapiens
  light chain complementarity determining region 3 for antibody 10673
QEYNSYSLT

SEQ ID NO: 21346 - protein, 7 aa, Homo sapiens
  heavy chain complementarity determining region 3 for antibody 10673
ARVPGFS

SEQ ID NO: 21347 - protein, 9 aa, Homo sapiens
  light chain complementarity determining region 3 for antibody 10674
QQYHSYPYT

SEQ ID NO: 21348 - protein, 17 aa, Homo sapiens
  heavy chain complementarity determining region 3 for antibody 10674
AREEFADVDLRQYYFDY

SEQ ID NO: 21349 - protein, 10 aa, Homo sapiens
  light chain complementarity determining region 3 for antibody 10675
QLYGSSPRYT

SEQ ID NO: 21350 - protein, 20 aa, Homo sapiens
  heavy chain complementarity determining region 3 for antibody 10675
ARDRGGRTSSFTNYQQSMDV

SEQ ID NO: 21351 - protein, 10 aa, Homo sapiens
  light chain complementarity determining region 3 for antibody 10676
QQYVSSALFT

SEQ ID NO: 21352 - protein, 16 aa, Homo sapiens
  heavy chain complementarity determining region 3 for antibody 10676
ARELFKGEYDYYALDV

SEQ ID NO: 21353 - protein, 9 aa, Homo sapiens
  light chain complementarity determining region 3 for antibody 10677
QQSFSPPWA

SEQ ID NO: 21354 - protein, 19 aa, Homo sapiens
  heavy chain complementarity determining region 3 for antibody 10677
ATLRYISGELTYDYYGMDV

SEQ ID NO: 21355 - protein, 9 aa, Homo sapiens
  light chain complementarity determining region 3 for antibody 10678
QQSYTFPWT

SEQ ID NO: 21356 - protein, 14 aa, Homo sapiens
  heavy chain complementarity determining region 3 for antibody 10678
ATDPPTDGYNSLDF

SEQ ID NO: 21357 - protein, 10 aa, Homo sapiens
  light chain complementarity determining region 3 for antibody 10679
HQYGGSPPYT

SEQ ID NO: 21358 - protein, 13 aa, Homo sapiens
  heavy chain complementarity determining region 3 for antibody 10679
AKEGTVVAAPLDV

SEQ ID NO: 21359 - protein, 9 aa, Homo sapiens
  light chain complementarity determining region 3 for antibody 10680
QQSYDVLDT

SEQ ID NO: 21360 - protein, 12 aa, Homo sapiens
  heavy chain complementarity determining region 3 for antibody 10680
AREIDTIFYSDY

SEQ ID NO: 21361 - protein, 9 aa, Homo sapiens
  light chain complementarity determining region 3 for antibody 10681
QQYNSYPYT

SEQ ID NO: 21362 - protein, 17 aa, Homo sapiens
  heavy chain complementarity determining region 3 for antibody 10681
AREDWSDVDLRLFYLDC

SEQ ID NO: 21363 - protein, 9 aa, Homo sapiens
  light chain complementarity determining region 3 for antibody 10682
QQTYSTLWT

SEQ ID NO: 21364 - protein, 16 aa, Homo sapiens
  heavy chain complementarity determining region 3 for antibody 10682
AYTPPVVDTVKDGFHV

SEQ ID NO: 21365 - protein, 9 aa, Homo sapiens
  light chain complementarity determining region 3 for antibody 10683
QQAKSFPIT

SEQ ID NO: 21366 - protein, 19 aa, Homo sapiens
  heavy chain complementarity determining region 3 for antibody 10683
ATDRYCSRPNCPQGNWFDP

SEQ ID NO: 21367 - protein, 9 aa, Homo sapiens
  light chain complementarity determining region 3 for antibody 10684
QQYSSYPWT

SEQ ID NO: 21368 - protein, 17 aa, Homo sapiens
  heavy chain complementarity determining region 3 for antibody 10684
ARRFGLYYFGASDYYDY

SEQ ID NO: 21369 - protein, 9 aa, Homo sapiens
  light chain complementarity determining region 3 for antibody 10685
LQHDNFPLP

SEQ ID NO: 21370 - protein, 19 aa, Homo sapiens
  heavy chain complementarity determining region 3 for antibody 10685
ARSIAAAGSYYFYYYAMDV

SEQ ID NO: 21371 - protein, 10 aa, Homo sapiens
  light chain complementarity determining region 3 for antibody 10686
LRYVSSELFT

SEQ ID NO: 21372 - protein, 16 aa, Homo sapiens
  heavy chain complementarity determining region 3 for antibody 10686
ARELFKGEYDYYGMDV

SEQ ID NO: 21373 - protein, 8 aa, Homo sapiens
  light chain complementarity determining region 3 for antibody 10687
QQYNNWPS

SEQ ID NO: 21374 - protein, 12 aa, Homo sapiens
  heavy chain complementarity determining region 3 for antibody 10687
VQGNGAGSYSRH

SEQ ID NO: 21375 - protein, 10 aa, Homo sapiens
  light chain complementarity determining region 3 for antibody 10688
QQSYSTHLFT

SEQ ID NO: 21376 - protein, 14 aa, Homo sapiens
  heavy chain complementarity determining region 3 for antibody 10688
ARMAYGGSDYWFDP

SEQ ID NO: 21377 - protein, 9 aa, Homo sapiens
  light chain complementarity determining region 3 for antibody 10689
QQYHSTPYT

SEQ ID NO: 21378 - protein, 21 aa, Homo sapiens
  heavy chain complementarity determining region 3 for antibody 10689
ARPGGQYCSGSNCYYDNWFGS

SEQ ID NO: 21379 - protein, 8 aa, Homo sapiens
  light chain complementarity determining region 3 for antibody 10690
QQSYRALS

SEQ ID NO: 21380 - protein, 10 aa, Homo sapiens
  heavy chain complementarity determining region 3 for antibody 10690
AHLSRGVNFF

SEQ ID NO: 21381 - protein, 8 aa, Homo sapiens
  light chain complementarity determining region 3 for antibody 10691
QHYKNWPL

SEQ ID NO: 21382 - protein, 18 aa, Homo sapiens
  heavy chain complementarity determining region 3 for antibody 10691
AKDAAVDVILGNRGYFDF

SEQ ID NO: 21383 - protein, 9 aa, Homo sapiens
  light chain complementarity determining region 3 for antibody 10692
MQALQTSIT

SEQ ID NO: 21384 - protein, 14 aa, Homo sapiens
  heavy chain complementarity determining region 3 for antibody 10692
ARMWWTQLDHGPDV

SEQ ID NO: 21385 - protein, 9 aa, Homo sapiens
  light chain complementarity determining region 3 for antibody 10693
QQYDNLPYT

SEQ ID NO: 21386 - protein, 13 aa, Homo sapiens
  heavy chain complementarity determining region 3 for antibody 10693
AREISWWRGAFDI

SEQ ID NO: 21387 - protein, 9 aa, Homo sapiens
  light chain complementarity determining region 3 for antibody 10694
QQRSNWPLT

SEQ ID NO: 21388 - protein, 17 aa, Homo sapiens
  heavy chain complementarity determining region 3 for antibody 10694
AKASSTPSHRGFYYMDV

SEQ ID NO: 21389 - protein, 9 aa, Homo sapiens
  light chain complementarity determining region 3 for antibody 10695
QQANSFPYT

SEQ ID NO: 21390 - protein, 19 aa, Homo sapiens
  heavy chain complementarity determining region 3 for antibody 10695
ASGYSYGYSGRFNDYGMDV

SEQ ID NO: 21391 - protein, 9 aa, Homo sapiens
  light chain complementarity determining region 3 for antibody 10696
QQYGTSWYT

SEQ ID NO: 21392 - protein, 20 aa, Homo sapiens
  heavy chain complementarity determining region 3 for antibody 10696
ARDPHRYGGKDLLYHYGMDV

SEQ ID NO: 21393 - protein, 10 aa, Homo sapiens
  light chain complementarity determining region 3 for antibody 10697
QQSYSTLSWT

SEQ ID NO: 21394 - protein, 19 aa, Homo sapiens
  heavy chain complementarity determining region 3 for antibody 10697
ARDKVEGDYAQWDYYGMDV

SEQ ID NO: 21395 - protein, 10 aa, Homo sapiens
  light chain complementarity determining region 3 for antibody 10698
QESYSTPPFT

SEQ ID NO: 21396 - protein, 27 aa, Homo sapiens
  heavy chain complementarity determining region 3 for antibody 10698
ARPRRVLSLGESFAPPTGLWDYYGMDV

SEQ ID NO: 21397 - protein, 9 aa, Homo sapiens
  light chain complementarity determining region 3 for antibody 10699
MQGLLSPPA

SEQ ID NO: 21398 - protein, 18 aa, Homo sapiens
  heavy chain complementarity determining region 3 for antibody 10699
ARTRVGVYSGGSPFMFDP

SEQ ID NO: 21399 - protein, 9 aa, Homo sapiens
  light chain complementarity determining region 3 for antibody 10700
QQYDNFPPT

SEQ ID NO: 21400 - protein, 20 aa, Homo sapiens
  heavy chain complementarity determining region 3 for antibody 10700
ARLLGYCSGGSCQAHKLFDF

SEQ ID NO: 21401 - protein, 9 aa, Homo sapiens
  light chain complementarity determining region 3 for antibody 10701
QQSYGLPYT

SEQ ID NO: 21402 - protein, 15 aa, Homo sapiens
  heavy chain complementarity determining region 3 for antibody 10701
ARGGAVRPRYYGMDV

SEQ ID NO: 21403 - protein, 9 aa, Homo sapiens
  light chain complementarity determining region 3 for antibody 10702
QQRSNWRDT

SEQ ID NO: 21404 - protein, 15 aa, Homo sapiens
  heavy chain complementarity determining region 3 for antibody 10702
ARGRGGEISRAYSDF

SEQ ID NO: 21405 - protein, 8 aa, Homo sapiens
  light chain complementarity determining region 3 for antibody 10703
QHYGTSGT

SEQ ID NO: 21406 - protein, 19 aa, Homo sapiens
  heavy chain complementarity determining region 3 for antibody 10703
ARSDLLSEELSSEPGAFDF

SEQ ID NO: 21407 - protein, 9 aa, Homo sapiens
  light chain complementarity determining region 3 for antibody 10704
QQYHSYPYT

SEQ ID NO: 21408 - protein, 17 aa, Homo sapiens
  heavy chain complementarity determining region 3 for antibody 10704
AREQFADVDLRQYFFDY

SEQ ID NO: 21409 - protein, 8 aa, Homo sapiens
  light chain complementarity determining region 3 for antibody 10705
MQGTHWPT

SEQ ID NO: 21410 - protein, 12 aa, Homo sapiens
  heavy chain complementarity determining region 3 for antibody 10705
THDWDFNYGMDV

SEQ ID NO: 21411 - protein, 9 aa, Homo sapiens
  light chain complementarity determining region 3 for antibody 10706
QQYKSYPPT

SEQ ID NO: 21412 - protein, 26 aa, Homo sapiens
  heavy chain complementarity determining region 3 for antibody 10706
ARDQGVNIVPTGQNIPEGDTEGTFDY

SEQ ID NO: 21413 - protein, 9 aa, Homo sapiens
  light chain complementarity determining region 3 for antibody 10707
MQGLLTPPA

SEQ ID NO: 21414 - protein, 18 aa, Homo sapiens
  heavy chain complementarity determining region 3 for antibody 10707
ARTRVGLYSGGSPFMFNP

SEQ ID NO: 21415 - protein, 9 aa, Homo sapiens
  light chain complementarity determining region 3 for antibody 10708
MQGLHFPLT

SEQ ID NO: 21416 - protein, 19 aa, Homo sapiens
  heavy chain complementarity determining region 3 for antibody 10708
ARVAYYYDEEDHYYYAMDV

SEQ ID NO: 21417 - protein, 9 aa, Homo sapiens
  light chain complementarity determining region 3 for antibody 10709
QQYGGLPIT

SEQ ID NO: 21418 - protein, 17 aa, Homo sapiens
  heavy chain complementarity determining region 3 for antibody 10709
ARVDGYILTGYPYHSDY

SEQ ID NO: 21419 - protein, 9 aa, Homo sapiens
  light chain complementarity determining region 3 for antibody 10710
QQGDSLPFT

SEQ ID NO: 21420 - protein, 19 aa, Homo sapiens
  heavy chain complementarity determining region 3 for antibody 10710
ARSDYSGDTDRYYDYGMDV

SEQ ID NO: 21421 - protein, 9 aa, Homo sapiens
  light chain complementarity determining region 3 for antibody 10711
QQYKTYPYT

SEQ ID NO: 21422 - protein, 17 aa, Homo sapiens
  heavy chain complementarity determining region 3 for antibody 10711
AREDWNDVDLREYYFDY

SEQ ID NO: 21423 - protein, 9 aa, Homo sapiens
  light chain complementarity determining region 3 for antibody 10712
QQYDHFSIT

SEQ ID NO: 21424 - protein, 14 aa, Homo sapiens
  heavy chain complementarity determining region 3 for antibody 10712
VRQVVTAVRWPFEY

SEQ ID NO: 21425 - protein, 8 aa, Homo sapiens
  light chain complementarity determining region 3 for antibody 10713
QQYGSSPT

SEQ ID NO: 21426 - protein, 12 aa, Homo sapiens
  heavy chain complementarity determining region 3 for antibody 10713
AVELGYGDIPIA

SEQ ID NO: 21427 - protein, 11 aa, Homo sapiens
  light chain complementarity determining region 3 for antibody 10714
QHNGSSPPENT

SEQ ID NO: 21428 - protein, 17 aa, Homo sapiens
  heavy chain complementarity determining region 3 for antibody 10714
ARENYDVLTGSNYGMDV

SEQ ID NO: 21429 - protein, 9 aa, Homo sapiens
  light chain complementarity determining region 3 for antibody 10715
MQGTHWPPT

SEQ ID NO: 21430 - protein, 15 aa, Homo sapiens
  heavy chain complementarity determining region 3 for antibody 10715
ARGRRGFREGMGMDV

SEQ ID NO: 21431 - protein, 10 aa, Homo sapiens
  light chain complementarity determining region 3 for antibody 10716
QQYGDSPLVT

SEQ ID NO: 21432 - protein, 16 aa, Homo sapiens
  heavy chain complementarity determining region 3 for antibody 10716
TRRIVGTWLVPYYFDY

SEQ ID NO: 21433 - protein, 9 aa, Homo sapiens
  light chain complementarity determining region 3 for antibody 10717
QQYGTLPQS

SEQ ID NO: 21434 - protein, 13 aa, Homo sapiens
  heavy chain complementarity determining region 3 for antibody 10717
NTWVGGRGDLFDY

SEQ ID NO: 21435 - protein, 9 aa, Homo sapiens
  light chain complementarity determining region 3 for antibody 10718
QQYGSSPWT

SEQ ID NO: 21436 - protein, 14 aa, Homo sapiens
  heavy chain complementarity determining region 3 for antibody 10718
AKDALVIGHDAFDV

SEQ ID NO: 21437 - protein, 9 aa, Homo sapiens
  light chain complementarity determining region 3 for antibody 10719
QQSYTTPRT

SEQ ID NO: 21438 - protein, 19 aa, Homo sapiens
  heavy chain complementarity determining region 3 for antibody 10719
ARDGPILRFFDDPVYGMDV

SEQ ID NO: 21439 - protein, 9 aa, Homo sapiens
  light chain complementarity determining region 3 for antibody 10720
QQYYGGPIT

SEQ ID NO: 21440 - protein, 13 aa, Homo sapiens
  heavy chain complementarity determining region 3 for antibody 10720
ARGKDSGSWMFDY

SEQ ID NO: 21441 - protein, 10 aa, Homo sapiens
  light chain complementarity determining region 3 for antibody 10721
MQGTHWPPLN

SEQ ID NO: 21442 - protein, 26 aa, Homo sapiens
  heavy chain complementarity determining region 3 for antibody 10721
ARELITSIATPGHEFPNYYYYYGMDV

SEQ ID NO: 21443 - protein, 8 aa, Homo sapiens
  light chain complementarity determining region 3 for antibody 10722
LQHNSYLT

SEQ ID NO: 21444 - protein, 13 aa, Homo sapiens
  heavy chain complementarity determining region 3 for antibody 10722
AREYDSSGGGMDV

SEQ ID NO: 21445 - protein, 9 aa, Homo sapiens
  light chain complementarity determining region 3 for antibody 10723
QQSYSMRLT

SEQ ID NO: 21446 - protein, 12 aa, Homo sapiens
  heavy chain complementarity determining region 3 for antibody 10723
ATMRSYYNGLDV

SEQ ID NO: 21447 - protein, 9 aa, Homo sapiens
  light chain complementarity determining region 3 for antibody 10724
QQSYRPPQA

SEQ ID NO: 21448 - protein, 14 aa, Homo sapiens
  heavy chain complementarity determining region 3 for antibody 10724
ARSKEWFLGAAFDY

SEQ ID NO: 21449 - protein, 9 aa, Homo sapiens
  light chain complementarity determining region 3 for antibody 10725
QQAKTFPHT

SEQ ID NO: 21450 - protein, 13 aa, Homo sapiens
  heavy chain complementarity determining region 3 for antibody 10725
ARGRKFENQYFDY

SEQ ID NO: 21451 - protein, 9 aa, Homo sapiens
  light chain complementarity determining region 3 for antibody 10726
QQYSRYPYT

SEQ ID NO: 21452 - protein, 17 aa, Homo sapiens
  heavy chain complementarity determining region 3 for antibody 10726
VREDWTDVDLREWYFDY

SEQ ID NO: 21453 - protein, 9 aa, Homo sapiens
  light chain complementarity determining region 3 for antibody 10727
QQANSFPLT

SEQ ID NO: 21454 - protein, 17 aa, Homo sapiens
  heavy chain complementarity determining region 3 for antibody 10727
ARDQLQLPNYYYYGMGV

SEQ ID NO: 21455 - protein, 11 aa, Homo sapiens
  light chain complementarity determining region 3 for antibody 10728
QQCYSSPPENT

SEQ ID NO: 21456 - protein, 16 aa, Homo sapiens
  heavy chain complementarity determining region 3 for antibody 10728
AREAGEDYYYKDIFDI

SEQ ID NO: 21457 - protein, 9 aa, Homo sapiens
  light chain complementarity determining region 3 for antibody 10729
QQQFTGRWT

SEQ ID NO: 21458 - protein, 15 aa, Homo sapiens
  heavy chain complementarity determining region 3 for antibody 10729
AKEGCSGGICYGFDV

SEQ ID NO: 21459 - protein, 9 aa, Homo sapiens
  light chain complementarity determining region 3 for antibody 10730
QESYSFPVT

SEQ ID NO: 21460 - protein, 22 aa, Homo sapiens
  heavy chain complementarity determining region 3 for antibody 10730
ARVYEWRKRHIGSVKYYRQFDH

SEQ ID NO: 21461 - protein, 9 aa, Homo sapiens
  light chain complementarity determining region 3 for antibody 10731
QQYETLPVT

SEQ ID NO: 21462 - protein, 15 aa, Homo sapiens
  heavy chain complementarity determining region 3 for antibody 10731
ARHRFGGSSSENFDF

SEQ ID NO: 21463 - protein, 9 aa, Homo sapiens
  light chain complementarity determining region 3 for antibody 10732
LQHNSYPYT

SEQ ID NO: 21464 - protein, 7 aa, Homo sapiens
  heavy chain complementarity determining region 3 for antibody 10732
ARDGGGY

SEQ ID NO: 21465 - protein, 9 aa, Homo sapiens
  light chain complementarity determining region 3 for antibody 10733
QQYGSSPDT

SEQ ID NO: 21466 - protein, 10 aa, Homo sapiens
  heavy chain complementarity determining region 3 for antibody 10733
ARESMGPMEY

SEQ ID NO: 21467 - protein, 9 aa, Homo sapiens
  light chain complementarity determining region 3 for antibody 10734
QQSYSTPPM

SEQ ID NO: 21468 - protein, 13 aa, Homo sapiens
  heavy chain complementarity determining region 3 for antibody 10734
ARVDDTNYLIVAY

SEQ ID NO: 21469 - protein, 9 aa, Homo sapiens
  light chain complementarity determining region 3 for antibody 10735
QQSYITPQT

SEQ ID NO: 21470 - protein, 19 aa, Homo sapiens
  heavy chain complementarity determining region 3 for antibody 10735
ARDPIPDIMVRGSKDGMDV

SEQ ID NO: 21471 - protein, 8 aa, Homo sapiens
  light chain complementarity determining region 3 for antibody 10736
QQYGSSLT

SEQ ID NO: 21472 - protein, 17 aa, Homo sapiens
  heavy chain complementarity determining region 3 for antibody 10736
AKVYRPHCGSYCFYFDS

SEQ ID NO: 21473 - protein, 9 aa, Homo sapiens
  light chain complementarity determining region 3 for antibody 10737
MQGLQFPLT

SEQ ID NO: 21474 - protein, 19 aa, Homo sapiens
  heavy chain complementarity determining region 3 for antibody 10737
ARVAYYYDEEDHYYYAMDV

SEQ ID NO: 21475 - protein, 9 aa, Homo sapiens
  light chain complementarity determining region 3 for antibody 10738
QQYGSSPLT

SEQ ID NO: 21476 - protein, 20 aa, Homo sapiens
  heavy chain complementarity determining region 3 for antibody 10738
ARDREAVAGAFRIINDFFDF

SEQ ID NO: 21477 - protein, 9 aa, Homo sapiens
  light chain complementarity determining region 3 for antibody 10739
QKYNSAPFT

SEQ ID NO: 21478 - protein, 15 aa, Homo sapiens
  heavy chain complementarity determining region 3 for antibody 10739
ARDRTVAAPNWYFDL

SEQ ID NO: 21479 - protein, 9 aa, Homo sapiens
  light chain complementarity determining region 3 for antibody 10740
QQYGSSPYT

SEQ ID NO: 21480 - protein, 13 aa, Homo sapiens
  heavy chain complementarity determining region 3 for antibody 10740
ARGFRYGSGPYVH

SEQ ID NO: 21481 - protein, 9 aa, Homo sapiens
  light chain complementarity determining region 3 for antibody 10741
QNYDSSPRI

SEQ ID NO: 21482 - protein, 13 aa, Homo sapiens
  heavy chain complementarity determining region 3 for antibody 10741
TRDEDGNNTPFDY

SEQ ID NO: 21483 - protein, 11 aa, Homo sapiens
  light chain complementarity determining region 3 for antibody 10742
QQSYSAPPMHT

SEQ ID NO: 21484 - protein, 22 aa, Homo sapiens
  heavy chain complementarity determining region 3 for antibody 10742
ARVTTYFYDTSGFSAVGYRMDV

SEQ ID NO: 21485 - protein, 9 aa, Homo sapiens
  light chain complementarity determining region 3 for antibody 10743
MQGLLTPPA

SEQ ID NO: 21486 - protein, 18 aa, Homo sapiens
  heavy chain complementarity determining region 3 for antibody 10743
ARTRVGMYSGGSPFMFDP

SEQ ID NO: 21487 - protein, 9 aa, Homo sapiens
  light chain complementarity determining region 3 for antibody 10744
QRYDNSPYT

SEQ ID NO: 21488 - protein, 15 aa, Homo sapiens
  heavy chain complementarity determining region 3 for antibody 10744
ARSSIVALGYYGMDV

SEQ ID NO: 21489 - protein, 10 aa, Homo sapiens
  light chain complementarity determining region 3 for antibody 10745
QQSFSPPSLT

SEQ ID NO: 21490 - protein, 10 aa, Homo sapiens
  heavy chain complementarity determining region 3 for antibody 10745
ARDWGWGFDP

SEQ ID NO: 21491 - protein, 9 aa, Homo sapiens
  light chain complementarity determining region 3 for antibody 10746
QQYNSYPWT

SEQ ID NO: 21492 - protein, 17 aa, Homo sapiens
  heavy chain complementarity determining region 3 for antibody 10746
ARRSGLYYFDAHNYYDY

SEQ ID NO: 21493 - protein, 8 aa, Homo sapiens
  light chain complementarity determining region 3 for antibody 10747
QQSFTSPA

SEQ ID NO: 21494 - protein, 16 aa, Homo sapiens
  heavy chain complementarity determining region 3 for antibody 10747
ARVGPTNMSRYYPMDV

SEQ ID NO: 21495 - protein, 8 aa, Homo sapiens
  light chain complementarity determining region 3 for antibody 10748
HQYYSIPT

SEQ ID NO: 21496 - protein, 28 aa, Homo sapiens
  heavy chain complementarity determining region 3 for antibody 10748
ARTRREAPYYDPLTGYYESVHYYYAMDV

SEQ ID NO: 21497 - protein, 9 aa, Homo sapiens
  light chain complementarity determining region 3 for antibody 10749
QQYHSYPYT

SEQ ID NO: 21498 - protein, 17 aa, Homo sapiens
  heavy chain complementarity determining region 3 for antibody 10749
AREQFNDVDLRQYFFDY

SEQ ID NO: 21499 - protein, 7 aa, Homo sapiens
  light chain complementarity determining region 3 for antibody 10750
QRTYIAP

SEQ ID NO: 21500 - protein, 23 aa, Homo sapiens
  heavy chain complementarity determining region 3 for antibody 10750
AKGPYCSGGSCDRDAYYYYGMDV

SEQ ID NO: 21501 - protein, 9 aa, Homo sapiens
  light chain complementarity determining region 3 for antibody 10751
LQENTYPLT

SEQ ID NO: 21502 - protein, 19 aa, Homo sapiens
  heavy chain complementarity determining region 3 for antibody 10751
AREEGYYDGSGSFHPESDY

SEQ ID NO: 21503 - protein, 9 aa, Homo sapiens
  light chain complementarity determining region 3 for antibody 10752
QQSYSTPYT

SEQ ID NO: 21504 - protein, 15 aa, Homo sapiens
  heavy chain complementarity determining region 3 for antibody 10752
ARGGAVRPRYYGVDV

SEQ ID NO: 21505 - protein, 9 aa, Homo sapiens
  light chain complementarity determining region 3 for antibody 10753
QQFNSYLWT

SEQ ID NO: 21506 - protein, 17 aa, Homo sapiens
  heavy chain complementarity determining region 3 for antibody 10753
ATSYCDNARCFPVGSDY

SEQ ID NO: 21507 - protein, 9 aa, Homo sapiens
  light chain complementarity determining region 3 for antibody 10754
QQYGTLPLT

SEQ ID NO: 21508 - protein, 14 aa, Homo sapiens
  heavy chain complementarity determining region 3 for antibody 10754
ARGLGYHLNSCLDP

SEQ ID NO: 21509 - protein, 9 aa, Homo sapiens
  light chain complementarity determining region 3 for antibody 10755
QQHESVPLT

SEQ ID NO: 21510 - protein, 20 aa, Homo sapiens
  heavy chain complementarity determining region 3 for antibody 10755
AKDRPVDTSMDDYYYHGMDV

SEQ ID NO: 21511 - protein, 9 aa, Homo sapiens
  light chain complementarity determining region 3 for antibody 10756
LQESTYPLT

SEQ ID NO: 21512 - protein, 19 aa, Homo sapiens
  heavy chain complementarity determining region 3 for antibody 10756
AREEGYYDGSGSWHPESDN

SEQ ID NO: 21513 - protein, 9 aa, Homo sapiens
  light chain complementarity determining region 3 for antibody 10757
QQYGTSPLT

SEQ ID NO: 21514 - protein, 16 aa, Homo sapiens
  heavy chain complementarity determining region 3 for antibody 10757
ARWGAVPESRKNCFDY

SEQ ID NO: 21515 - protein, 10 aa, Homo sapiens
  light chain complementarity determining region 3 for antibody 10758
QQYGSSSGFT

SEQ ID NO: 21516 - protein, 14 aa, Homo sapiens
  heavy chain complementarity determining region 3 for antibody 10758
ARPDSIYYYYAMDV

SEQ ID NO: 21517 - protein, 9 aa, Homo sapiens
  light chain complementarity determining region 3 for antibody 10759
QQYGSSATT

SEQ ID NO: 21518 - protein, 23 aa, Homo sapiens
  heavy chain complementarity determining region 3 for antibody 10759
ARQPRSPSSWGIVAAGTINWFDP

SEQ ID NO: 21519 - protein, 9 aa, Homo sapiens
  light chain complementarity determining region 3 for antibody 10760
MQALQTPWT

SEQ ID NO: 21520 - protein, 17 aa, Homo sapiens
  heavy chain complementarity determining region 3 for antibody 10760
AREPMVTDRYYYDGLDV

SEQ ID NO: 21521 - protein, 9 aa, Homo sapiens
  light chain complementarity determining region 3 for antibody 10761
RQFDTYPIT

SEQ ID NO: 21522 - protein, 12 aa, Homo sapiens
  heavy chain complementarity determining region 3 for antibody 10761
TRLAVPTSRVDY

SEQ ID NO: 21523 - protein, 9 aa, Homo sapiens
  light chain complementarity determining region 3 for antibody 10762
QVAYRFPLT

SEQ ID NO: 21524 - protein, 13 aa, Homo sapiens
  heavy chain complementarity determining region 3 for antibody 10762
ARTYGSGRNWFDS

SEQ ID NO: 21525 - protein, 8 aa, Homo sapiens
  light chain complementarity determining region 3 for antibody 10763
HQYLSFST

SEQ ID NO: 21526 - protein, 15 aa, Homo sapiens
  heavy chain complementarity determining region 3 for antibody 10763
ARTDMIRGVIGAFDV

SEQ ID NO: 21527 - protein, 9 aa, Homo sapiens
  light chain complementarity determining region 3 for antibody 10764
QQYYSTPYS

SEQ ID NO: 21528 - protein, 13 aa, Homo sapiens
  heavy chain complementarity determining region 3 for antibody 10764
AKATSDGSGALHY

SEQ ID NO: 21529 - protein, 11 aa, Homo sapiens
  light chain complementarity determining region 3 for antibody 10765
QRRSNWPPGFT

SEQ ID NO: 21530 - protein, 14 aa, Homo sapiens
  heavy chain complementarity determining region 3 for antibody 10765
ARDPYSYGLNYLDY

SEQ ID NO: 21531 - protein, 9 aa, Homo sapiens
  light chain complementarity determining region 3 for antibody 10766
QQYETSPFT

SEQ ID NO: 21532 - protein, 11 aa, Homo sapiens
  heavy chain complementarity determining region 3 for antibody 10766
GRGSVTPDMGY

SEQ ID NO: 21533 - protein, 9 aa, Homo sapiens
  light chain complementarity determining region 3 for antibody 10767
MQALQTPLT

SEQ ID NO: 21534 - protein, 18 aa, Homo sapiens
  heavy chain complementarity determining region 3 for antibody 10767
GRDGRGGGISVAAPGFDL

SEQ ID NO: 21535 - protein, 9 aa, Homo sapiens
  light chain complementarity determining region 3 for antibody 10768
QQYSNYPYS

SEQ ID NO: 21536 - protein, 17 aa, Homo sapiens
  heavy chain complementarity determining region 3 for antibody 10768
AREDWADVDLRLYYFDY

SEQ ID NO: 21537 - protein, 9 aa, Homo sapiens
  light chain complementarity determining region 3 for antibody 10769
QQAYRFPLT

SEQ ID NO: 21538 - protein, 13 aa, Homo sapiens
  heavy chain complementarity determining region 3 for antibody 10769
VRTYGSGRNWFDP

SEQ ID NO: 21539 - protein, 9 aa, Homo sapiens
  light chain complementarity determining region 3 for antibody 10770
QKYDSAPHT

SEQ ID NO: 21540 - protein, 19 aa, Homo sapiens
  heavy chain complementarity determining region 3 for antibody 10770
ARQVDYDGGDYYVSDAFDI

SEQ ID NO: 21541 - protein, 8 aa, Homo sapiens
  light chain complementarity determining region 3 for antibody 10771
QQYNFDPT

SEQ ID NO: 21542 - protein, 19 aa, Homo sapiens
  heavy chain complementarity determining region 3 for antibody 10771
ARDTWSSGRPNRGYFYFDL

SEQ ID NO: 21543 - protein, 8 aa, Homo sapiens
  light chain complementarity determining region 3 for antibody 10772
QQYKSVWT

SEQ ID NO: 21544 - protein, 13 aa, Homo sapiens
  heavy chain complementarity determining region 3 for antibody 10772
AKVRDGDYDSLDF

SEQ ID NO: 21545 - protein, 8 aa, Homo sapiens
  light chain complementarity determining region 3 for antibody 10773
QQYGSSPT

SEQ ID NO: 21546 - protein, 21 aa, Homo sapiens
  heavy chain complementarity determining region 3 for antibody 10773
ATRTSGKYSSSDDYYYYGMDV

SEQ ID NO: 21547 - protein, 9 aa, Homo sapiens
  light chain complementarity determining region 3 for antibody 10774
MQALQTPCT

SEQ ID NO: 21548 - protein, 19 aa, Homo sapiens
  heavy chain complementarity determining region 3 for antibody 10774
VRGLYSTYWSGYVGDGFDM

SEQ ID NO: 21549 - protein, 9 aa, Homo sapiens
  light chain complementarity determining region 3 for antibody 10775
QQYGSSWLT

SEQ ID NO: 21550 - protein, 22 aa, Homo sapiens
  heavy chain complementarity determining region 3 for antibody 10775
ARQGACGGDCYSLGYYYYAMDV

SEQ ID NO: 21551 - protein, 10 aa, Homo sapiens
  light chain complementarity determining region 3 for antibody 10776
QQYGSSPPVT

SEQ ID NO: 21552 - protein, 17 aa, Homo sapiens
  heavy chain complementarity determining region 3 for antibody 10776
AGAHYDILTGYFYGMDV

SEQ ID NO: 21553 - protein, 9 aa, Homo sapiens
  light chain complementarity determining region 3 for antibody 10777
QQSYDTPYT

SEQ ID NO: 21554 - protein, 12 aa, Homo sapiens
  heavy chain complementarity determining region 3 for antibody 10777
ARHYYGNNAAEF

SEQ ID NO: 21555 - protein, 9 aa, Homo sapiens
  light chain complementarity determining region 3 for antibody 10778
QQYGSSPRT

SEQ ID NO: 21556 - protein, 16 aa, Homo sapiens
  heavy chain complementarity determining region 3 for antibody 10778
ATTTGYSNYYYYGMDV

SEQ ID NO: 21557 - protein, 9 aa, Homo sapiens
  light chain complementarity determining region 3 for antibody 10779
QQYNSYPYT

SEQ ID NO: 21558 - protein, 17 aa, Homo sapiens
  heavy chain complementarity determining region 3 for antibody 10779
AKVRSPMVRGVISHFDY

SEQ ID NO: 21559 - protein, 9 aa, Homo sapiens
  light chain complementarity determining region 3 for antibody 10780
QQYHSYSHT

SEQ ID NO: 21560 - protein, 21 aa, Homo sapiens
  heavy chain complementarity determining region 3 for antibody 10780
AREQSYTVAGINYYYYYAMDV

SEQ ID NO: 21561 - protein, 10 aa, Homo sapiens
  light chain complementarity determining region 3 for antibody 10781
QQYGSSPAGT

SEQ ID NO: 21562 - protein, 17 aa, Homo sapiens
  heavy chain complementarity determining region 3 for antibody 10781
AREDWSDVDLRAFYFDS

SEQ ID NO: 21563 - protein, 9 aa, Homo sapiens
  light chain complementarity determining region 3 for antibody 10782
QHYDNLLLT

SEQ ID NO: 21564 - protein, 16 aa, Homo sapiens
  heavy chain complementarity determining region 3 for antibody 10782
ARAHGSGYTYGYIFDN

SEQ ID NO: 21565 - protein, 9 aa, Homo sapiens
  light chain complementarity determining region 3 for antibody 10783
QQSYSTPRT

SEQ ID NO: 21566 - protein, 18 aa, Homo sapiens
  heavy chain complementarity determining region 3 for antibody 10783
VREKVGDYCTGSCSFYEN

SEQ ID NO: 21567 - protein, 9 aa, Homo sapiens
  light chain complementarity determining region 3 for antibody 10784
QQYDNLPPT

SEQ ID NO: 21568 - protein, 17 aa, Homo sapiens
  heavy chain complementarity determining region 3 for antibody 10784
ARVHDSSNYYVAEYFQY

SEQ ID NO: 21569 - protein, 10 aa, Homo sapiens
  light chain complementarity determining region 3 for antibody 10785
QQGYSSLGLT

SEQ ID NO: 21570 - protein, 13 aa, Homo sapiens
  heavy chain complementarity determining region 3 for antibody 10785
ARLPSGSYPEFDY

SEQ ID NO: 21571 - protein, 9 aa, Homo sapiens
  light chain complementarity determining region 3 for antibody 10786
QQLNTYPPV

SEQ ID NO: 21572 - protein, 17 aa, Homo sapiens
  heavy chain complementarity determining region 3 for antibody 10786
ARGSGSPGHYYYYGMDV

SEQ ID NO: 21573 - protein, 10 aa, Homo sapiens
  light chain complementarity determining region 3 for antibody 10787
QKYNNAPPFT

SEQ ID NO: 21574 - protein, 17 aa, Homo sapiens
  heavy chain complementarity determining region 3 for antibody 10787
ASDPTYGDSYYYSGMDL

SEQ ID NO: 21575 - protein, 10 aa, Homo sapiens
  light chain complementarity determining region 3 for antibody 10788
QKYDSAPPFT

SEQ ID NO: 21576 - protein, 19 aa, Homo sapiens
  heavy chain complementarity determining region 3 for antibody 10788
ARELDFDILTGYLGGLFQH

SEQ ID NO: 21577 - protein, 10 aa, Homo sapiens
  light chain complementarity determining region 3 for antibody 10789
LLHGTSPPYT

SEQ ID NO: 21578 - protein, 15 aa, Homo sapiens
  heavy chain complementarity determining region 3 for antibody 10789
ARGSYTKYYFYGLDV

SEQ ID NO: 21579 - protein, 9 aa, Homo sapiens
  light chain complementarity determining region 3 for antibody 10790
QQYNDWPPT

SEQ ID NO: 21580 - protein, 16 aa, Homo sapiens
  heavy chain complementarity determining region 3 for antibody 10790
AKVWSESAYNPILFDC

SEQ ID NO: 21581 - protein, 10 aa, Homo sapiens
  light chain complementarity determining region 3 for antibody 10791
QQYGGSPMYT

SEQ ID NO: 21582 - protein, 20 aa, Homo sapiens
  heavy chain complementarity determining region 3 for antibody 10791
AREFPLAVVDGYYHFYGMNV

SEQ ID NO: 21583 - protein, 9 aa, Homo sapiens
  light chain complementarity determining region 3 for antibody 10792
QQVNTYPLT

SEQ ID NO: 21584 - protein, 18 aa, Homo sapiens
  heavy chain complementarity determining region 3 for antibody 10792
ARYEDYGDSPTVYYGLDV

SEQ ID NO: 21585 - protein, 10 aa, Homo sapiens
  light chain complementarity determining region 3 for antibody 10793
QQRSNWPHFT

SEQ ID NO: 21586 - protein, 19 aa, Homo sapiens
  heavy chain complementarity determining region 3 for antibody 10793
ARQANWSPTKTGGNYYLDS

SEQ ID NO: 21587 - protein, 8 aa, Homo sapiens
  light chain complementarity determining region 3 for antibody 10794
QQYGSFVT

SEQ ID NO: 21588 - protein, 17 aa, Homo sapiens
  heavy chain complementarity determining region 3 for antibody 10794
ARPRPYYYDSRGYYFDF

SEQ ID NO: 21589 - protein, 9 aa, Homo sapiens
  light chain complementarity determining region 3 for antibody 10795
HQYGTSRGT

SEQ ID NO: 21590 - protein, 21 aa, Homo sapiens
  heavy chain complementarity determining region 3 for antibody 10795
ATDRGGDYYRKSGYYYRPFDY

SEQ ID NO: 21591 - protein, 8 aa, Homo sapiens
  light chain complementarity determining region 3 for antibody 10796
QQSYSTPS

SEQ ID NO: 21592 - protein, 17 aa, Homo sapiens
  heavy chain complementarity determining region 3 for antibody 10796
AKDDFVSDRIFYKAMDV

SEQ ID NO: 21593 - protein, 9 aa, Homo sapiens
  light chain complementarity determining region 3 for antibody 10797
QHYDNLPLT

SEQ ID NO: 21594 - protein, 17 aa, Homo sapiens
  heavy chain complementarity determining region 3 for antibody 10797
VKGSTTMVRGDYYGMDV

SEQ ID NO: 21595 - protein, 9 aa, Homo sapiens
  light chain complementarity determining region 3 for antibody 10798
QQYGSSPLT

SEQ ID NO: 21596 - protein, 11 aa, Homo sapiens
  heavy chain complementarity determining region 3 for antibody 10798
THYSSGWFFDF

SEQ ID NO: 21597 - protein, 10 aa, Homo sapiens
  light chain complementarity determining region 3 for antibody 10799
QQTYSTPLFI

SEQ ID NO: 21598 - protein, 12 aa, Homo sapiens
  heavy chain complementarity determining region 3 for antibody 10799
ARGPRSGWYLVD

SEQ ID NO: 21599 - protein, 9 aa, Homo sapiens
  light chain complementarity determining region 3 for antibody 10800
QQANSFPFT

SEQ ID NO: 21600 - protein, 16 aa, Homo sapiens
  heavy chain complementarity determining region 3 for antibody 10800
ARGGFGELGLQNALDI

SEQ ID NO: 21601 - protein, 10 aa, Homo sapiens
  light chain complementarity determining region 3 for antibody 10801
QQYDSYSGET

SEQ ID NO: 21602 - protein, 21 aa, Homo sapiens
  heavy chain complementarity determining region 3 for antibody 10801
TKDRIAGDSTGYVFIGEYFQD

SEQ ID NO: 21603 - protein, 9 aa, Homo sapiens
  light chain complementarity determining region 3 for antibody 10802
QQLNTYPLT

SEQ ID NO: 21604 - protein, 18 aa, Homo sapiens
  heavy chain complementarity determining region 3 for antibody 10802
VRGSGAPVDLYYYYAMDV

SEQ ID NO: 21605 - protein, 8 aa, Homo sapiens
  light chain complementarity determining region 3 for antibody 10803
QQTHSFPP

SEQ ID NO: 21606 - protein, 22 aa, Homo sapiens
  heavy chain complementarity determining region 3 for antibody 10803
ARHSGYSNTWYMNYYYYYGMDV

SEQ ID NO: 21607 - protein, 10 aa, Homo sapiens
  light chain complementarity determining region 3 for antibody 10804
QQYVSSALYT

SEQ ID NO: 21608 - protein, 16 aa, Homo sapiens
  heavy chain complementarity determining region 3 for antibody 10804
ARELFKGEYDYYALDV

SEQ ID NO: 21609 - protein, 9 aa, Homo sapiens
  light chain complementarity determining region 3 for antibody 10805
QQANSFPIT

SEQ ID NO: 21610 - protein, 21 aa, Homo sapiens
  heavy chain complementarity determining region 3 for antibody 10805
ARDRSYGSGSYEYYYYYGMDV

SEQ ID NO: 21611 - protein, 9 aa, Homo sapiens
  light chain complementarity determining region 3 for antibody 10806
QQSYSTPYT

SEQ ID NO: 21612 - protein, 17 aa, Homo sapiens
  heavy chain complementarity determining region 3 for antibody 10806
ARDGSYGDRMYYYGMDV

SEQ ID NO: 21613 - protein, 9 aa, Homo sapiens
  light chain complementarity determining region 3 for antibody 10807
QQSYSTPLT

SEQ ID NO: 21614 - protein, 18 aa, Homo sapiens
  heavy chain complementarity determining region 3 for antibody 10807
AHLMISFGGLIGTYSFDI

SEQ ID NO: 21615 - protein, 8 aa, Homo sapiens
  light chain complementarity determining region 3 for antibody 10808
QQYNSVWT

SEQ ID NO: 21616 - protein, 17 aa, Homo sapiens
  heavy chain complementarity determining region 3 for antibody 10808
ARGFIVDFWSGYSPFDH

SEQ ID NO: 21617 - protein, 8 aa, Homo sapiens
  light chain complementarity determining region 3 for antibody 10809
MQALQTVT

SEQ ID NO: 21618 - protein, 18 aa, Homo sapiens
  heavy chain complementarity determining region 3 for antibody 10809
ARAPYYGDHGDRPNWFDP

SEQ ID NO: 21619 - protein, 8 aa, Homo sapiens
  light chain complementarity determining region 3 for antibody 10810
QQYDNLLT

SEQ ID NO: 21620 - protein, 20 aa, Homo sapiens
  heavy chain complementarity determining region 3 for antibody 10810
AKDRSVNAAMDYYYYSGMDV

SEQ ID NO: 21621 - protein, 11 aa, Homo sapiens
  light chain complementarity determining region 3 for antibody 10811
QQSYSSPPEYT

SEQ ID NO: 21622 - protein, 12 aa, Homo sapiens
  heavy chain complementarity determining region 3 for antibody 10811
ARPDYGDHKIDL

SEQ ID NO: 21623 - protein, 9 aa, Homo sapiens
  light chain complementarity determining region 3 for antibody 10812
QQADSFPRT

SEQ ID NO: 21624 - protein, 15 aa, Homo sapiens
  heavy chain complementarity determining region 3 for antibody 10812
ARDRSTTPTTGYFDY

SEQ ID NO: 21625 - protein, 9 aa, Homo sapiens
  light chain complementarity determining region 3 for antibody 10813
QQYNNWPLT

SEQ ID NO: 21626 - protein, 13 aa, Homo sapiens
  heavy chain complementarity determining region 3 for antibody 10813
AKSHERAYRIGDQ

SEQ ID NO: 21627 - protein, 10 aa, Homo sapiens
  light chain complementarity determining region 3 for antibody 10814
QFYRDWPGWT

SEQ ID NO: 21628 - protein, 17 aa, Homo sapiens
  heavy chain complementarity determining region 3 for antibody 10814
AKEIWIVNRPGGDAFDM

SEQ ID NO: 21629 - protein, 8 aa, Homo sapiens
  light chain complementarity determining region 3 for antibody 10815
QQYDTSRT

SEQ ID NO: 21630 - protein, 17 aa, Homo sapiens
  heavy chain complementarity determining region 3 for antibody 10815
ARVHFYGSKTYSYWFDP

SEQ ID NO: 21631 - protein, 9 aa, Homo sapiens
  light chain complementarity determining region 3 for antibody 10816
QHYHNWPRT

SEQ ID NO: 21632 - protein, 9 aa, Homo sapiens
  heavy chain complementarity determining region 3 for antibody 10816
ARGASEVDF

SEQ ID NO: 21633 - protein, 8 aa, Homo sapiens
  light chain complementarity determining region 3 for antibody 10817
QQYFTYPT

SEQ ID NO: 21634 - protein, 15 aa, Homo sapiens
  heavy chain complementarity determining region 3 for antibody 10817
AKAFATESSYGYFDS

SEQ ID NO: 21635 - protein, 9 aa, Homo sapiens
  light chain complementarity determining region 3 for antibody 10818
QQYGSPPYT

SEQ ID NO: 21636 - protein, 14 aa, Homo sapiens
  heavy chain complementarity determining region 3 for antibody 10818
ARGQNRASSVPHAY

SEQ ID NO: 21637 - protein, 11 aa, Homo sapiens
  light chain complementarity determining region 3 for antibody 10819
QQCYSAPPENT

SEQ ID NO: 21638 - protein, 16 aa, Homo sapiens
  heavy chain complementarity determining region 3 for antibody 10819
AREAGEDYYYKDIFDI

SEQ ID NO: 21639 - protein, 8 aa, Homo sapiens
  light chain complementarity determining region 3 for antibody 10820
QQYGTSPT

SEQ ID NO: 21640 - protein, 12 aa, Homo sapiens
  heavy chain complementarity determining region 3 for antibody 10820
ARGSVGDLSLPY

SEQ ID NO: 21641 - protein, 9 aa, Homo sapiens
  light chain complementarity determining region 3 for antibody 10821
QQLNSYPWT

SEQ ID NO: 21642 - protein, 11 aa, Homo sapiens
  heavy chain complementarity determining region 3 for antibody 10821
ASLMVRRGIDV

SEQ ID NO: 21643 - protein, 9 aa, Homo sapiens
  light chain complementarity determining region 3 for antibody 10822
MQALQTLLT

SEQ ID NO: 21644 - protein, 16 aa, Homo sapiens
  heavy chain complementarity determining region 3 for antibody 10822
ARLNFDVYSTSVGMDV

SEQ ID NO: 21645 - protein, 9 aa, Homo sapiens
  light chain complementarity determining region 3 for antibody 10823
QQFNSYPLT

SEQ ID NO: 21646 - protein, 6 aa, Homo sapiens
  heavy chain complementarity determining region 3 for antibody 10823
ASRGGF

SEQ ID NO: 21647 - protein, 9 aa, Homo sapiens
  light chain complementarity determining region 3 for antibody 10824
QQAYRFPLT

SEQ ID NO: 21648 - protein, 13 aa, Homo sapiens
  heavy chain complementarity determining region 3 for antibody 10824
ARTYGSGRNWFDL

SEQ ID NO: 21649 - protein, 9 aa, Homo sapiens
  light chain complementarity determining region 3 for antibody 10825
QQYHRYPLT

SEQ ID NO: 21650 - protein, 13 aa, Homo sapiens
  heavy chain complementarity determining region 3 for antibody 10825
ASASRAQFEAFDI

SEQ ID NO: 21651 - protein, 9 aa, Homo sapiens
  light chain complementarity determining region 3 for antibody 10826
QQYGSSPYT

SEQ ID NO: 21652 - protein, 12 aa, Homo sapiens
  heavy chain complementarity determining region 3 for antibody 10826
ARRSWDSGYDPS

SEQ ID NO: 21653 - protein, 9 aa, Homo sapiens
  light chain complementarity determining region 3 for antibody 10827
QQYYDTPRT

SEQ ID NO: 21654 - protein, 23 aa, Homo sapiens
  heavy chain complementarity determining region 3 for antibody 10827
ARGGPYRPAPYFYDISGPQYFQH

SEQ ID NO: 21655 - protein, 8 aa, Homo sapiens
  light chain complementarity determining region 3 for antibody 10828
QQYDNTIT

SEQ ID NO: 21656 - protein, 19 aa, Homo sapiens
  heavy chain complementarity determining region 3 for antibody 10828
ARLESYFDNSGYFREKFRH

SEQ ID NO: 21657 - protein, 9 aa, Homo sapiens
  light chain complementarity determining region 3 for antibody 10829
QQYSSYPLT

SEQ ID NO: 21658 - protein, 15 aa, Homo sapiens
  heavy chain complementarity determining region 3 for antibody 10829
ARGGIYYDILVGLDS

SEQ ID NO: 21659 - protein, 9 aa, Homo sapiens
  light chain complementarity determining region 3 for antibody 10830
QQYNSYPGT

SEQ ID NO: 21660 - protein, 17 aa, Homo sapiens
  heavy chain complementarity determining region 3 for antibody 10830
ARQIDIVVEIVSDGLDV

SEQ ID NO: 21661 - protein, 9 aa, Homo sapiens
  light chain complementarity determining region 3 for antibody 10831
MQGTHWPQT

SEQ ID NO: 21662 - protein, 20 aa, Homo sapiens
  heavy chain complementarity determining region 3 for antibody 10831
ARDGGYYDSSGYYYGASPEY

SEQ ID NO: 21663 - protein, 8 aa, Homo sapiens
  light chain complementarity determining region 3 for antibody 10832
HQANSFPP

SEQ ID NO: 21664 - protein, 22 aa, Homo sapiens
  heavy chain complementarity determining region 3 for antibody 10832
TRHSGYSNTWYMNYYYYYGMDV

SEQ ID NO: 21665 - protein, 11 aa, Homo sapiens
  light chain complementarity determining region 3 for antibody 10833
QQYDNSSPGYT

SEQ ID NO: 21666 - protein, 16 aa, Homo sapiens
  heavy chain complementarity determining region 3 for antibody 10833
AHRFYYGTNGSVAFDI

SEQ ID NO: 21667 - protein, 9 aa, Homo sapiens
  light chain complementarity determining region 3 for antibody 10834
QQSYSVPYT

SEQ ID NO: 21668 - protein, 13 aa, Homo sapiens
  heavy chain complementarity determining region 3 for antibody 10834
ARGSIYGSGKYEY

SEQ ID NO: 21669 - protein, 10 aa, Homo sapiens
  light chain complementarity determining region 3 for antibody 10835
QQSYSIHMYT

SEQ ID NO: 21670 - protein, 21 aa, Homo sapiens
  heavy chain complementarity determining region 3 for antibody 10835
ARGYLESLNGDHQHYHYALDV

SEQ ID NO: 21671 - protein, 9 aa, Homo sapiens
  light chain complementarity determining region 3 for antibody 10836
QQSYNAPQT

SEQ ID NO: 21672 - protein, 15 aa, Homo sapiens
  heavy chain complementarity determining region 3 for antibody 10836
ATESVGPSASNAFDL

SEQ ID NO: 21673 - protein, 9 aa, Homo sapiens
  light chain complementarity determining region 3 for antibody 10837
MQGTHWPPA

SEQ ID NO: 21674 - protein, 17 aa, Homo sapiens
  heavy chain complementarity determining region 3 for antibody 10837
TKDVPGQDITVVSGMDV

SEQ ID NO: 21675 - protein, 9 aa, Homo sapiens
  light chain complementarity determining region 3 for antibody 10838
MQGTHWPLT

SEQ ID NO: 21676 - protein, 13 aa, Homo sapiens
  heavy chain complementarity determining region 3 for antibody 10838
ARAYSRTFILLGY

SEQ ID NO: 21677 - protein, 8 aa, Homo sapiens
  light chain complementarity determining region 3 for antibody 10839
QQYNSLWP

SEQ ID NO: 21678 - protein, 16 aa, Homo sapiens
  heavy chain complementarity determining region 3 for antibody 10839
ARARGYGDDAYDAFDI

SEQ ID NO: 21679 - protein, 9 aa, Homo sapiens
  light chain complementarity determining region 3 for antibody 10840
QQLNSYPIT

SEQ ID NO: 21680 - protein, 16 aa, Homo sapiens
  heavy chain complementarity determining region 3 for antibody 10840
ARDRGSSWYENNWFDP

SEQ ID NO: 21681 - protein, 7 aa, Homo sapiens
  light chain complementarity determining region 3 for antibody 10841
QHYNSWT

SEQ ID NO: 21682 - protein, 12 aa, Homo sapiens
  heavy chain complementarity determining region 3 for antibody 10841
AKETASYGHADY

SEQ ID NO: 21683 - protein, 9 aa, Homo sapiens
  light chain complementarity determining region 3 for antibody 10842
LQYDSYPWT

SEQ ID NO: 21684 - protein, 9 aa, Homo sapiens
  heavy chain complementarity determining region 3 for antibody 10842
ARGHYGPDY

SEQ ID NO: 21685 - protein, 9 aa, Homo sapiens
  light chain complementarity determining region 3 for antibody 10843
QQYNTYSRT

SEQ ID NO: 21686 - protein, 14 aa, Homo sapiens
  heavy chain complementarity determining region 3 for antibody 10843
VTDAAGGSFDAFDV

SEQ ID NO: 21687 - protein, 9 aa, Homo sapiens
  light chain complementarity determining region 3 for antibody 10844
QMYGDSTWT

SEQ ID NO: 21688 - protein, 9 aa, Homo sapiens
  heavy chain complementarity determining region 3 for antibody 10844
ARWNQAFDY

SEQ ID NO: 21689 - protein, 10 aa, Homo sapiens
  light chain complementarity determining region 3 for antibody 10845
QHYNTYPSGT

SEQ ID NO: 21690 - protein, 17 aa, Homo sapiens
  heavy chain complementarity determining region 3 for antibody 10845
ARDQLQLPNYYYYGMGV

SEQ ID NO: 21691 - protein, 9 aa, Homo sapiens
  light chain complementarity determining region 3 for antibody 10846
QQYGTSRYT

SEQ ID NO: 21692 - protein, 23 aa, Homo sapiens
  heavy chain complementarity determining region 3 for antibody 10846
ARVGCSGEKCSSTAGYYYYPLDV

SEQ ID NO: 21693 - protein, 9 aa, Homo sapiens
  light chain complementarity determining region 3 for antibody 10847
QQFSPYSYS

SEQ ID NO: 21694 - protein, 13 aa, Homo sapiens
  heavy chain complementarity determining region 3 for antibody 10847
VRIGAAAGTAFDY

SEQ ID NO: 21695 - protein, 9 aa, Homo sapiens
  light chain complementarity determining region 3 for antibody 10848
MQALLTPPT

SEQ ID NO: 21696 - protein, 19 aa, Homo sapiens
  heavy chain complementarity determining region 3 for antibody 10848
ARAHLTTYYSGGSAYGMDV

SEQ ID NO: 21697 - protein, 9 aa, Homo sapiens
  light chain complementarity determining region 3 for antibody 10849
LQRSAWPQT

SEQ ID NO: 21698 - protein, 12 aa, Homo sapiens
  heavy chain complementarity determining region 3 for antibody 10849
ARDTGGDWYFDY

SEQ ID NO: 21699 - protein, 9 aa, Homo sapiens
  light chain complementarity determining region 3 for antibody 10850
QQTYSTPVT

SEQ ID NO: 21700 - protein, 11 aa, Homo sapiens
  heavy chain complementarity determining region 3 for antibody 10850
ARLDGHREFDY

SEQ ID NO: 21701 - protein, 9 aa, Homo sapiens
  light chain complementarity determining region 3 for antibody 10851
QQSYDIPLT

SEQ ID NO: 21702 - protein, 17 aa, Homo sapiens
  heavy chain complementarity determining region 3 for antibody 10851
ARGSGAPGAYYHYGMDV

SEQ ID NO: 21703 - protein, 10 aa, Homo sapiens
  light chain complementarity determining region 3 for antibody 10852
QQHGSSPGLT

SEQ ID NO: 21704 - protein, 19 aa, Homo sapiens
  heavy chain complementarity determining region 3 for antibody 10852
AREREYYGDYVSYYYAMDV

SEQ ID NO: 21705 - protein, 9 aa, Homo sapiens
  light chain complementarity determining region 3 for antibody 10853
QQANTLPFT

SEQ ID NO: 21706 - protein, 19 aa, Homo sapiens
  heavy chain complementarity determining region 3 for antibody 10853
ARNDYSGDTDRYYDFGMDV

SEQ ID NO: 21707 - protein, 9 aa, Homo sapiens
  light chain complementarity determining region 3 for antibody 10854
QWSYSTPLT

SEQ ID NO: 21708 - protein, 19 aa, Homo sapiens
  heavy chain complementarity determining region 3 for antibody 10854
AQEMTDFSGYGAPIYYFDY

SEQ ID NO: 21709 - protein, 9 aa, Homo sapiens
  light chain complementarity determining region 3 for antibody 10855
QQYNSFPYT

SEQ ID NO: 21710 - protein, 17 aa, Homo sapiens
  heavy chain complementarity determining region 3 for antibody 10855
AREDWNDVDLREFYFDY

SEQ ID NO: 21711 - protein, 10 aa, Homo sapiens
  light chain complementarity determining region 3 for antibody 10856
QQYHNWPPIT

SEQ ID NO: 21712 - protein, 14 aa, Homo sapiens
  heavy chain complementarity determining region 3 for antibody 10856
ARDFSTGIYGWFDP

SEQ ID NO: 21713 - protein, 11 aa, Homo sapiens
  light chain complementarity determining region 3 for antibody 10857
QQFDDVLPGFT

SEQ ID NO: 21714 - protein, 20 aa, Homo sapiens
  heavy chain complementarity determining region 3 for antibody 10857
ARGRNGGNSDRLPVWNNMAV

SEQ ID NO: 21715 - protein, 10 aa, Homo sapiens
  light chain complementarity determining region 3 for antibody 10858
QRYGGSPLFT

SEQ ID NO: 21716 - protein, 16 aa, Homo sapiens
  heavy chain complementarity determining region 3 for antibody 10858
ARELFKGEIDYYGMDV

SEQ ID NO: 21717 - protein, 9 aa, Homo sapiens
  light chain complementarity determining region 3 for antibody 10859
QQYGSSPYT

SEQ ID NO: 21718 - protein, 21 aa, Homo sapiens
  heavy chain complementarity determining region 3 for antibody 10859
ASHSSGTYYVLPYYSFHIMDV

SEQ ID NO: 21719 - protein, 9 aa, Homo sapiens
  light chain complementarity determining region 3 for antibody 10860
QQSYSTLWT

SEQ ID NO: 21720 - protein, 15 aa, Homo sapiens
  heavy chain complementarity determining region 3 for antibody 10860
ARAPPIAVVINGMDV

SEQ ID NO: 21721 - protein, 9 aa, Homo sapiens
  light chain complementarity determining region 3 for antibody 10861
QQRSNWPPT

SEQ ID NO: 21722 - protein, 11 aa, Homo sapiens
  heavy chain complementarity determining region 3 for antibody 10861
ARMTRLWTFDI

SEQ ID NO: 21723 - protein, 9 aa, Homo sapiens
  light chain complementarity determining region 3 for antibody 10862
QQYDDLPLT

SEQ ID NO: 21724 - protein, 20 aa, Homo sapiens
  heavy chain complementarity determining region 3 for antibody 10862
AKDHKRSSSVDYYYHHGMDV

SEQ ID NO: 21725 - protein, 9 aa, Homo sapiens
  light chain complementarity determining region 3 for antibody 10863
QQADSFPLT

SEQ ID NO: 21726 - protein, 13 aa, Homo sapiens
  heavy chain complementarity determining region 3 for antibody 10863
ARGAPGNTWHFDS

SEQ ID NO: 21727 - protein, 9 aa, Homo sapiens
  light chain complementarity determining region 3 for antibody 10864
MQGSHWPLT

SEQ ID NO: 21728 - protein, 16 aa, Homo sapiens
  heavy chain complementarity determining region 3 for antibody 10864
ARDLRASAAAGANFDY

SEQ ID NO: 21729 - protein, 9 aa, Homo sapiens
  light chain complementarity determining region 3 for antibody 10865
HQYSTSRGT

SEQ ID NO: 21730 - protein, 21 aa, Homo sapiens
  heavy chain complementarity determining region 3 for antibody 10865
ARDRGGDYHENSGYYYRPLDY

SEQ ID NO: 21731 - protein, 10 aa, Homo sapiens [sequence omitted]

SEQ ID NO: 21732 - protein, 19 aa, Homo sapiens
  heavy chain complementarity determining region 3 for antibody 10866
VTDYDFPRHSSSWSPWFDP

SEQ ID NO: 21733 - protein, 10 aa, Homo sapiens
  light chain complementarity determining region 3 for antibody 10867
QQYGTSLPVT

SEQ ID NO: 21734 - protein, 17 aa, Homo sapiens
  heavy chain complementarity determining region 3 for antibody 10867
VRDREFYYNSGGPTCDC

SEQ ID NO: 21735 - protein, 9 aa, Homo sapiens
  light chain complementarity determining region 3 for antibody 10868
QQSYNAPQT

SEQ ID NO: 21736 - protein, 15 aa, Homo sapiens
  heavy chain complementarity determining region 3 for antibody 10868
ATESVGPTASNAFDL

SEQ ID NO: 21737 - protein, 10 aa, Homo sapiens
  light chain complementarity determining region 3 for antibody 10869
QQFDNPFPFT

SEQ ID NO: 21738 - protein, 13 aa, Homo sapiens
  heavy chain complementarity determining region 3 for antibody 10869
ARDSVGDSGYGST

SEQ ID NO: 21739 - protein, 10 aa, Homo sapiens
  light chain complementarity determining region 3 for antibody 10870
QQYNSYSQGA

SEQ ID NO: 21740 - protein, 14 aa, Homo sapiens
  heavy chain complementarity determining region 3 for antibody 10870
AKDDTGDYPSYFDH

SEQ ID NO: 21741 - protein, 9 aa, Homo sapiens
  light chain complementarity determining region 3 for antibody 10871
QQYNAYPRT

SEQ ID NO: 21742 - protein, 11 aa, Homo sapiens
  heavy chain complementarity determining region 3 for antibody 10871
ARDPMVRGNDY

SEQ ID NO: 21743 - protein, 9 aa, Homo sapiens
  light chain complementarity determining region 3 for antibody 10872
QQSFSTPYS

SEQ ID NO: 21744 - protein, 12 aa, Homo sapiens
  heavy chain complementarity determining region 3 for antibody 10872
ARGGSGWRSFDS

SEQ ID NO: 21745 - protein, 10 aa, Homo sapiens
  light chain complementarity determining region 3 for antibody 10873
QQYGTSRPIT

SEQ ID NO: 21746 - protein, 18 aa, Homo sapiens
  heavy chain complementarity determining region 3 for antibody 10873
AADWGRVTATYSHYGLDV

SEQ ID NO: 21747 - protein, 9 aa, Homo sapiens
  light chain complementarity determining region 3 for antibody 10874
QQYGSSPIT

SEQ ID NO: 21748 - protein, 6 aa, Homo sapiens
  heavy chain complementarity determining region 3 for antibody 10874
AIMILG

SEQ ID NO: 21749 - protein, 9 aa, Homo sapiens
  light chain complementarity determining region 3 for antibody 10875
MQALQTPRT

SEQ ID NO: 21750 - protein, 23 aa, Homo sapiens
  heavy chain complementarity determining region 3 for antibody 10875
ARGGYSASDLSPDIPASYYGVDV

SEQ ID NO: 21751 - protein, 9 aa, Homo sapiens
  light chain complementarity determining region 3 for antibody 10876
LQESTYPLT

SEQ ID NO: 21752 - protein, 19 aa, Homo sapiens
  heavy chain complementarity determining region 3 for antibody 10876
AREEGHYSGSGSFLPESDS

SEQ ID NO: 21753 - protein, 9 aa, Homo sapiens
  light chain complementarity determining region 3 for antibody 10877
QQYNSFPYT

SEQ ID NO: 21754 - protein, 17 aa, Homo sapiens
  heavy chain complementarity determining region 3 for antibody 10877
AREDYNDVDLRLFYFDC

SEQ ID NO: 21755 - protein, 10 aa, Homo sapiens
  light chain complementarity determining region 3 for antibody 10878
QQRSNWPPGG

SEQ ID NO: 21756 - protein, 9 aa, Homo sapiens
  heavy chain complementarity determining region 3 for antibody 10878
ARDRNYFDS

SEQ ID NO: 21757 - protein, 9 aa, Homo sapiens
  light chain complementarity determining region 3 for antibody 10879
QQYGSSPGT

SEQ ID NO: 21758 - protein, 12 aa, Homo sapiens
  heavy chain complementarity determining region 3 for antibody 10879
AGGFLEWLLFEY

SEQ ID NO: 21759 - protein, 8 aa, Homo sapiens
  light chain complementarity determining region 3 for antibody 10880
QQYGGSVT

SEQ ID NO: 21760 - protein, 20 aa, Homo sapiens
  heavy chain complementarity determining region 3 for antibody 10880
VRGQYCGGDCSPGPGHAFDI

SEQ ID NO: 21761 - protein, 10 aa, Homo sapiens
  light chain complementarity determining region 3 for antibody 10881
QQYGALPPWT

SEQ ID NO: 21762 - protein, 16 aa, Homo sapiens
  heavy chain complementarity determining region 3 for antibody 10881
ARGGIEAWRYFYGMDV

SEQ ID NO: 21763 - protein, 9 aa, Homo sapiens
  light chain complementarity determining region 3 for antibody 10882
QQSYSTTWT

SEQ ID NO: 21764 - protein, 15 aa, Homo sapiens
  heavy chain complementarity determining region 3 for antibody 10882
AVDIVAKNYYYGMDV

SEQ ID NO: 21765 - protein, 9 aa, Homo sapiens
  light chain complementarity determining region 3 for antibody 10883
QQSFSPPWA

SEQ ID NO: 21766 - protein, 19 aa, Homo sapiens
  heavy chain complementarity determining region 3 for antibody 10883
ATLRYGSGELTYDYYGMDV

SEQ ID NO: 21767 - protein, 9 aa, Homo sapiens
  light chain complementarity determining region 3 for antibody 10884
QQSYSTPYT

SEQ ID NO: 21768 - protein, 15 aa, Homo sapiens
  heavy chain complementarity determining region 3 for antibody 10884
ARGDCRDETCYPGAY

SEQ ID NO: 21769 - protein, 9 aa, Homo sapiens
  light chain complementarity determining region 3 for antibody 10885
QQSYSVPYS

SEQ ID NO: 21770 - protein, 13 aa, Homo sapiens
  heavy chain complementarity determining region 3 for antibody 10885
ARGSIYGSGKYEY

SEQ ID NO: 21771 - protein, 9 aa, Homo sapiens
  light chain complementarity determining region 3 for antibody 10886
QQSYSTPLT

SEQ ID NO: 21772 - protein, 19 aa, Homo sapiens
  heavy chain complementarity determining region 3 for antibody 10886
ARGPTAAYTYGMRGGGIDV

SEQ ID NO: 21773 - protein, 9 aa, Homo sapiens
  light chain complementarity determining region 3 for antibody 10887
QQYHNLPIT

SEQ ID NO: 21774 - protein, 19 aa, Homo sapiens
  heavy chain complementarity determining region 3 for antibody 10887
VREGSPGGAYNRIFRAFDL

SEQ ID NO: 21775 - protein, 10 aa, Homo sapiens
  light chain complementarity determining region 3 for antibody 10888
LQHDNFPLVT

SEQ ID NO: 21776 - protein, 17 aa, Homo sapiens
  heavy chain complementarity determining region 3 for antibody 10888
ARDGEWELRAFYNWFDP

SEQ ID NO: 21777 - protein, 10 aa, Homo sapiens
  light chain complementarity determining region 3 for antibody 10889
QQSYSSRIFT

SEQ ID NO: 21778 - protein, 20 aa, Homo sapiens
  heavy chain complementarity determining region 3 for antibody 10889
ARTTQEYSSSWYWGYYGMDV

SEQ ID NO: 21779 - protein, 9 aa, Homo sapiens
  light chain complementarity determining region 3 for antibody 10890
QQYYTTPFT

SEQ ID NO: 21780 - protein, 17 aa, Homo sapiens
  heavy chain complementarity determining region 3 for antibody 10890
ARGRYESGDYYNNAFDF

SEQ ID NO: 21781 - protein, 10 aa, Homo sapiens
  light chain complementarity determining region 3 for antibody 10891
QQYVNSGLFT

SEQ ID NO: 21782 - protein, 16 aa, Homo sapiens
  heavy chain complementarity determining region 3 for antibody 10891
AREVFKGQIDYYGMDV

SEQ ID NO: 21783 - protein, 9 aa, Homo sapiens
  light chain complementarity determining region 3 for antibody 10892
QQYDKVPLT

SEQ ID NO: 21784 - protein, 20 aa, Homo sapiens
  heavy chain complementarity determining region 3 for antibody 10892
AKDRRRDTSMDYFYYSAMGV

SEQ ID NO: 21785 - protein, 9 aa, Homo sapiens
  light chain complementarity determining region 3 for antibody 10893
QQSYTIPYT

SEQ ID NO: 21786 - protein, 11 aa, Homo sapiens
  heavy chain complementarity determining region 3 for antibody 10893
ARVRGSSWIDY

SEQ ID NO: 21787 - protein, 9 aa, Homo sapiens
  light chain complementarity determining region 3 for antibody 10894
QQSYSTLYT

SEQ ID NO: 21788 - protein, 12 aa, Homo sapiens
  heavy chain complementarity determining region 3 for antibody 10894
ARDRSSSEGSDY

SEQ ID NO: 21789 - protein, 9 aa, Homo sapiens
  light chain complementarity determining region 3 for antibody 10895
QQSYSTPYT

SEQ ID NO: 21790 - protein, 19 aa, Homo sapiens
  heavy chain complementarity determining region 3 for antibody 10895
ARQSGDTMVRGVISDGFDI

SEQ ID NO: 21791 - protein, 9 aa, Homo sapiens
  light chain complementarity determining region 3 for antibody 10896
LQHNSYPRT

SEQ ID NO: 21792 - protein, 19 aa, Homo sapiens
  heavy chain complementarity determining region 3 for antibody 10896
TTDFWLIVTAGFYYHGMDV

SEQ ID NO: 21793 - protein, 9 aa, Homo sapiens
  light chain complementarity determining region 3 for antibody 10897
QYRSNRPGT

SEQ ID NO: 21794 - protein, 18 aa, Homo sapiens
  heavy chain complementarity determining region 3 for antibody 10897
ALEPQTEFGSGNYGYFDY

SEQ ID NO: 21795 - protein, 9 aa, Homo sapiens
  light chain complementarity determining region 3 for antibody 10898
QQYNSFPYT

SEQ ID NO: 21796 - protein, 17 aa, Homo sapiens
  heavy chain complementarity determining region 3 for antibody 10898
AREDFSDVDLRLFYLDY

SEQ ID NO: 21797 - protein, 9 aa, Homo sapiens
  light chain complementarity determining region 3 for antibody 10899
QQYGSAPLT

SEQ ID NO: 21798 - protein, 12 aa, Homo sapiens
  heavy chain complementarity determining region 3 for antibody 10899
AAWYSSWSAFDY

SEQ ID NO: 21799 - protein, 9 aa, Homo sapiens
  light chain complementarity determining region 3 for antibody 10900
HQYGSSWYT

SEQ ID NO: 21800 - protein, 20 aa, Homo sapiens
  heavy chain complementarity determining region 3 for antibody 10900
ARDPHRYGGKDSLYHYGLDV

SEQ ID NO: 21801 - protein, 9 aa, Homo sapiens
  light chain complementarity determining region 3 for antibody 10901
QQYGSSPET

SEQ ID NO: 21802 - protein, 11 aa, Homo sapiens
  heavy chain complementarity determining region 3 for antibody 10901
AKDTQWQPFDH

SEQ ID NO: 21803 - protein, 9 aa, Homo sapiens
  light chain complementarity determining region 3 for antibody 10902
LQYDSYSWT

SEQ ID NO: 21804 - protein, 16 aa, Homo sapiens
  heavy chain complementarity determining region 3 for antibody 10902
ARVGMWDGYKLPGVGV

SEQ ID NO: 21805 - protein, 10 aa, Homo sapiens
  light chain complementarity determining region 3 for antibody 10903
HQSTILPRLT

SEQ ID NO: 21806 - protein, 18 aa, Homo sapiens
  heavy chain complementarity determining region 3 for antibody 10903
ARDVGYDRSANYHWYFDV

SEQ ID NO: 21807 - protein, 10 aa, Homo sapiens
  light chain complementarity determining region 3 for antibody 10904
QQYGSSPPIT

SEQ ID NO: 21808 - protein, 12 aa, Homo sapiens
  heavy chain complementarity determining region 3 for antibody 10904
AVELGYGDIPIA

SEQ ID NO: 21809 - protein, 8 aa, Homo sapiens
  light chain complementarity determining region 3 for antibody 10905
QQYGNSLT

SEQ ID NO: 21810 - protein, 15 aa, Homo sapiens
  heavy chain complementarity determining region 3 for antibody 10905
ARRPEFQFGKYFFDY

SEQ ID NO: 21811 - protein, 9 aa, Homo sapiens
  light chain complementarity determining region 3 for antibody 10906
QQYGGSRYT

SEQ ID NO: 21812 - protein, 11 aa, Homo sapiens
  heavy chain complementarity determining region 3 for antibody 10906
AHTTYGYYFDY

SEQ ID NO: 21813 - protein, 9 aa, Homo sapiens
  light chain complementarity determining region 3 for antibody 10907
QQYDTYSYT

SEQ ID NO: 21814 - protein, 20 aa, Homo sapiens
  heavy chain complementarity determining region 3 for antibody 10907
ARFSYCSGDCYRAHYYGMDV

SEQ ID NO: 21815 - protein, 9 aa, Homo sapiens
  light chain complementarity determining region 3 for antibody 10908
QHYDNLLFT

SEQ ID NO: 21816 - protein, 11 aa, Homo sapiens
  heavy chain complementarity determining region 3 for antibody 10908
ARVNYGSGFDH

SEQ ID NO: 21817 - protein, 9 aa, Homo sapiens
  light chain complementarity determining region 3 for antibody 10909
LQHNSYPWT

SEQ ID NO: 21818 - protein, 10 aa, Homo sapiens
  heavy chain complementarity determining region 3 for antibody 10909
ARAYANPSSY

SEQ ID NO: 21819 - protein, 11 aa, Homo sapiens
  light chain complementarity determining region 3 for antibody 10910
QQLNDFTRGIT

SEQ ID NO: 21820 - protein, 17 aa, Homo sapiens
  heavy chain complementarity determining region 3 for antibody 10910
ARERQYCSHLSCYGEDY

SEQ ID NO: 21821 - protein, 9 aa, Homo sapiens
  light chain complementarity determining region 3 for antibody 10911
QQANSFPIT

SEQ ID NO: 21822 - protein, 25 aa, Homo sapiens
  heavy chain complementarity determining region 3 for antibody 10911
TTDSLINDDIMPGYPNYYYYYGMDV

SEQ ID NO: 21823 - protein, 9 aa, Homo sapiens
  light chain complementarity determining region 3 for antibody 10912
QQYDSYPYT

SEQ ID NO: 21824 - protein, 17 aa, Homo sapiens
  heavy chain complementarity determining region 3 for antibody 10912
AREDWSDVDLQTYYFDN

SEQ ID NO: 21825 - protein, 8 aa, Homo sapiens
  light chain complementarity determining region 3 for antibody 10913
QQTYTPIT

SEQ ID NO: 21826 - protein, 12 aa, Homo sapiens
  heavy chain complementarity determining region 3 for antibody 10913
AKDKGMIGSLDY

SEQ ID NO: 21827 - protein, 10 aa, Homo sapiens
  light chain complementarity determining region 3 for antibody 10914
QQATSFPPIP

SEQ ID NO: 21828 - protein, 21 aa, Homo sapiens
  heavy chain complementarity determining region 3 for antibody 10914
ARGLTDEGYKSGYGYYYGLDV

SEQ ID NO: 21829 - protein, 9 aa, Homo sapiens
  light chain complementarity determining region 3 for antibody 10915
QQYSTFPYT

SEQ ID NO: 21830 - protein, 17 aa, Homo sapiens
  heavy chain complementarity determining region 3 for antibody 10915
AREDWNDVDLRQFYFDY

SEQ ID NO: 21831 - protein, 9 aa, Homo sapiens
  light chain complementarity determining region 3 for antibody 10916
QQYDNLPLT

SEQ ID NO: 21832 - protein, 18 aa, Homo sapiens
  heavy chain complementarity determining region 3 for antibody 10916
VRAPGDYDMLRRGYYFDH

SEQ ID NO: 21833 - protein, 9 aa, Homo sapiens
  light chain complementarity determining region 3 for antibody 10917
QQRTDWLLT

SEQ ID NO: 21834 - protein, 25 aa, Homo sapiens
  heavy chain complementarity determining region 3 for antibody 10917
ARGQLRPRINSMVRGREPRPLYLDY

SEQ ID NO: 21835 - protein, 9 aa, Homo sapiens
  light chain complementarity determining region 3 for antibody 10918
QQYNNWPRT

SEQ ID NO: 21836 - protein, 17 aa, Homo sapiens
  heavy chain complementarity determining region 3 for antibody 10918
AKEAVVVVHANSRYFQH

SEQ ID NO: 21837 - protein, 9 aa, Homo sapiens
  light chain complementarity determining region 3 for antibody 10919
QQTYSTPVT

SEQ ID NO: 21838 - protein, 16 aa, Homo sapiens
  heavy chain complementarity determining region 3 for antibody 10919
ATLFTASGWSRGWLDP

SEQ ID NO: 21839 - protein, 8 aa, Homo sapiens
  light chain complementarity determining region 3 for antibody 10920
QQLSSYPA

SEQ ID NO: 21840 - protein, 23 aa, Homo sapiens
  heavy chain complementarity determining region 3 for antibody 10920
SHISVTSRDVPLGTHYYYYGMDV

SEQ ID NO: 21841 - protein, 10 aa, Homo sapiens
  light chain complementarity determining region 3 for antibody 10921
QYHGYSPLYT

SEQ ID NO: 21842 - protein, 13 aa, Homo sapiens
  heavy chain complementarity determining region 3 for antibody 10921
ARGGNDSGWYLGY

SEQ ID NO: 21843 - protein, 10 aa, Homo sapiens
  light chain complementarity determining region 3 for antibody 10922
QQYSRWPPWT

SEQ ID NO: 21844 - protein, 9 aa, Homo sapiens
  heavy chain complementarity determining region 3 for antibody 10922
ARGYSYGNL

SEQ ID NO: 21845 - protein, 9 aa, Homo sapiens
  light chain complementarity determining region 3 for antibody 10923
QQYGTSRYT

SEQ ID NO: 21846 - protein, 23 aa, Homo sapiens
  heavy chain complementarity determining region 3 for antibody 10923
ARVGCSGEKCSSMSGYYYYPLDV

SEQ ID NO: 21847 - protein, 9 aa, Homo sapiens
  light chain complementarity determining region 3 for antibody 10924
QHYATSRGT

SEQ ID NO: 21848 - protein, 21 aa, Homo sapiens
  heavy chain complementarity determining region 3 for antibody 10924
ARDRGGDFHHGSAYYYRPLDY

SEQ ID NO: 21849 - protein, 9 aa, Homo sapiens
  light chain complementarity determining region 3 for antibody 10925
LQSYRTPWT

SEQ ID NO: 21850 - protein, 12 aa, Homo sapiens
  heavy chain complementarity determining region 3 for antibody 10925
ARDWGTGDHFKY

SEQ ID NO: 21851 - protein, 9 aa, Homo sapiens
  light chain complementarity determining region 3 for antibody 10926
QYYGGSPYT

SEQ ID NO: 21852 - protein, 14 aa, Homo sapiens
  heavy chain complementarity determining region 3 for antibody 10926
ARDSTRLGGGDFDY

SEQ ID NO: 21853 - protein, 12 aa, Homo sapiens
  light chain complementarity determining region 3 for antibody 10927
QQYGSGSSPPYT

SEQ ID NO: 21854 - protein, 12 aa, Homo sapiens
  heavy chain complementarity determining region 3 for antibody 10927
ASCIYGSGTLKV

SEQ ID NO: 21855 - protein, 9 aa, Homo sapiens
  light chain complementarity determining region 3 for antibody 10928
QQYDNLPYT

SEQ ID NO: 21856 - protein, 10 aa, Homo sapiens
  heavy chain complementarity determining region 3 for antibody 10928
ARENNWGPDS

SEQ ID NO: 21857 - protein, 8 aa, Homo sapiens
  light chain complementarity determining region 3 for antibody 10929
QQSYSSLT

SEQ ID NO: 21858 - protein, 19 aa, Homo sapiens
  heavy chain complementarity determining region 3 for antibody 10929
VRDSLRYFDWIRPTNWFDA

SEQ ID NO: 21859 - protein, 9 aa, Homo sapiens
  light chain complementarity determining region 3 for antibody 10930
QQLNSYPLT

SEQ ID NO: 21860 - protein, 16 aa, Homo sapiens
  heavy chain complementarity determining region 3 for antibody 10930
AGSRREGYNWVWYFDL

SEQ ID NO: 21861 - protein, 9 aa, Homo sapiens
  light chain complementarity determining region 3 for antibody 10931
MQGTYWPLT

SEQ ID NO: 21862 - protein, 15 aa, Homo sapiens
  heavy chain complementarity determining region 3 for antibody 10931
VRDRLHVLTGSSIDS

SEQ ID NO: 21863 - protein, 9 aa, Homo sapiens
  light chain complementarity determining region 3 for antibody 10932
QQYKNYPIT

SEQ ID NO: 21864 - protein, 22 aa, Homo sapiens
  heavy chain complementarity determining region 3 for antibody 10932
ARENAHSDYDLGDFSPYDVFDI

SEQ ID NO: 21865 - protein, 9 aa, Homo sapiens
  light chain complementarity determining region 3 for antibody 10933
QQCQDTPIT

SEQ ID NO: 21866 - protein, 16 aa, Homo sapiens
  heavy chain complementarity determining region 3 for antibody 10933
ARDLRGVYNVPTTLDY

SEQ ID NO: 21867 - protein, 9 aa, Homo sapiens
  light chain complementarity determining region 3 for antibody 10934
MQGLLTPPA

SEQ ID NO: 21868 - protein, 18 aa, Homo sapiens
  heavy chain complementarity determining region 3 for antibody 10934
ARTRVGLYSGGSPFMFDP

SEQ ID NO: 21869 - protein, 9 aa, Homo sapiens
  light chain complementarity determining region 3 for antibody 10935
QQYNSYPYT

SEQ ID NO: 21870 - protein, 16 aa, Homo sapiens
  heavy chain complementarity determining region 3 for antibody 10935
AKDRGSGNYYNSDFDY

SEQ ID NO: 21871 - protein, 10 aa, Homo sapiens
  light chain complementarity determining region 3 for antibody 10936
QQYNNWPPIT

SEQ ID NO: 21872 - protein, 9 aa, Homo sapiens
  heavy chain complementarity determining region 3 for antibody 10936
ARDPDWLEY

SEQ ID NO: 21873 - protein, 9 aa, Homo sapiens
  light chain complementarity determining region 3 for antibody 10937
QQSNSIPWT

SEQ ID NO: 21874 - protein, 16 aa, Homo sapiens
  heavy chain complementarity determining region 3 for antibody 10937
ARGYSGSDHPYNWFDP

SEQ ID NO: 21875 - protein, 9 aa, Homo sapiens
  light chain complementarity determining region 3 for antibody 10938
QQRSDWPIT

SEQ ID NO: 21876 - protein, 10 aa, Homo sapiens
  heavy chain complementarity determining region 3 for antibody 10938
ARDADRKDDF

SEQ ID NO: 21877 - protein, 9 aa, Homo sapiens
  light chain complementarity determining region 3 for antibody 10939
QQANSLPFT

SEQ ID NO: 21878 - protein, 19 aa, Homo sapiens
  heavy chain complementarity determining region 3 for antibody 10939
ARADYSGETDRYYDYGMDV

SEQ ID NO: 21879 - protein, 8 aa, Homo sapiens
  light chain complementarity determining region 3 for antibody 10940
QQYYSLHT

SEQ ID NO: 21880 - protein, 11 aa, Homo sapiens
  heavy chain complementarity determining region 3 for antibody 10940
AHTRGYTGFDF

SEQ ID NO: 21881 - protein, 9 aa, Homo sapiens
  light chain complementarity determining region 3 for antibody 10941
QQYDNVPIT

SEQ ID NO: 21882 - protein, 16 aa, Homo sapiens
  heavy chain complementarity determining region 3 for antibody 10941
TTRKYSYAYASVSFDH

SEQ ID NO: 21883 - protein, 9 aa, Homo sapiens
  light chain complementarity determining region 3 for antibody 10942
QQANNFLLS

SEQ ID NO: 21884 - protein, 15 aa, Homo sapiens
  heavy chain complementarity determining region 3 for antibody 10942
ARAPVPLATAVSPDS

SEQ ID NO: 21885 - protein, 9 aa, Homo sapiens
  light chain complementarity determining region 3 for antibody 10943
QQYNTYPYT

SEQ ID NO: 21886 - protein, 19 aa, Homo sapiens
  heavy chain complementarity determining region 3 for antibody 10943
ARDQSSSYGDYYYHYGMDV

SEQ ID NO: 21887 - protein, 9 aa, Homo sapiens
  light chain complementarity determining region 3 for antibody 10944
QQYNSYPRT

SEQ ID NO: 21888 - protein, 17 aa, Homo sapiens
  heavy chain complementarity determining region 3 for antibody 10944
AKERGMSVPYYYYGMDV

SEQ ID NO: 21889 - protein, 6 aa, Homo sapiens
  light chain complementarity determining region 3 for antibody 10945
QQADSV

SEQ ID NO: 21890 - protein, 15 aa, Homo sapiens
  heavy chain complementarity determining region 3 for antibody 10945
ARLFYYYDGSGYLDY

SEQ ID NO: 21891 - protein, 11 aa, Homo sapiens
  light chain complementarity determining region 3 for antibody 10946
QKYNSAPPIFT

SEQ ID NO: 21892 - protein, 11 aa, Homo sapiens
  heavy chain complementarity determining region 3 for antibody 10946
ARDHEGYGYYY

SEQ ID NO: 21893 - protein, 9 aa, Homo sapiens
  light chain complementarity determining region 3 for antibody 10947
MQALQTPYT

SEQ ID NO: 21894 - protein, 19 aa, Homo sapiens
  heavy chain complementarity determining region 3 for antibody 10947
ARGLYKDYWSGYTGDGFDI

SEQ ID NO: 21895 - protein, 9 aa, Homo sapiens
  light chain complementarity determining region 3 for antibody 10948
HQSSSLPWT

SEQ ID NO: 21896 - protein, 15 aa, Homo sapiens
  heavy chain complementarity determining region 3 for antibody 10948
ATLRVVGITSEWSGS

SEQ ID NO: 21897 - protein, 9 aa, Homo sapiens
  light chain complementarity determining region 3 for antibody 10949
QQYGSSRYT

SEQ ID NO: 21898 - protein, 23 aa, Homo sapiens
  heavy chain complementarity determining region 3 for antibody 10949
ARVGCSGEKCSSMSGYYYYPLDV

SEQ ID NO: 21899 - protein, 9 aa, Homo sapiens
  light chain complementarity determining region 3 for antibody 10950
QQRSNWPLT

SEQ ID NO: 21900 - protein, 14 aa, Homo sapiens
  heavy chain complementarity determining region 3 for antibody 10950
AKEGWQWDGYYFDY

SEQ ID NO: 21901 - protein, 10 aa, Homo sapiens
  light chain complementarity determining region 3 for antibody 10951
QHHGNSPLYT

SEQ ID NO: 21902 - protein, 12 aa, Homo sapiens
  heavy chain complementarity determining region 3 for antibody 10951
AKGILGRGGMDV

SEQ ID NO: 21903 - protein, 9 aa, Homo sapiens
  light chain complementarity determining region 3 for antibody 10952
QQYYSAPRT

SEQ ID NO: 21904 - protein, 20 aa, Homo sapiens
  heavy chain complementarity determining region 3 for antibody 10952
VRDDILTGYYQSDYYHAMDV

SEQ ID NO: 21905 - protein, 9 aa, Homo sapiens
  light chain complementarity determining region 3 for antibody 10953
QQYNSYSYT

SEQ ID NO: 21906 - protein, 19 aa, Homo sapiens
  heavy chain complementarity determining region 3 for antibody 10953
ARDTRFGEYTQAPLNYFQH

SEQ ID NO: 21907 - protein, 9 aa, Homo sapiens
  light chain complementarity determining region 3 for antibody 10954
QQYNSYSIT

SEQ ID NO: 21908 - protein, 14 aa, Homo sapiens
  heavy chain complementarity determining region 3 for antibody 10954
ARDLAGTVPYYFDY

SEQ ID NO: 21909 - protein, 9 aa, Homo sapiens
  light chain complementarity determining region 3 for antibody 10955
QQYGSSPFT

SEQ ID NO: 21910 - protein, 13 aa, Homo sapiens
  heavy chain complementarity determining region 3 for antibody 10955
ARSRSYYGDYFEY

SEQ ID NO: 21911 - protein, 9 aa, Homo sapiens
  light chain complementarity determining region 3 for antibody 10956
QQSYITPLT

SEQ ID NO: 21912 - protein, 17 aa, Homo sapiens
  heavy chain complementarity determining region 3 for antibody 10956
AREGLLLERTRWGSVDV

SEQ ID NO: 21913 - protein, 8 aa, Homo sapiens
  light chain complementarity determining region 3 for antibody 10957
QQRSNSIT

SEQ ID NO: 21914 - protein, 25 aa, Homo sapiens
  heavy chain complementarity determining region 3 for antibody 10957
ARTRIYFYDSTGDPTLDYHHYGMDV

SEQ ID NO: 21915 - protein, 9 aa, Homo sapiens
  light chain complementarity determining region 3 for antibody 10958
QQNFSPPWA

SEQ ID NO: 21916 - protein, 19 aa, Homo sapiens
  heavy chain complementarity determining region 3 for antibody 10958
ATMRYGSGELTYDYYGMDV

SEQ ID NO: 21917 - protein, 9 aa, Homo sapiens
  light chain complementarity determining region 3 for antibody 10959
QQLNSYPLT

SEQ ID NO: 21918 - protein, 18 aa, Homo sapiens
  heavy chain complementarity determining region 3 for antibody 10959
ARYEDYGDPPTVYYGMDV

SEQ ID NO: 21919 - protein, 9 aa, Homo sapiens
  light chain complementarity determining region 3 for antibody 10960
LQHNGYPWT

SEQ ID NO: 21920 - protein, 17 aa, Homo sapiens
  heavy chain complementarity determining region 3 for antibody 10960
AREPRGFEFGYVSSFDH

SEQ ID NO: 21921 - protein, 9 aa, Homo sapiens
  light chain complementarity determining region 3 for antibody 10961
HQYNSFPYT

SEQ ID NO: 21922 - protein, 17 aa, Homo sapiens
  heavy chain complementarity determining region 3 for antibody 10961
AREDWSDVDLRNFYLEF

SEQ ID NO: 21923 - protein, 9 aa, Homo sapiens
  light chain complementarity determining region 3 for antibody 10962
QQSYTTPGT

SEQ ID NO: 21924 - protein, 13 aa, Homo sapiens
  heavy chain complementarity determining region 3 for antibody 10962
ARIIYGNYYGMDV

SEQ ID NO: 21925 - protein, 9 aa, Homo sapiens
  light chain complementarity determining region 3 for antibody 10963
QQSFTFPRT

SEQ ID NO: 21926 - protein, 17 aa, Homo sapiens
  heavy chain complementarity determining region 3 for antibody 10963
ATDPEDNSGSYSGAGDY

SEQ ID NO: 21927 - protein, 9 aa, Homo sapiens
  light chain complementarity determining region 3 for antibody 10964
QQYGSSRYT

SEQ ID NO: 21928 - protein, 22 aa, Homo sapiens
  heavy chain complementarity determining region 3 for antibody 10964
ARIYDDSGYYYTAGYYYYAMDV

SEQ ID NO: 21929 - protein, 8 aa, Homo sapiens
  light chain complementarity determining region 3 for antibody 10965
QQSYSTFH

SEQ ID NO: 21930 - protein, 20 aa, Homo sapiens
  heavy chain complementarity determining region 3 for antibody 10965
AKDDGVYSVDDTDYYYAMDV

SEQ ID NO: 21931 - protein, 9 aa, Homo sapiens
  light chain complementarity determining region 3 for antibody 10966
QQYGSSRYT

SEQ ID NO: 21932 - protein, 22 aa, Homo sapiens
  heavy chain complementarity determining region 3 for antibody 10966
ARIYDDSAKYYSAGYYYYAMDV

SEQ ID NO: 21933 - protein, 9 aa, Homo sapiens
  light chain complementarity determining region 3 for antibody 10967
QQSYTALYT

SEQ ID NO: 21934 - protein, 16 aa, Homo sapiens
  heavy chain complementarity determining region 3 for antibody 10967
ARGGYLTSTPYYGMDV

SEQ ID NO: 21935 - protein, 10 aa, Homo sapiens
  light chain complementarity determining region 3 for antibody 10968
QQSYSIHMYT

SEQ ID NO: 21936 - protein, 16 aa, Homo sapiens
  heavy chain complementarity determining region 3 for antibody 10968
ARGGFGELGLHNVFDI

SEQ ID NO: 21937 - protein, 9 aa, Homo sapiens
  light chain complementarity determining region 3 for antibody 10969
QQYGSFLQT

SEQ ID NO: 21938 - protein, 13 aa, Homo sapiens
  heavy chain complementarity determining region 3 for antibody 10969
AGGHGSTSGLIDY

SEQ ID NO: 21939 - protein, 9 aa, Homo sapiens
  light chain complementarity determining region 3 for antibody 10970
QQSYSLPRT

SEQ ID NO: 21940 - protein, 18 aa, Homo sapiens
  heavy chain complementarity determining region 3 for antibody 10970
ARIHEYYYDSSGGKALDV

SEQ ID NO: 21941 - protein, 11 aa, Homo sapiens
  light chain complementarity determining region 3 for antibody 10971
QQRSNWPPLLA

SEQ ID NO: 21942 - protein, 11 aa, Homo sapiens
  heavy chain complementarity determining region 3 for antibody 10971
AREQTGYYPLY

SEQ ID NO: 21943 - protein, 10 aa, Homo sapiens
  light chain complementarity determining region 3 for antibody 10972
QQRGNWPPIT

SEQ ID NO: 21944 - protein, 18 aa, Homo sapiens
  heavy chain complementarity determining region 3 for antibody 10972
AKDLAPSMRVVAQGALDI

SEQ ID NO: 21945 - protein, 9 aa, Homo sapiens
  light chain complementarity determining region 3 for antibody 10973
QHYENFRHT

SEQ ID NO: 21946 - protein, 13 aa, Homo sapiens
  heavy chain complementarity determining region 3 for antibody 10973
ARDRGLGWYHLDS

SEQ ID NO: 21947 - protein, 10 aa, Homo sapiens
  light chain complementarity determining region 3 for antibody 10974
QGYGSSPPIT

SEQ ID NO: 21948 - protein, 22 aa, Homo sapiens
  heavy chain complementarity determining region 3 for antibody 10974
ARDGYGDYDAALGDYYYYGMDV

SEQ ID NO: 21949 - protein, 9 aa, Homo sapiens
  light chain complementarity determining region 3 for antibody 10975
QQYDSYPWT

SEQ ID NO: 21950 - protein, 14 aa, Homo sapiens
  heavy chain complementarity determining region 3 for antibody 10975
VKESNIGPYRTADF

SEQ ID NO: 21951 - protein, 9 aa, Homo sapiens
  light chain complementarity determining region 3 for antibody 10976
QQYDNLPHT

SEQ ID NO: 21952 - protein, 17 aa, Homo sapiens
  heavy chain complementarity determining region 3 for antibody 10976
ARAPPVEYYDSSGYYNY

SEQ ID NO: 21953 - protein, 9 aa, Homo sapiens
  light chain complementarity determining region 3 for antibody 10977
QQSFSTPRT

SEQ ID NO: 21954 - protein, 15 aa, Homo sapiens
  heavy chain complementarity determining region 3 for antibody 10977
ASTYHYSGHAPYFDY

SEQ ID NO: 21955 - protein, 9 aa, Homo sapiens
  light chain complementarity determining region 3 for antibody 10978
QQGYNLPYT

SEQ ID NO: 21956 - protein, 18 aa, Homo sapiens
  heavy chain complementarity determining region 3 for antibody 10978
ARLYGYDSAAYFFTHFDY

SEQ ID NO: 21957 - protein, 9 aa, Homo sapiens
  light chain complementarity determining region 3 for antibody 10979
QQYNSYPYT

SEQ ID NO: 21958 - protein, 22 aa, Homo sapiens
  heavy chain complementarity determining region 3 for antibody 10979
ARGRPFPDTHINRNYYYYGMDV

SEQ ID NO: 21959 - protein, 9 aa, Homo sapiens
  light chain complementarity determining region 3 for antibody 10980
QQYNSPLYT

SEQ ID NO: 21960 - protein, 20 aa, Homo sapiens
  heavy chain complementarity determining region 3 for antibody 10980
ARDPTYDISTAYHPHRAIDY

SEQ ID NO: 21961 - protein, 9 aa, Homo sapiens
  light chain complementarity determining region 3 for antibody 10981
QQYGRSPYT

SEQ ID NO: 21962 - protein, 13 aa, Homo sapiens
  heavy chain complementarity determining region 3 for antibody 10981
ARGSRSNSSPYDY

SEQ ID NO: 21963 - protein, 11 aa, Homo sapiens
  light chain complementarity determining region 3 for antibody 10982
QQYADSIRALT

SEQ ID NO: 21964 - protein, 13 aa, Homo sapiens
  heavy chain complementarity determining region 3 for antibody 10982
ARDGVAPGIYFDY

SEQ ID NO: 21965 - protein, 8 aa, Homo sapiens
  light chain complementarity determining region 3 for antibody 10983
QQTYNAVT

SEQ ID NO: 21966 - protein, 18 aa, Homo sapiens
  heavy chain complementarity determining region 3 for antibody 10983
ARQHDYYASGSYFEALDY

SEQ ID NO: 21967 - protein, 9 aa, Homo sapiens
  light chain complementarity determining region 3 for antibody 10984
QQSYSTPFT

SEQ ID NO: 21968 - protein, 14 aa, Homo sapiens
  heavy chain complementarity determining region 3 for antibody 10984
ARLPGIYPRYGMDV

SEQ ID NO: 21969 - protein, 10 aa, Homo sapiens
  light chain complementarity determining region 3 for antibody 10985
QHYDSLPSIT

SEQ ID NO: 21970 - protein, 19 aa, Homo sapiens
  heavy chain complementarity determining region 3 for antibody 10985
TRRLGGYSSGWPRHYGMDV

SEQ ID NO: 21971 - protein, 11 aa, Homo sapiens
  light chain complementarity determining region 3 for antibody 10986
QHYDDFPPMYT

SEQ ID NO: 21972 - protein, 9 aa, Homo sapiens
  heavy chain complementarity determining region 3 for antibody 10986
VRFRAGQEA

SEQ ID NO: 21973 - protein, 10 aa, Homo sapiens
  light chain complementarity determining region 3 for antibody 10987
QQYNSYSLLT

SEQ ID NO: 21974 - protein, 13 aa, Homo sapiens
  heavy chain complementarity determining region 3 for antibody 10987
ARSDYEILTAFDY

SEQ ID NO: 21975 - protein, 9 aa, Homo sapiens
  light chain complementarity determining region 3 for antibody 10988
QQYGSSPWT

SEQ ID NO: 21976 - protein, 19 aa, Homo sapiens
  heavy chain complementarity determining region 3 for antibody 10988
ARSIAAAGSYYFYYYAMDV

SEQ ID NO: 21977 - protein, 9 aa, Homo sapiens
  light chain complementarity determining region 3 for antibody 10989
QQYDSLPLT

SEQ ID NO: 21978 - protein, 13 aa, Homo sapiens
  heavy chain complementarity determining region 3 for antibody 10989
ARCPRYSGSYVIS

SEQ ID NO: 21979 - protein, 10 aa, Homo sapiens
  light chain complementarity determining region 3 for antibody 10990
QQSYTTPSLT

SEQ ID NO: 21980 - protein, 13 aa, Homo sapiens
  heavy chain complementarity determining region 3 for antibody 10990
ARGMVGETGWFDP

SEQ ID NO: 21981 - protein, 10 aa, Homo sapiens
  light chain complementarity determining region 3 for antibody 10991
QQSGTLPRLT

SEQ ID NO: 21982 - protein, 18 aa, Homo sapiens
  heavy chain complementarity determining region 3 for antibody 10991
ARDVGYDSNANYNWYFDL

SEQ ID NO: 21983 - protein, 9 aa, Homo sapiens
  light chain complementarity determining region 3 for antibody 10992
QQFNSYPRT

SEQ ID NO: 21984 - protein, 14 aa, Homo sapiens
  heavy chain complementarity determining region 3 for antibody 10992
AKEGYAIGAFGLDH

SEQ ID NO: 21985 - protein, 8 aa, Homo sapiens
  light chain complementarity determining region 3 for antibody 10993
MQGTHSYT

SEQ ID NO: 21986 - protein, 10 aa, Homo sapiens
  heavy chain complementarity determining region 3 for antibody 10993
ARDNWNSFDY

SEQ ID NO: 21987 - protein, 9 aa, Homo sapiens
  light chain complementarity determining region 3 for antibody 10994
QQYYDTVWT

SEQ ID NO: 21988 - protein, 16 aa, Homo sapiens
  heavy chain complementarity determining region 3 for antibody 10994
TTQGGLWFGYWQGATS

SEQ ID NO: 21989 - protein, 9 aa, Homo sapiens
  light chain complementarity determining region 3 for antibody 10995
QQSYRTPHT

SEQ ID NO: 21990 - protein, 14 aa, Homo sapiens
  heavy chain complementarity determining region 3 for antibody 10995
ARSGHDYGSLGIDS

SEQ ID NO: 21991 - protein, 9 aa, Homo sapiens
  light chain complementarity determining region 3 for antibody 10996
QQGYSFPFT

SEQ ID NO: 21992 - protein, 19 aa, Homo sapiens
  heavy chain complementarity determining region 3 for antibody 10996
ARSDYSGDTDRYYDHGMDV

SEQ ID NO: 21993 - protein, 9 aa, Homo sapiens
  light chain complementarity determining region 3 for antibody 10997
MQALQTPRT

SEQ ID NO: 21994 - protein, 23 aa, Homo sapiens
  heavy chain complementarity determining region 3 for antibody 10997
ARGGYSANDLSPDIPATYYGVDV

SEQ ID NO: 21995 - protein, 10 aa, Homo sapiens
  light chain complementarity determining region 3 for antibody 10998
MQALQTLGGP

SEQ ID NO: 21996 - protein, 13 aa, Homo sapiens
  heavy chain complementarity determining region 3 for antibody 10998
ASVLIGDKRKSTY

SEQ ID NO: 21997 - protein, 9 aa, Homo sapiens
  light chain complementarity determining region 3 for antibody 10999
QQYHSYPYT

SEQ ID NO: 21998 - protein, 17 aa, Homo sapiens
  heavy chain complementarity determining region 3 for antibody 10999
AREQFADVDLRQYYFDY

SEQ ID NO: 21999 - protein, 9 aa, Homo sapiens
  light chain complementarity determining region 3 for antibody 11000
QQYGSSRYT

SEQ ID NO: 22000 - protein, 22 aa, Homo sapiens
  heavy chain complementarity determining region 3 for antibody 11000
ARIYDDSAKQYSAGYYYYAMDV

SEQ ID NO: 22001 - protein, 9 aa, Homo sapiens
  light chain complementarity determining region 3 for antibody 11001
QQSNIFPLT

SEQ ID NO: 22002 - protein, 14 aa, Homo sapiens
  heavy chain complementarity determining region 3 for antibody 11001
ASFGGAVPGNPFDR

SEQ ID NO: 22003 - protein, 9 aa, Homo sapiens
  light chain complementarity determining region 3 for antibody 11002
QQRSNWPRT

SEQ ID NO: 22004 - protein, 21 aa, Homo sapiens
  heavy chain complementarity determining region 3 for antibody 11002
ARDVTYYHDMSSPQTPSWFDP

SEQ ID NO: 22005 - protein, 8 aa, Homo sapiens
  light chain complementarity determining region 3 for antibody 11003
LQYKSYWT

SEQ ID NO: 22006 - protein, 17 aa, Homo sapiens
  heavy chain complementarity determining region 3 for antibody 11003
ARVSAMVRGTFYWYYDL

SEQ ID NO: 22007 - protein, 9 aa, Homo sapiens
  light chain complementarity determining region 3 for antibody 11004
QQYNSYPRT

SEQ ID NO: 22008 - protein, 12 aa, Homo sapiens
  heavy chain complementarity determining region 3 for antibody 11004
AKDREWLAAFDI

SEQ ID NO: 22009 - protein, 9 aa, Homo sapiens
  light chain complementarity determining region 3 for antibody 11005
QQYDELPIT

SEQ ID NO: 22010 - protein, 21 aa, Homo sapiens
  heavy chain complementarity determining region 3 for antibody 11005
ARDLVHYASSGHYGGSDHFQR

SEQ ID NO: 22011 - protein, 9 aa, Homo sapiens
  light chain complementarity determining region 3 for antibody 11006
QQLGSSPFT

SEQ ID NO: 22012 - protein, 13 aa, Homo sapiens
  heavy chain complementarity determining region 3 for antibody 11006
ARHLYSDLIPFDY

SEQ ID NO: 22013 - protein, 9 aa, Homo sapiens
  light chain complementarity determining region 3 for antibody 11007
QQGSYWPPT

SEQ ID NO: 22014 - protein, 15 aa, Homo sapiens
  heavy chain complementarity determining region 3 for antibody 11007
AHYRNGWYSEPIYDY

SEQ ID NO: 22015 - protein, 8 aa, Homo sapiens
  light chain complementarity determining region 3 for antibody 11008
QQCADSLT

SEQ ID NO: 22016 - protein, 20 aa, Homo sapiens
  heavy chain complementarity determining region 3 for antibody 11008
ARDLDDFWSASYTQLLLLYH

SEQ ID NO: 22017 - protein, 8 aa, Homo sapiens
  light chain complementarity determining region 3 for antibody 11009
MQGTYSYT

SEQ ID NO: 22018 - protein, 15 aa, Homo sapiens
  heavy chain complementarity determining region 3 for antibody 11009
AKEGLLWFGEDAFDI

SEQ ID NO: 22019 - protein, 9 aa, Homo sapiens
  light chain complementarity determining region 3 for antibody 11010
LQHDGFPLT

SEQ ID NO: 22020 - protein, 15 aa, Homo sapiens
  heavy chain complementarity determining region 3 for antibody 11010
AHGYSSKWYLFPFDF

SEQ ID NO: 22021 - protein, 11 aa, Homo sapiens
  light chain complementarity determining region 3 for antibody 11011
QQRSNWPPTFT

SEQ ID NO: 22022 - protein, 18 aa, Homo sapiens
  heavy chain complementarity determining region 3 for antibody 11011
ASVLYENSSSGRKYYFDY

SEQ ID NO: 22023 - protein, 9 aa, Homo sapiens
  light chain complementarity determining region 3 for antibody 11012
MQALQTPIT

SEQ ID NO: 22024 - protein, 12 aa, Homo sapiens
  heavy chain complementarity determining region 3 for antibody 11012
AKDSRNKWELLD

SEQ ID NO: 22025 - protein, 9 aa, Homo sapiens
  light chain complementarity determining region 3 for antibody 11013
QQYKDYPWA

SEQ ID NO: 22026 - protein, 13 aa, Homo sapiens
  heavy chain complementarity determining region 3 for antibody 11013
ATGGYDGTIARVD

SEQ ID NO: 22027 - protein, 9 aa, Homo sapiens
  light chain complementarity determining region 3 for antibody 11014
MQALQTLYT

SEQ ID NO: 22028 - protein, 14 aa, Homo sapiens
  heavy chain complementarity determining region 3 for antibody 11014
ARGWGSGRPYGMDV

SEQ ID NO: 22029 - protein, 6 aa, Homo sapiens
  light chain complementarity determining region 3 for antibody 11015
QQYNSR

SEQ ID NO: 22030 - protein, 16 aa, Homo sapiens
  heavy chain complementarity determining region 3 for antibody 11015
ARDHSRTYWDHDAFDM

SEQ ID NO: 22031 - protein, 9 aa, Homo sapiens
  light chain complementarity determining region 3 for antibody 11016
QQRSNWPIT

SEQ ID NO: 22032 - protein, 17 aa, Homo sapiens
  heavy chain complementarity determining region 3 for antibody 11016
TRDRSGWYRGGTFTPAY

SEQ ID NO: 22033 - protein, 9 aa, Homo sapiens
  light chain complementarity determining region 3 for antibody 11017
QQRNNWGLT

SEQ ID NO: 22034 - protein, 22 aa, Homo sapiens
  heavy chain complementarity determining region 3 for antibody 11017
TRHSGYSNTWYMNYYYYYGMDV

SEQ ID NO: 22035 - protein, 9 aa, Homo sapiens
  light chain complementarity determining region 3 for antibody 11018
QHYTIWPYT

SEQ ID NO: 22036 - protein, 11 aa, Homo sapiens
  heavy chain complementarity determining region 3 for antibody 11018
VAEYGPKQWLY

SEQ ID NO: 22037 - protein, 9 aa, Homo sapiens
  light chain complementarity determining region 3 for antibody 11019
QQYGDTPLT

SEQ ID NO: 22038 - protein, 15 aa, Homo sapiens
  heavy chain complementarity determining region 3 for antibody 11019
TKGPGYASSKRYFDL

SEQ ID NO: 22039 - protein, 9 aa, Homo sapiens
  light chain complementarity determining region 3 for antibody 11020
QQSYNIPYT

SEQ ID NO: 22040 - protein, 15 aa, Homo sapiens
  heavy chain complementarity determining region 3 for antibody 11020
ARGGAVRPRYYGMDV

SEQ ID NO: 22041 - protein, 8 aa, Homo sapiens
  light chain complementarity determining region 3 for antibody 11021
MQALQRFT

SEQ ID NO: 22042 - protein, 12 aa, Homo sapiens
  heavy chain complementarity determining region 3 for antibody 11021
ARNGYSYGKFDY

SEQ ID NO: 22043 - protein, 9 aa, Homo sapiens
  light chain complementarity determining region 3 for antibody 11022
QQYNSYSHT

SEQ ID NO: 22044 - protein, 21 aa, Homo sapiens
  heavy chain complementarity determining region 3 for antibody 11022
AREQSYTVAGINYYYYYAMDV

SEQ ID NO: 22045 - protein, 9 aa, Homo sapiens
  light chain complementarity determining region 3 for antibody 11023
QQYNSFPIT

SEQ ID NO: 22046 - protein, 19 aa, Homo sapiens
  heavy chain complementarity determining region 3 for antibody 11023
ARDRDYTIVDDYGSGVIDF

SEQ ID NO: 22047 - protein, 9 aa, Homo sapiens
  light chain complementarity determining region 3 for antibody 11024
QQSYSTPTT

SEQ ID NO: 22048 - protein, 16 aa, Homo sapiens
  heavy chain complementarity determining region 3 for antibody 11024
ARLGWDQEAKRGYFDY

SEQ ID NO: 22049 - protein, 9 aa, Homo sapiens
  light chain complementarity determining region 3 for antibody 11025
QQCYSDPLT

SEQ ID NO: 22050 - protein, 13 aa, Homo sapiens
  heavy chain complementarity determining region 3 for antibody 11025
ARGRSDASDALDV

SEQ ID NO: 22051 - protein, 9 aa, Homo sapiens
  light chain complementarity determining region 3 for antibody 11026
QHRSNWSGT

SEQ ID NO: 22052 - protein, 11 aa, Homo sapiens
  heavy chain complementarity determining region 3 for antibody 11026
ARGEPYGDSDH

SEQ ID NO: 22053 - protein, 9 aa, Homo sapiens
  light chain complementarity determining region 3 for antibody 11027
QQYGWSPDT

SEQ ID NO: 22054 - protein, 13 aa, Homo sapiens
  heavy chain complementarity determining region 3 for antibody 11027
GHPTIAATYGVDV

SEQ ID NO: 22055 - protein, 8 aa, Homo sapiens
  light chain complementarity determining region 3 for antibody 11028
QQYDDLRS

SEQ ID NO: 22056 - protein, 18 aa, Homo sapiens
  heavy chain complementarity determining region 3 for antibody 11028
ARESVYFGELSTYYFFDS

SEQ ID NO: 22057 - protein, 9 aa, Homo sapiens
  light chain complementarity determining region 3 for antibody 11029
QQSYSTPYT

SEQ ID NO: 22058 - protein, 15 aa, Homo sapiens
  heavy chain complementarity determining region 3 for antibody 11029
VKARGSTWGTYRWDV

SEQ ID NO: 22059 - protein, 9 aa, Homo sapiens
  light chain complementarity determining region 3 for antibody 11030
QQSYSAPLS

SEQ ID NO: 22060 - protein, 21 aa, Homo sapiens
  heavy chain complementarity determining region 3 for antibody 11030
ARGSGIMLGGEMYYYYYGMDV

SEQ ID NO: 22061 - protein, 9 aa, Homo sapiens
  light chain complementarity determining region 3 for antibody 11031
QQSFLPPWT

SEQ ID NO: 22062 - protein, 14 aa, Homo sapiens
  heavy chain complementarity determining region 3 for antibody 11031
VRSYETSGDSWFDP

SEQ ID NO: 22063 - protein, 9 aa, Homo sapiens
  light chain complementarity determining region 3 for antibody 11032
LQHNSFPRT

SEQ ID NO: 22064 - protein, 17 aa, Homo sapiens
  heavy chain complementarity determining region 3 for antibody 11032
AREGYCTTGVCYNWFDP

SEQ ID NO: 22065 - protein, 9 aa, Homo sapiens
  light chain complementarity determining region 3 for antibody 11033
QQYYFTPWT

SEQ ID NO: 22066 - protein, 19 aa, Homo sapiens
  heavy chain complementarity determining region 3 for antibody 11033
ARAKREQLVDSYSFHGLDV

SEQ ID NO: 22067 - protein, 9 aa, Homo sapiens
  light chain complementarity determining region 3 for antibody 11034
QQYNSYPYT

SEQ ID NO: 22068 - protein, 17 aa, Homo sapiens
  heavy chain complementarity determining region 3 for antibody 11034
AREDYSDVDLRLFYHDF

SEQ ID NO: 22069 - protein, 11 aa, Homo sapiens
  light chain complementarity determining region 3 for antibody 11035
QQYNNWPPWGT

SEQ ID NO: 22070 - protein, 10 aa, Homo sapiens
  heavy chain complementarity determining region 3 for antibody 11035
AKDLTGDPTG

SEQ ID NO: 22071 - protein, 9 aa, Homo sapiens
  light chain complementarity determining region 3 for antibody 11036
QQSYSTLYT

SEQ ID NO: 22072 - protein, 13 aa, Homo sapiens
  heavy chain complementarity determining region 3 for antibody 11036
ARETRLWGDAFDF

SEQ ID NO: 22073 - protein, 9 aa, Homo sapiens
  light chain complementarity determining region 3 for antibody 11037
QQSQDAPYT

SEQ ID NO: 22074 - protein, 13 aa, Homo sapiens
  heavy chain complementarity determining region 3 for antibody 11037
TRDLRRFLNWFDP

SEQ ID NO: 22075 - protein, 10 aa, Homo sapiens
  light chain complementarity determining region 3 for antibody 11038
QQRSNWPPLT

SEQ ID NO: 22076 - protein, 16 aa, Homo sapiens
  heavy chain complementarity determining region 3 for antibody 11038
ARETYSSGREPYYCDY

SEQ ID NO: 22077 - protein, 9 aa, Homo sapiens
  light chain complementarity determining region 3 for antibody 11039
QQANSFPLT

SEQ ID NO: 22078 - protein, 21 aa, Homo sapiens
  heavy chain complementarity determining region 3 for antibody 11039
VRDRSFGSGSYEYYYYYGMDA

SEQ ID NO: 22079 - protein, 9 aa, Homo sapiens
  light chain complementarity determining region 3 for antibody 11040
LQHNSYPRT

SEQ ID NO: 22080 - protein, 16 aa, Homo sapiens
  heavy chain complementarity determining region 3 for antibody 11040
ARDSVGLGIGEYYFDY

SEQ ID NO: 22081 - protein, 10 aa, Homo sapiens
  light chain complementarity determining region 3 for antibody 11041
QQYHSLSQGT

SEQ ID NO: 22082 - protein, 14 aa, Homo sapiens
  heavy chain complementarity determining region 3 for antibody 11041
AKDSTGDYPSYFDH

SEQ ID NO: 22083 - protein, 9 aa, Homo sapiens
  light chain complementarity determining region 3 for antibody 11042
QQYGSSTYT

SEQ ID NO: 22084 - protein, 21 aa, Homo sapiens
  heavy chain complementarity determining region 3 for antibody 11042
AGIGAGVGDHPLGYYYYAMDV

SEQ ID NO: 22085 - protein, 9 aa, Homo sapiens
  light chain complementarity determining region 3 for antibody 11043
QQYGSSPYT

SEQ ID NO: 22086 - protein, 13 aa, Homo sapiens
  heavy chain complementarity determining region 3 for antibody 11043
ARGTTYASGTYFV

SEQ ID NO: 22087 - protein, 9 aa, Homo sapiens
  light chain complementarity determining region 3 for antibody 11044
QQSDSLPLT

SEQ ID NO: 22088 - protein, 13 aa, Homo sapiens
  heavy chain complementarity determining region 3 for antibody 11044
ARDLGGNYYILDL

SEQ ID NO: 22089 - protein, 9 aa, Homo sapiens
  light chain complementarity determining region 3 for antibody 11045
QQSDIVALT

SEQ ID NO: 22090 - protein, 10 aa, Homo sapiens
  heavy chain complementarity determining region 3 for antibody 11045
ASGRGWESSI

SEQ ID NO: 22091 - protein, 9 aa, Homo sapiens
  light chain complementarity determining region 3 for antibody 11046
QQLHGYPLT

SEQ ID NO: 22092 - protein, 11 aa, Homo sapiens
  heavy chain complementarity determining region 3 for antibody 11046
AKDTQWQPFDH

SEQ ID NO: 22093 - protein, 10 aa, Homo sapiens
  light chain complementarity determining region 3 for antibody 11047
MQGTHWPPIT

SEQ ID NO: 22094 - protein, 8 aa, Homo sapiens
  heavy chain complementarity determining region 3 for antibody 11047
VTLFGFDD

SEQ ID NO: 22095 - protein, 9 aa, Homo sapiens
  light chain complementarity determining region 3 for antibody 11048
QQYYTIPGT

SEQ ID NO: 22096 - protein, 16 aa, Homo sapiens
  heavy chain complementarity determining region 3 for antibody 11048
ARRRCSGGSCYGVVDY

SEQ ID NO: 22097 - protein, 10 aa, Homo sapiens
  light chain complementarity determining region 3 for antibody 11049
QQYNDWPAYT

SEQ ID NO: 22098 - protein, 9 aa, Homo sapiens
  heavy chain complementarity determining region 3 for antibody 11049
ARKGKVIDG

SEQ ID NO: 22099 - protein, 9 aa, Homo sapiens
  light chain complementarity determining region 3 for antibody 11050
QHYDNLPLT

SEQ ID NO: 22100 - protein, 10 aa, Homo sapiens
  heavy chain complementarity determining region 3 for antibody 11050
ARSRRYGFDI

SEQ ID NO: 22101 - protein, 9 aa, Homo sapiens
  light chain complementarity determining region 3 for antibody 11051
MQALQTPFT

SEQ ID NO: 22102 - protein, 14 aa, Homo sapiens
  heavy chain complementarity determining region 3 for antibody 11051
ARDLLGDISAYFDH

SEQ ID NO: 22103 - protein, 9 aa, Homo sapiens
  light chain complementarity determining region 3 for antibody 11052
QQYNSYPYT

SEQ ID NO: 22104 - protein, 18 aa, Homo sapiens
  heavy chain complementarity determining region 3 for antibody 11052
ARTRVGVYSGGSPFMFDP

SEQ ID NO: 22105 - protein, 9 aa, Homo sapiens
  light chain complementarity determining region 3 for antibody 11053
QQYGSSPRT

SEQ ID NO: 22106 - protein, 14 aa, Homo sapiens
  heavy chain complementarity determining region 3 for antibody 11053
ATDSALLGYGELTN

SEQ ID NO: 22107 - protein, 9 aa, Homo sapiens
  light chain complementarity determining region 3 for antibody 11054
QQYDTYPWT

SEQ ID NO: 22108 - protein, 16 aa, Homo sapiens
  heavy chain complementarity determining region 3 for antibody 11054
AALGSGSLYDPYAFDV

SEQ ID NO: 22109 - protein, 9 aa, Homo sapiens
  light chain complementarity determining region 3 for antibody 11055
QQANSFPLT

SEQ ID NO: 22110 - protein, 19 aa, Homo sapiens
  heavy chain complementarity determining region 3 for antibody 11055
ANFRLTSYDSYYYYYGMDV

SEQ ID NO: 22111 - protein, 9 aa, Homo sapiens
  light chain complementarity determining region 3 for antibody 11056
QKYNSAPLT

SEQ ID NO: 22112 - protein, 22 aa, Homo sapiens
  heavy chain complementarity determining region 3 for antibody 11056
ARGGPERDYYDSIDSIYDAFDI

SEQ ID NO: 22113 - protein, 8 aa, Homo sapiens
  light chain complementarity determining region 3 for antibody 11057
QQYYGVKT

SEQ ID NO: 22114 - protein, 9 aa, Homo sapiens
  heavy chain complementarity determining region 3 for antibody 11057
VKEAYYFDI

SEQ ID NO: 22115 - protein, 9 aa, Homo sapiens
  light chain complementarity determining region 3 for antibody 11058
QQYHNVPPA

SEQ ID NO: 22116 - protein, 16 aa, Homo sapiens
  heavy chain complementarity determining region 3 for antibody 11058
ARDHAYYYDSGSPSYY

SEQ ID NO: 22117 - protein, 9 aa, Homo sapiens
  light chain complementarity determining region 3 for antibody 11059
QQYGSSPIT

SEQ ID NO: 22118 - protein, 16 aa, Homo sapiens
  heavy chain complementarity determining region 3 for antibody 11059
ATYHCSRNICYANFDS

SEQ ID NO: 22119 - protein, 11 aa, Homo sapiens
  light chain complementarity determining region 3 for antibody 11060
QQNDNLLPMYT

SEQ ID NO: 22120 - protein, 8 aa, Homo sapiens
  heavy chain complementarity determining region 3 for antibody 11060
AKEGWFDP

SEQ ID NO: 22121 - protein, 9 aa, Homo sapiens
  light chain complementarity determining region 3 for antibody 11061
QHRRNWPRT

SEQ ID NO: 22122 - protein, 13 aa, Homo sapiens
  heavy chain complementarity determining region 3 for antibody 11061
ARSYYPGDNWFDP

SEQ ID NO: 22123 - protein, 9 aa, Homo sapiens
  light chain complementarity determining region 3 for antibody 11062
QQYNSYPPT

SEQ ID NO: 22124 - protein, 14 aa, Homo sapiens
  heavy chain complementarity determining region 3 for antibody 11062
ARVFVIAAAGTYDY

SEQ ID NO: 22125 - protein, 9 aa, Homo sapiens
  light chain complementarity determining region 3 for antibody 11063
QQSYTTPYS

SEQ ID NO: 22126 - protein, 12 aa, Homo sapiens
  heavy chain complementarity determining region 3 for antibody 11063
ASLSHFEMAIDY

SEQ ID NO: 22127 - protein, 9 aa, Homo sapiens
  light chain complementarity determining region 3 for antibody 11064
QQSYSAPLT

SEQ ID NO: 22128 - protein, 17 aa, Homo sapiens
  heavy chain complementarity determining region 3 for antibody 11064
ASQSCSGAICPKDAFDI

SEQ ID NO: 22129 - protein, 11 aa, Homo sapiens
  light chain complementarity determining region 3 for antibody 11065
QQRRNWPPEPT

SEQ ID NO: 22130 - protein, 18 aa, Homo sapiens
  heavy chain complementarity determining region 3 for antibody 11065
AKDADCNGGNCYLFYFDY

SEQ ID NO: 22131 - protein, 9 aa, Homo sapiens
  light chain complementarity determining region 3 for antibody 11066
QQAYSFPHT

SEQ ID NO: 22132 - protein, 17 aa, Homo sapiens
  heavy chain complementarity determining region 3 for antibody 11066
AKDLDTPMDYYFYGMDV

SEQ ID NO: 22133 - protein, 9 aa, Homo sapiens
  light chain complementarity determining region 3 for antibody 11067
QKYNSAPLT

SEQ ID NO: 22134 - protein, 22 aa, Homo sapiens
  heavy chain complementarity determining region 3 for antibody 11067
ARDRWFRIEEDGFRTIRHPFDY

SEQ ID NO: 22135 - protein, 9 aa, Homo sapiens
  light chain complementarity determining region 3 for antibody 11068
LQDYYSPPT

SEQ ID NO: 22136 - protein, 10 aa, Homo sapiens
  heavy chain complementarity determining region 3 for antibody 11068
ARDLRGGDDY

SEQ ID NO: 22137 - protein, 9 aa, Homo sapiens
  light chain complementarity determining region 3 for antibody 11069
HHYHSFPYT

SEQ ID NO: 22138 - protein, 17 aa, Homo sapiens
  heavy chain complementarity determining region 3 for antibody 11069
AREDWNDVDMREFYFDY

SEQ ID NO: 22139 - protein, 9 aa, Homo sapiens
  light chain complementarity determining region 3 for antibody 11070
QQTYSTVLT

SEQ ID NO: 22140 - protein, 13 aa, Homo sapiens
  heavy chain complementarity determining region 3 for antibody 11070
ARGPWDGYNYQDF

SEQ ID NO: 22141 - protein, 9 aa, Homo sapiens
  light chain complementarity determining region 3 for antibody 11071
QQSYSTPYT

SEQ ID NO: 22142 - protein, 18 aa, Homo sapiens
  heavy chain complementarity determining region 3 for antibody 11071
ARVPALRRTGYWFRWFDP

SEQ ID NO: 22143 - protein, 8 aa, Homo sapiens
  light chain complementarity determining region 3 for antibody 11072
QQSYSTPR

SEQ ID NO: 22144 - protein, 15 aa, Homo sapiens
  heavy chain complementarity determining region 3 for antibody 11072
AGIVGSGSYSSALDI

SEQ ID NO: 22145 - protein, 8 aa, Homo sapiens
  light chain complementarity determining region 3 for antibody 11073
QQYNSYPT

SEQ ID NO: 22146 - protein, 15 aa, Homo sapiens
  heavy chain complementarity determining region 3 for antibody 11073
ARVDRATGLRYYFDY

SEQ ID NO: 22147 - protein, 9 aa, Homo sapiens
  light chain complementarity determining region 3 for antibody 11074
QQSYTTPPT

SEQ ID NO: 22148 - protein, 15 aa, Homo sapiens
  heavy chain complementarity determining region 3 for antibody 11074
ARVSGTDRGGDHFDK

SEQ ID NO: 22149 - protein, 11 aa, Homo sapiens
  light chain complementarity determining region 3 for antibody 11075
QQLNSYPLAFT

SEQ ID NO: 22150 - protein, 15 aa, Homo sapiens
  heavy chain complementarity determining region 3 for antibody 11075
GLSNTSGYDYYGMDV

SEQ ID NO: 22151 - protein, 9 aa, Homo sapiens
  light chain complementarity determining region 3 for antibody 11076
QQANSFPPT

SEQ ID NO: 22152 - protein, 15 aa, Homo sapiens
  heavy chain complementarity determining region 3 for antibody 11076
TREPHNSGSYYGYHY

SEQ ID NO: 22153 - protein, 9 aa, Homo sapiens
  light chain complementarity determining region 3 for antibody 11077
LQDHIYPLT

SEQ ID NO: 22154 - protein, 14 aa, Homo sapiens
  heavy chain complementarity determining region 3 for antibody 11077
ALGLDSGGNYPYAY

SEQ ID NO: 22155 - protein, 9 aa, Homo sapiens
  light chain complementarity determining region 3 for antibody 11078
QQYDNFPPT

SEQ ID NO: 22156 - protein, 20 aa, Homo sapiens
  heavy chain complementarity determining region 3 for antibody 11078
ARLLGYCSGGSCQAHKLFDY

SEQ ID NO: 22157 - protein, 9 aa, Homo sapiens
  light chain complementarity determining region 3 for antibody 11079
QQGHSFPFT

SEQ ID NO: 22158 - protein, 19 aa, Homo sapiens
  heavy chain complementarity determining region 3 for antibody 11079
ARSDYSGETDRYYDYGMDV

SEQ ID NO: 22159 - protein, 9 aa, Homo sapiens
  light chain complementarity determining region 3 for antibody 11080
QQANIFPLT

SEQ ID NO: 22160 - protein, 25 aa, Homo sapiens
  heavy chain complementarity determining region 3 for antibody 11080
ARDHLGNTVGSTTSFLRYYYYGMDV

SEQ ID NO: 22161 - protein, 9 aa, Homo sapiens
  light chain complementarity determining region 3 for antibody 11081
QHYNDYSRT

SEQ ID NO: 22162 - protein, 20 aa, Homo sapiens
  heavy chain complementarity determining region 3 for antibody 11081
VRDMRVARPDEDYYYYGMDV

SEQ ID NO: 22163 - protein, 10 aa, Homo sapiens
  light chain complementarity determining region 3 for antibody 11082
MQGLQTPPIT

SEQ ID NO: 22164 - protein, 21 aa, Homo sapiens
  heavy chain complementarity determining region 3 for antibody 11082
ARGYYYGSGSYYNSFYYGMDV

SEQ ID NO: 22165 - protein, 9 aa, Homo sapiens
  light chain complementarity determining region 3 for antibody 11083
MQALLTPIT

SEQ ID NO: 22166 - protein, 19 aa, Homo sapiens
  heavy chain complementarity determining region 3 for antibody 11083
ARGDFHYYSGSGGSFGMDV

SEQ ID NO: 22167 - protein, 9 aa, Homo sapiens
  light chain complementarity determining region 3 for antibody 11084
QQYNSYAWT

SEQ ID NO: 22168 - protein, 15 aa, Homo sapiens
  heavy chain complementarity determining region 3 for antibody 11084
ARAPYSGSSPGAFDY

SEQ ID NO: 22169 - protein, 10 aa, Homo sapiens
  light chain complementarity determining region 3 for antibody 11085
QQYKNWPPLT

SEQ ID NO: 22170 - protein, 15 aa, Homo sapiens
  heavy chain complementarity determining region 3 for antibody 11085
ARVVSGWYAPRWFDT

SEQ ID NO: 22171 - protein, 10 aa, Homo sapiens
  light chain complementarity determining region 3 for antibody 11086
QQYIKWPPWT

SEQ ID NO: 22172 - protein, 9 aa, Homo sapiens
  heavy chain complementarity determining region 3 for antibody 11086
VTGYSYGDT

SEQ ID NO: 22173 - protein, 9 aa, Homo sapiens
  light chain complementarity determining region 3 for antibody 11087
QQYGSSPFT

SEQ ID NO: 22174 - protein, 17 aa, Homo sapiens
  heavy chain complementarity determining region 3 for antibody 11087
AREDDWQQLAKGGFFDY

SEQ ID NO: 22175 - protein, 10 aa, Homo sapiens
  light chain complementarity determining region 3 for antibody 11088
QQYDNLPPIT

SEQ ID NO: 22176 - protein, 15 aa, Homo sapiens
  heavy chain complementarity determining region 3 for antibody 11088
AKDTEYTYGFGAMDV

SEQ ID NO: 22177 - protein, 9 aa, Homo sapiens
  light chain complementarity determining region 3 for antibody 11089
QKYNSAPGT

SEQ ID NO: 22178 - protein, 13 aa, Homo sapiens
  heavy chain complementarity determining region 3 for antibody 11089
AHRASGSYFLFDY

SEQ ID NO: 22179 - protein, 11 aa, Homo sapiens
  light chain complementarity determining region 3 for antibody 11090
QEYDRLPPRVT

SEQ ID NO: 22180 - protein, 22 aa, Homo sapiens
  heavy chain complementarity determining region 3 for antibody 11090
AHNQKHSYAAFSGAFYYYALDV

SEQ ID NO: 22181 - protein, 9 aa, Homo sapiens
  light chain complementarity determining region 3 for antibody 11091
QQYYTYPWT

SEQ ID NO: 22182 - protein, 17 aa, Homo sapiens
  heavy chain complementarity determining region 3 for antibody 11091
ARRSGLYYFDAHNYFDY

SEQ ID NO: 22183 - protein, 8 aa, Homo sapiens
  light chain complementarity determining region 3 for antibody 11092
QQYNTYWT

SEQ ID NO: 22184 - protein, 19 aa, Homo sapiens
  heavy chain complementarity determining region 3 for antibody 11092
AKGRGQYVGRGAAYYGLDV

SEQ ID NO: 22185 - protein, 8 aa, Homo sapiens
  light chain complementarity determining region 3 for antibody 11093
QQYGSSPT

SEQ ID NO: 22186 - protein, 20 aa, Homo sapiens
  heavy chain complementarity determining region 3 for antibody 11093
ARDPRRGQTVYTNHVWWFDP

SEQ ID NO: 22187 - protein, 9 aa, Homo sapiens
  light chain complementarity determining region 3 for antibody 11094
QQYDSLPLT

SEQ ID NO: 22188 - protein, 16 aa, Homo sapiens
  heavy chain complementarity determining region 3 for antibody 11094
AKDKILRYFDWLLFDS

SEQ ID NO: 22189 - protein, 9 aa, Homo sapiens
  light chain complementarity determining region 3 for antibody 11095
QQSYDTMWT

SEQ ID NO: 22190 - protein, 14 aa, Homo sapiens
  heavy chain complementarity determining region 3 for antibody 11095
ARQGRGATGRYFDP

SEQ ID NO: 22191 - protein, 11 aa, Homo sapiens
  light chain complementarity determining region 3 for antibody 11096
QQRSTWPLSLT

SEQ ID NO: 22192 - protein, 12 aa, Homo sapiens
  heavy chain complementarity determining region 3 for antibody 11096
AKNLGVGTSTDF

SEQ ID NO: 22193 - protein, 9 aa, Homo sapiens
  light chain complementarity determining region 3 for antibody 11097
QQLNTYPWT

SEQ ID NO: 22194 - protein, 9 aa, Homo sapiens
  heavy chain complementarity determining region 3 for antibody 11097
ARYLGAFDL

SEQ ID NO: 22195 - protein, 9 aa, Homo sapiens
  light chain complementarity determining region 3 for antibody 11098
QQADSFPLT

SEQ ID NO: 22196 - protein, 15 aa, Homo sapiens
  heavy chain complementarity determining region 3 for antibody 11098
ARDPGYSSAWNYFDC

SEQ ID NO: 22197 - protein, 9 aa, Homo sapiens
  light chain complementarity determining region 3 for antibody 11099
LQHNSYPVT

SEQ ID NO: 22198 - protein, 20 aa, Homo sapiens
  heavy chain complementarity determining region 3 for antibody 11099
ARDRGKSFGIIVGTQYGTDV

SEQ ID NO: 22199 - protein, 9 aa, Homo sapiens
  light chain complementarity determining region 3 for antibody 11100
QQYVTTPRT

SEQ ID NO: 22200 - protein, 12 aa, Homo sapiens
  heavy chain complementarity determining region 3 for antibody 11100
ARDVGWYWYFDF

SEQ ID NO: 22201 - protein, 9 aa, Homo sapiens
  light chain complementarity determining region 3 for antibody 11101
QQYVSSPLT

SEQ ID NO: 22202 - protein, 12 aa, Homo sapiens
  heavy chain complementarity determining region 3 for antibody 11101
ARQDGDYRHFDY

SEQ ID NO: 22203 - protein, 8 aa, Homo sapiens
  light chain complementarity determining region 3 for antibody 11102
QQYDNLIT

SEQ ID NO: 22204 - protein, 21 aa, Homo sapiens
  heavy chain complementarity determining region 3 for antibody 11102
AKDRSADTTMDGYYYYSALDV

SEQ ID NO: 22205 - protein, 10 aa, Homo sapiens
  light chain complementarity determining region 3 for antibody 11103
QQSYSSHMYT

SEQ ID NO: 22206 - protein, 21 aa, Homo sapiens
  heavy chain complementarity determining region 3 for antibody 11103
ARGYLESLYGDYLHYYYAMDV

SEQ ID NO: 22207 - protein, 9 aa, Homo sapiens
  light chain complementarity determining region 3 for antibody 11104
QQRSRWPPS

SEQ ID NO: 22208 - protein, 13 aa, Homo sapiens
  heavy chain complementarity determining region 3 for antibody 11104
ARTYGSGDSLDDY

SEQ ID NO: 22209 - protein, 9 aa, Homo sapiens
  light chain complementarity determining region 3 for antibody 11105
QQADSFPIT

SEQ ID NO: 22210 - protein, 18 aa, Homo sapiens
  heavy chain complementarity determining region 3 for antibody 11105
AHTSAYYESDDPTHYFNS

SEQ ID NO: 22211 - protein, 11 aa, Homo sapiens
  light chain complementarity determining region 3 for antibody 11106
QHNGSSPPENT

SEQ ID NO: 22212 - protein, 17 aa, Homo sapiens
  heavy chain complementarity determining region 3 for antibody 11106
ARETYDVLTGSNFGMDV

SEQ ID NO: 22213 - protein, 9 aa, Homo sapiens
  light chain complementarity determining region 3 for antibody 11107
QQYVNVALT

SEQ ID NO: 22214 - protein, 15 aa, Homo sapiens
  heavy chain complementarity determining region 3 for antibody 11107
VKYDSSGYYYGRLDY

SEQ ID NO: 22215 - protein, 9 aa, Homo sapiens
  light chain complementarity determining region 3 for antibody 11108
QQYSTFPYT

SEQ ID NO: 22216 - protein, 15 aa, Homo sapiens
  heavy chain complementarity determining region 3 for antibody 11108
AKDREYRSSWSPFDY

SEQ ID NO: 22217 - protein, 8 aa, Homo sapiens
  light chain complementarity determining region 3 for antibody 11109
QQYNHWPL

SEQ ID NO: 22218 - protein, 14 aa, Homo sapiens
  heavy chain complementarity determining region 3 for antibody 11109
ARSLKGWEFLYFEL

SEQ ID NO: 22219 - protein, 9 aa, Homo sapiens
  light chain complementarity determining region 3 for antibody 11110
QQYENWPLT

SEQ ID NO: 22220 - protein, 22 aa, Homo sapiens
  heavy chain complementarity determining region 3 for antibody 11110
AKGLCSITSCYEAHYYYNGMDV

SEQ ID NO: 22221 - protein, 9 aa, Homo sapiens
  light chain complementarity determining region 3 for antibody 11111
QQYDSSSLT

SEQ ID NO: 22222 - protein, 21 aa, Homo sapiens
  heavy chain complementarity determining region 3 for antibody 11111
AHTESTTIFGVVLSYYNWFDP

SEQ ID NO: 22223 - protein, 9 aa, Homo sapiens
  light chain complementarity determining region 3 for antibody 11112
QQSYSTPLT

SEQ ID NO: 22224 - protein, 15 aa, Homo sapiens
  heavy chain complementarity determining region 3 for antibody 11112
ARDSDDSGGLYRFED

SEQ ID NO: 22225 - protein, 9 aa, Homo sapiens
  light chain complementarity determining region 3 for antibody 11113
QQANIFPLT

SEQ ID NO: 22226 - protein, 25 aa, Homo sapiens
  heavy chain complementarity determining region 3 for antibody 11113
ARDHLGNIVGSAPSFLRYYYHGLEV

SEQ ID NO: 22227 - protein, 10 aa, Homo sapiens
  light chain complementarity determining region 3 for antibody 11114
QLYDNLLSIT

SEQ ID NO: 22228 - protein, 15 aa, Homo sapiens
  heavy chain complementarity determining region 3 for antibody 11114
ARQDHGDYYYSGLDV

SEQ ID NO: 22229 - protein, 9 aa, Homo sapiens
  light chain complementarity determining region 3 for antibody 11115
MQGTHWPWT

SEQ ID NO: 22230 - protein, 12 aa, Homo sapiens
  heavy chain complementarity determining region 3 for antibody 11115
VHVSGWPYYFDQ

SEQ ID NO: 22231 - protein, 9 aa, Homo sapiens
  light chain complementarity determining region 3 for antibody 11116
MQALQTSIT

SEQ ID NO: 22232 - protein, 14 aa, Homo sapiens
  heavy chain complementarity determining region 3 for antibody 11116
ARMWWTQLDHGVDF

SEQ ID NO: 22233 - protein, 9 aa, Homo sapiens
  light chain complementarity determining region 3 for antibody 11117
QQYGSSPLT

SEQ ID NO: 22234 - protein, 12 aa, Homo sapiens
  heavy chain complementarity determining region 3 for antibody 11117
AAWYSSWSAFEY

SEQ ID NO: 22235 - protein, 9 aa, Homo sapiens
  light chain complementarity determining region 3 for antibody 11118
QQSYSTPGT

SEQ ID NO: 22236 - protein, 16 aa, Homo sapiens
  heavy chain complementarity determining region 3 for antibody 11118
AKDKILRYFDWLLFDS

SEQ ID NO: 22237 - protein, 9 aa, Homo sapiens
  light chain complementarity determining region 3 for antibody 11119
QQRNTWGLT

SEQ ID NO: 22238 - protein, 22 aa, Homo sapiens
  heavy chain complementarity determining region 3 for antibody 11119
ARHSGYSNTWYMNYYYYYGMDV

SEQ ID NO: 22239 - protein, 8 aa, Homo sapiens
  light chain complementarity determining region 3 for antibody 11120
QQCCIPLP

SEQ ID NO: 22240 - protein, 26 aa, Homo sapiens
  heavy chain complementarity determining region 3 for antibody 11120
ARPNPSLGGYCHGGSCPDYYYYGLDV

SEQ ID NO: 22241 - protein, 9 aa, Homo sapiens
  light chain complementarity determining region 3 for antibody 11121
QVAYRFPLT

SEQ ID NO: 22242 - protein, 13 aa, Homo sapiens
  heavy chain complementarity determining region 3 for antibody 11121
ARTYNSGRNWFDT

SEQ ID NO: 22243 - protein, 10 aa, Homo sapiens
  light chain complementarity determining region 3 for antibody 11122
QRYGWSPPDT

SEQ ID NO: 22244 - protein, 12 aa, Homo sapiens
  heavy chain complementarity determining region 3 for antibody 11122
AGDPGLRNGADV

SEQ ID NO: 22245 - protein, 9 aa, Homo sapiens
  light chain complementarity determining region 3 for antibody 11123
QQYYSYPII

SEQ ID NO: 22246 - protein, 14 aa, Homo sapiens
  heavy chain complementarity determining region 3 for antibody 11123
TKCVPGDHISRIEY

SEQ ID NO: 22247 - protein, 9 aa, Homo sapiens
  light chain complementarity determining region 3 for antibody 11124
QQYQSYPLT

SEQ ID NO: 22248 - protein, 10 aa, Homo sapiens
  heavy chain complementarity determining region 3 for antibody 11124
ATDLEQAGDN

SEQ ID NO: 22249 - protein, 9 aa, Homo sapiens
  light chain complementarity determining region 3 for antibody 11125
QQYNSYPIT

SEQ ID NO: 22250 - protein, 14 aa, Homo sapiens
  heavy chain complementarity determining region 3 for antibody 11125
TRHHSSSWANWFDP

SEQ ID NO: 22251 - protein, 9 aa, Homo sapiens
  light chain complementarity determining region 3 for antibody 11126
QQYKTLPLT

SEQ ID NO: 22252 - protein, 19 aa, Homo sapiens
  heavy chain complementarity determining region 3 for antibody 11126
ARDRDYTIVDDYGSGDFDY

SEQ ID NO: 22253 - protein, 9 aa, Homo sapiens
  light chain complementarity determining region 3 for antibody 11127
QQYDNYRLT

SEQ ID NO: 22254 - protein, 15 aa, Homo sapiens
  heavy chain complementarity determining region 3 for antibody 11127
ATHQGVFRAAYGMDL

SEQ ID NO: 22255 - protein, 9 aa, Homo sapiens
  light chain complementarity determining region 3 for antibody 11128
QQTYSAPYT

SEQ ID NO: 22256 - protein, 18 aa, Homo sapiens
  heavy chain complementarity determining region 3 for antibody 11128
ARDVYCSGGSCYENWFDP

SEQ ID NO: 22257 - protein, 9 aa, Homo sapiens
  light chain complementarity determining region 3 for antibody 11129
QQINTFPLA

SEQ ID NO: 22258 - protein, 11 aa, Homo sapiens
  heavy chain complementarity determining region 3 for antibody 11129
ARHPPYSPFDH

SEQ ID NO: 22259 - protein, 10 aa, Homo sapiens
  light chain complementarity determining region 3 for antibody 11130
QHSYSNPPWT

SEQ ID NO: 22260 - protein, 11 aa, Homo sapiens
  heavy chain complementarity determining region 3 for antibody 11130
ARVKLANAFDI

SEQ ID NO: 22261 - protein, 9 aa, Homo sapiens
  light chain complementarity determining region 3 for antibody 11131
MQALQTPYT

SEQ ID NO: 22262 - protein, 19 aa, Homo sapiens
  heavy chain complementarity determining region 3 for antibody 11131
ARLDRYCSGSRCYSFWFDP

SEQ ID NO: 22263 - protein, 6 aa, Homo sapiens
  light chain complementarity determining region 3 for antibody 11132
MQALQT

SEQ ID NO: 22264 - protein, 15 aa, Homo sapiens
  heavy chain complementarity determining region 3 for antibody 11132
ARGLLDTAMAFSFDY

SEQ ID NO: 22265 - protein, 10 aa, Homo sapiens
  light chain complementarity determining region 3 for antibody 11133
QQYDNLPPLT

SEQ ID NO: 22266 - protein, 20 aa, Homo sapiens
  heavy chain complementarity determining region 3 for antibody 11133
AKHTDLYFGTERTVGYWCDT

SEQ ID NO: 22267 - protein, 10 aa, Homo sapiens
  light chain complementarity determining region 3 for antibody 11134
QQYVNSALFT

SEQ ID NO: 22268 - protein, 16 aa, Homo sapiens
  heavy chain complementarity determining region 3 for antibody 11134
AREIFKGEIDYYAMDV

SEQ ID NO: 22269 - protein, 9 aa, Homo sapiens
  light chain complementarity determining region 3 for antibody 11135
QQYNTFPIT

SEQ ID NO: 22270 - protein, 19 aa, Homo sapiens
  heavy chain complementarity determining region 3 for antibody 11135
ARDRDYTIVDDSGSGVIDF

SEQ ID NO: 22271 - protein, 9 aa, Homo sapiens
  light chain complementarity determining region 3 for antibody 11136
QQYHTYSWT

SEQ ID NO: 22272 - protein, 15 aa, Homo sapiens
  heavy chain complementarity determining region 3 for antibody 11136
ARGDYYYDSSSHPLY

SEQ ID NO: 22273 - protein, 10 aa, Homo sapiens
  light chain complementarity determining region 3 for antibody 11137
QQYGSSPAWT

SEQ ID NO: 22274 - protein, 17 aa, Homo sapiens
  heavy chain complementarity determining region 3 for antibody 11137
ARDRSQGVLGYYYGMDV

SEQ ID NO: 22275 - protein, 9 aa, Homo sapiens
  light chain complementarity determining region 3 for antibody 11138
QQYGSSLYT

SEQ ID NO: 22276 - protein, 21 aa, Homo sapiens
  heavy chain complementarity determining region 3 for antibody 11138
AREGRKQLGRIDYYFYHAMDV

SEQ ID NO: 22277 - protein, 9 aa, Homo sapiens
  light chain complementarity determining region 3 for antibody 11139
QQYFTSPPT

SEQ ID NO: 22278 - protein, 20 aa, Homo sapiens
  heavy chain complementarity determining region 3 for antibody 11139
TRGMLYGSNYFNFGYWNFDL

SEQ ID NO: 22279 - protein, 7 aa, Homo sapiens
  light chain complementarity determining region 3 for antibody 11140
QQYDNLF

SEQ ID NO: 22280 - protein, 13 aa, Homo sapiens
  heavy chain complementarity determining region 3 for antibody 11140
ASGLHSGYDYFDY

SEQ ID NO: 22281 - protein, 11 aa, Homo sapiens
  light chain complementarity determining region 3 for antibody 11141
QQYDNFPPRFT

SEQ ID NO: 22282 - protein, 9 aa, Homo sapiens
  heavy chain complementarity determining region 3 for antibody 11141
TRRMVGFDY

SEQ ID NO: 22283 - protein, 9 aa, Homo sapiens
  light chain complementarity determining region 3 for antibody 11142
QQSYSIPYT

SEQ ID NO: 22284 - protein, 15 aa, Homo sapiens
  heavy chain complementarity determining region 3 for antibody 11142
ARGGAVRPRYYGMDV

SEQ ID NO: 22285 - protein, 9 aa, Homo sapiens
  light chain complementarity determining region 3 for antibody 11143
QQYDSYPQT

SEQ ID NO: 22286 - protein, 9 aa, Homo sapiens
  heavy chain complementarity determining region 3 for antibody 11143
ARDLLGIDY

SEQ ID NO: 22287 - protein, 8 aa, Homo sapiens
  light chain complementarity determining region 3 for antibody 11144
QQYDNLLT

SEQ ID NO: 22288 - protein, 11 aa, Homo sapiens
  heavy chain complementarity determining region 3 for antibody 11144
GRSHTENAFDI

SEQ ID NO: 22289 - protein, 9 aa, Homo sapiens
  light chain complementarity determining region 3 for antibody 11145
QQSYSTPYT

SEQ ID NO: 22290 - protein, 15 aa, Homo sapiens
  heavy chain complementarity determining region 3 for antibody 11145
AKDNGVGIGVAGLDH

SEQ ID NO: 22291 - protein, 9 aa, Homo sapiens
  light chain complementarity determining region 3 for antibody 11146
QQSYSAPLT

SEQ ID NO: 22292 - protein, 12 aa, Homo sapiens
  heavy chain complementarity determining region 3 for antibody 11146
AKEYLAYGSGDY

SEQ ID NO: 22293 - protein, 10 aa, Homo sapiens
  light chain complementarity determining region 3 for antibody 11147
QESYSTPPFT

SEQ ID NO: 22294 - protein, 27 aa, Homo sapiens
  heavy chain complementarity determining region 3 for antibody 11147
ARPRRVLSLGESFAPPTGLWDYYGLDV

SEQ ID NO: 22295 - protein, 9 aa, Homo sapiens
  light chain complementarity determining region 3 for antibody 11148
MQATHWPRA

SEQ ID NO: 22296 - protein, 15 aa, Homo sapiens
  heavy chain complementarity determining region 3 for antibody 11148
ARDGAPLVAAGTVDY

SEQ ID NO: 22297 - protein, 9 aa, Homo sapiens
  light chain complementarity determining region 3 for antibody 11149
MERTHWPPP

SEQ ID NO: 22298 - protein, 14 aa, Homo sapiens
  heavy chain complementarity determining region 3 for antibody 11149
ARVEVMVGATHFDS

SEQ ID NO: 22299 - protein, 8 aa, Homo sapiens
  light chain complementarity determining region 3 for antibody 11150
QQYHNLVT

SEQ ID NO: 22300 - protein, 21 aa, Homo sapiens
  heavy chain complementarity determining region 3 for antibody 11150
ASNLLIHCTITSCSHTNWFDP

SEQ ID NO: 22301 - protein, 9 aa, Homo sapiens
  light chain complementarity determining region 3 for antibody 11151
QQYDSYPYT

SEQ ID NO: 22302 - protein, 17 aa, Homo sapiens
  heavy chain complementarity determining region 3 for antibody 11151
AREQYNDVDLREYYFDF

SEQ ID NO: 22303 - protein, 9 aa, Homo sapiens
  light chain complementarity determining region 3 for antibody 11152
QQYDNLPLT

SEQ ID NO: 22304 - protein, 13 aa, Homo sapiens
  heavy chain complementarity determining region 3 for antibody 11152
VRESMFYGDPLDS

SEQ ID NO: 22305 - protein, 7 aa, Homo sapiens
  light chain complementarity determining region 3 for antibody 11153
QQSYSTP

SEQ ID NO: 22306 - protein, 13 aa, Homo sapiens
  heavy chain complementarity determining region 3 for antibody 11153
ASSFCSGGSCYDY

SEQ ID NO: 22307 - protein, 9 aa, Homo sapiens
  light chain complementarity determining region 3 for antibody 11154
QQYSSYSST

SEQ ID NO: 22308 - protein, 16 aa, Homo sapiens
  heavy chain complementarity determining region 3 for antibody 11154
ARGNRGVINYYYVMDV

SEQ ID NO: 22309 - protein, 9 aa, Homo sapiens
  light chain complementarity determining region 3 for antibody 11155
QQYGSSRYT

SEQ ID NO: 22310 - protein, 22 aa, Homo sapiens
  heavy chain complementarity determining region 3 for antibody 11155
ARIYDSSGSYYSAGYYYYAMDV

SEQ ID NO: 22311 - protein, 9 aa, Homo sapiens
  light chain complementarity determining region 3 for antibody 11156
QQYGSSPRT

SEQ ID NO: 22312 - protein, 12 aa, Homo sapiens
  heavy chain complementarity determining region 3 for antibody 11156
ARAIRYELLSEF

SEQ ID NO: 22313 - protein, 9 aa, Homo sapiens
  light chain complementarity determining region 3 for antibody 11157
QQYGSSLLT

SEQ ID NO: 22314 - protein, 19 aa, Homo sapiens
  heavy chain complementarity determining region 3 for antibody 11157
ARVGGGWYYVREPHYYFDY

SEQ ID NO: 22315 - protein, 9 aa, Homo sapiens
  light chain complementarity determining region 3 for antibody 11158
QQYAASPRT

SEQ ID NO: 22316 - protein, 15 aa, Homo sapiens
  heavy chain complementarity determining region 3 for antibody 11158
ARDPGLEWRPNYFDF

SEQ ID NO: 22317 - protein, 11 aa, Homo sapiens
  light chain complementarity determining region 3 for antibody 11159
QQRTNWPPIFT

SEQ ID NO: 22318 - protein, 14 aa, Homo sapiens
  heavy chain complementarity determining region 3 for antibody 11159
ATSGSGYNLYYFDY

SEQ ID NO: 22319 - protein, 10 aa, Homo sapiens
  light chain complementarity determining region 3 for antibody 11160
QQRSSWPRLT

SEQ ID NO: 22320 - protein, 10 aa, Homo sapiens
  heavy chain complementarity determining region 3 for antibody 11160
ARVTGAQGDH

SEQ ID NO: 22321 - protein, 9 aa, Homo sapiens
  light chain complementarity determining region 3 for antibody 11161
QQRSNWLRT

SEQ ID NO: 22322 - protein, 15 aa, Homo sapiens
  heavy chain complementarity determining region 3 for antibody 11161
AAYNRLPAAGQGDEY

SEQ ID NO: 22323 - protein, 9 aa, Homo sapiens
  light chain complementarity determining region 3 for antibody 11162
QQGNSLPFT

SEQ ID NO: 22324 - protein, 19 aa, Homo sapiens
  heavy chain complementarity determining region 3 for antibody 11162
ARTDYSGDTDRYYDYGMDV

SEQ ID NO: 22325 - protein, 10 aa, Homo sapiens
  light chain complementarity determining region 3 for antibody 11163
QHYDNLPRLT

SEQ ID NO: 22326 - protein, 18 aa, Homo sapiens
  heavy chain complementarity determining region 3 for antibody 11163
AKDPDSQYYYDISGYSDY

SEQ ID NO: 22327 - protein, 9 aa, Homo sapiens
  light chain complementarity determining region 3 for antibody 11164
MQGTHWPQT

SEQ ID NO: 22328 - protein, 20 aa, Homo sapiens
  heavy chain complementarity determining region 3 for antibody 11164
ARDGGYYDSSGYYYGASPDS

SEQ ID NO: 22329 - protein, 9 aa, Homo sapiens
  light chain complementarity determining region 3 for antibody 11165
MQALQTPIT

SEQ ID NO: 22330 - protein, 12 aa, Homo sapiens
  heavy chain complementarity determining region 3 for antibody 11165
AKDSTNKWELLD

SEQ ID NO: 22331 - protein, 10 aa, Homo sapiens
  light chain complementarity determining region 3 for antibody 11166
QQYVNSALFT

SEQ ID NO: 22332 - protein, 16 aa, Homo sapiens
  heavy chain complementarity determining region 3 for antibody 11166
AREVFKGEIDYYAMDV

SEQ ID NO: 22333 - protein, 9 aa, Homo sapiens
  light chain complementarity determining region 3 for antibody 11167
QQYNSYPYT

SEQ ID NO: 22334 - protein, 19 aa, Homo sapiens
  heavy chain complementarity determining region 3 for antibody 11167
ARDQSSSYGDYYSYYGMDV

SEQ ID NO: 22335 - protein, 9 aa, Homo sapiens
  light chain complementarity determining region 3 for antibody 11168
QQYNSFPPT

SEQ ID NO: 22336 - protein, 12 aa, Homo sapiens
  heavy chain complementarity determining region 3 for antibody 11168
ATGGGYNYIFNF

SEQ ID NO: 22337 - protein, 9 aa, Homo sapiens
  light chain complementarity determining region 3 for antibody 11169
QQYENLPIT

SEQ ID NO: 22338 - protein, 18 aa, Homo sapiens
  heavy chain complementarity determining region 3 for antibody 11169
ASAPQYSRATYYYYGMDV

SEQ ID NO: 22339 - protein, 9 aa, Homo sapiens
  light chain complementarity determining region 3 for antibody 11170
QQSYSTPQT

SEQ ID NO: 22340 - protein, 18 aa, Homo sapiens
  heavy chain complementarity determining region 3 for antibody 11170
AKVSGQIWGRDYYYGMDV

SEQ ID NO: 22341 - protein, 10 aa, Homo sapiens
  light chain complementarity determining region 3 for antibody 11171
QQSYGPRPWT

SEQ ID NO: 22342 - protein, 15 aa, Homo sapiens
  heavy chain complementarity determining region 3 for antibody 11171
ARVSGPWVMIYYFDY

SEQ ID NO: 22343 - protein, 9 aa, Homo sapiens
  light chain complementarity determining region 3 for antibody 11172
QQSYDTPPT

SEQ ID NO: 22344 - protein, 10 aa, Homo sapiens
  heavy chain complementarity determining region 3 for antibody 11172
ARGSSSWYDY

SEQ ID NO: 22345 - protein, 10 aa, Homo sapiens
  light chain complementarity determining region 3 for antibody 11173
QQSFSVPPWT

SEQ ID NO: 22346 - protein, 19 aa, Homo sapiens
  heavy chain complementarity determining region 3 for antibody 11173
AREIHVLVENLPTTTALDL

SEQ ID NO: 22347 - protein, 10 aa, Homo sapiens
  light chain complementarity determining region 3 for antibody 11174
QQRSNWPSIT

SEQ ID NO: 22348 - protein, 8 aa, Homo sapiens
  heavy chain complementarity determining region 3 for antibody 11174
ARDLIITS

SEQ ID NO: 22349 - protein, 9 aa, Homo sapiens
  light chain complementarity determining region 3 for antibody 11175
QQGYIVPQT

SEQ ID NO: 22350 - protein, 18 aa, Homo sapiens
  heavy chain complementarity determining region 3 for antibody 11175
ARPSRTGSYSYRYYGMAV

SEQ ID NO: 22351 - protein, 9 aa, Homo sapiens
  light chain complementarity determining region 3 for antibody 11176
LQHNSYLLT

SEQ ID NO: 22352 - protein, 21 aa, Homo sapiens
  heavy chain complementarity determining region 3 for antibody 11176
ARDLLVSSGWSEYYRSHGMDV

SEQ ID NO: 22353 - protein, 10 aa, Homo sapiens
  light chain complementarity determining region 3 for antibody 11177
LQGTHWPPLN

SEQ ID NO: 22354 - protein, 26 aa, Homo sapiens
  heavy chain complementarity determining region 3 for antibody 11177
ARELITSIATPGHEFPNYYYYYGMDV

SEQ ID NO: 22355 - protein, 9 aa, Homo sapiens
  light chain complementarity determining region 3 for antibody 11178
HQSSSLPYT

SEQ ID NO: 22356 - protein, 19 aa, Homo sapiens
  heavy chain complementarity determining region 3 for antibody 11178
ARDRDYTIVDDYGSGVIDF

SEQ ID NO: 22357 - protein, 9 aa, Homo sapiens
  light chain complementarity determining region 3 for antibody 11179
HQSSRLPHT

SEQ ID NO: 22358 - protein, 11 aa, Homo sapiens
  heavy chain complementarity determining region 3 for antibody 11179
ARGDYLDAFHF

SEQ ID NO: 22359 - protein, 9 aa, Homo sapiens
  light chain complementarity determining region 3 for antibody 11180
QQYNSYSLT

SEQ ID NO: 22360 - protein, 14 aa, Homo sapiens
  heavy chain complementarity determining region 3 for antibody 11180
VRPSMAPRLYYFDF

SEQ ID NO: 22361 - protein, 9 aa, Homo sapiens
  light chain complementarity determining region 3 for antibody 11181
QQYNNYPYT

SEQ ID NO: 22362 - protein, 17 aa, Homo sapiens
  heavy chain complementarity determining region 3 for antibody 11181
AKGQDSYYYDISGYCDH

SEQ ID NO: 22363 - protein, 9 aa, Homo sapiens
  light chain complementarity determining region 3 for antibody 11182
QQYDNLPLT

SEQ ID NO: 22364 - protein, 10 aa, Homo sapiens
  heavy chain complementarity determining region 3 for antibody 11182
ARDEGGVTRD

SEQ ID NO: 22365 - protein, 9 aa, Homo sapiens
  light chain complementarity determining region 3 for antibody 11183
QQSYSTSWT

SEQ ID NO: 22366 - protein, 16 aa, Homo sapiens
  heavy chain complementarity determining region 3 for antibody 11183
ARDRGSSWYENNWFDP

SEQ ID NO: 22367 - protein, 11 aa, Homo sapiens
  light chain complementarity determining region 3 for antibody 11184
QQSHSTPPEYT

SEQ ID NO: 22368 - protein, 18 aa, Homo sapiens
  heavy chain complementarity determining region 3 for antibody 11184
ARAPIYDMNAYSYSWFDP

SEQ ID NO: 22369 - protein, 9 aa, Homo sapiens
  light chain complementarity determining region 3 for antibody 11185
QHYDNLRFT

SEQ ID NO: 22370 - protein, 14 aa, Homo sapiens
  heavy chain complementarity determining region 3 for antibody 11185
ARDRTTFVRGVFSP

SEQ ID NO: 22371 - protein, 11 aa, Homo sapiens
  light chain complementarity determining region 3 for antibody 11186
QESYTTPPRLT

SEQ ID NO: 22372 - protein, 13 aa, Homo sapiens
  heavy chain complementarity determining region 3 for antibody 11186
TRISVTHYYGMDV

SEQ ID NO: 22373 - protein, 8 aa, Homo sapiens
  light chain complementarity determining region 3 for antibody 11187
QQYVGSPT

SEQ ID NO: 22374 - protein, 16 aa, Homo sapiens
  heavy chain complementarity determining region 3 for antibody 11187
GRGPWELPESYQVLGF

SEQ ID NO: 22375 - protein, 10 aa, Homo sapiens
  light chain complementarity determining region 3 for antibody 11188
QQYSGNSLWT

SEQ ID NO: 22376 - protein, 13 aa, Homo sapiens
  heavy chain complementarity determining region 3 for antibody 11188
AADSYYSSADFDY

SEQ ID NO: 22377 - protein, 8 aa, Homo sapiens
  light chain complementarity determining region 3 for antibody 11189
QQYNSYST

SEQ ID NO: 22378 - protein, 12 aa, Homo sapiens
  heavy chain complementarity determining region 3 for antibody 11189
ARGIGTYYYFDY

SEQ ID NO: 22379 - protein, 9 aa, Homo sapiens
  light chain complementarity determining region 3 for antibody 11190
QQYDNLPLT

SEQ ID NO: 22380 - protein, 10 aa, Homo sapiens
  heavy chain complementarity determining region 3 for antibody 11190
VYNEGLMPLY

SEQ ID NO: 22381 - protein, 9 aa, Homo sapiens
  light chain complementarity determining region 3 for antibody 11191
QQTNSFPFT

SEQ ID NO: 22382 - protein, 20 aa, Homo sapiens
  heavy chain complementarity determining region 3 for antibody 11191
VRHNTLRYFDQTVFSYGMDV

SEQ ID NO: 22383 - protein, 9 aa, Homo sapiens
  light chain complementarity determining region 3 for antibody 11192
QQSYSTPQT

SEQ ID NO: 22384 - protein, 19 aa, Homo sapiens
  heavy chain complementarity determining region 3 for antibody 11192
ARENGGRGWVSYYYYGMDV

SEQ ID NO: 22385 - protein, 9 aa, Homo sapiens
  light chain complementarity determining region 3 for antibody 11193
QQGHSFPFT

SEQ ID NO: 22386 - protein, 19 aa, Homo sapiens
  heavy chain complementarity determining region 3 for antibody 11193
ARSDYSGDTDRYYDYGMDV

SEQ ID NO: 22387 - protein, 9 aa, Homo sapiens
  light chain complementarity determining region 3 for antibody 11194
QKYNTAPTP

SEQ ID NO: 22388 - protein, 13 aa, Homo sapiens
  heavy chain complementarity determining region 3 for antibody 11194
ARDGHGFGLPFDI

SEQ ID NO: 22389 - protein, 9 aa, Homo sapiens
  light chain complementarity determining region 3 for antibody 11195
MQGTHWPHT

SEQ ID NO: 22390 - protein, 11 aa, Homo sapiens
  heavy chain complementarity determining region 3 for antibody 11195
ATFGQQWRLAH

SEQ ID NO: 22391 - protein, 9 aa, Homo sapiens
  light chain complementarity determining region 3 for antibody 11196
QQYHSYPLT

SEQ ID NO: 22392 - protein, 19 aa, Homo sapiens
  heavy chain complementarity determining region 3 for antibody 11196
ARDHSHTTMEPGGEGCFDY

SEQ ID NO: 22393 - protein, 9 aa, Homo sapiens
  light chain complementarity determining region 3 for antibody 11197
QQSYSTPPT

SEQ ID NO: 22394 - protein, 16 aa, Homo sapiens
  heavy chain complementarity determining region 3 for antibody 11197
ARGGFGELGLHNAFDV

SEQ ID NO: 22395 - protein, 9 aa, Homo sapiens
  light chain complementarity determining region 3 for antibody 11198
QQSYSSPTT

SEQ ID NO: 22396 - protein, 14 aa, Homo sapiens
  heavy chain complementarity determining region 3 for antibody 11198
ARASERSGYYEIDY

SEQ ID NO: 22397 - protein, 9 aa, Homo sapiens
  light chain complementarity determining region 3 for antibody 11199
QQLNNYPLT

SEQ ID NO: 22398 - protein, 15 aa, Homo sapiens
  heavy chain complementarity determining region 3 for antibody 11199
GRGWWTDGYDYGMDV

SEQ ID NO: 22399 - protein, 9 aa, Homo sapiens
  light chain complementarity determining region 3 for antibody 11200
QQCYSTPLT

SEQ ID NO: 22400 - protein, 14 aa, Homo sapiens
  heavy chain complementarity determining region 3 for antibody 11200
ARDRNNNWWGGIDY

SEQ ID NO: 22401 - protein, 9 aa, Homo sapiens
  light chain complementarity determining region 3 for antibody 11201
QKYNSVPWT

SEQ ID NO: 22402 - protein, 14 aa, Homo sapiens
  heavy chain complementarity determining region 3 for antibody 11201
ARDESRSRVNVLDI

SEQ ID NO: 22403 - protein, 10 aa, Homo sapiens
  light chain complementarity determining region 3 for antibody 11202
QETYSIPQWT

SEQ ID NO: 22404 - protein, 13 aa, Homo sapiens
  heavy chain complementarity determining region 3 for antibody 11202
ARVGAVAGRGMDV

SEQ ID NO: 22405 - protein, 9 aa, Homo sapiens
  light chain complementarity determining region 3 for antibody 11203
HQSYTTPHT

SEQ ID NO: 22406 - protein, 14 aa, Homo sapiens
  heavy chain complementarity determining region 3 for antibody 11203
VSRVVEATLDYFDH

SEQ ID NO: 22407 - protein, 9 aa, Homo sapiens
  light chain complementarity determining region 3 for antibody 11204
QQYSSLPLT

SEQ ID NO: 22408 - protein, 16 aa, Homo sapiens
  heavy chain complementarity determining region 3 for antibody 11204
ARWGKTPTTMVDAFDI

SEQ ID NO: 22409 - protein, 9 aa, Homo sapiens
  light chain complementarity determining region 3 for antibody 11205
QQYNSYSRT

SEQ ID NO: 22410 - protein, 17 aa, Homo sapiens
  heavy chain complementarity determining region 3 for antibody 11205
ARGRITRPYYYYYGMDV

SEQ ID NO: 22411 - protein, 10 aa, Homo sapiens
  light chain complementarity determining region 3 for antibody 11206
QQYNNWPPLT

SEQ ID NO: 22412 - protein, 15 aa, Homo sapiens
  heavy chain complementarity determining region 3 for antibody 11206
AKFYKFPAVGNWLDY

SEQ ID NO: 22413 - protein, 8 aa, Homo sapiens
  light chain complementarity determining region 3 for antibody 11207
QQYHSVWT

SEQ ID NO: 22414 - protein, 15 aa, Homo sapiens
  heavy chain complementarity determining region 3 for antibody 11207
ARCARGSDSYDAFDV

SEQ ID NO: 22415 - protein, 9 aa, Homo sapiens
  light chain complementarity determining region 3 for antibody 11208
QQYDSYPWT

SEQ ID NO: 22416 - protein, 11 aa, Homo sapiens
  heavy chain complementarity determining region 3 for antibody 11208
ARNRQEGQNDY

SEQ ID NO: 22417 - protein, 10 aa, Homo sapiens
  light chain complementarity determining region 3 for antibody 11209
QQTYSSPPNT

SEQ ID NO: 22418 - protein, 19 aa, Homo sapiens
  heavy chain complementarity determining region 3 for antibody 11209
AKTAGSTFYSLQYYYGMDV

SEQ ID NO: 22419 - protein, 9 aa, Homo sapiens
  light chain complementarity determining region 3 for antibody 11210
QQSYSTPRT

SEQ ID NO: 22420 - protein, 11 aa, Homo sapiens
  heavy chain complementarity determining region 3 for antibody 11210
VHRVFKLYFEN

SEQ ID NO: 22421 - protein, 10 aa, Homo sapiens
  light chain complementarity determining region 3 for antibody 11211
QHLSIYHALT

SEQ ID NO: 22422 - protein, 17 aa, Homo sapiens
  heavy chain complementarity determining region 3 for antibody 11211
AKDLGAGAKDYYYGMDV

SEQ ID NO: 22423 - protein, 9 aa, Homo sapiens
  light chain complementarity determining region 3 for antibody 11212
LQSHSTPYT

SEQ ID NO: 22424 - protein, 21 aa, Homo sapiens
  heavy chain complementarity determining region 3 for antibody 11212
ARGLSTYYYDSSGYSSYGMDV

SEQ ID NO: 22425 - protein, 9 aa, Homo sapiens
  light chain complementarity determining region 3 for antibody 11213
LQHNSYPLT

SEQ ID NO: 22426 - protein, 17 aa, Homo sapiens
  heavy chain complementarity determining region 3 for antibody 11213
ARDNFDVMTGSASWFDP

SEQ ID NO: 22427 - protein, 8 aa, Homo sapiens
  light chain complementarity determining region 3 for antibody 11214
HQYLSFST

SEQ ID NO: 22428 - protein, 15 aa, Homo sapiens
  heavy chain complementarity determining region 3 for antibody 11214
ARTDLIRGVIGAFDV

SEQ ID NO: 22429 - protein, 9 aa, Homo sapiens
  light chain complementarity determining region 3 for antibody 11215
QQYNSYPLT

SEQ ID NO: 22430 - protein, 12 aa, Homo sapiens
  heavy chain complementarity determining region 3 for antibody 11215
ARDRSLNDALDL

SEQ ID NO: 22431 - protein, 10 aa, Homo sapiens
  light chain complementarity determining region 3 for antibody 11216
QQYNNWPPIT

SEQ ID NO: 22432 - protein, 14 aa, Homo sapiens
  heavy chain complementarity determining region 3 for antibody 11216
ARDFSTGIYGWFDP

SEQ ID NO: 22433 - protein, 10 aa, Homo sapiens
  light chain complementarity determining region 3 for antibody 11217
QQYNDWPPNT

SEQ ID NO: 22434 - protein, 14 aa, Homo sapiens
  heavy chain complementarity determining region 3 for antibody 11217
ARASKYQMLFYLDY

SEQ ID NO: 22435 - protein, 9 aa, Homo sapiens
  light chain complementarity determining region 3 for antibody 11218
QQYDSYPYT

SEQ ID NO: 22436 - protein, 17 aa, Homo sapiens
  heavy chain complementarity determining region 3 for antibody 11218
ARENWNDVDLRQFYFDF

SEQ ID NO: 22437 - protein, 8 aa, Homo sapiens
  light chain complementarity determining region 3 for antibody 11219
QQSYTTPL

SEQ ID NO: 22438 - protein, 17 aa, Homo sapiens
  heavy chain complementarity determining region 3 for antibody 11219
ARGNSGWHGITYWYFDL

SEQ ID NO: 22439 - protein, 9 aa, Homo sapiens
  light chain complementarity determining region 3 for antibody 11220
QQSYSTPLT

SEQ ID NO: 22440 - protein, 11 aa, Homo sapiens
  heavy chain complementarity determining region 3 for antibody 11220
ARDHPDLRLDV

SEQ ID NO: 22441 - protein, 9 aa, Homo sapiens
  light chain complementarity determining region 3 for antibody 11221
QQRSNWPPT

SEQ ID NO: 22442 - protein, 20 aa, Homo sapiens
  heavy chain complementarity determining region 3 for antibody 11221
ARYCGGDCSSISYYYNGLDV

SEQ ID NO: 22443 - protein, 9 aa, Homo sapiens
  light chain complementarity determining region 3 for antibody 11222
MQGTYWPRT

SEQ ID NO: 22444 - protein, 11 aa, Homo sapiens
  heavy chain complementarity determining region 3 for antibody 11222
AREPAFGDLDY

SEQ ID NO: 22445 - protein, 9 aa, Homo sapiens
  light chain complementarity determining region 3 for antibody 11223
MQGTHWPIT

SEQ ID NO: 22446 - protein, 14 aa, Homo sapiens
  heavy chain complementarity determining region 3 for antibody 11223
VKDKNHILTDHLDY

SEQ ID NO: 22447 - protein, 9 aa, Homo sapiens
  light chain complementarity determining region 3 for antibody 11224
HQSFDTPYT

SEQ ID NO: 22448 - protein, 12 aa, Homo sapiens
  heavy chain complementarity determining region 3 for antibody 11224
ASSTTTADAFDV

SEQ ID NO: 22449 - protein, 9 aa, Homo sapiens
  light chain complementarity determining region 3 for antibody 11225
QQYNSFPYT

SEQ ID NO: 22450 - protein, 17 aa, Homo sapiens
  heavy chain complementarity determining region 3 for antibody 11225
AREDWSDVDLRLFYIDY

SEQ ID NO: 22451 - protein, 9 aa, Homo sapiens
  light chain complementarity determining region 3 for antibody 11226
QQYGSSPQT

SEQ ID NO: 22452 - protein, 11 aa, Homo sapiens
  heavy chain complementarity determining region 3 for antibody 11226
ARDRKFGESAD

SEQ ID NO: 22453 - protein, 9 aa, Homo sapiens
  light chain complementarity determining region 3 for antibody 11227
QQYDNLPPT

SEQ ID NO: 22454 - protein, 14 aa, Homo sapiens
  heavy chain complementarity determining region 3 for antibody 11227
ARDQATVVRGVLDY

SEQ ID NO: 22455 - protein, 11 aa, Homo sapiens
  light chain complementarity determining region 3 for antibody 11228
QQYDGSPHMYT

SEQ ID NO: 22456 - protein, 12 aa, Homo sapiens
  heavy chain complementarity determining region 3 for antibody 11228
AHRPLTRGWFDP

SEQ ID NO: 22457 - protein, 9 aa, Homo sapiens
  light chain complementarity determining region 3 for antibody 11229
QQSYSIPRT

SEQ ID NO: 22458 - protein, 20 aa, Homo sapiens
  heavy chain complementarity determining region 3 for antibody 11229
ARGEKLINYSYNSAGQPLDY

SEQ ID NO: 22459 - protein, 9 aa, Homo sapiens
  light chain complementarity determining region 3 for antibody 11230
LQDFYYPYT

SEQ ID NO: 22460 - protein, 18 aa, Homo sapiens
  heavy chain complementarity determining region 3 for antibody 11230
ARDPLHCIGADCFSYFDQ

SEQ ID NO: 22461 - protein, 10 aa, Homo sapiens
  light chain complementarity determining region 3 for antibody 11231
HQSSSLPRLT

SEQ ID NO: 22462 - protein, 18 aa, Homo sapiens
  heavy chain complementarity determining region 3 for antibody 11231
ARDLGYDFNAYYHWYFDL

SEQ ID NO: 22463 - protein, 11 aa, Homo sapiens
  light chain complementarity determining region 3 for antibody 11232
QQYSGSPGGVT

SEQ ID NO: 22464 - protein, 16 aa, Homo sapiens
  heavy chain complementarity determining region 3 for antibody 11232
AHLDWLQFRGSVFFDY

SEQ ID NO: 22465 - protein, 9 aa, Homo sapiens
  light chain complementarity determining region 3 for antibody 11233
QQYNSFPWT

SEQ ID NO: 22466 - protein, 17 aa, Homo sapiens
  heavy chain complementarity determining region 3 for antibody 11233
ARAGGFAGTFSYYGMDV

SEQ ID NO: 22467 - protein, 10 aa, Homo sapiens
  light chain complementarity determining region 3 for antibody 11234
QQYHSYSPEA

SEQ ID NO: 22468 - protein, 14 aa, Homo sapiens
  heavy chain complementarity determining region 3 for antibody 11234
AKDRGLLWFGELSH

SEQ ID NO: 22469 - protein, 9 aa, Homo sapiens
  light chain complementarity determining region 3 for antibody 11235
QQYGSSPLT

SEQ ID NO: 22470 - protein, 13 aa, Homo sapiens
  heavy chain complementarity determining region 3 for antibody 11235
TRCGVTAIEYFQH

SEQ ID NO: 22471 - protein, 8 aa, Homo sapiens
  light chain complementarity determining region 3 for antibody 11236
QQYDNLLT

SEQ ID NO: 22472 - protein, 20 aa, Homo sapiens
  heavy chain complementarity determining region 3 for antibody 11236
ARDRSVNAAMDYYFYSGMDV

SEQ ID NO: 22473 - protein, 9 aa, Homo sapiens
  light chain complementarity determining region 3 for antibody 11237
QQSYSTLFT

SEQ ID NO: 22474 - protein, 18 aa, Homo sapiens
  heavy chain complementarity determining region 3 for antibody 11237
ARARRDRQIYGDYYYFDY

SEQ ID NO: 22475 - protein, 11 aa, Homo sapiens
  light chain complementarity determining region 3 for antibody 11238
QQSHSTPPEYT

SEQ ID NO: 22476 - protein, 18 aa, Homo sapiens
  heavy chain complementarity determining region 3 for antibody 11238
ARAPIYDTDGYSFTWFDP

SEQ ID NO: 22477 - protein, 9 aa, Homo sapiens
  light chain complementarity determining region 3 for antibody 11239
QQHRNVPIT

SEQ ID NO: 22478 - protein, 20 aa, Homo sapiens
  heavy chain complementarity determining region 3 for antibody 11239
AKDRVPDTSMDYFFHHGMDV

SEQ ID NO: 22479 - protein, 9 aa, Homo sapiens
  light chain complementarity determining region 3 for antibody 11240
QQFDGSRRT

SEQ ID NO: 22480 - protein, 21 aa, Homo sapiens
  heavy chain complementarity determining region 3 for antibody 11240
VREGYYHSGNYYYYDYYGMDV

SEQ ID NO: 22481 - protein, 9 aa, Homo sapiens
  light chain complementarity determining region 3 for antibody 11241
QQAYRFPLT

SEQ ID NO: 22482 - protein, 13 aa, Homo sapiens
  heavy chain complementarity determining region 3 for antibody 11241
VRTYGSGRNWFDT

SEQ ID NO: 22483 - protein, 9 aa, Homo sapiens
  light chain complementarity determining region 3 for antibody 11242
MQGLQTPPT

SEQ ID NO: 22484 - protein, 16 aa, Homo sapiens
  heavy chain complementarity determining region 3 for antibody 11242
ARGGFGELGLHNAFDV

SEQ ID NO: 22485 - protein, 9 aa, Homo sapiens
  light chain complementarity determining region 3 for antibody 11243
QQYSTYPLT

SEQ ID NO: 22486 - protein, 15 aa, Homo sapiens
  heavy chain complementarity determining region 3 for antibody 11243
ARGGIHYDILTGLDY

SEQ ID NO: 22487 - protein, 9 aa, Homo sapiens
  light chain complementarity determining region 3 for antibody 11244
QQYNSYPLT

SEQ ID NO: 22488 - protein, 16 aa, Homo sapiens
  heavy chain complementarity determining region 3 for antibody 11244
ARAEMAPKSAHWYFDL

SEQ ID NO: 22489 - protein, 10 aa, Homo sapiens
  light chain complementarity determining region 3 for antibody 11245
QQYDNVPPYT

SEQ ID NO: 22490 - protein, 11 aa, Homo sapiens
  heavy chain complementarity determining region 3 for antibody 11245
ARERTTVTFDY

SEQ ID NO: 22491 - protein, 9 aa, Homo sapiens
  light chain complementarity determining region 3 for antibody 11246
QQSYSTPYT

SEQ ID NO: 22492 - protein, 15 aa, Homo sapiens
  heavy chain complementarity determining region 3 for antibody 11246
ARDQRQLLNHRAFDV

SEQ ID NO: 22493 - protein, 10 aa, Homo sapiens
  light chain complementarity determining region 3 for antibody 11247
QQLNSYPRFT

SEQ ID NO: 22494 - protein, 16 aa, Homo sapiens
  heavy chain complementarity determining region 3 for antibody 11247
ARGGTYTSVYYYGMDV

SEQ ID NO: 22495 - protein, 9 aa, Homo sapiens
  light chain complementarity determining region 3 for antibody 11248
QEYDNYSAT

SEQ ID NO: 22496 - protein, 12 aa, Homo sapiens
  heavy chain complementarity determining region 3 for antibody 11248
TTGGAVSLSGAH

SEQ ID NO: 22497 - protein, 10 aa, Homo sapiens
  light chain complementarity determining region 3 for antibody 11249
HQRSNWPPFT

SEQ ID NO: 22498 - protein, 15 aa, Homo sapiens
  heavy chain complementarity determining region 3 for antibody 11249
ARDGCSGASCYSFEH

SEQ ID NO: 22499 - protein, 8 aa, Homo sapiens
  light chain complementarity determining region 3 for antibody 11250
QQYNSYSQ

SEQ ID NO: 22500 - protein, 15 aa, Homo sapiens
  heavy chain complementarity determining region 3 for antibody 11250
ASRPQVGVVVDTGGS

SEQ ID NO: 22501 - protein, 9 aa, Homo sapiens
  light chain complementarity determining region 3 for antibody 11251
QQYNSYPWT

SEQ ID NO: 22502 - protein, 17 aa, Homo sapiens
  heavy chain complementarity determining region 3 for antibody 11251
ARGVRRQELVPEYYFDY

SEQ ID NO: 22503 - protein, 9 aa, Homo sapiens
  light chain complementarity determining region 3 for antibody 11252
QQYHTYPRT

SEQ ID NO: 22504 - protein, 14 aa, Homo sapiens
  heavy chain complementarity determining region 3 for antibody 11252
ARESYSGYDLDIDQ

SEQ ID NO: 22505 - protein, 9 aa, Homo sapiens
  light chain complementarity determining region 3 for antibody 11253
QQSYSAPYT

SEQ ID NO: 22506 - protein, 9 aa, Homo sapiens
  heavy chain complementarity determining region 3 for antibody 11253
VGGTIAAVY

SEQ ID NO: 22507 - protein, 9 aa, Homo sapiens
  light chain complementarity determining region 3 for antibody 11254
QQLNSYPLT

SEQ ID NO: 22508 - protein, 18 aa, Homo sapiens
  heavy chain complementarity determining region 3 for antibody 11254
ARYEDYGDSPTVYYGMDA

SEQ ID NO: 22509 - protein, 9 aa, Homo sapiens
  light chain complementarity determining region 3 for antibody 11255
MQAVQTPLT

SEQ ID NO: 22510 - protein, 17 aa, Homo sapiens
  heavy chain complementarity determining region 3 for antibody 11255
TKETDLAVAGYAEYFLH

SEQ ID NO: 22511 - protein, 10 aa, Homo sapiens
  light chain complementarity determining region 3 for antibody 11256
QYHGNSPLYT

SEQ ID NO: 22512 - protein, 12 aa, Homo sapiens
  heavy chain complementarity determining region 3 for antibody 11256
AKGILGRGGMDV

SEQ ID NO: 22513 - protein, 9 aa, Homo sapiens
  light chain complementarity determining region 3 for antibody 11257
QQYGSSRYT

SEQ ID NO: 22514 - protein, 20 aa, Homo sapiens
  heavy chain complementarity determining region 3 for antibody 11257
ARWNDSSGYNFGIYYYAMDV

SEQ ID NO: 22515 - protein, 9 aa, Homo sapiens
  light chain complementarity determining region 3 for antibody 11258
QQYGSSPLT

SEQ ID NO: 22516 - protein, 18 aa, Homo sapiens
  heavy chain complementarity determining region 3 for antibody 11258
VKIYHYDTNEFPRGYFDH

SEQ ID NO: 22517 - protein, 9 aa, Homo sapiens
  light chain complementarity determining region 3 for antibody 11259
QQYDNWPWT

SEQ ID NO: 22518 - protein, 17 aa, Homo sapiens
  heavy chain complementarity determining region 3 for antibody 11259
VTHYYHDSGIYHDFFNY

SEQ ID NO: 22519 - protein, 9 aa, Homo sapiens
  light chain complementarity determining region 3 for antibody 11260
QQYDNLLIT

SEQ ID NO: 22520 - protein, 17 aa, Homo sapiens
  heavy chain complementarity determining region 3 for antibody 11260
ARDDSPYRNSGWSFSSF

SEQ ID NO: 22521 - protein, 9 aa, Homo sapiens
  light chain complementarity determining region 3 for antibody 11261
MQSLQLPPN

SEQ ID NO: 22522 - protein, 14 aa, Homo sapiens
  heavy chain complementarity determining region 3 for antibody 11261
ARGPENWRSLNFDY

SEQ ID NO: 22523 - protein, 9 aa, Homo sapiens
  light chain complementarity determining region 3 for antibody 11262
MQGLLTPPA

SEQ ID NO: 22524 - protein, 18 aa, Homo sapiens
  heavy chain complementarity determining region 3 for antibody 11262
ARTRVGVYSGGSPFMFDP

SEQ ID NO: 22525 - protein, 10 aa, Homo sapiens
  light chain complementarity determining region 3 for antibody 11263
HQSSSLVRLT

SEQ ID NO: 22526 - protein, 18 aa, Homo sapiens
  heavy chain complementarity determining region 3 for antibody 11263
ARDLGYDYNANYHWYFDL

SEQ ID NO: 22527 - protein, 9 aa, Homo sapiens
  light chain complementarity determining region 3 for antibody 11264
QQYITYWGT

SEQ ID NO: 22528 - protein, 17 aa, Homo sapiens
  heavy chain complementarity determining region 3 for antibody 11264
GHTYYYDSSGYSPLFDY

SEQ ID NO: 22529 - protein, 9 aa, Homo sapiens
  light chain complementarity determining region 3 for antibody 11265
QQYGNSWWT

SEQ ID NO: 22530 - protein, 19 aa, Homo sapiens
  heavy chain complementarity determining region 3 for antibody 11265
ARVGDGHNKRGYYYYPMDV

SEQ ID NO: 22531 - protein, 8 aa, Homo sapiens
  light chain complementarity determining region 3 for antibody 11266
QQYDNLIT

SEQ ID NO: 22532 - protein, 18 aa, Homo sapiens
  heavy chain complementarity determining region 3 for antibody 11266
ALSSCDGDCYSAPEFFLH

SEQ ID NO: 22533 - protein, 10 aa, Homo sapiens
  light chain complementarity determining region 3 for antibody 11267
QQSYSTPPYT

SEQ ID NO: 22534 - protein, 16 aa, Homo sapiens
  heavy chain complementarity determining region 3 for antibody 11267
AKAGFGELGLHNAFDV

SEQ ID NO: 22535 - protein, 9 aa, Homo sapiens
  light chain complementarity determining region 3 for antibody 11268
QQGKNFPIT

SEQ ID NO: 22536 - protein, 20 aa, Homo sapiens
  heavy chain complementarity determining region 3 for antibody 11268
ARAVSDLVRGIIFPPYSFDY

SEQ ID NO: 22537 - protein, 9 aa, Homo sapiens
  light chain complementarity determining region 3 for antibody 11269
QQANSFPFT

SEQ ID NO: 22538 - protein, 24 aa, Homo sapiens
  heavy chain complementarity determining region 3 for antibody 11269
AKDHRVGFGDPVGVGYYYYYAMDV

SEQ ID NO: 22539 - protein, 11 aa, Homo sapiens
  light chain complementarity determining region 3 for antibody 11270
QHNGSSPPENT

SEQ ID NO: 22540 - protein, 17 aa, Homo sapiens
  heavy chain complementarity determining region 3 for antibody 11270
ARENYDVLTGANYGMDV

SEQ ID NO: 22541 - protein, 9 aa, Homo sapiens
  light chain complementarity determining region 3 for antibody 11271
MQSLQTPRT

SEQ ID NO: 22542 - protein, 18 aa, Homo sapiens
  heavy chain complementarity determining region 3 for antibody 11271
ARAGDDGSGYWDLYVFDI

SEQ ID NO: 22543 - protein, 9 aa, Homo sapiens
  light chain complementarity determining region 3 for antibody 11272
MQALQTLIT

SEQ ID NO: 22544 - protein, 10 aa, Homo sapiens
  heavy chain complementarity determining region 3 for antibody 11272
ARSFTFGGVP

SEQ ID NO: 22545 - protein, 9 aa, Homo sapiens
  light chain complementarity determining region 3 for antibody 11273
HRTYNAPRS

SEQ ID NO: 22546 - protein, 14 aa, Homo sapiens
  heavy chain complementarity determining region 3 for antibody 11273
AALREIVVLTSPLQ

SEQ ID NO: 22547 - protein, 9 aa, Homo sapiens
  light chain complementarity determining region 3 for antibody 11274
QQYYTSPLT

SEQ ID NO: 22548 - protein, 17 aa, Homo sapiens
  heavy chain complementarity determining region 3 for antibody 11274
ARERSVAGAVRFYGMDV

SEQ ID NO: 22549 - protein, 9 aa, Homo sapiens
  light chain complementarity determining region 3 for antibody 11275
QQYVTYPYT

SEQ ID NO: 22550 - protein, 17 aa, Homo sapiens
  heavy chain complementarity determining region 3 for antibody 11275
AREEFADVDLRQYFFDY

SEQ ID NO: 22551 - protein, 9 aa, Homo sapiens
  light chain complementarity determining region 3 for antibody 11276
QQYNSYPYT

SEQ ID NO: 22552 - protein, 14 aa, Homo sapiens
  heavy chain complementarity determining region 3 for antibody 11276
AREDSSNLYGYFQH

SEQ ID NO: 22553 - protein, 9 aa, Homo sapiens
  light chain complementarity determining region 3 for antibody 11277
QQYNSKPYT

SEQ ID NO: 22554 - protein, 10 aa, Homo sapiens
  heavy chain complementarity determining region 3 for antibody 11277
ARVGFDAFDI

SEQ ID NO: 22555 - protein, 8 aa, Homo sapiens
  light chain complementarity determining region 3 for antibody 11278
QQYHSVWT

SEQ ID NO: 22556 - protein, 15 aa, Homo sapiens
  heavy chain complementarity determining region 3 for antibody 11278
ARCARGGDTYDAFDI

SEQ ID NO: 22557 - protein, 9 aa, Homo sapiens
  light chain complementarity determining region 3 for antibody 11279
QQYENLPPS

SEQ ID NO: 22558 - protein, 19 aa, Homo sapiens
  heavy chain complementarity determining region 3 for antibody 11279
ATKRGYSYGPPYYYYGMDV

SEQ ID NO: 22559 - protein, 9 aa, Homo sapiens
  light chain complementarity determining region 3 for antibody 11280
QQRSSWPLT

SEQ ID NO: 22560 - protein, 11 aa, Homo sapiens
  heavy chain complementarity determining region 3 for antibody 11280
ANRDNKGYFDY

SEQ ID NO: 22561 - protein, 10 aa, Homo sapiens
  light chain complementarity determining region 3 for antibody 11281
QQRSNGPPLT

SEQ ID NO: 22562 - protein, 26 aa, Homo sapiens
  heavy chain complementarity determining region 3 for antibody 11281
AKDMDEPPMVRGVIFSPFIIDNWLDP

SEQ ID NO: 22563 - protein, 10 aa, Homo sapiens
  light chain complementarity determining region 3 for antibody 11282
QQLNTYPPIT

SEQ ID NO: 22564 - protein, 14 aa, Homo sapiens
  heavy chain complementarity determining region 3 for antibody 11282
AGDVDTPHRRAFDV

SEQ ID NO: 22565 - protein, 9 aa, Homo sapiens
  light chain complementarity determining region 3 for antibody 11283
QQLKSFPPN

SEQ ID NO: 22566 - protein, 18 aa, Homo sapiens
  heavy chain complementarity determining region 3 for antibody 11283
ARGSGAPIDDYYYYGLDV

SEQ ID NO: 22567 - protein, 10 aa, Homo sapiens
  light chain complementarity determining region 3 for antibody 11284
QQFDNWPPWT

SEQ ID NO: 22568 - protein, 17 aa, Homo sapiens
  heavy chain complementarity determining region 3 for antibody 11284
ARNRRGFSYGYGGFFDS

SEQ ID NO: 22569 - protein, 9 aa, Homo sapiens
  light chain complementarity determining region 3 for antibody 11285
QQANSFPLT

SEQ ID NO: 22570 - protein, 14 aa, Homo sapiens
  heavy chain complementarity determining region 3 for antibody 11285
VRGRYYDSSGPIDY

SEQ ID NO: 22571 - protein, 9 aa, Homo sapiens
  light chain complementarity determining region 3 for antibody 11286
QKYNSAPWT

SEQ ID NO: 22572 - protein, 16 aa, Homo sapiens
  heavy chain complementarity determining region 3 for antibody 11286
ARLDRVDCTSEGCRDY

SEQ ID NO: 22573 - protein, 9 aa, Homo sapiens
  light chain complementarity determining region 3 for antibody 11287
QKYNSAPWT

SEQ ID NO: 22574 - protein, 12 aa, Homo sapiens
  heavy chain complementarity determining region 3 for antibody 11287
ARAARGTGGFDY

SEQ ID NO: 22575 - protein, 9 aa, Homo sapiens
  light chain complementarity determining region 3 for antibody 11288
QHSYGTPWT

SEQ ID NO: 22576 - protein, 12 aa, Homo sapiens
  heavy chain complementarity determining region 3 for antibody 11288
ARVQAAGNGIDT

SEQ ID NO: 22577 - protein, 10 aa, Homo sapiens
  light chain complementarity determining region 3 for antibody 11289
LQHNSYPRLT

SEQ ID NO: 22578 - protein, 17 aa, Homo sapiens
  heavy chain complementarity determining region 3 for antibody 11289
AQLIWGSGSRDYFGLDA

SEQ ID NO: 22579 - protein, 9 aa, Homo sapiens
  light chain complementarity determining region 3 for antibody 11290
LQDYNYPRT

SEQ ID NO: 22580 - protein, 10 aa, Homo sapiens
  heavy chain complementarity determining region 3 for antibody 11290
ARDHPGIEEY

SEQ ID NO: 22581 - protein, 8 aa, Homo sapiens
  light chain complementarity determining region 3 for antibody 11291
QRSSTYFS

SEQ ID NO: 22582 - protein, 11 aa, Homo sapiens
  heavy chain complementarity determining region 3 for antibody 11291
ARVYSGVGFDV

SEQ ID NO: 22583 - protein, 9 aa, Homo sapiens
  light chain complementarity determining region 3 for antibody 11292
QQYKSYPHT

SEQ ID NO: 22584 - protein, 12 aa, Homo sapiens
  heavy chain complementarity determining region 3 for antibody 11292
AGDSGSYSSCDY

SEQ ID NO: 22585 - protein, 9 aa, Homo sapiens
  light chain complementarity determining region 3 for antibody 11293
QQYGSSPVT

SEQ ID NO: 22586 - protein, 13 aa, Homo sapiens
  heavy chain complementarity determining region 3 for antibody 11293
ATRPLDSSGYFDS

SEQ ID NO: 22587 - protein, 9 aa, Homo sapiens
  light chain complementarity determining region 3 for antibody 11294
QQYGGSPET

SEQ ID NO: 22588 - protein, 16 aa, Homo sapiens
  heavy chain complementarity determining region 3 for antibody 11294
ATSLGYCSGNSCYSDS

SEQ ID NO: 22589 - protein, 10 aa, Homo sapiens
  light chain complementarity determining region 3 for antibody 11295
QQYDNWPPWT

SEQ ID NO: 22590 - protein, 10 aa, Homo sapiens
  heavy chain complementarity determining region 3 for antibody 11295
TRGAFIAARL

SEQ ID NO: 22591 - protein, 11 aa, Homo sapiens
  light chain complementarity determining region 3 for antibody 11296
QQYDNLLPSLT

SEQ ID NO: 22592 - protein, 15 aa, Homo sapiens
  heavy chain complementarity determining region 3 for antibody 11296
ARGRGGEISRAYSDF

SEQ ID NO: 22593 - protein, 10 aa, Homo sapiens
  light chain complementarity determining region 3 for antibody 11297
QQTYSSPTWT

SEQ ID NO: 22594 - protein, 13 aa, Homo sapiens
  heavy chain complementarity determining region 3 for antibody 11297
ARVGAVAGRAFDI

SEQ ID NO: 22595 - protein, 9 aa, Homo sapiens
  light chain complementarity determining region 3 for antibody 11298
QQTYNAPLT

SEQ ID NO: 22596 - protein, 16 aa, Homo sapiens
  heavy chain complementarity determining region 3 for antibody 11298
TTLPFMAPNYYYGMDV

SEQ ID NO: 22597 - protein, 9 aa, Homo sapiens
  light chain complementarity determining region 3 for antibody 11299
QQSYTTPYT

SEQ ID NO: 22598 - protein, 14 aa, Homo sapiens
  heavy chain complementarity determining region 3 for antibody 11299
ARGPVAHLKFGMDV

SEQ ID NO: 22599 - protein, 10 aa, Homo sapiens
  light chain complementarity determining region 3 for antibody 11300
QQSYSGPPLS

SEQ ID NO: 22600 - protein, 20 aa, Homo sapiens
  heavy chain complementarity determining region 3 for antibody 11300
ARHFRETLGGLVREFAAFDI

SEQ ID NO: 22601 - protein, 10 aa, Homo sapiens
  light chain complementarity determining region 3 for antibody 11301
QQHDSSLLFT

SEQ ID NO: 22602 - protein, 16 aa, Homo sapiens
  heavy chain complementarity determining region 3 for antibody 11301
ARHDYDILTYGPTLDS

SEQ ID NO: 22603 - protein, 9 aa, Homo sapiens
  light chain complementarity determining region 3 for antibody 11302
QKCDDLPLT

SEQ ID NO: 22604 - protein, 26 aa, Homo sapiens
  heavy chain complementarity determining region 3 for antibody 11302
ARAAFDLSGAHNYYGSGIYYKGGSDS

SEQ ID NO: 22605 - protein, 9 aa, Homo sapiens
  light chain complementarity determining region 3 for antibody 11303
MQALQTPLT

SEQ ID NO: 22606 - protein, 15 aa, Homo sapiens
  heavy chain complementarity determining region 3 for antibody 11303
ARAFGFGDSSHGMDV

SEQ ID NO: 22607 - protein, 9 aa, Homo sapiens
  light chain complementarity determining region 3 for antibody 11304
HQYGSSPDT

SEQ ID NO: 22608 - protein, 11 aa, Homo sapiens
  heavy chain complementarity determining region 3 for antibody 11304
ARRGGRHGFDY

SEQ ID NO: 22609 - protein, 10 aa, Homo sapiens
  light chain complementarity determining region 3 for antibody 11305
QQYNSYSPVT

SEQ ID NO: 22610 - protein, 13 aa, Homo sapiens
  heavy chain complementarity determining region 3 for antibody 11305
ARSIDWLPYVVDF

SEQ ID NO: 22611 - protein, 7 aa, Homo sapiens
  light chain complementarity determining region 3 for antibody 11306
QQYNSRT

SEQ ID NO: 22612 - protein, 27 aa, Homo sapiens
  heavy chain complementarity determining region 3 for antibody 11306
ARYPGEVDEGDIVIVADQDNYYYGMDV

SEQ ID NO: 22613 - protein, 10 aa, Homo sapiens
  light chain complementarity determining region 3 for antibody 11307
QQYNNWPPLT

SEQ ID NO: 22614 - protein, 17 aa, Homo sapiens
  heavy chain complementarity determining region 3 for antibody 11307
ARVSSSGLYGAPGYFDY

SEQ ID NO: 22615 - protein, 9 aa, Homo sapiens
  light chain complementarity determining region 3 for antibody 11308
QQYNIYWYT

SEQ ID NO: 22616 - protein, 14 aa, Homo sapiens
  heavy chain complementarity determining region 3 for antibody 11308
VRHDYGDYVSGVDV

SEQ ID NO: 22617 - protein, 10 aa, Homo sapiens
  light chain complementarity determining region 3 for antibody 11309
QQYDNLPQYT

SEQ ID NO: 22618 - protein, 16 aa, Homo sapiens
  heavy chain complementarity determining region 3 for antibody 11309
ARDSSYGRPHYYGMDV

SEQ ID NO: 22619 - protein, 9 aa, Homo sapiens
  light chain complementarity determining region 3 for antibody 11310
QQTYSTPYT

SEQ ID NO: 22620 - protein, 17 aa, Homo sapiens
  heavy chain complementarity determining region 3 for antibody 11310
ARGTYYNDTSGNGPLDY

SEQ ID NO: 22621 - protein, 9 aa, Homo sapiens
  light chain complementarity determining region 3 for antibody 11311
QQSYSSSWT

SEQ ID NO: 22622 - protein, 12 aa, Homo sapiens
  heavy chain complementarity determining region 3 for antibody 11311
GTTTHYYYALDV

SEQ ID NO: 22623 - protein, 9 aa, Homo sapiens
  light chain complementarity determining region 3 for antibody 11312
QQSYSPPYT

SEQ ID NO: 22624 - protein, 15 aa, Homo sapiens
  heavy chain complementarity determining region 3 for antibody 11312
ARGGAVRPRYRGMDV

SEQ ID NO: 22625 - protein, 9 aa, Homo sapiens
  light chain complementarity determining region 3 for antibody 11313
QQSYSIPYT

SEQ ID NO: 22626 - protein, 17 aa, Homo sapiens
  heavy chain complementarity determining region 3 for antibody 11313
ARASYYDVDLNRFYFDY

SEQ ID NO: 22627 - protein, 11 aa, Homo sapiens
  light chain complementarity determining region 3 for antibody 11314
QQLNSYSGGFT

SEQ ID NO: 22628 - protein, 19 aa, Homo sapiens
  heavy chain complementarity determining region 3 for antibody 11314
ARGGACSGDTCYSYYGADV

SEQ ID NO: 22629 - protein, 11 aa, Homo sapiens
  light chain complementarity determining region 3 for antibody 11315
QQLNGNSGGLT

SEQ ID NO: 22630 - protein, 19 aa, Homo sapiens
  heavy chain complementarity determining region 3 for antibody 11315
ARGGACSGATCYSYFGVDV

SEQ ID NO: 22631 - protein, 9 aa, Homo sapiens
  light chain complementarity determining region 3 for antibody 11316
QQFYDYPLT

SEQ ID NO: 22632 - protein, 19 aa, Homo sapiens
  heavy chain complementarity determining region 3 for antibody 11316
ARDLSEILTGHYGGFPGVN

SEQ ID NO: 22633 - protein, 9 aa, Homo sapiens
  light chain complementarity determining region 3 for antibody 11317
QQFNNYLIT

SEQ ID NO: 22634 - protein, 13 aa, Homo sapiens
  heavy chain complementarity determining region 3 for antibody 11317
AKDYDYGDFHFDY

SEQ ID NO: 22635 - protein, 11 aa, Homo sapiens
  light chain complementarity determining region 3 for antibody 11318
QLYGGPPPMYT

SEQ ID NO: 22636 - protein, 10 aa, Homo sapiens
  heavy chain complementarity determining region 3 for antibody 11318
ARNGYYSIDP

SEQ ID NO: 22637 - protein, 11 aa, Homo sapiens
  light chain complementarity determining region 3 for antibody 11319
QQYNNWPPEDT

SEQ ID NO: 22638 - protein, 22 aa, Homo sapiens
  heavy chain complementarity determining region 3 for antibody 11319
ARGRPFPDTHINRNYYYYGMDV

SEQ ID NO: 22639 - protein, 9 aa, Homo sapiens
  light chain complementarity determining region 3 for antibody 11320
QQYNAYALT

SEQ ID NO: 22640 - protein, 16 aa, Homo sapiens
  heavy chain complementarity determining region 3 for antibody 11320
ARGKYSDFDSGHGMDV

SEQ ID NO: 22641 - protein, 9 aa, Homo sapiens
  light chain complementarity determining region 3 for antibody 11321
QQYGTSPFT

SEQ ID NO: 22642 - protein, 20 aa, Homo sapiens
  heavy chain complementarity determining region 3 for antibody 11321
ATDGFIAAEDMMMPWGAFEI

SEQ ID NO: 22643 - protein, 9 aa, Homo sapiens
  light chain complementarity determining region 3 for antibody 11322
QQYDSSPWT

SEQ ID NO: 22644 - protein, 12 aa, Homo sapiens
  heavy chain complementarity determining region 3 for antibody 11322
VKDPRNSWLPNA

SEQ ID NO: 22645 - protein, 9 aa, Homo sapiens
  light chain complementarity determining region 3 for antibody 11323
QQSYSTRRT

SEQ ID NO: 22646 - protein, 16 aa, Homo sapiens
  heavy chain complementarity determining region 3 for antibody 11323
ARTQGTRDYYYYAMDV

SEQ ID NO: 22647 - protein, 9 aa, Homo sapiens
  light chain complementarity determining region 3 for antibody 11324
QQRSSWPYT

SEQ ID NO: 22648 - protein, 12 aa, Homo sapiens
  heavy chain complementarity determining region 3 for antibody 11324
AREPYSPPYFDS

SEQ ID NO: 22649 - protein, 9 aa, Homo sapiens
  light chain complementarity determining region 3 for antibody 11325
QQRDNWPRT

SEQ ID NO: 22650 - protein, 16 aa, Homo sapiens
  heavy chain complementarity determining region 3 for antibody 11325
AKVPSYGDPTYNWFDP

SEQ ID NO: 22651 - protein, 9 aa, Homo sapiens
  light chain complementarity determining region 3 for antibody 11326
QQGNSYPRS

SEQ ID NO: 22652 - protein, 9 aa, Homo sapiens
  heavy chain complementarity determining region 3 for antibody 11326
ARGTVTLDY

SEQ ID NO: 22653 - protein, 9 aa, Homo sapiens
  light chain complementarity determining region 3 for antibody 11327
QQFHNLPLT

SEQ ID NO: 22654 - protein, 9 aa, Homo sapiens
  heavy chain complementarity determining region 3 for antibody 11327
VQGFSTWYS

SEQ ID NO: 22655 - protein, 9 aa, Homo sapiens
  light chain complementarity determining region 3 for antibody 11328
QQAYSVPRT

SEQ ID NO: 22656 - protein, 10 aa, Homo sapiens
  heavy chain complementarity determining region 3 for antibody 11328
ARDLGTAWDY

SEQ ID NO: 22657 - protein, 10 aa, Homo sapiens
  light chain complementarity determining region 3 for antibody 11329
QHYNTYSGYI

SEQ ID NO: 22658 - protein, 19 aa, Homo sapiens
  heavy chain complementarity determining region 3 for antibody 11329
ARVRLLDYGDYVGASHSDF

SEQ ID NO: 22659 - protein, 9 aa, Homo sapiens
  light chain complementarity determining region 3 for antibody 11330
MQSTHWPPT

SEQ ID NO: 22660 - protein, 8 aa, Homo sapiens
  heavy chain complementarity determining region 3 for antibody 11330
VRAEQFDY

SEQ ID NO: 22661 - protein, 9 aa, Homo sapiens
  light chain complementarity determining region 3 for antibody 11331
LQYNSFPRT

SEQ ID NO: 22662 - protein, 18 aa, Homo sapiens
  heavy chain complementarity determining region 3 for antibody 11331
ASSHYYDSNGSYKEDLDY

SEQ ID NO: 22663 - protein, 9 aa, Homo sapiens
  light chain complementarity determining region 3 for antibody 11332
LQHNSYPWT

SEQ ID NO: 22664 - protein, 11 aa, Homo sapiens
  heavy chain complementarity determining region 3 for antibody 11332
ARIPPNLTGDY

SEQ ID NO: 22665 - protein, 9 aa, Homo sapiens
  light chain complementarity determining region 3 for antibody 11333
HQYYSPSLT

SEQ ID NO: 22666 - protein, 13 aa, Homo sapiens
  heavy chain complementarity determining region 3 for antibody 11333
ARGEGSEFYGMDV

SEQ ID NO: 22667 - protein, 9 aa, Homo sapiens
  light chain complementarity determining region 3 for antibody 11334
HQYSRAPYT

SEQ ID NO: 22668 - protein, 21 aa, Homo sapiens
  heavy chain complementarity determining region 3 for antibody 11334
AQTLPELPHLKFFYSYYGMDV

SEQ ID NO: 22669 - protein, 10 aa, Homo sapiens
  light chain complementarity determining region 3 for antibody 11335
QYHGYSPLST

SEQ ID NO: 22670 - protein, 12 aa, Homo sapiens
  heavy chain complementarity determining region 3 for antibody 11335
AKGILGRGGMDV

SEQ ID NO: 22671 - protein, 10 aa, Homo sapiens
  light chain complementarity determining region 3 for antibody 11336
QQYNSYSLLT

SEQ ID NO: 22672 - protein, 19 aa, Homo sapiens
  heavy chain complementarity determining region 3 for antibody 11336
ARGLYTTYWSGYTGDGFDF

SEQ ID NO: 22673 - protein, 9 aa, Homo sapiens
  light chain complementarity determining region 3 for antibody 11337
QQYNSFPPT

SEQ ID NO: 22674 - protein, 19 aa, Homo sapiens
  heavy chain complementarity determining region 3 for antibody 11337
AKDPHSVVIGELLEPLFDS

SEQ ID NO: 22675 - protein, 9 aa, Homo sapiens
  light chain complementarity determining region 3 for antibody 11338
QQYGSSLWT

SEQ ID NO: 22676 - protein, 20 aa, Homo sapiens
  heavy chain complementarity determining region 3 for antibody 11338
ARATLLRYFDWPPPLVGVDV

SEQ ID NO: 22677 - protein, 8 aa, Homo sapiens
  light chain complementarity determining region 3 for antibody 11339
QQYGSSIT

SEQ ID NO: 22678 - protein, 14 aa, Homo sapiens
  heavy chain complementarity determining region 3 for antibody 11339
ARRRSVGGADHFDY

SEQ ID NO: 22679 - protein, 9 aa, Homo sapiens
  light chain complementarity determining region 3 for antibody 11340
QQYGDSLIT

SEQ ID NO: 22680 - protein, 19 aa, Homo sapiens
  heavy chain complementarity determining region 3 for antibody 11340
GSSIILRFFDWPPVNWFDP

SEQ ID NO: 22681 - protein, 9 aa, Homo sapiens
  light chain complementarity determining region 3 for antibody 11341
QQYESFPYT

SEQ ID NO: 22682 - protein, 17 aa, Homo sapiens
  heavy chain complementarity determining region 3 for antibody 11341
AREDYSDVDLRLYYFDT

SEQ ID NO: 22683 - protein, 11 aa, Homo sapiens
  light chain complementarity determining region 3 for antibody 11342
QQYDNLPPLFT

SEQ ID NO: 22684 - protein, 12 aa, Homo sapiens
  heavy chain complementarity determining region 3 for antibody 11342
ARGHLSDEAFDV

SEQ ID NO: 22685 - protein, 9 aa, Homo sapiens
  light chain complementarity determining region 3 for antibody 11343
QQSYSTPFN

SEQ ID NO: 22686 - protein, 18 aa, Homo sapiens
  heavy chain complementarity determining region 3 for antibody 11343
ARTRVGMYSGGSPFMFDP

SEQ ID NO: 22687 - protein, 9 aa, Homo sapiens
  light chain complementarity determining region 3 for antibody 11344
QQRGNWLWT

SEQ ID NO: 22688 - protein, 12 aa, Homo sapiens
  heavy chain complementarity determining region 3 for antibody 11344
ATTRNPPDGLDV

SEQ ID NO: 22689 - protein, 9 aa, Homo sapiens
  light chain complementarity determining region 3 for antibody 11345
QQANSSPIT

SEQ ID NO: 22690 - protein, 15 aa, Homo sapiens
  heavy chain complementarity determining region 3 for antibody 11345
ARCVDAACNYYGMDV

SEQ ID NO: 22691 - protein, 9 aa, Homo sapiens
  light chain complementarity determining region 3 for antibody 11346
QHRNNWGLT

SEQ ID NO: 22692 - protein, 22 aa, Homo sapiens
  heavy chain complementarity determining region 3 for antibody 11346
ARHSGYSNTWYMDYYYYYGMDV

SEQ ID NO: 22693 - protein, 9 aa, Homo sapiens
  light chain complementarity determining region 3 for antibody 11347
MQGTHWPYT

SEQ ID NO: 22694 - protein, 7 aa, Homo sapiens
  heavy chain complementarity determining region 3 for antibody 11347
ARGGIYP

SEQ ID NO: 22695 - protein, 9 aa, Homo sapiens
  light chain complementarity determining region 3 for antibody 11348
LQTYTTPWT

SEQ ID NO: 22696 - protein, 12 aa, Homo sapiens
  heavy chain complementarity determining region 3 for antibody 11348
ARDWGTGDHLKY

SEQ ID NO: 22697 - protein, 9 aa, Homo sapiens
  light chain complementarity determining region 3 for antibody 11349
QQYNSYSWT

SEQ ID NO: 22698 - protein, 20 aa, Homo sapiens
  heavy chain complementarity determining region 3 for antibody 11349
ATVGVLRYCTSTSCYNGWHY

SEQ ID NO: 22699 - protein, 9 aa, Homo sapiens
  light chain complementarity determining region 3 for antibody 11350
QQYNSYPYT

SEQ ID NO: 22700 - protein, 15 aa, Homo sapiens
  heavy chain complementarity determining region 3 for antibody 11350
ARVNAPSITWPLYDF

SEQ ID NO: 22701 - protein, 9 aa, Homo sapiens
  light chain complementarity determining region 3 for antibody 11351
QQYNSYPIT

SEQ ID NO: 22702 - protein, 16 aa, Homo sapiens
  heavy chain complementarity determining region 3 for antibody 11351
TRRWDYDSSGQRIVDY

SEQ ID NO: 22703 - protein, 8 aa, Homo sapiens
  light chain complementarity determining region 3 for antibody 11352
QQYDHLPT

SEQ ID NO: 22704 - protein, 19 aa, Homo sapiens
  heavy chain complementarity determining region 3 for antibody 11352
ARMAPYSDSSGYSTYQFDH

SEQ ID NO: 22705 - protein, 9 aa, Homo sapiens
  light chain complementarity determining region 3 for antibody 11353
QQSYSTPVT

SEQ ID NO: 22706 - protein, 14 aa, Homo sapiens
  heavy chain complementarity determining region 3 for antibody 11353
ARGTNYYDSSGYYL

SEQ ID NO: 22707 - protein, 9 aa, Homo sapiens
  light chain complementarity determining region 3 for antibody 11354
QQSYSNPPT

SEQ ID NO: 22708 - protein, 19 aa, Homo sapiens
  heavy chain complementarity determining region 3 for antibody 11354
TRLNRNCSSGSCYSEWFDP

SEQ ID NO: 22709 - protein, 10 aa, Homo sapiens
  light chain complementarity determining region 3 for antibody 11355
QQSYSNLGAT

SEQ ID NO: 22710 - protein, 21 aa, Homo sapiens
  heavy chain complementarity determining region 3 for antibody 11355
ARGSGDYLGGTFVYYYYGMDV

SEQ ID NO: 22711 - protein, 9 aa, Homo sapiens
  light chain complementarity determining region 3 for antibody 11356
QQSYRTPFT

SEQ ID NO: 22712 - protein, 22 aa, Homo sapiens
  heavy chain complementarity determining region 3 for antibody 11356
ARVPGITVAGPLTGYYYYGKDV

SEQ ID NO: 22713 - protein, 8 aa, Homo sapiens
  light chain complementarity determining region 3 for antibody 11357
QQFSSYPS

SEQ ID NO: 22714 - protein, 16 aa, Homo sapiens
  heavy chain complementarity determining region 3 for antibody 11357
ARVYSSDWYGGGAFDI

SEQ ID NO: 22715 - protein, 9 aa, Homo sapiens
  light chain complementarity determining region 3 for antibody 11358
LQHNSYPQT

SEQ ID NO: 22716 - protein, 11 aa, Homo sapiens
  heavy chain complementarity determining region 3 for antibody 11358
ARDHEGYGYYY

SEQ ID NO: 22717 - protein, 9 aa, Homo sapiens
  light chain complementarity determining region 3 for antibody 11359
QQYNTYPYT

SEQ ID NO: 22718 - protein, 17 aa, Homo sapiens
  heavy chain complementarity determining region 3 for antibody 11359
AREQWADVDLRQYYFDY

SEQ ID NO: 22719 - protein, 9 aa, Homo sapiens
  light chain complementarity determining region 3 for antibody 11360
QQYKSYPRT

SEQ ID NO: 22720 - protein, 24 aa, Homo sapiens
  heavy chain complementarity determining region 3 for antibody 11360
ARGSTDGTVTTFGVPVLERYYFDY

SEQ ID NO: 22721 - protein, 9 aa, Homo sapiens
  light chain complementarity determining region 3 for antibody 11361
QQYGSSRYT

SEQ ID NO: 22722 - protein, 23 aa, Homo sapiens
  heavy chain complementarity determining region 3 for antibody 11361
ARVGCSGEKCSSMSGYYYYALDV

SEQ ID NO: 22723 - protein, 10 aa, Homo sapiens
  light chain complementarity determining region 3 for antibody 11362
QQYGSSFPVT

SEQ ID NO: 22724 - protein, 18 aa, Homo sapiens
  heavy chain complementarity determining region 3 for antibody 11362
ARPNYYYASGSYYPQFDH

SEQ ID NO: 22725 - protein, 9 aa, Homo sapiens
  light chain complementarity determining region 3 for antibody 11363
QQYDTSPLT

SEQ ID NO: 22726 - protein, 13 aa, Homo sapiens
  heavy chain complementarity determining region 3 for antibody 11363
ARWGGNSLSAFDL

SEQ ID NO: 22727 - protein, 8 aa, Homo sapiens
  light chain complementarity determining region 3 for antibody 11364
QQYDSYWA

SEQ ID NO: 22728 - protein, 18 aa, Homo sapiens
  heavy chain complementarity determining region 3 for antibody 11364
AREGEITTHQPLGWFFDL

SEQ ID NO: 22729 - protein, 9 aa, Homo sapiens
  light chain complementarity determining region 3 for antibody 11365
QQYDNLPYT

SEQ ID NO: 22730 - protein, 17 aa, Homo sapiens
  heavy chain complementarity determining region 3 for antibody 11365
ARDMYNDVWGSRGIFDS

SEQ ID NO: 22731 - protein, 9 aa, Homo sapiens
  light chain complementarity determining region 3 for antibody 11366
QQTYATPRT

SEQ ID NO: 22732 - protein, 13 aa, Homo sapiens
  heavy chain complementarity determining region 3 for antibody 11366
ARVGAVAGRAFDV

SEQ ID NO: 22733 - protein, 10 aa, Homo sapiens
  light chain complementarity determining region 3 for antibody 11367
QQSYTTPFGT

SEQ ID NO: 22734 - protein, 20 aa, Homo sapiens
  heavy chain complementarity determining region 3 for antibody 11367
ARSSDWYIPTWRSHYYGMDV

SEQ ID NO: 22735 - protein, 9 aa, Homo sapiens
  light chain complementarity determining region 3 for antibody 11368
QQSYSAPRT

SEQ ID NO: 22736 - protein, 22 aa, Homo sapiens
  heavy chain complementarity determining region 3 for antibody 11368
AREERSYSSGWSGGSPYWFFDL

SEQ ID NO: 22737 - protein, 9 aa, Homo sapiens
  light chain complementarity determining region 3 for antibody 11369
QQSYNTPFT

SEQ ID NO: 22738 - protein, 15 aa, Homo sapiens
  heavy chain complementarity determining region 3 for antibody 11369
VKNGVGLSGRRYFQH

SEQ ID NO: 22739 - protein, 9 aa, Homo sapiens
  light chain complementarity determining region 3 for antibody 11370
QQSYKTPLT

SEQ ID NO: 22740 - protein, 14 aa, Homo sapiens
  heavy chain complementarity determining region 3 for antibody 11370
AKCNGWYGECYFDY

SEQ ID NO: 22741 - protein, 9 aa, Homo sapiens
  light chain complementarity determining region 3 for antibody 11371
QQATSFPYT

SEQ ID NO: 22742 - protein, 16 aa, Homo sapiens
  heavy chain complementarity determining region 3 for antibody 11371
SGADAGELGPLHWFDP

SEQ ID NO: 22743 - protein, 11 aa, Homo sapiens
  light chain complementarity determining region 3 for antibody 11372
QHLNSYSGGFT

SEQ ID NO: 22744 - protein, 19 aa, Homo sapiens
  heavy chain complementarity determining region 3 for antibody 11372
TRGGACSGDNCYSYYGTDV

SEQ ID NO: 22745 - protein, 9 aa, Homo sapiens
  light chain complementarity determining region 3 for antibody 11373
LQHNSYPRT

SEQ ID NO: 22746 - protein, 11 aa, Homo sapiens
  heavy chain complementarity determining region 3 for antibody 11373
ARGWELLSPDY

SEQ ID NO: 22747 - protein, 10 aa, Homo sapiens
  light chain complementarity determining region 3 for antibody 11374
QQYVNSGLFI

SEQ ID NO: 22748 - protein, 16 aa, Homo sapiens
  heavy chain complementarity determining region 3 for antibody 11374
AREIFKGEIDYYAMDV

SEQ ID NO: 22749 - protein, 9 aa, Homo sapiens
  light chain complementarity determining region 3 for antibody 11375
QQYSTSPGT

SEQ ID NO: 22750 - protein, 18 aa, Homo sapiens
  heavy chain complementarity determining region 3 for antibody 11375
ARYLYHDYWGGLLQPFDN

SEQ ID NO: 22751 - protein, 9 aa, Homo sapiens
  light chain complementarity determining region 3 for antibody 11376
QQYRDLPIT

SEQ ID NO: 22752 - protein, 20 aa, Homo sapiens
  heavy chain complementarity determining region 3 for antibody 11376
ARAQDYYDSSGYTVHYAMDV

SEQ ID NO: 22753 - protein, 9 aa, Homo sapiens
  light chain complementarity determining region 3 for antibody 11377
QQYNSFPYT

SEQ ID NO: 22754 - protein, 17 aa, Homo sapiens
  heavy chain complementarity determining region 3 for antibody 11377
AREDWSDVDLRLFYLDY

SEQ ID NO: 22755 - protein, 9 aa, Homo sapiens
  light chain complementarity determining region 3 for antibody 11378
QQYGSSLWT

SEQ ID NO: 22756 - protein, 14 aa, Homo sapiens
  heavy chain complementarity determining region 3 for antibody 11378
ARENYGDYDCGMDV

SEQ ID NO: 22757 - protein, 8 aa, Homo sapiens
  light chain complementarity determining region 3 for antibody 11379
QQYGNSLS

SEQ ID NO: 22758 - protein, 15 aa, Homo sapiens
  heavy chain complementarity determining region 3 for antibody 11379
ARRPEFQFGKYFFDY

SEQ ID NO: 22759 - protein, 9 aa, Homo sapiens
  light chain complementarity determining region 3 for antibody 11380
QQYDSYPYT

SEQ ID NO: 22760 - protein, 13 aa, Homo sapiens
  heavy chain complementarity determining region 3 for antibody 11380
AKGLDGYNLIGDT

SEQ ID NO: 22761 - protein, 9 aa, Homo sapiens
  light chain complementarity determining region 3 for antibody 11381
QQSYITPRT

SEQ ID NO: 22762 - protein, 15 aa, Homo sapiens
  heavy chain complementarity determining region 3 for antibody 11381
ARVQVTPSYYYGMDV

SEQ ID NO: 22763 - protein, 8 aa, Homo sapiens
  light chain complementarity determining region 3 for antibody 11382
QQSYGSPT

SEQ ID NO: 22764 - protein, 13 aa, Homo sapiens
  heavy chain complementarity determining region 3 for antibody 11382
ARDRPGTYYVFDY

SEQ ID NO: 22765 - protein, 8 aa, Homo sapiens
  light chain complementarity determining region 3 for antibody 11383
QQRSNWPR

SEQ ID NO: 22766 - protein, 18 aa, Homo sapiens
  heavy chain complementarity determining region 3 for antibody 11383
ARHQAQTFKRSVGGSFDI

SEQ ID NO: 22767 - protein, 8 aa, Homo sapiens
  light chain complementarity determining region 3 for antibody 11384
QQRSNWIT

SEQ ID NO: 22768 - protein, 13 aa, Homo sapiens
  heavy chain complementarity determining region 3 for antibody 11384
ATEGSYRPKWFDS

SEQ ID NO: 22769 - protein, 9 aa, Homo sapiens
  light chain complementarity determining region 3 for antibody 11385
QQATSFPFT

SEQ ID NO: 22770 - protein, 16 aa, Homo sapiens
  heavy chain complementarity determining region 3 for antibody 11385
AGADSGELGPLHWFDP

SEQ ID NO: 22771 - protein, 9 aa, Homo sapiens
  light chain complementarity determining region 3 for antibody 11386
QKYNSAPPA

SEQ ID NO: 22772 - protein, 14 aa, Homo sapiens
  heavy chain complementarity determining region 3 for antibody 11386
ARPKSVGTRDAFDI

SEQ ID NO: 22773 - protein, 9 aa, Homo sapiens
  light chain complementarity determining region 3 for antibody 11387
SQYGTSPRT

SEQ ID NO: 22774 - protein, 9 aa, Homo sapiens
  heavy chain complementarity determining region 3 for antibody 11387
AREWSGFDY

SEQ ID NO: 22775 - protein, 10 aa, Homo sapiens
  light chain complementarity determining region 3 for antibody 11388
QRTYNVSPIT

SEQ ID NO: 22776 - protein, 17 aa, Homo sapiens
  heavy chain complementarity determining region 3 for antibody 11388
ARRFGLYYFGASDYYDY

SEQ ID NO: 22777 - protein, 9 aa, Homo sapiens
  light chain complementarity determining region 3 for antibody 11389
QQYSVYPLT

SEQ ID NO: 22778 - protein, 14 aa, Homo sapiens
  heavy chain complementarity determining region 3 for antibody 11389
ARGSGPADIFEFDF

SEQ ID NO: 22779 - protein, 9 aa, Homo sapiens
  light chain complementarity determining region 3 for antibody 11390
QQYGSSLFT

SEQ ID NO: 22780 - protein, 16 aa, Homo sapiens
  heavy chain complementarity determining region 3 for antibody 11390
ARGGFGELGLQNAFDI

SEQ ID NO: 22781 - protein, 9 aa, Homo sapiens
  light chain complementarity determining region 3 for antibody 11391
QQSYSAPIT

SEQ ID NO: 22782 - protein, 16 aa, Homo sapiens
  heavy chain complementarity determining region 3 for antibody 11391
AREGSGTAMEEGYFDY

SEQ ID NO: 22783 - protein, 8 aa, Homo sapiens
  light chain complementarity determining region 3 for antibody 11392
QQSYNAIT

SEQ ID NO: 22784 - protein, 22 aa, Homo sapiens
  heavy chain complementarity determining region 3 for antibody 11392
AKDIAMIVVVVENPDTPDTLDY

SEQ ID NO: 22785 - protein, 10 aa, Homo sapiens
  light chain complementarity determining region 3 for antibody 11393
QQRANWPPIT

SEQ ID NO: 22786 - protein, 18 aa, Homo sapiens
  heavy chain complementarity determining region 3 for antibody 11393
AKDLAPSMRVVAQGAFDI

SEQ ID NO: 22787 - protein, 9 aa, Homo sapiens
  light chain complementarity determining region 3 for antibody 11394
QQGHSLPFT

SEQ ID NO: 22788 - protein, 19 aa, Homo sapiens
  heavy chain complementarity determining region 3 for antibody 11394
ARSDYSGETDRYYDYGLDV

SEQ ID NO: 22789 - protein, 9 aa, Homo sapiens
  light chain complementarity determining region 3 for antibody 11395
QKYDSAPLT

SEQ ID NO: 22790 - protein, 18 aa, Homo sapiens
  heavy chain complementarity determining region 3 for antibody 11395
ARDSYDVLTGPNPGGLDV

SEQ ID NO: 22791 - protein, 9 aa, Homo sapiens
  light chain complementarity determining region 3 for antibody 11396
QHYYSYPIT

SEQ ID NO: 22792 - protein, 12 aa, Homo sapiens
  heavy chain complementarity determining region 3 for antibody 11396
APSIAVAGLLDY

SEQ ID NO: 22793 - protein, 11 aa, Homo sapiens
  light chain complementarity determining region 3 for antibody 11397
QERTNWPSRIT

SEQ ID NO: 22794 - protein, 14 aa, Homo sapiens
  heavy chain complementarity determining region 3 for antibody 11397
ARDSLLYSSSSLDY

SEQ ID NO: 22795 - protein, 9 aa, Homo sapiens
  light chain complementarity determining region 3 for antibody 11398
MQGLLTPPA

SEQ ID NO: 22796 - protein, 18 aa, Homo sapiens
  heavy chain complementarity determining region 3 for antibody 11398
ARTRFGVYSGSSPFMFDP

SEQ ID NO: 22797 - protein, 9 aa, Homo sapiens
  light chain complementarity determining region 3 for antibody 11399
QQYNSYPWT

SEQ ID NO: 22798 - protein, 15 aa, Homo sapiens
  heavy chain complementarity determining region 3 for antibody 11399
ATRGGYKWSDKAFTI

SEQ ID NO: 22799 - protein, 9 aa, Homo sapiens
  light chain complementarity determining region 3 for antibody 11400
QQYNSFPPT

SEQ ID NO: 22800 - protein, 19 aa, Homo sapiens
  heavy chain complementarity determining region 3 for antibody 11400
AKDPHPVVIGDLLEPVFDH

SEQ ID NO: 22801 - protein, 6 aa, Homo sapiens
  light chain complementarity determining region 3 for antibody 11401
QQYNSF

SEQ ID NO: 22802 - protein, 17 aa, Homo sapiens
  heavy chain complementarity determining region 3 for antibody 11401
ARVVSKPYIRGWFGMDI

SEQ ID NO: 22803 - protein, 8 aa, Homo sapiens
  light chain complementarity determining region 3 for antibody 11402
QQYGTSKT

SEQ ID NO: 22804 - protein, 14 aa, Homo sapiens
  heavy chain complementarity determining region 3 for antibody 11402
AREGGFTLTNWFDL

SEQ ID NO: 22805 - protein, 11 aa, Homo sapiens
  light chain complementarity determining region 3 for antibody 11403
QQYDPYSRMYT

SEQ ID NO: 22806 - protein, 10 aa, Homo sapiens
  heavy chain complementarity determining region 3 for antibody 11403
ARPRAGALDF

SEQ ID NO: 22807 - protein, 10 aa, Homo sapiens
  light chain complementarity determining region 3 for antibody 11404
QQSYTMSFIT

SEQ ID NO: 22808 - protein, 12 aa, Homo sapiens
  heavy chain complementarity determining region 3 for antibody 11404
ARSQLRENFFDP

SEQ ID NO: 22809 - protein, 9 aa, Homo sapiens
  light chain complementarity determining region 3 for antibody 11405
QQSYSTPWT

SEQ ID NO: 22810 - protein, 14 aa, Homo sapiens
  heavy chain complementarity determining region 3 for antibody 11405
ARERVGRGMALFDY

SEQ ID NO: 22811 - protein, 9 aa, Homo sapiens
  light chain complementarity determining region 3 for antibody 11406
QQSYSTKWT

SEQ ID NO: 22812 - protein, 18 aa, Homo sapiens
  heavy chain complementarity determining region 3 for antibody 11406
ARDSLLGYCSSTSCWFDP

SEQ ID NO: 22813 - protein, 9 aa, Homo sapiens
  light chain complementarity determining region 3 for antibody 11407
QQSDSSPRT

SEQ ID NO: 22814 - protein, 18 aa, Homo sapiens
  heavy chain complementarity determining region 3 for antibody 11407
ARSSLIIAVPATLDAFDI

SEQ ID NO: 22815 - protein, 9 aa, Homo sapiens
  light chain complementarity determining region 3 for antibody 11408
QHYNSYPYT

SEQ ID NO: 22816 - protein, 15 aa, Homo sapiens
  heavy chain complementarity determining region 3 for antibody 11408
AGAGDRYDVDHGMDV

SEQ ID NO: 22817 - protein, 10 aa, Homo sapiens
  light chain complementarity determining region 3 for antibody 11409
MQGTYWPLLT

SEQ ID NO: 22818 - protein, 10 aa, Homo sapiens
  heavy chain complementarity determining region 3 for antibody 11409
ARENNWGPDR

SEQ ID NO: 22819 - protein, 8 aa, Homo sapiens
  light chain complementarity determining region 3 for antibody 11410
MQAQQTLT

SEQ ID NO: 22820 - protein, 19 aa, Homo sapiens
  heavy chain complementarity determining region 3 for antibody 11410
ARVARNDNGDRPYYFGMDV

SEQ ID NO: 22821 - protein, 9 aa, Homo sapiens
  light chain complementarity determining region 3 for antibody 11411
LQDYNYPWT

SEQ ID NO: 22822 - protein, 17 aa, Homo sapiens
  heavy chain complementarity determining region 3 for antibody 11411
VRGMTGTSSTSDYYFDH

SEQ ID NO: 22823 - protein, 9 aa, Homo sapiens
  light chain complementarity determining region 3 for antibody 11412
QYCGTSSWT

SEQ ID NO: 22824 - protein, 12 aa, Homo sapiens
  heavy chain complementarity determining region 3 for antibody 11412
ARDERFDEAFDI

SEQ ID NO: 22825 - protein, 9 aa, Homo sapiens
  light chain complementarity determining region 3 for antibody 11413
QQYTSWPIT

SEQ ID NO: 22826 - protein, 15 aa, Homo sapiens
  heavy chain complementarity determining region 3 for antibody 11413
AKDWGVSGWYNWFDP

SEQ ID NO: 22827 - protein, 9 aa, Homo sapiens
  light chain complementarity determining region 3 for antibody 11414
QQYSKWPLT

SEQ ID NO: 22828 - protein, 24 aa, Homo sapiens
  heavy chain complementarity determining region 3 for antibody 11414
AKDTKSIGAMLVGIPNHLNNWFDP

SEQ ID NO: 22829 - protein, 9 aa, Homo sapiens
  light chain complementarity determining region 3 for antibody 11415
QQYNSYPYT

SEQ ID NO: 22830 - protein, 16 aa, Homo sapiens
  heavy chain complementarity determining region 3 for antibody 11415
AKDLVHSGSSWWGPDS

SEQ ID NO: 22831 - protein, 10 aa, Homo sapiens
  light chain complementarity determining region 3 for antibody 11416
QQYGTSPRYT

SEQ ID NO: 22832 - protein, 12 aa, Homo sapiens
  heavy chain complementarity determining region 3 for antibody 11416
AGGISSRFYFDY

SEQ ID NO: 22833 - protein, 9 aa, Homo sapiens
  light chain complementarity determining region 3 for antibody 11417
QQSYITPRT

SEQ ID NO: 22834 - protein, 19 aa, Homo sapiens
  heavy chain complementarity determining region 3 for antibody 11417
ARDGPILRFFDDPVYGMDV

SEQ ID NO: 22835 - protein, 9 aa, Homo sapiens
  light chain complementarity determining region 3 for antibody 11418
QQSYITPIT

SEQ ID NO: 22836 - protein, 15 aa, Homo sapiens
  heavy chain complementarity determining region 3 for antibody 11418
AQGGSSLVVAARFDP

SEQ ID NO: 22837 - protein, 10 aa, Homo sapiens
  light chain complementarity determining region 3 for antibody 11419
QQSYGPPPLT

SEQ ID NO: 22838 - protein, 20 aa, Homo sapiens
  heavy chain complementarity determining region 3 for antibody 11419
TRHFRETLGGLKREFAAFDI

SEQ ID NO: 22839 - protein, 9 aa, Homo sapiens
  light chain complementarity determining region 3 for antibody 11420
QQLNDYPRT

SEQ ID NO: 22840 - protein, 15 aa, Homo sapiens
  heavy chain complementarity determining region 3 for antibody 11420
ARDIRSFDRGTLGNE

SEQ ID NO: 22841 - protein, 9 aa, Homo sapiens
  light chain complementarity determining region 3 for antibody 11421
QQFAHVPLT

SEQ ID NO: 22842 - protein, 8 aa, Homo sapiens
  heavy chain complementarity determining region 3 for antibody 11421
ARDLIITS

SEQ ID NO: 22843 - protein, 10 aa, Homo sapiens
  light chain complementarity determining region 3 for antibody 11422
QQANSFLSLT

SEQ ID NO: 22844 - protein, 15 aa, Homo sapiens
  heavy chain complementarity determining region 3 for antibody 11422
ARGGYEKGGGVDFDL

SEQ ID NO: 22845 - protein, 11 aa, Homo sapiens
  light chain complementarity determining region 3 for antibody 11423
QLRYNWPPVLT

SEQ ID NO: 22846 - protein, 17 aa, Homo sapiens
  heavy chain complementarity determining region 3 for antibody 11423
ARDEGGGGRLLVAAPDY

SEQ ID NO: 22847 - protein, 10 aa, Homo sapiens
  light chain complementarity determining region 3 for antibody 11424
QHYDPSPMYT

SEQ ID NO: 22848 - protein, 10 aa, Homo sapiens
  heavy chain complementarity determining region 3 for antibody 11424
ARHGFYSLEW

SEQ ID NO: 22849 - protein, 7 aa, Homo sapiens
  light chain complementarity determining region 3 for antibody 11425
QEANSFP

SEQ ID NO: 22850 - protein, 19 aa, Homo sapiens
  heavy chain complementarity determining region 3 for antibody 11425
AKEDVTVFGVPEYYYGMDV

SEQ ID NO: 22851 - protein, 11 aa, Homo sapiens
  light chain complementarity determining region 3 for antibody 11426
QYNGSSPPENT

SEQ ID NO: 22852 - protein, 17 aa, Homo sapiens
  heavy chain complementarity determining region 3 for antibody 11426
ARESYDVLTGYNYGMDV

SEQ ID NO: 22853 - protein, 10 aa, Homo sapiens
  light chain complementarity determining region 3 for antibody 11427
QYHGYSPLYP

SEQ ID NO: 22854 - protein, 12 aa, Homo sapiens
  heavy chain complementarity determining region 3 for antibody 11427
AKGILGRGGMDV

SEQ ID NO: 22855 - protein, 10 aa, Homo sapiens
  light chain complementarity determining region 3 for antibody 11428
QYHGTSPLYT

SEQ ID NO: 22856 - protein, 12 aa, Homo sapiens
  heavy chain complementarity determining region 3 for antibody 11428
AKGILGRGGMDV

SEQ ID NO: 22857 - protein, 10 aa, Homo sapiens
  light chain complementarity determining region 3 for antibody 11429
QQYVSSALFT

SEQ ID NO: 22858 - protein, 16 aa, Homo sapiens
  heavy chain complementarity determining region 3 for antibody 11429
ARELFKGEIDYYGMDV

SEQ ID NO: 22859 - protein, 9 aa, Homo sapiens
  light chain complementarity determining region 3 for antibody 11430
QQYNSYSRT

SEQ ID NO: 22860 - protein, 18 aa, Homo sapiens
  heavy chain complementarity determining region 3 for antibody 11430
ARGGSWGGDFDLGRENDY

SEQ ID NO: 22861 - protein, 9 aa, Homo sapiens
  light chain complementarity determining region 3 for antibody 11431
QQYNDYSLF

SEQ ID NO: 22862 - protein, 14 aa, Homo sapiens
  heavy chain complementarity determining region 3 for antibody 11431
ARRPTWFGTAYFDY

SEQ ID NO: 22863 - protein, 9 aa, Homo sapiens
  light chain complementarity determining region 3 for antibody 11432
QQYKSSPFT

SEQ ID NO: 22864 - protein, 13 aa, Homo sapiens
  heavy chain complementarity determining region 3 for antibody 11432
ARGGEQWVAWFDP

SEQ ID NO: 22865 - protein, 10 aa, Homo sapiens
  light chain complementarity determining region 3 for antibody 11433
QQYHNYPPIT

SEQ ID NO: 22866 - protein, 21 aa, Homo sapiens
  heavy chain complementarity determining region 3 for antibody 11433
ARDQVGIAGRRWTYEYYGMDV

SEQ ID NO: 22867 - protein, 10 aa, Homo sapiens
  light chain complementarity determining region 3 for antibody 11434
QQYGSSLPWT

SEQ ID NO: 22868 - protein, 14 aa, Homo sapiens
  heavy chain complementarity determining region 3 for antibody 11434
ARDRNNNWWGGIDY

SEQ ID NO: 22869 - protein, 10 aa, Homo sapiens
  light chain complementarity determining region 3 for antibody 11435
QQTNSFPLLA

SEQ ID NO: 22870 - protein, 19 aa, Homo sapiens
  heavy chain complementarity determining region 3 for antibody 11435
ARTPWTTATGLPNYYAMDV

SEQ ID NO: 22871 - protein, 9 aa, Homo sapiens
  light chain complementarity determining region 3 for antibody 11436
QQSYSTPYT

SEQ ID NO: 22872 - protein, 12 aa, Homo sapiens
  heavy chain complementarity determining region 3 for antibody 11436
ANLPVANTPSVP

SEQ ID NO: 22873 - protein, 9 aa, Homo sapiens
  light chain complementarity determining region 3 for antibody 11437
QQSYSTPLT

SEQ ID NO: 22874 - protein, 17 aa, Homo sapiens
  heavy chain complementarity determining region 3 for antibody 11437
ARGSGSPGHYYYYGMDV

SEQ ID NO: 22875 - protein, 9 aa, Homo sapiens
  light chain complementarity determining region 3 for antibody 11438
QQGHSIPFT

SEQ ID NO: 22876 - protein, 19 aa, Homo sapiens
  heavy chain complementarity determining region 3 for antibody 11438
ARSDYSGDTDRYYDYGMDV

SEQ ID NO: 22877 - protein, 9 aa, Homo sapiens
  light chain complementarity determining region 3 for antibody 11439
QKYNSAPRT

SEQ ID NO: 22878 - protein, 20 aa, Homo sapiens
  heavy chain complementarity determining region 3 for antibody 11439
ARGGKYSSNFPYFYHYGLDV

SEQ ID NO: 22879 - protein, 9 aa, Homo sapiens
  light chain complementarity determining region 3 for antibody 11440
QKYNNAPLT

SEQ ID NO: 22880 - protein, 17 aa, Homo sapiens
  heavy chain complementarity determining region 3 for antibody 11440
AAPRFTSSWPAEKPFDY

SEQ ID NO: 22881 - protein, 10 aa, Homo sapiens
  light chain complementarity determining region 3 for antibody 11441
QHYGSLSLGT

SEQ ID NO: 22882 - protein, 25 aa, Homo sapiens
  heavy chain complementarity determining region 3 for antibody 11441
ARDIPTAVDVRDVLSGRDYYYGMDV

SEQ ID NO: 22883 - protein, 10 aa, Homo sapiens
  light chain complementarity determining region 3 for antibody 11442
MQGTHWPPYT

SEQ ID NO: 22884 - protein, 9 aa, Homo sapiens
  heavy chain complementarity determining region 3 for antibody 11442
LRDNYGADY

SEQ ID NO: 22885 - protein, 9 aa, Homo sapiens
  light chain complementarity determining region 3 for antibody 11443
MQGTHWPGT

SEQ ID NO: 22886 - protein, 15 aa, Homo sapiens
  heavy chain complementarity determining region 3 for antibody 11443
ARDRPHPLTGQDPDF

SEQ ID NO: 22887 - protein, 9 aa, Homo sapiens
  light chain complementarity determining region 3 for antibody 11444
MQALQTPVT

SEQ ID NO: 22888 - protein, 15 aa, Homo sapiens
  heavy chain complementarity determining region 3 for antibody 11444
AKGDYGSGIELALDY

SEQ ID NO: 22889 - protein, 9 aa, Homo sapiens
  light chain complementarity determining region 3 for antibody 11445
LQDYNYPRT

SEQ ID NO: 22890 - protein, 19 aa, Homo sapiens
  heavy chain complementarity determining region 3 for antibody 11445
ARDQSPGNFITGYYDAFDI

SEQ ID NO: 22891 - protein, 8 aa, Homo sapiens
  light chain complementarity determining region 3 for antibody 11446
QRYDSAIT

SEQ ID NO: 22892 - protein, 15 aa, Homo sapiens
  heavy chain complementarity determining region 3 for antibody 11446
AKGPGWAVAKRFFNY

SEQ ID NO: 22893 - protein, 10 aa, Homo sapiens
  light chain complementarity determining region 3 for antibody 11447
QQYNDGPTQS

SEQ ID NO: 22894 - protein, 15 aa, Homo sapiens
  heavy chain complementarity determining region 3 for antibody 11447
AKETNQYAGGWYYDQ

SEQ ID NO: 22895 - protein, 9 aa, Homo sapiens
  light chain complementarity determining region 3 for antibody 11448
QQYKSYPFT

SEQ ID NO: 22896 - protein, 15 aa, Homo sapiens
  heavy chain complementarity determining region 3 for antibody 11448
VREGCGGDCNDALDV

SEQ ID NO: 22897 - protein, 9 aa, Homo sapiens
  light chain complementarity determining region 3 for antibody 11449
QQYHNYPWT

SEQ ID NO: 22898 - protein, 11 aa, Homo sapiens
  heavy chain complementarity determining region 3 for antibody 11449
ARSASGDYFDN

SEQ ID NO: 22899 - protein, 10 aa, Homo sapiens
  light chain complementarity determining region 3 for antibody 11450
QQYGSVPPYT

SEQ ID NO: 22900 - protein, 17 aa, Homo sapiens
  heavy chain complementarity determining region 3 for antibody 11450
ARGVGLVPSYHYYAMDA

SEQ ID NO: 22901 - protein, 9 aa, Homo sapiens
  light chain complementarity determining region 3 for antibody 11451
QQYGSSPRT

SEQ ID NO: 22902 - protein, 11 aa, Homo sapiens
  heavy chain complementarity determining region 3 for antibody 11451
ARSWQKGAFDI

SEQ ID NO: 22903 - protein, 9 aa, Homo sapiens
  light chain complementarity determining region 3 for antibody 11452
QQYGSSPRT

SEQ ID NO: 22904 - protein, 17 aa, Homo sapiens
  heavy chain complementarity determining region 3 for antibody 11452
ARDDFVSDRIFYKGMDV

SEQ ID NO: 22905 - protein, 9 aa, Homo sapiens
  light chain complementarity determining region 3 for antibody 11453
QQYDTSPWT

SEQ ID NO: 22906 - protein, 19 aa, Homo sapiens
  heavy chain complementarity determining region 3 for antibody 11453
AKTGGSGYCYNRVCATHNY

SEQ ID NO: 22907 - protein, 9 aa, Homo sapiens
  light chain complementarity determining region 3 for antibody 11454
QQYDDLPLT

SEQ ID NO: 22908 - protein, 21 aa, Homo sapiens
  heavy chain complementarity determining region 3 for antibody 11454
ARALPTEYYSSGDYSLGIFDS

SEQ ID NO: 22909 - protein, 8 aa, Homo sapiens
  light chain complementarity determining region 3 for antibody 11455
QQYASSKT

SEQ ID NO: 22910 - protein, 10 aa, Homo sapiens
  heavy chain complementarity determining region 3 for antibody 11455
AREGAGGFDY

SEQ ID NO: 22911 - protein, 9 aa, Homo sapiens
  light chain complementarity determining region 3 for antibody 11456
QQTYSRPLT

SEQ ID NO: 22912 - protein, 13 aa, Homo sapiens
  heavy chain complementarity determining region 3 for antibody 11456
ARMQDAGTLGSDY

SEQ ID NO: 22913 - protein, 9 aa, Homo sapiens
  light chain complementarity determining region 3 for antibody 11457
QQSYSTPYT

SEQ ID NO: 22914 - protein, 13 aa, Homo sapiens
  heavy chain complementarity determining region 3 for antibody 11457
ARGSMYASTWYAF

SEQ ID NO: 22915 - protein, 9 aa, Homo sapiens
  light chain complementarity determining region 3 for antibody 11458
QQSYSTPRT

SEQ ID NO: 22916 - protein, 12 aa, Homo sapiens
  heavy chain complementarity determining region 3 for antibody 11458
ASTYPYAAGYDH

SEQ ID NO: 22917 - protein, 10 aa, Homo sapiens
  light chain complementarity determining region 3 for antibody 11459
QQRSSWQGTT

SEQ ID NO: 22918 - protein, 14 aa, Homo sapiens
  heavy chain complementarity determining region 3 for antibody 11459
AHSEREWLSGWPDP

SEQ ID NO: 22919 - protein, 9 aa, Homo sapiens
  light chain complementarity determining region 3 for antibody 11460
QQRSNWPIA

SEQ ID NO: 22920 - protein, 19 aa, Homo sapiens
  heavy chain complementarity determining region 3 for antibody 11460
ARVVAYSGLSRDPENWFDL

SEQ ID NO: 22921 - protein, 9 aa, Homo sapiens
  light chain complementarity determining region 3 for antibody 11461
LQRANWPFT

SEQ ID NO: 22922 - protein, 14 aa, Homo sapiens
  heavy chain complementarity determining region 3 for antibody 11461
AKDGRPNIAGLIDS

SEQ ID NO: 22923 - protein, 9 aa, Homo sapiens
  light chain complementarity determining region 3 for antibody 11462
QQYNSYSWT

SEQ ID NO: 22924 - protein, 15 aa, Homo sapiens
  heavy chain complementarity determining region 3 for antibody 11462
GKMPGGGEHTEFFHY

SEQ ID NO: 22925 - protein, 9 aa, Homo sapiens
  light chain complementarity determining region 3 for antibody 11463
QQYNSYSRT

SEQ ID NO: 22926 - protein, 13 aa, Homo sapiens
  heavy chain complementarity determining region 3 for antibody 11463
ARAGRDFYYGMDV

SEQ ID NO: 22927 - protein, 9 aa, Homo sapiens
  light chain complementarity determining region 3 for antibody 11464
QQYNSFTWT

SEQ ID NO: 22928 - protein, 13 aa, Homo sapiens
  heavy chain complementarity determining region 3 for antibody 11464
ARFLGFPYDAFDI

SEQ ID NO: 22929 - protein, 9 aa, Homo sapiens
  light chain complementarity determining region 3 for antibody 11465
QQYITYPYT

SEQ ID NO: 22930 - protein, 17 aa, Homo sapiens
  heavy chain complementarity determining region 3 for antibody 11465
AREDWNDVDLREYYLDY

SEQ ID NO: 22931 - protein, 8 aa, Homo sapiens
  light chain complementarity determining region 3 for antibody 11466
QQYISFWT

SEQ ID NO: 22932 - protein, 17 aa, Homo sapiens
  heavy chain complementarity determining region 3 for antibody 11466
ARGYSDYDRNGPFYFDF

SEQ ID NO: 22933 - protein, 9 aa, Homo sapiens
  light chain complementarity determining region 3 for antibody 11467
QQYGSSPWT

SEQ ID NO: 22934 - protein, 12 aa, Homo sapiens
  heavy chain complementarity determining region 3 for antibody 11467
ARVGRYLNWFDP

SEQ ID NO: 22935 - protein, 9 aa, Homo sapiens
  light chain complementarity determining region 3 for antibody 11468
QQYGSSPQT

SEQ ID NO: 22936 - protein, 15 aa, Homo sapiens
  heavy chain complementarity determining region 3 for antibody 11468
AREMKGRGHYYGMDV

SEQ ID NO: 22937 - protein, 9 aa, Homo sapiens
  light chain complementarity determining region 3 for antibody 11469
QQSYSTPYT

SEQ ID NO: 22938 - protein, 12 aa, Homo sapiens
  heavy chain complementarity determining region 3 for antibody 11469
VRGRTVGGLFDY

SEQ ID NO: 22939 - protein, 9 aa, Homo sapiens
  light chain complementarity determining region 3 for antibody 11470
QQSYSTPLT

SEQ ID NO: 22940 - protein, 13 aa, Homo sapiens
  heavy chain complementarity determining region 3 for antibody 11470
ARVYSSTWYNFDS

SEQ ID NO: 22941 - protein, 9 aa, Homo sapiens
  light chain complementarity determining region 3 for antibody 11471
QQSYFTPRT

SEQ ID NO: 22942 - protein, 9 aa, Homo sapiens
  heavy chain complementarity determining region 3 for antibody 11471
ARVWYRFDP

SEQ ID NO: 22943 - protein, 9 aa, Homo sapiens
  light chain complementarity determining region 3 for antibody 11472
QQLIGYPRT

SEQ ID NO: 22944 - protein, 19 aa, Homo sapiens
  heavy chain complementarity determining region 3 for antibody 11472
AREQMYYDTSGYPTTHFDS

SEQ ID NO: 22945 - protein, 9 aa, Homo sapiens
  light chain complementarity determining region 3 for antibody 11473
QQGFSFPWT

SEQ ID NO: 22946 - protein, 14 aa, Homo sapiens
  heavy chain complementarity determining region 3 for antibody 11473
ARVRAGAGKGWFDS

SEQ ID NO: 22947 - protein, 9 aa, Homo sapiens
  light chain complementarity determining region 3 for antibody 11474
QQFSGYPLT

SEQ ID NO: 22948 - protein, 17 aa, Homo sapiens
  heavy chain complementarity determining region 3 for antibody 11474
ARDRLATIRNSYYGMDV

SEQ ID NO: 22949 - protein, 8 aa, Homo sapiens
  light chain complementarity determining region 3 for antibody 11475
QQANSVPP

SEQ ID NO: 22950 - protein, 22 aa, Homo sapiens
  heavy chain complementarity determining region 3 for antibody 11475
ARHSGYSNTWYMNYYYYYGMDV

SEQ ID NO: 22951 - protein, 9 aa, Homo sapiens
  light chain complementarity determining region 3 for antibody 11476
QNYNNAPLT

SEQ ID NO: 22952 - protein, 18 aa, Homo sapiens
  heavy chain complementarity determining region 3 for antibody 11476
AKDLAPSMRVVAQGALDI

SEQ ID NO: 22953 - protein, 9 aa, Homo sapiens
  light chain complementarity determining region 3 for antibody 11477
QHSYDIPYT

SEQ ID NO: 22954 - protein, 15 aa, Homo sapiens
  heavy chain complementarity determining region 3 for antibody 11477
ARDSTNWGSVWYFDL

SEQ ID NO: 22955 - protein, 10 aa, Homo sapiens
  light chain complementarity determining region 3 for antibody 11478
QESYSTPPLT

SEQ ID NO: 22956 - protein, 20 aa, Homo sapiens
  heavy chain complementarity determining region 3 for antibody 11478
ARHFRETLGGQVREFAAFDI

SEQ ID NO: 22957 - protein, 9 aa, Homo sapiens
  light chain complementarity determining region 3 for antibody 11479
MQGLLSPPA

SEQ ID NO: 22958 - protein, 18 aa, Homo sapiens
  heavy chain complementarity determining region 3 for antibody 11479
ARTRVGMYSGGSPFMFDP

SEQ ID NO: 22959 - protein, 9 aa, Homo sapiens
  light chain complementarity determining region 3 for antibody 11480
LQDYNYPRT

SEQ ID NO: 22960 - protein, 13 aa, Homo sapiens
  heavy chain complementarity determining region 3 for antibody 11480
LHDSNKWYSRFDY

SEQ ID NO: 22961 - protein, 9 aa, Homo sapiens
  light chain complementarity determining region 3 for antibody 11481
QQYSNWPLT

SEQ ID NO: 22962 - protein, 18 aa, Homo sapiens
  heavy chain complementarity determining region 3 for antibody 11481
AKEVFSVGGGTHLCFFDY

SEQ ID NO: 22963 - protein, 9 aa, Homo sapiens
  light chain complementarity determining region 3 for antibody 11482
QQYNSFPYT

SEQ ID NO: 22964 - protein, 17 aa, Homo sapiens
  heavy chain complementarity determining region 3 for antibody 11482
AREDWNDVDLQLYYLDY

SEQ ID NO: 22965 - protein, 9 aa, Homo sapiens
  light chain complementarity determining region 3 for antibody 11483
QQYHNYPYT

SEQ ID NO: 22966 - protein, 17 aa, Homo sapiens
  heavy chain complementarity determining region 3 for antibody 11483
ARQIDIVVEIVSDGLDV

SEQ ID NO: 22967 - protein, 9 aa, Homo sapiens
  light chain complementarity determining region 3 for antibody 11484
QQYDNLPIT

SEQ ID NO: 22968 - protein, 20 aa, Homo sapiens
  heavy chain complementarity determining region 3 for antibody 11484
ARESTEGSGRARTLYYGMDV

SEQ ID NO: 22969 - protein, 9 aa, Homo sapiens
  light chain complementarity determining region 3 for antibody 11485
QQSYTTPIT

SEQ ID NO: 22970 - protein, 12 aa, Homo sapiens
  heavy chain complementarity determining region 3 for antibody 11485
ARGLSGPNWFGP

SEQ ID NO: 22971 - protein, 10 aa, Homo sapiens
  light chain complementarity determining region 3 for antibody 11486
QQSYSTPPIT

SEQ ID NO: 22972 - protein, 10 aa, Homo sapiens
  heavy chain complementarity determining region 3 for antibody 11486
ARQPAGHLDL

SEQ ID NO: 22973 - protein, 9 aa, Homo sapiens
  light chain complementarity determining region 3 for antibody 11487
QQSHSVPLT

SEQ ID NO: 22974 - protein, 20 aa, Homo sapiens
  heavy chain complementarity determining region 3 for antibody 11487
AQDVRSPFPSGRTWAHFFDS

SEQ ID NO: 22975 - protein, 9 aa, Homo sapiens
  light chain complementarity determining region 3 for antibody 11488
QQSHSTPNT

SEQ ID NO: 22976 - protein, 17 aa, Homo sapiens
  heavy chain complementarity determining region 3 for antibody 11488
AREIDDSSGYYFPECDY

SEQ ID NO: 22977 - protein, 9 aa, Homo sapiens
  light chain complementarity determining region 3 for antibody 11489
QQSHNTPWT

SEQ ID NO: 22978 - protein, 14 aa, Homo sapiens
  heavy chain complementarity determining region 3 for antibody 11489
ARESCEDGVCKFDY

SEQ ID NO: 22979 - protein, 10 aa, Homo sapiens
  light chain complementarity determining region 3 for antibody 11490
QQRGDWPPLT

SEQ ID NO: 22980 - protein, 12 aa, Homo sapiens
  heavy chain complementarity determining region 3 for antibody 11490
TSTTGIVVVKDY

SEQ ID NO: 22981 - protein, 11 aa, Homo sapiens
  light chain complementarity determining region 3 for antibody 11491
QQLDSFMRGIT

SEQ ID NO: 22982 - protein, 17 aa, Homo sapiens
  heavy chain complementarity determining region 3 for antibody 11491
ARERQYCDDLSCYGEDS

SEQ ID NO: 22983 - protein, 9 aa, Homo sapiens
  light chain complementarity determining region 3 for antibody 11492
QQAKTFPHT

SEQ ID NO: 22984 - protein, 13 aa, Homo sapiens
  heavy chain complementarity determining region 3 for antibody 11492
ARGRRFENQFFDY

SEQ ID NO: 22985 - protein, 9 aa, Homo sapiens
  light chain complementarity determining region 3 for antibody 11493
MQGTHWPPT

SEQ ID NO: 22986 - protein, 15 aa, Homo sapiens
  heavy chain complementarity determining region 3 for antibody 11493
ARGRRGFREGMGLDV

SEQ ID NO: 22987 - protein, 9 aa, Homo sapiens
  light chain complementarity determining region 3 for antibody 11494
MQGTHWPPT

SEQ ID NO: 22988 - protein, 15 aa, Homo sapiens
  heavy chain complementarity determining region 3 for antibody 11494
ARGRRGFQEGMGMDV

SEQ ID NO: 22989 - protein, 9 aa, Homo sapiens
  light chain complementarity determining region 3 for antibody 11495
LHDYNYPRT

SEQ ID NO: 22990 - protein, 14 aa, Homo sapiens
  heavy chain complementarity determining region 3 for antibody 11495
AREGVRGNFAYFDY

SEQ ID NO: 22991 - protein, 9 aa, Homo sapiens
  light chain complementarity determining region 3 for antibody 11496
HQYNSLPYT

SEQ ID NO: 22992 - protein, 17 aa, Homo sapiens
  heavy chain complementarity determining region 3 for antibody 11496
AREDWSDVDLRQFYLES

SEQ ID NO: 22993 - protein, 9 aa, Homo sapiens
  light chain complementarity determining region 3 for antibody 11497
VQGTHWPYT

SEQ ID NO: 22994 - protein, 13 aa, Homo sapiens
  heavy chain complementarity determining region 3 for antibody 11497
ASPLLWFGEEDGG

SEQ ID NO: 22995 - protein, 8 aa, Homo sapiens
  light chain complementarity determining region 3 for antibody 11498
QRRGNWPA

SEQ ID NO: 22996 - protein, 17 aa, Homo sapiens
  heavy chain complementarity determining region 3 for antibody 11498
TIDHYYHRSGYSYYFEY

SEQ ID NO: 22997 - protein, 7 aa, Homo sapiens
  light chain complementarity determining region 3 for antibody 11499
QQYRSSP

SEQ ID NO: 22998 - protein, 22 aa, Homo sapiens
  heavy chain complementarity determining region 3 for antibody 11499
ARGGYDSVWGSYRYPYHYGMDV

SEQ ID NO: 22999 - protein, 10 aa, Homo sapiens
  light chain complementarity determining region 3 for antibody 11500
QQYKSYSPLT

SEQ ID NO: 23000 - protein, 11 aa, Homo sapiens
  heavy chain complementarity determining region 3 for antibody 11500
AHIGGWNWFDA

SEQ ID NO: 23001 - protein, 9 aa, Homo sapiens
  light chain complementarity determining region 3 for antibody 11501
QQYGSSTLT

SEQ ID NO: 23002 - protein, 23 aa, Homo sapiens
  heavy chain complementarity determining region 3 for antibody 11501
AKAYCTDGECYRGDYYYYYAMDV

SEQ ID NO: 23003 - protein, 9 aa, Homo sapiens
  light chain complementarity determining region 3 for antibody 11502
QQYGSSRYT

SEQ ID NO: 23004 - protein, 23 aa, Homo sapiens
  heavy chain complementarity determining region 3 for antibody 11502
ARVGCSGEKCSSTSGYYYYALDV

SEQ ID NO: 23005 - protein, 9 aa, Homo sapiens
  light chain complementarity determining region 3 for antibody 11503
QQYDRSFPT

SEQ ID NO: 23006 - protein, 17 aa, Homo sapiens
  heavy chain complementarity determining region 3 for antibody 11503
TTERFYFDASGYSPFDH

SEQ ID NO: 23007 - protein, 11 aa, Homo sapiens
  light chain complementarity determining region 3 for antibody 11504
QQYDNLPPGYT

SEQ ID NO: 23008 - protein, 21 aa, Homo sapiens
  heavy chain complementarity determining region 3 for antibody 11504
ARSKGPTRSGSHWDYYYGMDV

SEQ ID NO: 23009 - protein, 9 aa, Homo sapiens
  light chain complementarity determining region 3 for antibody 11505
QQYDNLPLT

SEQ ID NO: 23010 - protein, 16 aa, Homo sapiens
  heavy chain complementarity determining region 3 for antibody 11505
GKDYSASSGFAYWFDP

SEQ ID NO: 23011 - protein, 9 aa, Homo sapiens
  light chain complementarity determining region 3 for antibody 11506
QQVNSYPIT

SEQ ID NO: 23012 - protein, 10 aa, Homo sapiens
  heavy chain complementarity determining region 3 for antibody 11506
ARTYLRNFDS

SEQ ID NO: 23013 - protein, 9 aa, Homo sapiens
  light chain complementarity determining region 3 for antibody 11507
QQTKGFPYT

SEQ ID NO: 23014 - protein, 18 aa, Homo sapiens
  heavy chain complementarity determining region 3 for antibody 11507
ARHLWLDRGHFYYYSMDV

SEQ ID NO: 23015 - protein, 9 aa, Homo sapiens
  light chain complementarity determining region 3 for antibody 11508
QQSYSTPYT

SEQ ID NO: 23016 - protein, 17 aa, Homo sapiens
  heavy chain complementarity determining region 3 for antibody 11508
ARDGSYGDRMNYHGMDV

SEQ ID NO: 23017 - protein, 9 aa, Homo sapiens
  light chain complementarity determining region 3 for antibody 11509
QLRSNWPYT

SEQ ID NO: 23018 - protein, 15 aa, Homo sapiens
  heavy chain complementarity determining region 3 for antibody 11509
AGDSWATTGINAFDI

SEQ ID NO: 23019 - protein, 9 aa, Homo sapiens
  light chain complementarity determining region 3 for antibody 11510
QLLNNYVLT

SEQ ID NO: 23020 - protein, 11 aa, Homo sapiens
  heavy chain complementarity determining region 3 for antibody 11510
ARVMQGVACDV

SEQ ID NO: 23021 - protein, 9 aa, Homo sapiens
  light chain complementarity determining region 3 for antibody 11511
MQALQTSIT

SEQ ID NO: 23022 - protein, 14 aa, Homo sapiens
  heavy chain complementarity determining region 3 for antibody 11511
ARMWWTQQDHGVDA

SEQ ID NO: 23023 - protein, 11 aa, Homo sapiens
  light chain complementarity determining region 3 for antibody 11512
MHATHWPPMYT

SEQ ID NO: 23024 - protein, 18 aa, Homo sapiens
  heavy chain complementarity determining region 3 for antibody 11512
TRLESRGYYHGGLDAFDV

SEQ ID NO: 23025 - protein, 9 aa, Homo sapiens
  light chain complementarity determining region 3 for antibody 11513
QQYYSYPYT

SEQ ID NO: 23026 - protein, 15 aa, Homo sapiens
  heavy chain complementarity determining region 3 for antibody 11513
VRGVSNSFLFVSFDY

SEQ ID NO: 23027 - protein, 8 aa, Homo sapiens
  light chain complementarity determining region 3 for antibody 11514
QQYNTLWT

SEQ ID NO: 23028 - protein, 13 aa, Homo sapiens
  heavy chain complementarity determining region 3 for antibody 11514
ARSIDWLPYVVDF

SEQ ID NO: 23029 - protein, 9 aa, Homo sapiens
  light chain complementarity determining region 3 for antibody 11515
QQYGSSPYT

SEQ ID NO: 23030 - protein, 14 aa, Homo sapiens
  heavy chain complementarity determining region 3 for antibody 11515
ARAMYGDAVGYLDP

SEQ ID NO: 23031 - protein, 11 aa, Homo sapiens
  light chain complementarity determining region 3 for antibody 11516
QQYGSSPPMYT

SEQ ID NO: 23032 - protein, 18 aa, Homo sapiens
  heavy chain complementarity determining region 3 for antibody 11516
ARAAGYYDSSGYLAPLHY

SEQ ID NO: 23033 - protein, 9 aa, Homo sapiens
  light chain complementarity determining region 3 for antibody 11517
QQYDNLPYT

SEQ ID NO: 23034 - protein, 15 aa, Homo sapiens
  heavy chain complementarity determining region 3 for antibody 11517
ARISIFGVVIGSFDY

SEQ ID NO: 23035 - protein, 9 aa, Homo sapiens
  light chain complementarity determining region 3 for antibody 11518
QQTNSFPYT

SEQ ID NO: 23036 - protein, 18 aa, Homo sapiens
  heavy chain complementarity determining region 3 for antibody 11518
VRHLWFGRGSSYYYAMDV

SEQ ID NO: 23037 - protein, 9 aa, Homo sapiens
  light chain complementarity determining region 3 for antibody 11519
QQTDSFPLT

SEQ ID NO: 23038 - protein, 15 aa, Homo sapiens
  heavy chain complementarity determining region 3 for antibody 11519
ARARGTVFQRPGLDY

SEQ ID NO: 23039 - protein, 9 aa, Homo sapiens
  light chain complementarity determining region 3 for antibody 11520
QQSYSSTWT

SEQ ID NO: 23040 - protein, 23 aa, Homo sapiens
  heavy chain complementarity determining region 3 for antibody 11520
ARGVIGPYASNWYESDYYYGMDV

SEQ ID NO: 23041 - protein, 9 aa, Homo sapiens
  light chain complementarity determining region 3 for antibody 11521
QQSYSPPLT

SEQ ID NO: 23042 - protein, 23 aa, Homo sapiens
  heavy chain complementarity determining region 3 for antibody 11521
TTTPIWGFNGSQAGGLYYYGMDV

SEQ ID NO: 23043 - protein, 9 aa, Homo sapiens
  light chain complementarity determining region 3 for antibody 11522
QKYTSVPRS

SEQ ID NO: 23044 - protein, 15 aa, Homo sapiens
  heavy chain complementarity determining region 3 for antibody 11522
ARGGDLWFGEFPFDF

SEQ ID NO: 23045 - protein, 9 aa, Homo sapiens
  light chain complementarity determining region 3 for antibody 11523
MQTLQTLYN

SEQ ID NO: 23046 - protein, 10 aa, Homo sapiens
  heavy chain complementarity determining region 3 for antibody 11523
ARSRHPAMDV

SEQ ID NO: 23047 - protein, 9 aa, Homo sapiens
  light chain complementarity determining region 3 for antibody 11524
MQGLLTPPA

SEQ ID NO: 23048 - protein, 18 aa, Homo sapiens
  heavy chain complementarity determining region 3 for antibody 11524
ARTRVGLYSGGSPYMFDP

SEQ ID NO: 23049 - protein, 9 aa, Homo sapiens
  light chain complementarity determining region 3 for antibody 11525
MQALLAPPT

SEQ ID NO: 23050 - protein, 19 aa, Homo sapiens
  heavy chain complementarity determining region 3 for antibody 11525
AKDDGTYRDYIQPWGGFDY

SEQ ID NO: 23051 - protein, 9 aa, Homo sapiens
  light chain complementarity determining region 3 for antibody 11526
LQHNSYPPT

SEQ ID NO: 23052 - protein, 12 aa, Homo sapiens
  heavy chain complementarity determining region 3 for antibody 11526
ARNGRFLNWFDP

SEQ ID NO: 23053 - protein, 9 aa, Homo sapiens
  light chain complementarity determining region 3 for antibody 11527
QQYNTDWGT

SEQ ID NO: 23054 - protein, 19 aa, Homo sapiens
  heavy chain complementarity determining region 3 for antibody 11527
AKDKSHGGFGEILFEYFDH

SEQ ID NO: 23055 - protein, 9 aa, Homo sapiens
  light chain complementarity determining region 3 for antibody 11528
QQYNSYPYT

SEQ ID NO: 23056 - protein, 18 aa, Homo sapiens
  heavy chain complementarity determining region 3 for antibody 11528
ARDHRESGSWDGGLYFDY

SEQ ID NO: 23057 - protein, 9 aa, Homo sapiens
  light chain complementarity determining region 3 for antibody 11529
QQYNNYPYT

SEQ ID NO: 23058 - protein, 19 aa, Homo sapiens
  heavy chain complementarity determining region 3 for antibody 11529
ARDQSSSYGDYYYYYGMDV

SEQ ID NO: 23059 - protein, 9 aa, Homo sapiens
  light chain complementarity determining region 3 for antibody 11530
QQSYITPLT

SEQ ID NO: 23060 - protein, 13 aa, Homo sapiens
  heavy chain complementarity determining region 3 for antibody 11530
VTDKLVGPTILDN

SEQ ID NO: 23061 - protein, 9 aa, Homo sapiens
  light chain complementarity determining region 3 for antibody 11531
QQSYIRRWT

SEQ ID NO: 23062 - protein, 11 aa, Homo sapiens
  heavy chain complementarity determining region 3 for antibody 11531
ARGGGNTWANF

SEQ ID NO: 23063 - protein, 8 aa, Homo sapiens
  light chain complementarity determining region 3 for antibody 11532
QQRSNWWT

SEQ ID NO: 23064 - protein, 11 aa, Homo sapiens
  heavy chain complementarity determining region 3 for antibody 11532
ARENPENWFET

SEQ ID NO: 23065 - protein, 8 aa, Homo sapiens
  light chain complementarity determining region 3 for antibody 11533
QQRSDWPT

SEQ ID NO: 23066 - protein, 15 aa, Homo sapiens
  heavy chain complementarity determining region 3 for antibody 11533
ARDGNPAVVRGYCDY

SEQ ID NO: 23067 - protein, 9 aa, Homo sapiens
  light chain complementarity determining region 3 for antibody 11534
QQFEYLPLT

SEQ ID NO: 23068 - protein, 19 aa, Homo sapiens
  heavy chain complementarity determining region 3 for antibody 11534
ARHKFRIGQSDYYYYKTDV

SEQ ID NO: 23069 - protein, 9 aa, Homo sapiens
  light chain complementarity determining region 3 for antibody 11535
QQFDTLPYT

SEQ ID NO: 23070 - protein, 19 aa, Homo sapiens
  heavy chain complementarity determining region 3 for antibody 11535
ARERGYCSGGSCLRAAFDI

SEQ ID NO: 23071 - protein, 9 aa, Homo sapiens
  light chain complementarity determining region 3 for antibody 11536
QKYDTSPLT

SEQ ID NO: 23072 - protein, 16 aa, Homo sapiens
  heavy chain complementarity determining region 3 for antibody 11536
TRTYGDYPPYYYAMDV

SEQ ID NO: 23073 - protein, 9 aa, Homo sapiens
  light chain complementarity determining region 3 for antibody 11537
QHYDNLPLT

SEQ ID NO: 23074 - protein, 15 aa, Homo sapiens
  heavy chain complementarity determining region 3 for antibody 11537
ARSAEDLDIHKPLDV

SEQ ID NO: 23075 - protein, 9 aa, Homo sapiens
  light chain complementarity determining region 3 for antibody 11538
QQYNDWPLT

SEQ ID NO: 23076 - protein, 15 aa, Homo sapiens
  heavy chain complementarity determining region 3 for antibody 11538
AKARGPRYDSALFEY

SEQ ID NO: 23077 - protein, 10 aa, Homo sapiens
  light chain complementarity determining region 3 for antibody 11539
QQYGTSPQLT

SEQ ID NO: 23078 - protein, 13 aa, Homo sapiens
  heavy chain complementarity determining region 3 for antibody 11539
ARSSGYYPNYLES

SEQ ID NO: 23079 - protein, 8 aa, Homo sapiens
  light chain complementarity determining region 3 for antibody 11540
QQYGSSRT

SEQ ID NO: 23080 - protein, 13 aa, Homo sapiens
  heavy chain complementarity determining region 3 for antibody 11540
AKELYYYYFGLDV

SEQ ID NO: 23081 - protein, 10 aa, Homo sapiens
  light chain complementarity determining region 3 for antibody 11541
QQYGSSPPWT

SEQ ID NO: 23082 - protein, 13 aa, Homo sapiens
  heavy chain complementarity determining region 3 for antibody 11541
ARGLPGVGGWYSY

SEQ ID NO: 23083 - protein, 10 aa, Homo sapiens
  light chain complementarity determining region 3 for antibody 11542
QQYGRPAVYT

SEQ ID NO: 23084 - protein, 11 aa, Homo sapiens
  heavy chain complementarity determining region 3 for antibody 11542
ARGPATGDFDY

SEQ ID NO: 23085 - protein, 8 aa, Homo sapiens
  light chain complementarity determining region 3 for antibody 11543
QQYDNLLT

SEQ ID NO: 23086 - protein, 14 aa, Homo sapiens
  heavy chain complementarity determining region 3 for antibody 11543
ARGRMSQSWSETDS

SEQ ID NO: 23087 - protein, 9 aa, Homo sapiens
  light chain complementarity determining region 3 for antibody 11544
QQYDISPWT

SEQ ID NO: 23088 - protein, 19 aa, Homo sapiens
  heavy chain complementarity determining region 3 for antibody 11544
ARGPRYCSADRCYYSGMDV

SEQ ID NO: 23089 - protein, 10 aa, Homo sapiens
  light chain complementarity determining region 3 for antibody 11545
QQSYGTLVLT

SEQ ID NO: 23090 - protein, 20 aa, Homo sapiens
  heavy chain complementarity determining region 3 for antibody 11545
ARDTELGSQIWSYYYYGVDV

SEQ ID NO: 23091 - protein, 10 aa, Homo sapiens
  light chain complementarity determining region 3 for antibody 11546
QQRSNWPQLT

SEQ ID NO: 23092 - protein, 17 aa, Homo sapiens
  heavy chain complementarity determining region 3 for antibody 11546
AHTPWDAGYANDCHFDY

SEQ ID NO: 23093 - protein, 9 aa, Homo sapiens
  light chain complementarity determining region 3 for antibody 11547
QQLRSYPLT

SEQ ID NO: 23094 - protein, 13 aa, Homo sapiens
  heavy chain complementarity determining region 3 for antibody 11547
ARGDYSGAGEIGS

SEQ ID NO: 23095 - protein, 12 aa, Homo sapiens
  light chain complementarity determining region 3 for antibody 11548
QQGYSTPPISFT

SEQ ID NO: 23096 - protein, 13 aa, Homo sapiens
  heavy chain complementarity determining region 3 for antibody 11548
ARWGGNSLSAFDL

SEQ ID NO: 23097 - protein, 9 aa, Homo sapiens
  light chain complementarity determining region 3 for antibody 11549
QQAYSFPLT

SEQ ID NO: 23098 - protein, 18 aa, Homo sapiens
  heavy chain complementarity determining region 3 for antibody 11549
ARGLLWFGELSTYSWFDP

SEQ ID NO: 23099 - protein, 9 aa, Homo sapiens
  light chain complementarity determining region 3 for antibody 11550
QQANSFPRT

SEQ ID NO: 23100 - protein, 19 aa, Homo sapiens
  heavy chain complementarity determining region 3 for antibody 11550
ARISHFGEVSGPWDGWFDP

SEQ ID NO: 23101 - protein, 9 aa, Homo sapiens
  light chain complementarity determining region 3 for antibody 11551
QHFYDYPLS

SEQ ID NO: 23102 - protein, 12 aa, Homo sapiens
  heavy chain complementarity determining region 3 for antibody 11551
ASGGRISGKYDS

SEQ ID NO: 23103 - protein, 10 aa, Homo sapiens
  light chain complementarity determining region 3 for antibody 11552
QESYSAPPLT

SEQ ID NO: 23104 - protein, 20 aa, Homo sapiens
  heavy chain complementarity determining region 3 for antibody 11552
ARHFRENLGGQVREFAAFDI

SEQ ID NO: 23105 - protein, 9 aa, Homo sapiens
  light chain complementarity determining region 3 for antibody 11553
MQALQLPFT

SEQ ID NO: 23106 - protein, 19 aa, Homo sapiens
  heavy chain complementarity determining region 3 for antibody 11553
VRHDRYCSSDRCFSFWFDP

SEQ ID NO: 23107 - protein, 9 aa, Homo sapiens
  light chain complementarity determining region 3 for antibody 11554
LQHNSYPRT

SEQ ID NO: 23108 - protein, 11 aa, Homo sapiens
  heavy chain complementarity determining region 3 for antibody 11554
ARDQWGGSFDY

SEQ ID NO: 23109 - protein, 8 aa, Homo sapiens
  light chain complementarity determining region 3 for antibody 11555
HQYKIGVT

SEQ ID NO: 23110 - protein, 14 aa, Homo sapiens
  heavy chain complementarity determining region 3 for antibody 11555
ARDLEGARPWGEDY

SEQ ID NO: 23111 - protein, 9 aa, Homo sapiens
  light chain complementarity determining region 3 for antibody 11556
QQYSDYPLT

SEQ ID NO: 23112 - protein, 18 aa, Homo sapiens
  heavy chain complementarity determining region 3 for antibody 11556
ARGGGYCSGGNCYYIFEV

SEQ ID NO: 23113 - protein, 11 aa, Homo sapiens
  light chain complementarity determining region 3 for antibody 11557
QQYRNLLPSLT

SEQ ID NO: 23114 - protein, 14 aa, Homo sapiens
  heavy chain complementarity determining region 3 for antibody 11557
GRHRLGCGFCAFDI

SEQ ID NO: 23115 - protein, 9 aa, Homo sapiens
  light chain complementarity determining region 3 for antibody 11558
QQYNSYWYT

SEQ ID NO: 23116 - protein, 17 aa, Homo sapiens
  heavy chain complementarity determining region 3 for antibody 11558
ARASYFGSSYYYYGMDV

SEQ ID NO: 23117 - protein, 9 aa, Homo sapiens
  light chain complementarity determining region 3 for antibody 11559
QQYNSYPLT

SEQ ID NO: 23118 - protein, 20 aa, Homo sapiens
  heavy chain complementarity determining region 3 for antibody 11559
ARDRGRSFGIIVGTHYGVDV

SEQ ID NO: 23119 - protein, 9 aa, Homo sapiens
  light chain complementarity determining region 3 for antibody 11560
QQYNKWPKT

SEQ ID NO: 23120 - protein, 23 aa, Homo sapiens
  heavy chain complementarity determining region 3 for antibody 11560
ARSDVKPSVIRGVTTYLLGPFDY

SEQ ID NO: 23121 - protein, 9 aa, Homo sapiens
  light chain complementarity determining region 3 for antibody 11561
QQYLTYPLT

SEQ ID NO: 23122 - protein, 18 aa, Homo sapiens
  heavy chain complementarity determining region 3 for antibody 11561
ARGSYCDSSSWCPYGFDI

SEQ ID NO: 23123 - protein, 9 aa, Homo sapiens
  light chain complementarity determining region 3 for antibody 11562
QQYLSSPWT

SEQ ID NO: 23124 - protein, 13 aa, Homo sapiens
  heavy chain complementarity determining region 3 for antibody 11562
ARFEIGGFYYAVY

SEQ ID NO: 23125 - protein, 9 aa, Homo sapiens
  light chain complementarity determining region 3 for antibody 11563
QQYKSYPIT

SEQ ID NO: 23126 - protein, 13 aa, Homo sapiens
  heavy chain complementarity determining region 3 for antibody 11563
TTTHESLDNWFDP

SEQ ID NO: 23127 - protein, 7 aa, Homo sapiens
  light chain complementarity determining region 3 for antibody 11564
QQYKSWT

SEQ ID NO: 23128 - protein, 12 aa, Homo sapiens
  heavy chain complementarity determining region 3 for antibody 11564
VKDRGGRSGMDV

SEQ ID NO: 23129 - protein, 10 aa, Homo sapiens
  light chain complementarity determining region 3 for antibody 11565
QQYDSSSLFT

SEQ ID NO: 23130 - protein, 22 aa, Homo sapiens
  heavy chain complementarity determining region 3 for antibody 11565
ARHWYASGSPYGGHYYYFGMDV

SEQ ID NO: 23131 - protein, 10 aa, Homo sapiens
  light chain complementarity determining region 3 for antibody 11566
QQYDHLPMYT

SEQ ID NO: 23132 - protein, 24 aa, Homo sapiens
  heavy chain complementarity determining region 3 for antibody 11566
ARSGKGGSSWYRPPGFDGKYAMDV

SEQ ID NO: 23133 - protein, 9 aa, Homo sapiens
  light chain complementarity determining region 3 for antibody 11567
QQSYSTPRT

SEQ ID NO: 23134 - protein, 23 aa, Homo sapiens
  heavy chain complementarity determining region 3 for antibody 11567
ARGVPSDYDFWSGSTREGGWFDP

SEQ ID NO: 23135 - protein, 9 aa, Homo sapiens
  light chain complementarity determining region 3 for antibody 11568
QQSYSTPQT

SEQ ID NO: 23136 - protein, 19 aa, Homo sapiens
  heavy chain complementarity determining region 3 for antibody 11568
AREEGYYDGSGSWHPESDN

SEQ ID NO: 23137 - protein, 10 aa, Homo sapiens
  light chain complementarity determining region 3 for antibody 11569
QQRTDWPHFT

SEQ ID NO: 23138 - protein, 19 aa, Homo sapiens
  heavy chain complementarity determining region 3 for antibody 11569
ARQANSSPAKTGGQYYLDS

SEQ ID NO: 23139 - protein, 9 aa, Homo sapiens
  light chain complementarity determining region 3 for antibody 11570
QQLKIYPVT

SEQ ID NO: 23140 - protein, 16 aa, Homo sapiens
  heavy chain complementarity determining region 3 for antibody 11570
ARGDDFGSGSYYNFDY

SEQ ID NO: 23141 - protein, 9 aa, Homo sapiens
  light chain complementarity determining region 3 for antibody 11571
QKYNSAPLT

SEQ ID NO: 23142 - protein, 16 aa, Homo sapiens
  heavy chain complementarity determining region 3 for antibody 11571
TTHFAPRRWLVREGDH

SEQ ID NO: 23143 - protein, 9 aa, Homo sapiens
  light chain complementarity determining region 3 for antibody 11572
QKYNSALRT

SEQ ID NO: 23144 - protein, 13 aa, Homo sapiens
  heavy chain complementarity determining region 3 for antibody 11572
ATSVYDSLTPFDY

SEQ ID NO: 23145 - protein, 9 aa, Homo sapiens
  light chain complementarity determining region 3 for antibody 11573
QHYDDLRGP

SEQ ID NO: 23146 - protein, 18 aa, Homo sapiens
  heavy chain complementarity determining region 3 for antibody 11573
ARVDSYNDNSGRSRAFDI

SEQ ID NO: 23147 - protein, 9 aa, Homo sapiens
  light chain complementarity determining region 3 for antibody 11574
MQGTHWPWT

SEQ ID NO: 23148 - protein, 10 aa, Homo sapiens
  heavy chain complementarity determining region 3 for antibody 11574
ARETNWGPDY

SEQ ID NO: 23149 - protein, 9 aa, Homo sapiens
  light chain complementarity determining region 3 for antibody 11575
MQGTHWPIT

SEQ ID NO: 23150 - protein, 14 aa, Homo sapiens
  heavy chain complementarity determining region 3 for antibody 11575
ARARRVLMTGAFDM

SEQ ID NO: 23151 - protein, 9 aa, Homo sapiens
  light chain complementarity determining region 3 for antibody 11576
MQALQTPWT

SEQ ID NO: 23152 - protein, 13 aa, Homo sapiens
  heavy chain complementarity determining region 3 for antibody 11576
ARAGRDFYYGMDV

SEQ ID NO: 23153 - protein, 9 aa, Homo sapiens
  light chain complementarity determining region 3 for antibody 11577
AQGSYWPAT

SEQ ID NO: 23154 - protein, 10 aa, Homo sapiens
  heavy chain complementarity determining region 3 for antibody 11577
CRDRRGFGDV

SEQ ID NO: 23155 - protein, 9 aa, Homo sapiens
  light chain complementarity determining region 3 for antibody 11578
QQYYNTPQT

SEQ ID NO: 23156 - protein, 17 aa, Homo sapiens
  heavy chain complementarity determining region 3 for antibody 11578
ARGPTTMIMGTKGYFDY

SEQ ID NO: 23157 - protein, 9 aa, Homo sapiens
  light chain complementarity determining region 3 for antibody 11579
QQYYDNPRT

SEQ ID NO: 23158 - protein, 17 aa, Homo sapiens
  heavy chain complementarity determining region 3 for antibody 11579
ARDRDCGSTSCYNVFDY

SEQ ID NO: 23159 - protein, 8 aa, Homo sapiens
  light chain complementarity determining region 3 for antibody 11580
QQYTTSKT

SEQ ID NO: 23160 - protein, 10 aa, Homo sapiens
  heavy chain complementarity determining region 3 for antibody 11580
AREGAGGFDY

SEQ ID NO: 23161 - protein, 10 aa, Homo sapiens
  light chain complementarity determining region 3 for antibody 11581
QQYNSYSPWA

SEQ ID NO: 23162 - protein, 16 aa, Homo sapiens
  heavy chain complementarity determining region 3 for antibody 11581
AKDGQSYGDYPGYLDL

SEQ ID NO: 23163 - protein, 9 aa, Homo sapiens
  light chain complementarity determining region 3 for antibody 11582
QQYNNWPLT

SEQ ID NO: 23164 - protein, 13 aa, Homo sapiens
  heavy chain complementarity determining region 3 for antibody 11582
AKSHERAYRIGDS

SEQ ID NO: 23165 - protein, 8 aa, Homo sapiens
  light chain complementarity determining region 3 for antibody 11583
QQYNNPWA

SEQ ID NO: 23166 - protein, 8 aa, Homo sapiens
  heavy chain complementarity determining region 3 for antibody 11583
ARETPMVS

SEQ ID NO: 23167 - protein, 9 aa, Homo sapiens
  light chain complementarity determining region 3 for antibody 11584
QQYKSNSYT

SEQ ID NO: 23168 - protein, 10 aa, Homo sapiens
  heavy chain complementarity determining region 3 for antibody 11584
TRGGLGTFDD

SEQ ID NO: 23169 - protein, 9 aa, Homo sapiens
  light chain complementarity determining region 3 for antibody 11585
QQYGSSTWT

SEQ ID NO: 23170 - protein, 12 aa, Homo sapiens
  heavy chain complementarity determining region 3 for antibody 11585
ARVNRSGSPVGS

SEQ ID NO: 23171 - protein, 9 aa, Homo sapiens
  light chain complementarity determining region 3 for antibody 11586
QQYGSSPYT

SEQ ID NO: 23172 - protein, 13 aa, Homo sapiens
  heavy chain complementarity determining region 3 for antibody 11586
ARGTIYNSGPYSL

SEQ ID NO: 23173 - protein, 9 aa, Homo sapiens
  light chain complementarity determining region 3 for antibody 11587
QQYDNYRLT

SEQ ID NO: 23174 - protein, 26 aa, Homo sapiens
  heavy chain complementarity determining region 3 for antibody 11587
ARELITSIATPGHEFPNYYYYYGMDV

SEQ ID NO: 23175 - protein, 9 aa, Homo sapiens
  light chain complementarity determining region 3 for antibody 11588
QQYDNFPNT

SEQ ID NO: 23176 - protein, 7 aa, Homo sapiens
  heavy chain complementarity determining region 3 for antibody 11588
VRDEGDV

SEQ ID NO: 23177 - protein, 9 aa, Homo sapiens
  light chain complementarity determining region 3 for antibody 11589
QQTDSFPLT

SEQ ID NO: 23178 - protein, 13 aa, Homo sapiens
  heavy chain complementarity determining region 3 for antibody 11589
ARGAPGSTWYFEY

SEQ ID NO: 23179 - protein, 9 aa, Homo sapiens
  light chain complementarity determining region 3 for antibody 11590
QQSYSTPYT

SEQ ID NO: 23180 - protein, 17 aa, Homo sapiens
  heavy chain complementarity determining region 3 for antibody 11590
ARGSYYDVDLNRFYFDY

SEQ ID NO: 23181 - protein, 10 aa, Homo sapiens
  light chain complementarity determining region 3 for antibody 11591
QQSYSTLPIT

SEQ ID NO: 23182 - protein, 12 aa, Homo sapiens
  heavy chain complementarity determining region 3 for antibody 11591
AKRVPGGDFLDS

SEQ ID NO: 23183 - protein, 9 aa, Homo sapiens
  light chain complementarity determining region 3 for antibody 11592
QQSYIIPQT

SEQ ID NO: 23184 - protein, 18 aa, Homo sapiens
  heavy chain complementarity determining region 3 for antibody 11592
AHERTSSWYLSSPSWFDP

SEQ ID NO: 23185 - protein, 12 aa, Homo sapiens
  light chain complementarity determining region 3 for antibody 11593
QQRISWPRGSWT

SEQ ID NO: 23186 - protein, 10 aa, Homo sapiens
  heavy chain complementarity determining region 3 for antibody 11593
ARAFTRFAGL

SEQ ID NO: 23187 - protein, 9 aa, Homo sapiens
  light chain complementarity determining region 3 for antibody 11594
QQAKIFPYT

SEQ ID NO: 23188 - protein, 15 aa, Homo sapiens
  heavy chain complementarity determining region 3 for antibody 11594
ARGKKAAQFYHGMDV

SEQ ID NO: 23189 - protein, 9 aa, Homo sapiens
  light chain complementarity determining region 3 for antibody 11595
MQGTYWPIT

SEQ ID NO: 23190 - protein, 15 aa, Homo sapiens
  heavy chain complementarity determining region 3 for antibody 11595
ARGRRSVLTGESPHY

SEQ ID NO: 23191 - protein, 9 aa, Homo sapiens
  light chain complementarity determining region 3 for antibody 11596
MQALQTPWT

SEQ ID NO: 23192 - protein, 16 aa, Homo sapiens
  heavy chain complementarity determining region 3 for antibody 11596
AKEPGTGKYYNVVFDI

SEQ ID NO: 23193 - protein, 9 aa, Homo sapiens
  light chain complementarity determining region 3 for antibody 11597
MQALQTPHT

SEQ ID NO: 23194 - protein, 14 aa, Homo sapiens
  heavy chain complementarity determining region 3 for antibody 11597
TRDVCSGWYCGGGY

SEQ ID NO: 23195 - protein, 8 aa, Homo sapiens
  light chain complementarity determining region 3 for antibody 11598
LQHNSSWT

SEQ ID NO: 23196 - protein, 13 aa, Homo sapiens
  heavy chain complementarity determining region 3 for antibody 11598
ARISGSHDFSFDY

SEQ ID NO: 23197 - protein, 9 aa, Homo sapiens
  light chain complementarity determining region 3 for antibody 11599
QQYRSSPIT

SEQ ID NO: 23198 - protein, 16 aa, Homo sapiens
  heavy chain complementarity determining region 3 for antibody 11599
ARDLEFYYDSSAFDRN

SEQ ID NO: 23199 - protein, 9 aa, Homo sapiens
  light chain complementarity determining region 3 for antibody 11600
QQYNEWPYT

SEQ ID NO: 23200 - protein, 17 aa, Homo sapiens
  heavy chain complementarity determining region 3 for antibody 11600
VRFFTDVDGWYPGDTDY

SEQ ID NO: 23201 - protein, 10 aa, Homo sapiens
  light chain complementarity determining region 3 for antibody 11601
QQYDNLPPIT

SEQ ID NO: 23202 - protein, 15 aa, Homo sapiens
  heavy chain complementarity determining region 3 for antibody 11601
AREVPYHTNYWYFDL

SEQ ID NO: 23203 - protein, 8 aa, Homo sapiens
  light chain complementarity determining region 3 for antibody 11602
QQYDNLPP

SEQ ID NO: 23204 - protein, 19 aa, Homo sapiens
  heavy chain complementarity determining region 3 for antibody 11602
ARSAQYSGYDLGGYNWFDP

SEQ ID NO: 23205 - protein, 9 aa, Homo sapiens
  light chain complementarity determining region 3 for antibody 11603
QQTYNAPWT

SEQ ID NO: 23206 - protein, 13 aa, Homo sapiens
  heavy chain complementarity determining region 3 for antibody 11603
ARKERRAKSPFDF

SEQ ID NO: 23207 - protein, 9 aa, Homo sapiens
  light chain complementarity determining region 3 for antibody 11604
QQSYSSPFT

SEQ ID NO: 23208 - protein, 15 aa, Homo sapiens
  heavy chain complementarity determining region 3 for antibody 11604
AREEQRGYDLYYFDF

SEQ ID NO: 23209 - protein, 9 aa, Homo sapiens
  light chain complementarity determining region 3 for antibody 11605
QQSYSNPLT

SEQ ID NO: 23210 - protein, 16 aa, Homo sapiens
  heavy chain complementarity determining region 3 for antibody 11605
ARDYGDHIGYRDAFDI

SEQ ID NO: 23211 - protein, 9 aa, Homo sapiens
  light chain complementarity determining region 3 for antibody 11606
QQLNSYPYT

SEQ ID NO: 23212 - protein, 16 aa, Homo sapiens
  heavy chain complementarity determining region 3 for antibody 11606
ARGGFGELGLHNAFDV

SEQ ID NO: 23213 - protein, 9 aa, Homo sapiens
  light chain complementarity determining region 3 for antibody 11607
QQANSFPRT

SEQ ID NO: 23214 - protein, 18 aa, Homo sapiens
  heavy chain complementarity determining region 3 for antibody 11607
ASARMYCAGDCYSDAFEI

SEQ ID NO: 23215 - protein, 9 aa, Homo sapiens
  light chain complementarity determining region 3 for antibody 11608
QQANSFPFT

SEQ ID NO: 23216 - protein, 19 aa, Homo sapiens
  heavy chain complementarity determining region 3 for antibody 11608
ARSALTAFDSYYYFYGLDV

SEQ ID NO: 23217 - protein, 10 aa, Homo sapiens
  light chain complementarity determining region 3 for antibody 11609
QLLNSYPPIT

SEQ ID NO: 23218 - protein, 13 aa, Homo sapiens
  heavy chain complementarity determining region 3 for antibody 11609
ARVSIPTTGTFDY

SEQ ID NO: 23219 - protein, 9 aa, Homo sapiens
  light chain complementarity determining region 3 for antibody 11610
QKYNSAPLT

SEQ ID NO: 23220 - protein, 17 aa, Homo sapiens
  heavy chain complementarity determining region 3 for antibody 11610
ARGSGSPGNYYYYGMDV

SEQ ID NO: 23221 - protein, 9 aa, Homo sapiens
  light chain complementarity determining region 3 for antibody 11611
QKYDSAPQT

SEQ ID NO: 23222 - protein, 17 aa, Homo sapiens
  heavy chain complementarity determining region 3 for antibody 11611
VAYSSAWYGVEGGEFDY

SEQ ID NO: 23223 - protein, 9 aa, Homo sapiens
  light chain complementarity determining region 3 for antibody 11612
QQYYSIPYT

SEQ ID NO: 23224 - protein, 7 aa, Homo sapiens
  heavy chain complementarity determining region 3 for antibody 11612
TTEDNKN

SEQ ID NO: 23225 - protein, 8 aa, Homo sapiens
  light chain complementarity determining region 3 for antibody 11613
QQYQTYWT

SEQ ID NO: 23226 - protein, 23 aa, Homo sapiens
  heavy chain complementarity determining region 3 for antibody 11613
AGGPPGSGSYYKGQGYNYYGLDV

SEQ ID NO: 23227 - protein, 9 aa, Homo sapiens
  light chain complementarity determining region 3 for antibody 11614
QQYNSYPLT

SEQ ID NO: 23228 - protein, 19 aa, Homo sapiens
  heavy chain complementarity determining region 3 for antibody 11614
ARPRAYCSGGSCFRYGLEV

SEQ ID NO: 23229 - protein, 9 aa, Homo sapiens
  light chain complementarity determining region 3 for antibody 11615
QQYGSSPWT

SEQ ID NO: 23230 - protein, 12 aa, Homo sapiens
  heavy chain complementarity determining region 3 for antibody 11615
ARNGRFLNWFDP

SEQ ID NO: 23231 - protein, 9 aa, Homo sapiens
  light chain complementarity determining region 3 for antibody 11616
QQYGSSPIT

SEQ ID NO: 23232 - protein, 13 aa, Homo sapiens
  heavy chain complementarity determining region 3 for antibody 11616
ARRSYYGSRNFDS

SEQ ID NO: 23233 - protein, 9 aa, Homo sapiens
  light chain complementarity determining region 3 for antibody 11617
QQSYTTPYT

SEQ ID NO: 23234 - protein, 17 aa, Homo sapiens
  heavy chain complementarity determining region 3 for antibody 11617
ATRLMVRGVFGANWFDP

SEQ ID NO: 23235 - protein, 9 aa, Homo sapiens
  light chain complementarity determining region 3 for antibody 11618
QQSYSTPRT

SEQ ID NO: 23236 - protein, 23 aa, Homo sapiens
  heavy chain complementarity determining region 3 for antibody 11618
ARDQKVLSVHSFGAGYYYYGMDV

SEQ ID NO: 23237 - protein, 9 aa, Homo sapiens
  light chain complementarity determining region 3 for antibody 11619
QQSNITPWT

SEQ ID NO: 23238 - protein, 19 aa, Homo sapiens
  heavy chain complementarity determining region 3 for antibody 11619
ATRATGGDLLESYFYGMDV

SEQ ID NO: 23239 - protein, 8 aa, Homo sapiens
  light chain complementarity determining region 3 for antibody 11620
QQRSNWPS

SEQ ID NO: 23240 - protein, 12 aa, Homo sapiens
  heavy chain complementarity determining region 3 for antibody 11620
ARHRPEYNSFDP

SEQ ID NO: 23241 - protein, 9 aa, Homo sapiens
  light chain complementarity determining region 3 for antibody 11621
QQFKTYPHT

SEQ ID NO: 23242 - protein, 15 aa, Homo sapiens
  heavy chain complementarity determining region 3 for antibody 11621
AKGRHNLNYVYGMDV

SEQ ID NO: 23243 - protein, 9 aa, Homo sapiens
  light chain complementarity determining region 3 for antibody 11622
QQANSFPWT

SEQ ID NO: 23244 - protein, 11 aa, Homo sapiens
  heavy chain complementarity determining region 3 for antibody 11622
AAIFGANWFDP

SEQ ID NO: 23245 - protein, 9 aa, Homo sapiens
  light chain complementarity determining region 3 for antibody 11623
MQGTHWPWT

SEQ ID NO: 23246 - protein, 11 aa, Homo sapiens
  heavy chain complementarity determining region 3 for antibody 11623
ARHVYYSHLDV

SEQ ID NO: 23247 - protein, 8 aa, Homo sapiens
  light chain complementarity determining region 3 for antibody 11624
MQGTHWPP

SEQ ID NO: 23248 - protein, 19 aa, Homo sapiens
  heavy chain complementarity determining region 3 for antibody 11624
ATGPRNNWNYNAWVNRFDP

SEQ ID NO: 23249 - protein, 9 aa, Homo sapiens
  light chain complementarity determining region 3 for antibody 11625
QRYNSAPRA

SEQ ID NO: 23250 - protein, 20 aa, Homo sapiens
  heavy chain complementarity determining region 3 for antibody 11625
ARGGRYSDNFPYFYNYGLDV

SEQ ID NO: 23251 - protein, 9 aa, Homo sapiens
  light chain complementarity determining region 3 for antibody 11626
QQYSSSVLT

SEQ ID NO: 23252 - protein, 17 aa, Homo sapiens
  heavy chain complementarity determining region 3 for antibody 11626
ARQLYTYNWAVTEVFDY

SEQ ID NO: 23253 - protein, 9 aa, Homo sapiens
  light chain complementarity determining region 3 for antibody 11627
QQYNLYSFT

SEQ ID NO: 23254 - protein, 23 aa, Homo sapiens
  heavy chain complementarity determining region 3 for antibody 11627
ARPRCSGTTCLLVANNYYYAMDV

SEQ ID NO: 23255 - protein, 9 aa, Homo sapiens
  light chain complementarity determining region 3 for antibody 11628
QQYHSYPYT

SEQ ID NO: 23256 - protein, 17 aa, Homo sapiens
  heavy chain complementarity determining region 3 for antibody 11628
ARQIDIVVEIVSDGLDV

SEQ ID NO: 23257 - protein, 9 aa, Homo sapiens
  light chain complementarity determining region 3 for antibody 11629
QQYGSSWWT

SEQ ID NO: 23258 - protein, 19 aa, Homo sapiens
  heavy chain complementarity determining region 3 for antibody 11629
ARVGDGYNKLGYYYYPIDV

SEQ ID NO: 23259 - protein, 9 aa, Homo sapiens
  light chain complementarity determining region 3 for antibody 11630
QQYGSSPPT

SEQ ID NO: 23260 - protein, 20 aa, Homo sapiens
  heavy chain complementarity determining region 3 for antibody 11630
ARAGGRIPGRRGYDHYGLDV

SEQ ID NO: 23261 - protein, 10 aa, Homo sapiens
  light chain complementarity determining region 3 for antibody 11631
QQYGNSPPGT

SEQ ID NO: 23262 - protein, 24 aa, Homo sapiens
  heavy chain complementarity determining region 3 for antibody 11631
ARVPRESSTRVRIAVARTGGVFDH

SEQ ID NO: 23263 - protein, 9 aa, Homo sapiens
  light chain complementarity determining region 3 for antibody 11632
QQYGNLPYT

SEQ ID NO: 23264 - protein, 9 aa, Homo sapiens
  heavy chain complementarity determining region 3 for antibody 11632
ARGENWLDS

SEQ ID NO: 23265 - protein, 9 aa, Homo sapiens
  light chain complementarity determining region 3 for antibody 11633
QQYDNLPLT

SEQ ID NO: 23266 - protein, 22 aa, Homo sapiens
  heavy chain complementarity determining region 3 for antibody 11633
ARLTLSPNSDSSGYYHGRYFDY

SEQ ID NO: 23267 - protein, 9 aa, Homo sapiens
  light chain complementarity determining region 3 for antibody 11634
QQSYSTPYT

SEQ ID NO: 23268 - protein, 10 aa, Homo sapiens
  heavy chain complementarity determining region 3 for antibody 11634
ARAIAAAGSY

SEQ ID NO: 23269 - protein, 9 aa, Homo sapiens
  light chain complementarity determining region 3 for antibody 11635
QQSYSSPFT

SEQ ID NO: 23270 - protein, 11 aa, Homo sapiens
  heavy chain complementarity determining region 3 for antibody 11635
VHKGDYASWDY

SEQ ID NO: 23271 - protein, 9 aa, Homo sapiens
  light chain complementarity determining region 3 for antibody 11636
QQSYSIPFT

SEQ ID NO: 23272 - protein, 16 aa, Homo sapiens
  heavy chain complementarity determining region 3 for antibody 11636
AHITVDYPFRTPYFDY

SEQ ID NO: 23273 - protein, 9 aa, Homo sapiens
  light chain complementarity determining region 3 for antibody 11637
QQSYRTPKT

SEQ ID NO: 23274 - protein, 15 aa, Homo sapiens
  heavy chain complementarity determining region 3 for antibody 11637
ARDYYVSERGYYFDS

SEQ ID NO: 23275 - protein, 10 aa, Homo sapiens
  light chain complementarity determining region 3 for antibody 11638
QQSLSPPPFT

SEQ ID NO: 23276 - protein, 18 aa, Homo sapiens
  heavy chain complementarity determining region 3 for antibody 11638
ARLFFEQLAGDHHYALDV

SEQ ID NO: 23277 - protein, 11 aa, Homo sapiens
  light chain complementarity determining region 3 for antibody 11639
QQRSNWPPKLT

SEQ ID NO: 23278 - protein, 14 aa, Homo sapiens
  heavy chain complementarity determining region 3 for antibody 11639
ARDLLSGTYGTLDY

SEQ ID NO: 23279 - protein, 9 aa, Homo sapiens
  light chain complementarity determining region 3 for antibody 11640
QHYDFYLGT

SEQ ID NO: 23280 - protein, 12 aa, Homo sapiens
  heavy chain complementarity determining region 3 for antibody 11640
ARERGGQGALDY

SEQ ID NO: 23281 - protein, 9 aa, Homo sapiens
  light chain complementarity determining region 3 for antibody 11641
QGYNNAPWT

SEQ ID NO: 23282 - protein, 15 aa, Homo sapiens
  heavy chain complementarity determining region 3 for antibody 11641
GRHRYSSAQGYGMDV

SEQ ID NO: 23283 - protein, 10 aa, Homo sapiens
  light chain complementarity determining region 3 for antibody 11642
QEANSFPLLT

SEQ ID NO: 23284 - protein, 15 aa, Homo sapiens
  heavy chain complementarity determining region 3 for antibody 11642
ARADYFGSGNYHPDY

SEQ ID NO: 23285 - protein, 9 aa, Homo sapiens
  light chain complementarity determining region 3 for antibody 11643
QRTYNAPWT

SEQ ID NO: 23286 - protein, 19 aa, Homo sapiens
  heavy chain complementarity determining region 3 for antibody 11643
ARQVGDTMVRGLIYDAFDI

SEQ ID NO: 23287 - protein, 9 aa, Homo sapiens
  light chain complementarity determining region 3 for antibody 11644
QQYSGYYYT

SEQ ID NO: 23288 - protein, 21 aa, Homo sapiens
  heavy chain complementarity determining region 3 for antibody 11644
ARGGYYDTSGYRRFHFYGLDV

SEQ ID NO: 23289 - protein, 10 aa, Homo sapiens
  light chain complementarity determining region 3 for antibody 11645
QQYNTYSGDT

SEQ ID NO: 23290 - protein, 21 aa, Homo sapiens
  heavy chain complementarity determining region 3 for antibody 11645
AKDIIAGDSTGYDFIGEYFHR

SEQ ID NO: 23291 - protein, 10 aa, Homo sapiens [sequence omitted]

SEQ ID NO: 23292 - protein, 11 aa, Homo sapiens
  heavy chain complementarity determining region 3 for antibody 11646
ARDNWNLYFDY

SEQ ID NO: 23293 - protein, 9 aa, Homo sapiens
  light chain complementarity determining region 3 for antibody 11647
QQYGSSPWT

SEQ ID NO: 23294 - protein, 17 aa, Homo sapiens
  heavy chain complementarity determining region 3 for antibody 11647
ARHAQPLYYDISGLIDY

SEQ ID NO: 23295 - protein, 9 aa, Homo sapiens
  light chain complementarity determining region 3 for antibody 11648
QQYGSSPNT

SEQ ID NO: 23296 - protein, 13 aa, Homo sapiens
  heavy chain complementarity determining region 3 for antibody 11648
AKAGTTWSNQLNY

SEQ ID NO: 23297 - protein, 9 aa, Homo sapiens
  light chain complementarity determining region 3 for antibody 11649
QQYDSYPQT

SEQ ID NO: 23298 - protein, 20 aa, Homo sapiens
  heavy chain complementarity determining region 3 for antibody 11649
ARATSSYFYGSGSYLGYFDY

SEQ ID NO: 23299 - protein, 9 aa, Homo sapiens
  light chain complementarity determining region 3 for antibody 11650
QQYDNLPYT

SEQ ID NO: 23300 - protein, 14 aa, Homo sapiens
  heavy chain complementarity determining region 3 for antibody 11650
ARGVTGPHRGGMDV

SEQ ID NO: 23301 - protein, 10 aa, Homo sapiens
  light chain complementarity determining region 3 for antibody 11651
QQSSSAAPIT

SEQ ID NO: 23302 - protein, 14 aa, Homo sapiens
  heavy chain complementarity determining region 3 for antibody 11651
ARGRSPGSTRTFDS

SEQ ID NO: 23303 - protein, 10 aa, Homo sapiens
  light chain complementarity determining region 3 for antibody 11652
QQRTNWGALT

SEQ ID NO: 23304 - protein, 11 aa, Homo sapiens
  heavy chain complementarity determining region 3 for antibody 11652
TRDLITLAGDY

SEQ ID NO: 23305 - protein, 10 aa, Homo sapiens
  light chain complementarity determining region 3 for antibody 11653
QQRSNWPPFT

SEQ ID NO: 23306 - protein, 10 aa, Homo sapiens
  heavy chain complementarity determining region 3 for antibody 11653
AVMGYYAMDV

SEQ ID NO: 23307 - protein, 9 aa, Homo sapiens
  light chain complementarity determining region 3 for antibody 11654
QQNYRTPYT

SEQ ID NO: 23308 - protein, 14 aa, Homo sapiens
  heavy chain complementarity determining region 3 for antibody 11654
VKDIKSNYYYGMDA

SEQ ID NO: 23309 - protein, 9 aa, Homo sapiens
  light chain complementarity determining region 3 for antibody 11655
QQLYSYRQT

SEQ ID NO: 23310 - protein, 17 aa, Homo sapiens
  heavy chain complementarity determining region 3 for antibody 11655
AREVSDYVWGSYLPLDH

SEQ ID NO: 23311 - protein, 10 aa, Homo sapiens
  light chain complementarity determining region 3 for antibody 11656
QQLNSYPRLT

SEQ ID NO: 23312 - protein, 15 aa, Homo sapiens
  heavy chain complementarity determining region 3 for antibody 11656
ARCGGPDYYYYAMDV

SEQ ID NO: 23313 - protein, 9 aa, Homo sapiens
  light chain complementarity determining region 3 for antibody 11657
QQGYSAPLT

SEQ ID NO: 23314 - protein, 17 aa, Homo sapiens
  heavy chain complementarity determining region 3 for antibody 11657
AREPDGSYYNRYNYFDP

SEQ ID NO: 23315 - protein, 8 aa, Homo sapiens
  light chain complementarity determining region 3 for antibody 11658
QQFDNLVS

SEQ ID NO: 23316 - protein, 14 aa, Homo sapiens
  heavy chain complementarity determining region 3 for antibody 11658
ARDRYSGGWSALDY

SEQ ID NO: 23317 - protein, 11 aa, Homo sapiens
  light chain complementarity determining region 3 for antibody 11659
QQCYSSPPENT

SEQ ID NO: 23318 - protein, 16 aa, Homo sapiens
  heavy chain complementarity determining region 3 for antibody 11659
AREAGEDYYYKDIFDV

SEQ ID NO: 23319 - protein, 11 aa, Homo sapiens
  light chain complementarity determining region 3 for antibody 11660
QKYNSAPLRLT

SEQ ID NO: 23320 - protein, 11 aa, Homo sapiens
  heavy chain complementarity determining region 3 for antibody 11660
ARDRKFGESAD

SEQ ID NO: 23321 - protein, 10 aa, Homo sapiens
  light chain complementarity determining region 3 for antibody 11661
MQVTHWPPYT

SEQ ID NO: 23322 - protein, 15 aa, Homo sapiens
  heavy chain complementarity determining region 3 for antibody 11661
ARDYWSGELFRCFDL

SEQ ID NO: 23323 - protein, 10 aa, Homo sapiens
  light chain complementarity determining region 3 for antibody 11662
MQGTHWPPYG

SEQ ID NO: 23324 - protein, 17 aa, Homo sapiens
  heavy chain complementarity determining region 3 for antibody 11662
ARGDYYDNTTHYDAFDI

SEQ ID NO: 23325 - protein, 9 aa, Homo sapiens
  light chain complementarity determining region 3 for antibody 11663
MQALQTPRT

SEQ ID NO: 23326 - protein, 23 aa, Homo sapiens
  heavy chain complementarity determining region 3 for antibody 11663
ARGGYSASDLSPDIPATYYGVDV

SEQ ID NO: 23327 - protein, 9 aa, Homo sapiens
  light chain complementarity determining region 3 for antibody 11664
LQSYSDPWT

SEQ ID NO: 23328 - protein, 11 aa, Homo sapiens
  heavy chain complementarity determining region 3 for antibody 11664
ARERDRQQLGH

SEQ ID NO: 23329 - protein, 9 aa, Homo sapiens
  light chain complementarity determining region 3 for antibody 11665
LQHSHYPIT

SEQ ID NO: 23330 - protein, 15 aa, Homo sapiens
  heavy chain complementarity determining region 3 for antibody 11665
VRALSEVVVPYGMDV

SEQ ID NO: 23331 - protein, 9 aa, Homo sapiens
  light chain complementarity determining region 3 for antibody 11666
QQYNSSPWT

SEQ ID NO: 23332 - protein, 17 aa, Homo sapiens
  heavy chain complementarity determining region 3 for antibody 11666
ARRSGLYYFDAHNYYDY

SEQ ID NO: 23333 - protein, 8 aa, Homo sapiens
  light chain complementarity determining region 3 for antibody 11667
QQYNNWVT

SEQ ID NO: 23334 - protein, 14 aa, Homo sapiens
  heavy chain complementarity determining region 3 for antibody 11667
ATSRRGGSGWDFDS

SEQ ID NO: 23335 - protein, 12 aa, Homo sapiens
  light chain complementarity determining region 3 for antibody 11668
QQYNDWPPVRFT

SEQ ID NO: 23336 - protein, 15 aa, Homo sapiens
  heavy chain complementarity determining region 3 for antibody 11668
ARCGSGWQLPDYFDY

SEQ ID NO: 23337 - protein, 10 aa, Homo sapiens
  light chain complementarity determining region 3 for antibody 11669
QQYHSYSGYA

SEQ ID NO: 23338 - protein, 15 aa, Homo sapiens
  heavy chain complementarity determining region 3 for antibody 11669
AKNWESSSPPGYFDY

SEQ ID NO: 23339 - protein, 10 aa, Homo sapiens
  light chain complementarity determining region 3 for antibody 11670
QQYGSSPPFT

SEQ ID NO: 23340 - protein, 21 aa, Homo sapiens
  heavy chain complementarity determining region 3 for antibody 11670
ARVVRYSYESGHPTNSYGMDV

SEQ ID NO: 23341 - protein, 9 aa, Homo sapiens
  light chain complementarity determining region 3 for antibody 11671
QQYGSAPRT

SEQ ID NO: 23342 - protein, 15 aa, Homo sapiens
  heavy chain complementarity determining region 3 for antibody 11671
ARGGIVVDGTYYFDY

SEQ ID NO: 23343 - protein, 9 aa, Homo sapiens
  light chain complementarity determining region 3 for antibody 11672
QQYDNLPIT

SEQ ID NO: 23344 - protein, 12 aa, Homo sapiens
  heavy chain complementarity determining region 3 for antibody 11672
ARATGDPVYFQH

SEQ ID NO: 23345 - protein, 9 aa, Homo sapiens
  light chain complementarity determining region 3 for antibody 11673
QQYDNIPYT

SEQ ID NO: 23346 - protein, 10 aa, Homo sapiens
  heavy chain complementarity determining region 3 for antibody 11673
AREGVTDFDF

SEQ ID NO: 23347 - protein, 8 aa, Homo sapiens
  light chain complementarity determining region 3 for antibody 11674
QQYATFYT

SEQ ID NO: 23348 - protein, 20 aa, Homo sapiens
  heavy chain complementarity determining region 3 for antibody 11674
TTALEGSYYDFWSGYRCFDY

SEQ ID NO: 23349 - protein, 9 aa, Homo sapiens
  light chain complementarity determining region 3 for antibody 11675
QQVYSTPLT

SEQ ID NO: 23350 - protein, 12 aa, Homo sapiens
  heavy chain complementarity determining region 3 for antibody 11675
ARDIRNEFEENV

SEQ ID NO: 23351 - protein, 9 aa, Homo sapiens
  light chain complementarity determining region 3 for antibody 11676
QQTYSTPVT

SEQ ID NO: 23352 - protein, 14 aa, Homo sapiens
  heavy chain complementarity determining region 3 for antibody 11676
ARLDGSGRSGWFDP

SEQ ID NO: 23353 - protein, 9 aa, Homo sapiens
  light chain complementarity determining region 3 for antibody 11677
QQSYSSFFT

SEQ ID NO: 23354 - protein, 20 aa, Homo sapiens
  heavy chain complementarity determining region 3 for antibody 11677
ARTVVGRTFFGARFGGVLDY

SEQ ID NO: 23355 - protein, 11 aa, Homo sapiens
  light chain complementarity determining region 3 for antibody 11678
QQRSNWPPVYT

SEQ ID NO: 23356 - protein, 17 aa, Homo sapiens
  heavy chain complementarity determining region 3 for antibody 11678
AREGAGYGGTPDVAFDI

SEQ ID NO: 23357 - protein, 9 aa, Homo sapiens
  light chain complementarity determining region 3 for antibody 11679
QQRSNWPLT

SEQ ID NO: 23358 - protein, 18 aa, Homo sapiens
  heavy chain complementarity determining region 3 for antibody 11679
AKDLGQQLVYGYSYGMDV

SEQ ID NO: 23359 - protein, 10 aa, Homo sapiens
  light chain complementarity determining region 3 for antibody 11680
QQLADYPPYT

SEQ ID NO: 23360 - protein, 13 aa, Homo sapiens
  heavy chain complementarity determining region 3 for antibody 11680
ARGRDGLHRYFDV

SEQ ID NO: 23361 - protein, 9 aa, Homo sapiens
  light chain complementarity determining region 3 for antibody 11681
QKYNSAPIT

SEQ ID NO: 23362 - protein, 16 aa, Homo sapiens
  heavy chain complementarity determining region 3 for antibody 11681
ARAAVHCGADCFPSHY

SEQ ID NO: 23363 - protein, 9 aa, Homo sapiens
  light chain complementarity determining region 3 for antibody 11682
MQALQTPRT

SEQ ID NO: 23364 - protein, 23 aa, Homo sapiens
  heavy chain complementarity determining region 3 for antibody 11682
ARGGYSANDLSPDIPVTYYGVDV

SEQ ID NO: 23365 - protein, 10 aa, Homo sapiens
  light chain complementarity determining region 3 for antibody 11683
MQALQTPPYT

SEQ ID NO: 23366 - protein, 15 aa, Homo sapiens
  heavy chain complementarity determining region 3 for antibody 11683
ARAGYCGGDCYSQDY

SEQ ID NO: 23367 - protein, 9 aa, Homo sapiens
  light chain complementarity determining region 3 for antibody 11684
QQYYTLPLT

SEQ ID NO: 23368 - protein, 12 aa, Homo sapiens
  heavy chain complementarity determining region 3 for antibody 11684
ATWGVVPGAFDI

SEQ ID NO: 23369 - protein, 9 aa, Homo sapiens
  light chain complementarity determining region 3 for antibody 11685
QQYYSSPYS

SEQ ID NO: 23370 - protein, 14 aa, Homo sapiens
  heavy chain complementarity determining region 3 for antibody 11685
PTDPRHDSFRGMDV

SEQ ID NO: 23371 - protein, 8 aa, Homo sapiens
  light chain complementarity determining region 3 for antibody 11686
QQYRTLYS

SEQ ID NO: 23372 - protein, 25 aa, Homo sapiens
  heavy chain complementarity determining region 3 for antibody 11686
ARERGLAVVVAPTPIPNYYKYGMDL

SEQ ID NO: 23373 - protein, 9 aa, Homo sapiens
  light chain complementarity determining region 3 for antibody 11687
QQYNSYLYT

SEQ ID NO: 23374 - protein, 15 aa, Homo sapiens
  heavy chain complementarity determining region 3 for antibody 11687
ARWASYSSSLGGMDV

SEQ ID NO: 23375 - protein, 10 aa, Homo sapiens
  light chain complementarity determining region 3 for antibody 11688
QQYGSSPSIT

SEQ ID NO: 23376 - protein, 20 aa, Homo sapiens
  heavy chain complementarity determining region 3 for antibody 11688
ARDTELGSQIWSYYYYGVDV

SEQ ID NO: 23377 - protein, 9 aa, Homo sapiens
  light chain complementarity determining region 3 for antibody 11689
QQYGNSPVT

SEQ ID NO: 23378 - protein, 18 aa, Homo sapiens
  heavy chain complementarity determining region 3 for antibody 11689
AREQGHVWGSYRKPLFDY

SEQ ID NO: 23379 - protein, 10 aa, Homo sapiens
  light chain complementarity determining region 3 for antibody 11690
QQYFNWPLIT

SEQ ID NO: 23380 - protein, 15 aa, Homo sapiens
  heavy chain complementarity determining region 3 for antibody 11690
ASIFEFDSGTFYSNF

SEQ ID NO: 23381 - protein, 9 aa, Homo sapiens
  light chain complementarity determining region 3 for antibody 11691
QQYDSYPPT

SEQ ID NO: 23382 - protein, 26 aa, Homo sapiens
  heavy chain complementarity determining region 3 for antibody 11691
ARDEGVNIVPTGQNLPAGDTAGTFDF

SEQ ID NO: 23383 - protein, 9 aa, Homo sapiens
  light chain complementarity determining region 3 for antibody 11692
QQYDSLPLT

SEQ ID NO: 23384 - protein, 19 aa, Homo sapiens
  heavy chain complementarity determining region 3 for antibody 11692
TTGYGCGDDCYSTYDAFDI

SEQ ID NO: 23385 - protein, 9 aa, Homo sapiens
  light chain complementarity determining region 3 for antibody 11693
QQYDHLPIT

SEQ ID NO: 23386 - protein, 17 aa, Homo sapiens
  heavy chain complementarity determining region 3 for antibody 11693
AKMRYFFGGRYYYGMDV

SEQ ID NO: 23387 - protein, 9 aa, Homo sapiens
  light chain complementarity determining region 3 for antibody 11694
QQYASSPYT

SEQ ID NO: 23388 - protein, 13 aa, Homo sapiens
  heavy chain complementarity determining region 3 for antibody 11694
ARAYSSSRLNFDC

SEQ ID NO: 23389 - protein, 9 aa, Homo sapiens
  light chain complementarity determining region 3 for antibody 11695
QQSYSTPRT

SEQ ID NO: 23390 - protein, 12 aa, Homo sapiens
  heavy chain complementarity determining region 3 for antibody 11695
ARDNDSTEALDS

SEQ ID NO: 23391 - protein, 9 aa, Homo sapiens
  light chain complementarity determining region 3 for antibody 11696
QQSYSTPIT

SEQ ID NO: 23392 - protein, 22 aa, Homo sapiens
  heavy chain complementarity determining region 3 for antibody 11696
ARAKDYDYDRSGPRIARYFFDY

SEQ ID NO: 23393 - protein, 9 aa, Homo sapiens
  light chain complementarity determining region 3 for antibody 11697
QQSYSPPYT

SEQ ID NO: 23394 - protein, 15 aa, Homo sapiens
  heavy chain complementarity determining region 3 for antibody 11697
ARGGAVRPRYYGMDV

SEQ ID NO: 23395 - protein, 10 aa, Homo sapiens
  light chain complementarity determining region 3 for antibody 11698
QQSYITHMYT

SEQ ID NO: 23396 - protein, 21 aa, Homo sapiens
  heavy chain complementarity determining region 3 for antibody 11698
ARGYLESLDGDHSHFHYAMDV

SEQ ID NO: 23397 - protein, 10 aa, Homo sapiens
  light chain complementarity determining region 3 for antibody 11699
QQRSNWPPWA

SEQ ID NO: 23398 - protein, 17 aa, Homo sapiens
  heavy chain complementarity determining region 3 for antibody 11699
ARDTGFWSGYYVVTMDV

SEQ ID NO: 23399 - protein, 11 aa, Homo sapiens
  light chain complementarity determining region 3 for antibody 11700
QQRSNRPPEFT

SEQ ID NO: 23400 - protein, 15 aa, Homo sapiens
  heavy chain complementarity determining region 3 for antibody 11700
AREMKGRGHYYGMDV

SEQ ID NO: 23401 - protein, 9 aa, Homo sapiens
  light chain complementarity determining region 3 for antibody 11701
QQLNSYPRT

SEQ ID NO: 23402 - protein, 22 aa, Homo sapiens
  heavy chain complementarity determining region 3 for antibody 11701
ARRPVVVLAARAGPTRFSPNDY

SEQ ID NO: 23403 - protein, 9 aa, Homo sapiens
  light chain complementarity determining region 3 for antibody 11702
QQFNTFLIT

SEQ ID NO: 23404 - protein, 18 aa, Homo sapiens
  heavy chain complementarity determining region 3 for antibody 11702
ARRLYYYDSGGYYDAFDT

SEQ ID NO: 23405 - protein, 9 aa, Homo sapiens
  light chain complementarity determining region 3 for antibody 11703
MQGTHWPPT

SEQ ID NO: 23406 - protein, 15 aa, Homo sapiens
  heavy chain complementarity determining region 3 for antibody 11703
ARGRRGFQEGMGLDL

SEQ ID NO: 23407 - protein, 9 aa, Homo sapiens
  light chain complementarity determining region 3 for antibody 11704
MQGTHWPGT

SEQ ID NO: 23408 - protein, 11 aa, Homo sapiens
  heavy chain complementarity determining region 3 for antibody 11704
ARHVYYYHLDV

SEQ ID NO: 23409 - protein, 9 aa, Homo sapiens
  light chain complementarity determining region 3 for antibody 11705
LQYQTLSNT

SEQ ID NO: 23410 - protein, 13 aa, Homo sapiens
  heavy chain complementarity determining region 3 for antibody 11705
ARLTGYGYYFFDF

SEQ ID NO: 23411 - protein, 9 aa, Homo sapiens
  light chain complementarity determining region 3 for antibody 11706
LQDYNYPRT

SEQ ID NO: 23412 - protein, 17 aa, Homo sapiens
  heavy chain complementarity determining region 3 for antibody 11706
ARDSSPHSAYYYDAFDI

SEQ ID NO: 23413 - protein, 9 aa, Homo sapiens
  light chain complementarity determining region 3 for antibody 11707
QQYSSYPYT

SEQ ID NO: 23414 - protein, 17 aa, Homo sapiens
  heavy chain complementarity determining region 3 for antibody 11707
AREDYSDVDLREWYFDY

SEQ ID NO: 23415 - protein, 9 aa, Homo sapiens
  light chain complementarity determining region 3 for antibody 11708
QQYASSPPT

SEQ ID NO: 23416 - protein, 12 aa, Homo sapiens
  heavy chain complementarity determining region 3 for antibody 11708
AGGFLEWSLFEF

SEQ ID NO: 23417 - protein, 9 aa, Homo sapiens
  light chain complementarity determining region 3 for antibody 11709
QQSYSTPRT

SEQ ID NO: 23418 - protein, 13 aa, Homo sapiens
  heavy chain complementarity determining region 3 for antibody 11709
TRTYGSGRNWFDP

SEQ ID NO: 23419 - protein, 9 aa, Homo sapiens
  light chain complementarity determining region 3 for antibody 11710
QQSYSTPLS

SEQ ID NO: 23420 - protein, 14 aa, Homo sapiens
  heavy chain complementarity determining region 3 for antibody 11710
ARTTAVAGTFYFDY

SEQ ID NO: 23421 - protein, 9 aa, Homo sapiens
  light chain complementarity determining region 3 for antibody 11711
QQSYSTPFT

SEQ ID NO: 23422 - protein, 14 aa, Homo sapiens
  heavy chain complementarity determining region 3 for antibody 11711
ARLGKGQWLDSFDY

SEQ ID NO: 23423 - protein, 9 aa, Homo sapiens
  light chain complementarity determining region 3 for antibody 11712
QQSYSSPFA

SEQ ID NO: 23424 - protein, 15 aa, Homo sapiens
  heavy chain complementarity determining region 3 for antibody 11712
ARAYGSGSHYYGLDL

SEQ ID NO: 23425 - protein, 9 aa, Homo sapiens
  light chain complementarity determining region 3 for antibody 11713
QQSYSAPRT

SEQ ID NO: 23426 - protein, 22 aa, Homo sapiens
  heavy chain complementarity determining region 3 for antibody 11713
AREERDYSSGWSGGSPYWYLDL

SEQ ID NO: 23427 - protein, 9 aa, Homo sapiens
  light chain complementarity determining region 3 for antibody 11714
QQSHSTPLT

SEQ ID NO: 23428 - protein, 22 aa, Homo sapiens
  heavy chain complementarity determining region 3 for antibody 11714
ARGSRGGFGEPVVYYYNYGMDV

SEQ ID NO: 23429 - protein, 8 aa, Homo sapiens
  light chain complementarity determining region 3 for antibody 11715
QQSDSLFS

SEQ ID NO: 23430 - protein, 18 aa, Homo sapiens
  heavy chain complementarity determining region 3 for antibody 11715
AHLGQSFGELSTQKYFDC

SEQ ID NO: 23431 - protein, 11 aa, Homo sapiens
  light chain complementarity determining region 3 for antibody 11716
QQRSNWPRRLT

SEQ ID NO: 23432 - protein, 15 aa, Homo sapiens
  heavy chain complementarity determining region 3 for antibody 11716
ARHAVWFGEQYFFDS

SEQ ID NO: 23433 - protein, 10 aa, Homo sapiens
  light chain complementarity determining region 3 for antibody 11717
QQRSNWPQIT

SEQ ID NO: 23434 - protein, 18 aa, Homo sapiens
  heavy chain complementarity determining region 3 for antibody 11717
ARDLDTVALITQVGDFNF

SEQ ID NO: 23435 - protein, 9 aa, Homo sapiens
  light chain complementarity determining region 3 for antibody 11718
QQATGFPYT

SEQ ID NO: 23436 - protein, 16 aa, Homo sapiens
  heavy chain complementarity determining region 3 for antibody 11718
ASADAGELGPLYYFDP

SEQ ID NO: 23437 - protein, 9 aa, Homo sapiens
  light chain complementarity determining region 3 for antibody 11719
QHYKMSSVT

SEQ ID NO: 23438 - protein, 12 aa, Homo sapiens
  heavy chain complementarity determining region 3 for antibody 11719
ARLNWGVATIEY

SEQ ID NO: 23439 - protein, 10 aa, Homo sapiens
  light chain complementarity determining region 3 for antibody 11720
MQALQTPAVT

SEQ ID NO: 23440 - protein, 19 aa, Homo sapiens
  heavy chain complementarity determining region 3 for antibody 11720
ARHGSWGDTVRAYPLPTDY

SEQ ID NO: 23441 - protein, 9 aa, Homo sapiens
  light chain complementarity determining region 3 for antibody 11721
HQYYDTPFT

SEQ ID NO: 23442 - protein, 13 aa, Homo sapiens
  heavy chain complementarity determining region 3 for antibody 11721
AREKLEPDYGMDV

SEQ ID NO: 23443 - protein, 9 aa, Homo sapiens
  light chain complementarity determining region 3 for antibody 11722
AQGSYWPAS

SEQ ID NO: 23444 - protein, 10 aa, Homo sapiens
  heavy chain complementarity determining region 3 for antibody 11722
CRDREGFGDV

SEQ ID NO: 23445 - protein, 9 aa, Homo sapiens
  light chain complementarity determining region 3 for antibody 11723
QRTYNVPIT

SEQ ID NO: 23446 - protein, 9 aa, Homo sapiens
  heavy chain complementarity determining region 3 for antibody 11723
VRGYDVFDY

SEQ ID NO: 23447 - protein, 8 aa, Homo sapiens
  light chain complementarity determining region 3 for antibody 11724
QQYYSTPT

SEQ ID NO: 23448 - protein, 14 aa, Homo sapiens
  heavy chain complementarity determining region 3 for antibody 11724
ARQGRGVGMTYFEN

SEQ ID NO: 23449 - protein, 9 aa, Homo sapiens
  light chain complementarity determining region 3 for antibody 11725
QQYSTYLWT

SEQ ID NO: 23450 - protein, 16 aa, Homo sapiens
  heavy chain complementarity determining region 3 for antibody 11725
AKDIGTGTYRWDAFDM

SEQ ID NO: 23451 - protein, 9 aa, Homo sapiens
  light chain complementarity determining region 3 for antibody 11726
QQYSTFPYT

SEQ ID NO: 23452 - protein, 17 aa, Homo sapiens
  heavy chain complementarity determining region 3 for antibody 11726
AREQWNDVDLRQFYFDY

SEQ ID NO: 23453 - protein, 8 aa, Homo sapiens
  light chain complementarity determining region 3 for antibody 11727
QQYSSYST

SEQ ID NO: 23454 - protein, 20 aa, Homo sapiens
  heavy chain complementarity determining region 3 for antibody 11727
ARERVRPLTYNGDSTTGFDP

SEQ ID NO: 23455 - protein, 9 aa, Homo sapiens
  light chain complementarity determining region 3 for antibody 11728
QQYNSYLWT

SEQ ID NO: 23456 - protein, 12 aa, Homo sapiens
  heavy chain complementarity determining region 3 for antibody 11728
AKELESTKVFDY

SEQ ID NO: 23457 - protein, 9 aa, Homo sapiens
  light chain complementarity determining region 3 for antibody 11729
QQYGTFVYS

SEQ ID NO: 23458 - protein, 13 aa, Homo sapiens
  heavy chain complementarity determining region 3 for antibody 11729
ASTRGSNYGDGDF

SEQ ID NO: 23459 - protein, 8 aa, Homo sapiens
  light chain complementarity determining region 3 for antibody 11730
QQYGSSVT

SEQ ID NO: 23460 - protein, 23 aa, Homo sapiens
  heavy chain complementarity determining region 3 for antibody 11730
ARSQPNYHGSGNYYRGMSYYFDY

SEQ ID NO: 23461 - protein, 9 aa, Homo sapiens
  light chain complementarity determining region 3 for antibody 11731
QQYDDLPFT

SEQ ID NO: 23462 - protein, 25 aa, Homo sapiens
  heavy chain complementarity determining region 3 for antibody 11731
ARVRDIEIDDNIWGKNRYTGTGFDN

SEQ ID NO: 23463 - protein, 9 aa, Homo sapiens
  light chain complementarity determining region 3 for antibody 11732
QQSYSTPLT

SEQ ID NO: 23464 - protein, 12 aa, Homo sapiens
  heavy chain complementarity determining region 3 for antibody 11732
ARDTVVTASIDS

SEQ ID NO: 23465 - protein, 9 aa, Homo sapiens
  light chain complementarity determining region 3 for antibody 11733
QQSYSSPLT

SEQ ID NO: 23466 - protein, 14 aa, Homo sapiens
  heavy chain complementarity determining region 3 for antibody 11733
ARRNIYNWGSWFDP

SEQ ID NO: 23467 - protein, 9 aa, Homo sapiens
  light chain complementarity determining region 3 for antibody 11734
QQSYNTPLT

SEQ ID NO: 23468 - protein, 19 aa, Homo sapiens
  heavy chain complementarity determining region 3 for antibody 11734
ARAFGVAAESRYYYYGMDV

SEQ ID NO: 23469 - protein, 9 aa, Homo sapiens
  light chain complementarity determining region 3 for antibody 11735
QQSSTTPFT

SEQ ID NO: 23470 - protein, 21 aa, Homo sapiens
  heavy chain complementarity determining region 3 for antibody 11735
ARHIGAVAGTFLGFYYYGMDV

SEQ ID NO: 23471 - protein, 9 aa, Homo sapiens
  light chain complementarity determining region 3 for antibody 11736
QQLSSYPLT

SEQ ID NO: 23472 - protein, 18 aa, Homo sapiens
  heavy chain complementarity determining region 3 for antibody 11736
ARYEDYGDSPTVYYGMDV

SEQ ID NO: 23473 - protein, 9 aa, Homo sapiens
  light chain complementarity determining region 3 for antibody 11737
QLSYSTSIT

SEQ ID NO: 23474 - protein, 15 aa, Homo sapiens
  heavy chain complementarity determining region 3 for antibody 11737
ARRHIIVGGPDWFDP

SEQ ID NO: 23475 - protein, 10 aa, Homo sapiens
  light chain complementarity determining region 3 for antibody 11738
QHYHDLLMYT

SEQ ID NO: 23476 - protein, 16 aa, Homo sapiens
  heavy chain complementarity determining region 3 for antibody 11738
ARERTYYYDGSGFFDY

SEQ ID NO: 23477 - protein, 9 aa, Homo sapiens
  light chain complementarity determining region 3 for antibody 11739
LQHNSYPHT

SEQ ID NO: 23478 - protein, 19 aa, Homo sapiens
  heavy chain complementarity determining region 3 for antibody 11739
ATFASTRGRLAPYYYRMDV

SEQ ID NO: 23479 - protein, 9 aa, Homo sapiens
  light chain complementarity determining region 3 for antibody 11740
HQYYFFPYT

SEQ ID NO: 23480 - protein, 17 aa, Homo sapiens
  heavy chain complementarity determining region 3 for antibody 11740
AREDWNDVDLRLFYLDY

SEQ ID NO: 23481 - protein, 10 aa, Homo sapiens
  light chain complementarity determining region 3 for antibody 11741
HQSGSLPRLT

SEQ ID NO: 23482 - protein, 18 aa, Homo sapiens
  heavy chain complementarity determining region 3 for antibody 11741
ARDVGYDSRANYHWYFDL

SEQ ID NO: 23483 - protein, 9 aa, Homo sapiens
  light chain complementarity determining region 3 for antibody 11742
HHYGNSPGT

SEQ ID NO: 23484 - protein, 16 aa, Homo sapiens
  heavy chain complementarity determining region 3 for antibody 11742
ARRGGNHYHVPYYFDY

SEQ ID NO: 23485 - protein, 9 aa, Homo sapiens
  light chain complementarity determining region 3 for antibody 11743
QQYSTTPRT

SEQ ID NO: 23486 - protein, 16 aa, Homo sapiens
  heavy chain complementarity determining region 3 for antibody 11743
TRSPRSDYGDNFEYKY

SEQ ID NO: 23487 - protein, 9 aa, Homo sapiens
  light chain complementarity determining region 3 for antibody 11744
QQYNSYPWT

SEQ ID NO: 23488 - protein, 20 aa, Homo sapiens
  heavy chain complementarity determining region 3 for antibody 11744
VTDYRGRTFPRFSHEHGLGV

SEQ ID NO: 23489 - protein, 9 aa, Homo sapiens
  light chain complementarity determining region 3 for antibody 11745
QQYNNYSWT

SEQ ID NO: 23490 - protein, 19 aa, Homo sapiens
  heavy chain complementarity determining region 3 for antibody 11745
ARHTDGSGNFIGDSVWFGP

SEQ ID NO: 23491 - protein, 9 aa, Homo sapiens
  light chain complementarity determining region 3 for antibody 11746
QQYKTYPYT

SEQ ID NO: 23492 - protein, 17 aa, Homo sapiens
  heavy chain complementarity determining region 3 for antibody 11746
AREDWADVDLREFYFDY

SEQ ID NO: 23493 - protein, 10 aa, Homo sapiens
  light chain complementarity determining region 3 for antibody 11747
QQYGSSRLFT

SEQ ID NO: 23494 - protein, 14 aa, Homo sapiens
  heavy chain complementarity determining region 3 for antibody 11747
ARAWVGPTLRAFDI

SEQ ID NO: 23495 - protein, 9 aa, Homo sapiens
  light chain complementarity determining region 3 for antibody 11748
QQYFNPPYT

SEQ ID NO: 23496 - protein, 14 aa, Homo sapiens
  heavy chain complementarity determining region 3 for antibody 11748
ARVRAVAAPRGFDH

SEQ ID NO: 23497 - protein, 9 aa, Homo sapiens
  light chain complementarity determining region 3 for antibody 11749
QQTYSGLVT

SEQ ID NO: 23498 - protein, 17 aa, Homo sapiens
  heavy chain complementarity determining region 3 for antibody 11749
ARTLELERTYHYFGMDV

SEQ ID NO: 23499 - protein, 9 aa, Homo sapiens
  light chain complementarity determining region 3 for antibody 11750
QQSYSTPQT

SEQ ID NO: 23500 - protein, 12 aa, Homo sapiens
  heavy chain complementarity determining region 3 for antibody 11750
AREPYSPPYFDS

SEQ ID NO: 23501 - protein, 8 aa, Homo sapiens
  light chain complementarity determining region 3 for antibody 11751
QQSYSTPH

SEQ ID NO: 23502 - protein, 20 aa, Homo sapiens
  heavy chain complementarity determining region 3 for antibody 11751
AKDDGVYSAYDTSYYYAMDV

SEQ ID NO: 23503 - protein, 9 aa, Homo sapiens
  light chain complementarity determining region 3 for antibody 11752
QQSFITQRT

SEQ ID NO: 23504 - protein, 14 aa, Homo sapiens
  heavy chain complementarity determining region 3 for antibody 11752
VRNDAYGDYFFMDV

SEQ ID NO: 23505 - protein, 9 aa, Homo sapiens
  light chain complementarity determining region 3 for antibody 11753
QQRSNWPRT

SEQ ID NO: 23506 - protein, 16 aa, Homo sapiens
  heavy chain complementarity determining region 3 for antibody 11753
TRRWDYDSSGQRIVDY

SEQ ID NO: 23507 - protein, 9 aa, Homo sapiens
  light chain complementarity determining region 3 for antibody 11754
QQRRTWPKT

SEQ ID NO: 23508 - protein, 19 aa, Homo sapiens
  heavy chain complementarity determining region 3 for antibody 11754
ARDSSSSWGIPPYYFGMDV

SEQ ID NO: 23509 - protein, 9 aa, Homo sapiens
  light chain complementarity determining region 3 for antibody 11755
QQFNSYSIT

SEQ ID NO: 23510 - protein, 11 aa, Homo sapiens
  heavy chain complementarity determining region 3 for antibody 11755
ARDTTYGDYHY

SEQ ID NO: 23511 - protein, 9 aa, Homo sapiens
  light chain complementarity determining region 3 for antibody 11756
QQANSFPFT

SEQ ID NO: 23512 - protein, 19 aa, Homo sapiens
  heavy chain complementarity determining region 3 for antibody 11756
ARADYSGDTDRYYDYGMDV

SEQ ID NO: 23513 - protein, 10 aa, Homo sapiens
  light chain complementarity determining region 3 for antibody 11757
MQNTHWRGYI

SEQ ID NO: 23514 - protein, 16 aa, Homo sapiens
  heavy chain complementarity determining region 3 for antibody 11757
TRDMMDDFWNDYTGDY

SEQ ID NO: 23515 - protein, 9 aa, Homo sapiens
  light chain complementarity determining region 3 for antibody 11758
MQGTHWPPA

SEQ ID NO: 23516 - protein, 17 aa, Homo sapiens
  heavy chain complementarity determining region 3 for antibody 11758
TKDVPGQDIIVVNGMDV

SEQ ID NO: 23517 - protein, 9 aa, Homo sapiens
  light chain complementarity determining region 3 for antibody 11759
MQGTHWPAT

SEQ ID NO: 23518 - protein, 13 aa, Homo sapiens
  heavy chain complementarity determining region 3 for antibody 11759
ARFEIGGFYYAVY

SEQ ID NO: 23519 - protein, 9 aa, Homo sapiens
  light chain complementarity determining region 3 for antibody 11760
MQALQTSIT

SEQ ID NO: 23520 - protein, 18 aa, Homo sapiens
  heavy chain complementarity determining region 3 for antibody 11760
ARGPGSHGDRFFYYGLDV

SEQ ID NO: 23521 - protein, 9 aa, Homo sapiens
  light chain complementarity determining region 3 for antibody 11761
MQALQTPPR

SEQ ID NO: 23522 - protein, 22 aa, Homo sapiens
  heavy chain complementarity determining region 3 for antibody 11761
ARDILGGEAGDVLTGLHGNFDF

SEQ ID NO: 23523 - protein, 9 aa, Homo sapiens
  light chain complementarity determining region 3 for antibody 11762
HRYSVSRGT

SEQ ID NO: 23524 - protein, 21 aa, Homo sapiens
  heavy chain complementarity determining region 3 for antibody 11762
ARDRGGDFHGDSSYYNRPFDY

SEQ ID NO: 23525 - protein, 9 aa, Homo sapiens
  light chain complementarity determining region 3 for antibody 11763
HQYDTFPWT

SEQ ID NO: 23526 - protein, 6 aa, Homo sapiens
  heavy chain complementarity determining region 3 for antibody 11763
VRGVSD

SEQ ID NO: 23527 - protein, 9 aa, Homo sapiens
  light chain complementarity determining region 3 for antibody 11764
QQYNSFPPT

SEQ ID NO: 23528 - protein, 17 aa, Homo sapiens
  heavy chain complementarity determining region 3 for antibody 11764
ARHRTTGSLYYYSGMDV

SEQ ID NO: 23529 - protein, 8 aa, Homo sapiens
  light chain complementarity determining region 3 for antibody 11765
QQYGTSIT

SEQ ID NO: 23530 - protein, 18 aa, Homo sapiens
  heavy chain complementarity determining region 3 for antibody 11765
ARGDVEGSGVFLNWYFDL

SEQ ID NO: 23531 - protein, 9 aa, Homo sapiens
  light chain complementarity determining region 3 for antibody 11766
QQYGSSRYT

SEQ ID NO: 23532 - protein, 23 aa, Homo sapiens
  heavy chain complementarity determining region 3 for antibody 11766
ARVGCSGEKCFSKSGYYYYPLDV

SEQ ID NO: 23533 - protein, 9 aa, Homo sapiens
  light chain complementarity determining region 3 for antibody 11767
QQSYSIPRT

SEQ ID NO: 23534 - protein, 22 aa, Homo sapiens
  heavy chain complementarity determining region 3 for antibody 11767
ASHSDSSSYFDGSGYKSGAFDI

SEQ ID NO: 23535 - protein, 9 aa, Homo sapiens
  light chain complementarity determining region 3 for antibody 11768
QQSFDPPPT

SEQ ID NO: 23536 - protein, 15 aa, Homo sapiens
  heavy chain complementarity determining region 3 for antibody 11768
ARVRNWNPLYHGLDV

SEQ ID NO: 23537 - protein, 9 aa, Homo sapiens
  light chain complementarity determining region 3 for antibody 11769
QQLTIYPLA

SEQ ID NO: 23538 - protein, 17 aa, Homo sapiens
  heavy chain complementarity determining region 3 for antibody 11769
ARGGNPSGNYYYYGLDV

SEQ ID NO: 23539 - protein, 9 aa, Homo sapiens
  light chain complementarity determining region 3 for antibody 11770
QLAYRFPLT

SEQ ID NO: 23540 - protein, 13 aa, Homo sapiens
  heavy chain complementarity determining region 3 for antibody 11770
ARTYGSGRNWFDP

SEQ ID NO: 23541 - protein, 9 aa, Homo sapiens
  light chain complementarity determining region 3 for antibody 11771
MQGLQSPPT

SEQ ID NO: 23542 - protein, 14 aa, Homo sapiens
  heavy chain complementarity determining region 3 for antibody 11771
ARVSPVDYYYGMDV

SEQ ID NO: 23543 - protein, 9 aa, Homo sapiens
  light chain complementarity determining region 3 for antibody 11772
HQYYDTPYT

SEQ ID NO: 23544 - protein, 8 aa, Homo sapiens
  heavy chain complementarity determining region 3 for antibody 11772
AKSHPPDH

SEQ ID NO: 23545 - protein, 10 aa, Homo sapiens
  light chain complementarity determining region 3 for antibody 11773
QYHGYSPLYT

SEQ ID NO: 23546 - protein, 12 aa, Homo sapiens
  heavy chain complementarity determining region 3 for antibody 11773
AKGILGKGGMDV

SEQ ID NO: 23547 - protein, 10 aa, Homo sapiens
  light chain complementarity determining region 3 for antibody 11774
QQYSSNSLWT

SEQ ID NO: 23548 - protein, 13 aa, Homo sapiens
  heavy chain complementarity determining region 3 for antibody 11774
AADSYYSSADFDY

SEQ ID NO: 23549 - protein, 9 aa, Homo sapiens
  light chain complementarity determining region 3 for antibody 11775
QQYSGFPFT

SEQ ID NO: 23550 - protein, 13 aa, Homo sapiens
  heavy chain complementarity determining region 3 for antibody 11775
ARMKDDFYYGIDV

SEQ ID NO: 23551 - protein, 9 aa, Homo sapiens
  light chain complementarity determining region 3 for antibody 11776
QQYNSFPWT

SEQ ID NO: 23552 - protein, 13 aa, Homo sapiens
  heavy chain complementarity determining region 3 for antibody 11776
TTDRGGSRYGMDV

SEQ ID NO: 23553 - protein, 9 aa, Homo sapiens
  light chain complementarity determining region 3 for antibody 11777
QQYGTSPWT

SEQ ID NO: 23554 - protein, 31 aa, Homo sapiens
  heavy chain complementarity determining region 3 for antibody 11777
ARHVQEPFLRRPGRVFRLLPEVLRWLIRFDL

SEQ ID NO: 23555 - protein, 10 aa, Homo sapiens
  light chain complementarity determining region 3 for antibody 11778
QQYGSSPALT

SEQ ID NO: 23556 - protein, 13 aa, Homo sapiens
  heavy chain complementarity determining region 3 for antibody 11778
ARTNSGRPTQSRL

SEQ ID NO: 23557 - protein, 9 aa, Homo sapiens
  light chain complementarity determining region 3 for antibody 11779
QQYGSSLFT

SEQ ID NO: 23558 - protein, 17 aa, Homo sapiens
  heavy chain complementarity determining region 3 for antibody 11779
AKVPDYYDSAGAYFFDY

SEQ ID NO: 23559 - protein, 10 aa, Homo sapiens
  light chain complementarity determining region 3 for antibody 11780
QQYGRSPPLT

SEQ ID NO: 23560 - protein, 16 aa, Homo sapiens
  heavy chain complementarity determining region 3 for antibody 11780
ATSFLYSGSYYGGLDY

SEQ ID NO: 23561 - protein, 9 aa, Homo sapiens
  light chain complementarity determining region 3 for antibody 11781
QQYGDSPKT

SEQ ID NO: 23562 - protein, 13 aa, Homo sapiens
  heavy chain complementarity determining region 3 for antibody 11781
ARGLHLPPRGMDV

SEQ ID NO: 23563 - protein, 9 aa, Homo sapiens
  light chain complementarity determining region 3 for antibody 11782
QQYDNVPFT

SEQ ID NO: 23564 - protein, 16 aa, Homo sapiens
  heavy chain complementarity determining region 3 for antibody 11782
ARQDHCGDGCYSGFDY

SEQ ID NO: 23565 - protein, 8 aa, Homo sapiens
  light chain complementarity determining region 3 for antibody 11783
QQYDDLIT

SEQ ID NO: 23566 - protein, 20 aa, Homo sapiens
  heavy chain complementarity determining region 3 for antibody 11783
TKDRSVDTSMDYYYYSGMDV

SEQ ID NO: 23567 - protein, 9 aa, Homo sapiens
  light chain complementarity determining region 3 for antibody 11784
QQTYSSPRT

SEQ ID NO: 23568 - protein, 22 aa, Homo sapiens
  heavy chain complementarity determining region 3 for antibody 11784
ARHADSSSYFNSGVYKSGAFDI

SEQ ID NO: 23569 - protein, 9 aa, Homo sapiens
  light chain complementarity determining region 3 for antibody 11785
QQSDSTPRT

SEQ ID NO: 23570 - protein, 19 aa, Homo sapiens
  heavy chain complementarity determining region 3 for antibody 11785
ARAIQISVGWWRTGFFFDH

SEQ ID NO: 23571 - protein, 8 aa, Homo sapiens
  light chain complementarity determining region 3 for antibody 11786
QQRSNWLT

SEQ ID NO: 23572 - protein, 9 aa, Homo sapiens
  heavy chain complementarity determining region 3 for antibody 11786
VRGRDGYQA

SEQ ID NO: 23573 - protein, 9 aa, Homo sapiens
  light chain complementarity determining region 3 for antibody 11787
QQRGGWPLT

SEQ ID NO: 23574 - protein, 16 aa, Homo sapiens
  heavy chain complementarity determining region 3 for antibody 11787
AAGVKAYRRAVRYFDY

SEQ ID NO: 23575 - protein, 9 aa, Homo sapiens
  light chain complementarity determining region 3 for antibody 11788
QQANSFPLT

SEQ ID NO: 23576 - protein, 25 aa, Homo sapiens
  heavy chain complementarity determining region 3 for antibody 11788
AKDQLGNIVGSTTPFLRYYYYGMDV

SEQ ID NO: 23577 - protein, 8 aa, Homo sapiens
  light chain complementarity determining region 3 for antibody 11789
QQAHSFPP

SEQ ID NO: 23578 - protein, 22 aa, Homo sapiens
  heavy chain complementarity determining region 3 for antibody 11789
ARHSGYSNTWYMDYYYYYGMDV

SEQ ID NO: 23579 - protein, 9 aa, Homo sapiens
  light chain complementarity determining region 3 for antibody 11790
LQDYNYPRT

SEQ ID NO: 23580 - protein, 17 aa, Homo sapiens
  heavy chain complementarity determining region 3 for antibody 11790
ARDFSPYTGNYYDGFDI

SEQ ID NO: 23581 - protein, 8 aa, Homo sapiens
  light chain complementarity determining region 3 for antibody 11791
QRRSNWYT

SEQ ID NO: 23582 - protein, 9 aa, Homo sapiens
  heavy chain complementarity determining region 3 for antibody 11791
VRVRRDEDY

SEQ ID NO: 23583 - protein, 9 aa, Homo sapiens
  light chain complementarity determining region 3 for antibody 11792
QQYYFTPYT

SEQ ID NO: 23584 - protein, 20 aa, Homo sapiens
  heavy chain complementarity determining region 3 for antibody 11792
ATAHQSCSGNTCYSEGWFDS

SEQ ID NO: 23585 - protein, 9 aa, Homo sapiens
  light chain complementarity determining region 3 for antibody 11793
QQYNSYPLT

SEQ ID NO: 23586 - protein, 19 aa, Homo sapiens
  heavy chain complementarity determining region 3 for antibody 11793
ARDHSHTTMDPGGEGLFDY

SEQ ID NO: 23587 - protein, 8 aa, Homo sapiens
  light chain complementarity determining region 3 for antibody 11794
QQYNSYFT

SEQ ID NO: 23588 - protein, 14 aa, Homo sapiens
  heavy chain complementarity determining region 3 for antibody 11794
ARDLGGSNMYGMDV

SEQ ID NO: 23589 - protein, 9 aa, Homo sapiens
  light chain complementarity determining region 3 for antibody 11795
QQYNNWLLT

SEQ ID NO: 23590 - protein, 19 aa, Homo sapiens
  heavy chain complementarity determining region 3 for antibody 11795
ARAHCNSLSCPYYYYAMDV

SEQ ID NO: 23591 - protein, 10 aa, Homo sapiens
  light chain complementarity determining region 3 for antibody 11796
QQYGSSPPDT

SEQ ID NO: 23592 - protein, 14 aa, Homo sapiens
  heavy chain complementarity determining region 3 for antibody 11796
AREVAVSGTFYFDY

SEQ ID NO: 23593 - protein, 9 aa, Homo sapiens
  light chain complementarity determining region 3 for antibody 11797
QQSYTTSYT

SEQ ID NO: 23594 - protein, 18 aa, Homo sapiens
  heavy chain complementarity determining region 3 for antibody 11797
ARTSYPLIAATGGFAFDI

SEQ ID NO: 23595 - protein, 9 aa, Homo sapiens
  light chain complementarity determining region 3 for antibody 11798
QQSYSTPRT

SEQ ID NO: 23596 - protein, 17 aa, Homo sapiens
  heavy chain complementarity determining region 3 for antibody 11798
ARGLTTWRMGSGTLFDY

SEQ ID NO: 23597 - protein, 10 aa, Homo sapiens
  light chain complementarity determining region 3 for antibody 11799
QQSYSTPPNT

SEQ ID NO: 23598 - protein, 14 aa, Homo sapiens
  heavy chain complementarity determining region 3 for antibody 11799
ARENPWETAMAFDY

SEQ ID NO: 23599 - protein, 10 aa, Homo sapiens
  light chain complementarity determining region 3 for antibody 11800
QQRSDWPPGT

SEQ ID NO: 23600 - protein, 18 aa, Homo sapiens
  heavy chain complementarity determining region 3 for antibody 11800
ASLGGGGGNSLWYYGLDV

SEQ ID NO: 23601 - protein, 9 aa, Homo sapiens
  light chain complementarity determining region 3 for antibody 11801
QQLTIYPLA

SEQ ID NO: 23602 - protein, 17 aa, Homo sapiens
  heavy chain complementarity determining region 3 for antibody 11801
ARGGNPSGNHYYYGLDV

SEQ ID NO: 23603 - protein, 9 aa, Homo sapiens
  light chain complementarity determining region 3 for antibody 11802
QQFGDSHWT

SEQ ID NO: 23604 - protein, 16 aa, Homo sapiens
  heavy chain complementarity determining region 3 for antibody 11802
TRDHLVPTVGKNWFDP

SEQ ID NO: 23605 - protein, 9 aa, Homo sapiens
  light chain complementarity determining region 3 for antibody 11803
MQTQQTRLT

SEQ ID NO: 23606 - protein, 16 aa, Homo sapiens
  heavy chain complementarity determining region 3 for antibody 11803
ARVDSGSSFYFYGMDV

SEQ ID NO: 23607 - protein, 9 aa, Homo sapiens
  light chain complementarity determining region 3 for antibody 11804
LQHNSYPYT

SEQ ID NO: 23608 - protein, 21 aa, Homo sapiens
  heavy chain complementarity determining region 3 for antibody 11804
ARGSRAFTYDNYYVPMGTFDI

SEQ ID NO: 23609 - protein, 10 aa, Homo sapiens
  light chain complementarity determining region 3 for antibody 11805
LQHKNYAPIT

SEQ ID NO: 23610 - protein, 23 aa, Homo sapiens
  heavy chain complementarity determining region 3 for antibody 11805
ARGVFASGQLFPEGNYYYYGLDV

SEQ ID NO: 23611 - protein, 9 aa, Homo sapiens
  light chain complementarity determining region 3 for antibody 11806
QQYYSSPYS

SEQ ID NO: 23612 - protein, 14 aa, Homo sapiens
  heavy chain complementarity determining region 3 for antibody 11806
TTDPRHDSFRGMDV

SEQ ID NO: 23613 - protein, 10 aa, Homo sapiens
  light chain complementarity determining region 3 for antibody 11807
QQYYDWPPWT

SEQ ID NO: 23614 - protein, 18 aa, Homo sapiens
  heavy chain complementarity determining region 3 for antibody 11807
ARALNFYDRSGYTGHFDY

SEQ ID NO: 23615 - protein, 9 aa, Homo sapiens
  light chain complementarity determining region 3 for antibody 11808
QQYNSFPVT

SEQ ID NO: 23616 - protein, 19 aa, Homo sapiens
  heavy chain complementarity determining region 3 for antibody 11808
ARDRDYTIVDDAGSGVFDF

SEQ ID NO: 23617 - protein, 9 aa, Homo sapiens
  light chain complementarity determining region 3 for antibody 11809
QQYKSYPYT

SEQ ID NO: 23618 - protein, 17 aa, Homo sapiens
  heavy chain complementarity determining region 3 for antibody 11809
AREVWNDVDLREYYFDY

SEQ ID NO: 23619 - protein, 9 aa, Homo sapiens
  light chain complementarity determining region 3 for antibody 11810
QQYGSHMYT

SEQ ID NO: 23620 - protein, 14 aa, Homo sapiens
  heavy chain complementarity determining region 3 for antibody 11810
ARALNLSTSFTLAY

SEQ ID NO: 23621 - protein, 9 aa, Homo sapiens
  light chain complementarity determining region 3 for antibody 11811
QQYGGLPRT

SEQ ID NO: 23622 - protein, 10 aa, Homo sapiens
  heavy chain complementarity determining region 3 for antibody 11811
ATDYKGAFDS

SEQ ID NO: 23623 - protein, 10 aa, Homo sapiens
  light chain complementarity determining region 3 for antibody 11812
QQTYSARSFT

SEQ ID NO: 23624 - protein, 10 aa, Homo sapiens
  heavy chain complementarity determining region 3 for antibody 11812
ARGGLAVGEY

SEQ ID NO: 23625 - protein, 7 aa, Homo sapiens
  light chain complementarity determining region 3 for antibody 11813
QQTATPL

SEQ ID NO: 23626 - protein, 22 aa, Homo sapiens
  heavy chain complementarity determining region 3 for antibody 11813
ARAKTSRFYRGYATSPPYYFDY

SEQ ID NO: 23627 - protein, 9 aa, Homo sapiens
  light chain complementarity determining region 3 for antibody 11814
QQSYSTPYT

SEQ ID NO: 23628 - protein, 16 aa, Homo sapiens
  heavy chain complementarity determining region 3 for antibody 11814
ATYYCSSISCYAGFDT

SEQ ID NO: 23629 - protein, 9 aa, Homo sapiens
  light chain complementarity determining region 3 for antibody 11815
QQSYSTPLT

SEQ ID NO: 23630 - protein, 24 aa, Homo sapiens
  heavy chain complementarity determining region 3 for antibody 11815
ARDAPRGSSDYSWEVYYYYYGMDV

SEQ ID NO: 23631 - protein, 10 aa, Homo sapiens
  light chain complementarity determining region 3 for antibody 11816
QQSYRAPPVT

SEQ ID NO: 23632 - protein, 15 aa, Homo sapiens
  heavy chain complementarity determining region 3 for antibody 11816
AKDMMTTGYYYGMDV

SEQ ID NO: 23633 - protein, 10 aa, Homo sapiens
  light chain complementarity determining region 3 for antibody 11817
QQSYNHLALT

SEQ ID NO: 23634 - protein, 23 aa, Homo sapiens
  heavy chain complementarity determining region 3 for antibody 11817
ARSDVKPSVIRGVTTYLLGPFDY

SEQ ID NO: 23635 - protein, 10 aa, Homo sapiens
  light chain complementarity determining region 3 for antibody 11818
QQLYSYPVFA

SEQ ID NO: 23636 - protein, 19 aa, Homo sapiens
  heavy chain complementarity determining region 3 for antibody 11818
ARVLKRYFEWSTYYYLMDV

SEQ ID NO: 23637 - protein, 8 aa, Homo sapiens
  light chain complementarity determining region 3 for antibody 11819
QQCTTTPT

SEQ ID NO: 23638 - protein, 13 aa, Homo sapiens
  heavy chain complementarity determining region 3 for antibody 11819
AKAFADASDAFQI

SEQ ID NO: 23639 - protein, 9 aa, Homo sapiens
  light chain complementarity determining region 3 for antibody 11820
QQANSFPYT

SEQ ID NO: 23640 - protein, 17 aa, Homo sapiens
  heavy chain complementarity determining region 3 for antibody 11820
ARDRRGYSYGYGQDFQV

SEQ ID NO: 23641 - protein, 8 aa, Homo sapiens
  light chain complementarity determining region 3 for antibody 11821
QQAHCFPP

SEQ ID NO: 23642 - protein, 22 aa, Homo sapiens
  heavy chain complementarity determining region 3 for antibody 11821
ARHSGYSNTWYMNYYYYYGMDV

SEQ ID NO: 23643 - protein, 10 aa, Homo sapiens
  light chain complementarity determining region 3 for antibody 11822
QLLNSYPPFT

SEQ ID NO: 23644 - protein, 13 aa, Homo sapiens
  heavy chain complementarity determining region 3 for antibody 11822
ARITMAAAGAIDY

SEQ ID NO: 23645 - protein, 10 aa, Homo sapiens
  light chain complementarity determining region 3 for antibody 11823
QHYDNLPIFT

SEQ ID NO: 23646 - protein, 13 aa, Homo sapiens
  heavy chain complementarity determining region 3 for antibody 11823
ARHGGLQFRAFDI

SEQ ID NO: 23647 - protein, 9 aa, Homo sapiens
  light chain complementarity determining region 3 for antibody 11824
MQALQTTLT

SEQ ID NO: 23648 - protein, 10 aa, Homo sapiens
  heavy chain complementarity determining region 3 for antibody 11824
AREGYSRMVY

SEQ ID NO: 23649 - protein, 9 aa, Homo sapiens
  light chain complementarity determining region 3 for antibody 11825
LQHNSYPLT

SEQ ID NO: 23650 - protein, 12 aa, Homo sapiens
  heavy chain complementarity determining region 3 for antibody 11825
AGARNGYNLFDY

SEQ ID NO: 23651 - protein, 9 aa, Homo sapiens
  light chain complementarity determining region 3 for antibody 11826
LQHNSSPLT

SEQ ID NO: 23652 - protein, 18 aa, Homo sapiens
  heavy chain complementarity determining region 3 for antibody 11826
ARIGYYYESSGYYGDQDY

SEQ ID NO: 23653 - protein, 9 aa, Homo sapiens
  light chain complementarity determining region 3 for antibody 11827
QQYSSSPET

SEQ ID NO: 23654 - protein, 19 aa, Homo sapiens
  heavy chain complementarity determining region 3 for antibody 11827
ARRVIVVLPAARGYYGMDV

SEQ ID NO: 23655 - protein, 9 aa, Homo sapiens
  light chain complementarity determining region 3 for antibody 11828
QQYNTYPLT

SEQ ID NO: 23656 - protein, 19 aa, Homo sapiens
  heavy chain complementarity determining region 3 for antibody 11828
ARDHSHTTMDPGGEGLLDY

SEQ ID NO: 23657 - protein, 9 aa, Homo sapiens
  light chain complementarity determining region 3 for antibody 11829
QQYNSYSYT

SEQ ID NO: 23658 - protein, 15 aa, Homo sapiens
  heavy chain complementarity determining region 3 for antibody 11829
VKSGTYSSSSGWFDT

SEQ ID NO: 23659 - protein, 9 aa, Homo sapiens
  light chain complementarity determining region 3 for antibody 11830
QQYGSSPLT

SEQ ID NO: 23660 - protein, 18 aa, Homo sapiens
  heavy chain complementarity determining region 3 for antibody 11830
SRARREVIFRGVIGAFDI

SEQ ID NO: 23661 - protein, 9 aa, Homo sapiens
  light chain complementarity determining region 3 for antibody 11831
QQYDNLPIT

SEQ ID NO: 23662 - protein, 18 aa, Homo sapiens
  heavy chain complementarity determining region 3 for antibody 11831
ARDWSGCAGDCPLGNFDY

SEQ ID NO: 23663 - protein, 9 aa, Homo sapiens
  light chain complementarity determining region 3 for antibody 11832
QQTYTPLYT

SEQ ID NO: 23664 - protein, 18 aa, Homo sapiens
  heavy chain complementarity determining region 3 for antibody 11832
ARRGGYGSRDYFYYAMDV

SEQ ID NO: 23665 - protein, 9 aa, Homo sapiens
  light chain complementarity determining region 3 for antibody 11833
QQSYTPPQA

SEQ ID NO: 23666 - protein, 16 aa, Homo sapiens
  heavy chain complementarity determining region 3 for antibody 11833
ARAMGFTVVRGVFFDY

SEQ ID NO: 23667 - protein, 9 aa, Homo sapiens
  light chain complementarity determining region 3 for antibody 11834
QQSYSIPYT

SEQ ID NO: 23668 - protein, 22 aa, Homo sapiens
  heavy chain complementarity determining region 3 for antibody 11834
ARHRSGFCSGESCYGSRGYFDL

SEQ ID NO: 23669 - protein, 9 aa, Homo sapiens
  light chain complementarity determining region 3 for antibody 11835
QQSFTVVFT

SEQ ID NO: 23670 - protein, 20 aa, Homo sapiens
  heavy chain complementarity determining region 3 for antibody 11835
ARDVVYSSRIEVYYYYGMDV

SEQ ID NO: 23671 - protein, 6 aa, Homo sapiens
  light chain complementarity determining region 3 for antibody 11836
QQGGGP

SEQ ID NO: 23672 - protein, 19 aa, Homo sapiens
  heavy chain complementarity determining region 3 for antibody 11836
ARNRAIVGAFTPYYFGMDV

SEQ ID NO: 23673 - protein, 9 aa, Homo sapiens
  light chain complementarity determining region 3 for antibody 11837
QQANSFPLT

SEQ ID NO: 23674 - protein, 22 aa, Homo sapiens
  heavy chain complementarity determining region 3 for antibody 11837
AKEHSSYPDTSGYYYASYYLDH

SEQ ID NO: 23675 - protein, 10 aa, Homo sapiens
  light chain complementarity determining region 3 for antibody 11838
QHYNDWPPWA

SEQ ID NO: 23676 - protein, 17 aa, Homo sapiens
  heavy chain complementarity determining region 3 for antibody 11838
AKDPMFQSVVVDGYFDH

SEQ ID NO: 23677 - protein, 10 aa, Homo sapiens
  light chain complementarity determining region 3 for antibody 11839
MQGTHWPQNT

SEQ ID NO: 23678 - protein, 10 aa, Homo sapiens
  heavy chain complementarity determining region 3 for antibody 11839
ARGGHGDFDY

SEQ ID NO: 23679 - protein, 10 aa, Homo sapiens
  light chain complementarity determining region 3 for antibody 11840
MQGTHWPLLT

SEQ ID NO: 23680 - protein, 10 aa, Homo sapiens
  heavy chain complementarity determining region 3 for antibody 11840
ARENNWGPDS

SEQ ID NO: 23681 - protein, 9 aa, Homo sapiens
  light chain complementarity determining region 3 for antibody 11841
MQGLQIPST

SEQ ID NO: 23682 - protein, 14 aa, Homo sapiens
  heavy chain complementarity determining region 3 for antibody 11841
ATLGATHFYYGMAV

SEQ ID NO: 23683 - protein, 9 aa, Homo sapiens
  light chain complementarity determining region 3 for antibody 11842
MQALQTPYT

SEQ ID NO: 23684 - protein, 20 aa, Homo sapiens
  heavy chain complementarity determining region 3 for antibody 11842
ARGLGDFWSGYFHYFYGMDV

SEQ ID NO: 23685 - protein, 9 aa, Homo sapiens
  light chain complementarity determining region 3 for antibody 11843
LQHNSYPLT

SEQ ID NO: 23686 - protein, 13 aa, Homo sapiens
  heavy chain complementarity determining region 3 for antibody 11843
TRLIVAPGTYFDF

SEQ ID NO: 23687 - protein, 9 aa, Homo sapiens
  light chain complementarity determining region 3 for antibody 11844
LQDYTFPPT

SEQ ID NO: 23688 - protein, 14 aa, Homo sapiens
  heavy chain complementarity determining region 3 for antibody 11844
AKGLVEKTTGRVDS

SEQ ID NO: 23689 - protein, 10 aa, Homo sapiens
  light chain complementarity determining region 3 for antibody 11845
LLHGTSPPYT

SEQ ID NO: 23690 - protein, 15 aa, Homo sapiens
  heavy chain complementarity determining region 3 for antibody 11845
VRGSYTKYYFYGLDV

SEQ ID NO: 23691 - protein, 9 aa, Homo sapiens
  light chain complementarity determining region 3 for antibody 11846
HQYGNLPGT

SEQ ID NO: 23692 - protein, 15 aa, Homo sapiens
  heavy chain complementarity determining region 3 for antibody 11846
VRVIWYYFGLGGFDP

SEQ ID NO: 23693 - protein, 9 aa, Homo sapiens
  light chain complementarity determining region 3 for antibody 11847
HQYGAAPLT

SEQ ID NO: 23694 - protein, 12 aa, Homo sapiens
  heavy chain complementarity determining region 3 for antibody 11847
VRTTIVARRVDY

SEQ ID NO: 23695 - protein, 8 aa, Homo sapiens
  light chain complementarity determining region 3 for antibody 11848
QYLDGYPP

SEQ ID NO: 23696 - protein, 18 aa, Homo sapiens
  heavy chain complementarity determining region 3 for antibody 11848
ASVKVLIWFGKPRYYFDY

SEQ ID NO: 23697 - protein, 8 aa, Homo sapiens
  light chain complementarity determining region 3 for antibody 11849
QQYSSYST

SEQ ID NO: 23698 - protein, 16 aa, Homo sapiens
  heavy chain complementarity determining region 3 for antibody 11849
AKDSGVGAAAVFCFDY

SEQ ID NO: 23699 - protein, 9 aa, Homo sapiens
  light chain complementarity determining region 3 for antibody 11850
QQYNFYPYT

SEQ ID NO: 23700 - protein, 16 aa, Homo sapiens
  heavy chain complementarity determining region 3 for antibody 11850
ARWLVRGVVKGSYFDY

SEQ ID NO: 23701 - protein, 9 aa, Homo sapiens
  light chain complementarity determining region 3 for antibody 11851
QQYNDYPYT

SEQ ID NO: 23702 - protein, 15 aa, Homo sapiens
  heavy chain complementarity determining region 3 for antibody 11851
AKEIRSGHYWGFLDS

SEQ ID NO: 23703 - protein, 8 aa, Homo sapiens
  light chain complementarity determining region 3 for antibody 11852
QQYHTYWT

SEQ ID NO: 23704 - protein, 10 aa, Homo sapiens
  heavy chain complementarity determining region 3 for antibody 11852
AKYLRRAFDV

SEQ ID NO: 23705 - protein, 10 aa, Homo sapiens
  light chain complementarity determining region 3 for antibody 11853
QQYGSSPGVT

SEQ ID NO: 23706 - protein, 17 aa, Homo sapiens
  heavy chain complementarity determining region 3 for antibody 11853
ARDNFSGSYDYYYGMDV

SEQ ID NO: 23707 - protein, 9 aa, Homo sapiens
  light chain complementarity determining region 3 for antibody 11854
QQYDSFPYT

SEQ ID NO: 23708 - protein, 17 aa, Homo sapiens
  heavy chain complementarity determining region 3 for antibody 11854
AREDWADVDLRLYYFDY

SEQ ID NO: 23709 - protein, 9 aa, Homo sapiens
  light chain complementarity determining region 3 for antibody 11855
QQYDNLPLT

SEQ ID NO: 23710 - protein, 16 aa, Homo sapiens
  heavy chain complementarity determining region 3 for antibody 11855
ARDLEFYYDSSAFDRN

SEQ ID NO: 23711 - protein, 9 aa, Homo sapiens
  light chain complementarity determining region 3 for antibody 11856
QQYANSPLA

SEQ ID NO: 23712 - protein, 10 aa, Homo sapiens
  heavy chain complementarity determining region 3 for antibody 11856
AAGSGWLVDY

SEQ ID NO: 23713 - protein, 9 aa, Homo sapiens
  light chain complementarity determining region 3 for antibody 11857
QQTYTPLYT

SEQ ID NO: 23714 - protein, 18 aa, Homo sapiens
  heavy chain complementarity determining region 3 for antibody 11857
ARRRGYGSRDYFYYAMDV

SEQ ID NO: 23715 - protein, 8 aa, Homo sapiens
  light chain complementarity determining region 3 for antibody 11858
QQSYNNPS

SEQ ID NO: 23716 - protein, 13 aa, Homo sapiens
  heavy chain complementarity determining region 3 for antibody 11858
ASNLDYNYYGMDV

SEQ ID NO: 23717 - protein, 9 aa, Homo sapiens
  light chain complementarity determining region 3 for antibody 11859
QQCNTYPWT

SEQ ID NO: 23718 - protein, 11 aa, Homo sapiens
  heavy chain complementarity determining region 3 for antibody 11859
TTGVYSSGWLP

SEQ ID NO: 23719 - protein, 9 aa, Homo sapiens
  light chain complementarity determining region 3 for antibody 11860
QQANSFPYT

SEQ ID NO: 23720 - protein, 21 aa, Homo sapiens
  heavy chain complementarity determining region 3 for antibody 11860
VREGRRIAAGGYSRNHYGMDV

SEQ ID NO: 23721 - protein, 9 aa, Homo sapiens
  light chain complementarity determining region 3 for antibody 11861
QKYNSAPRT

SEQ ID NO: 23722 - protein, 16 aa, Homo sapiens
  heavy chain complementarity determining region 3 for antibody 11861
AKDLFRGVLRWDASDI

SEQ ID NO: 23723 - protein, 9 aa, Homo sapiens
  light chain complementarity determining region 3 for antibody 11862
QKYNSAPLT

SEQ ID NO: 23724 - protein, 16 aa, Homo sapiens
  heavy chain complementarity determining region 3 for antibody 11862
ARGGYGELGLHNAFDI

SEQ ID NO: 23725 - protein, 9 aa, Homo sapiens
  light chain complementarity determining region 3 for antibody 11863
QKHDSDPPL

SEQ ID NO: 23726 - protein, 13 aa, Homo sapiens
  heavy chain complementarity determining region 3 for antibody 11863
ARQFHGAAKHFDF

SEQ ID NO: 23727 - protein, 10 aa, Homo sapiens
  light chain complementarity determining region 3 for antibody 11864
QHYYSVPPWT

SEQ ID NO: 23728 - protein, 12 aa, Homo sapiens
  heavy chain complementarity determining region 3 for antibody 11864
ARLLRFGDYFDY

SEQ ID NO: 23729 - protein, 8 aa, Homo sapiens
  light chain complementarity determining region 3 for antibody 11865
MQGLRTPT

SEQ ID NO: 23730 - protein, 22 aa, Homo sapiens
  heavy chain complementarity determining region 3 for antibody 11865
ARSTRYCTAPNCAHSSSWDFDS

SEQ ID NO: 23731 - protein, 9 aa, Homo sapiens
  light chain complementarity determining region 3 for antibody 11866
MQALQTPWT

SEQ ID NO: 23732 - protein, 15 aa, Homo sapiens
  heavy chain complementarity determining region 3 for antibody 11866
ARGGPHYGDYDPLDH

SEQ ID NO: 23733 - protein, 9 aa, Homo sapiens
  light chain complementarity determining region 3 for antibody 11867
MQALETPLT

SEQ ID NO: 23734 - protein, 26 aa, Homo sapiens
  heavy chain complementarity determining region 3 for antibody 11867
ARAQYFDYVWGTLQSFHTYYYYKMDV

SEQ ID NO: 23735 - protein, 9 aa, Homo sapiens
  light chain complementarity determining region 3 for antibody 11868
QQYYSTPLT

SEQ ID NO: 23736 - protein, 16 aa, Homo sapiens
  heavy chain complementarity determining region 3 for antibody 11868
AKAMAPGLGGENWFDS

SEQ ID NO: 23737 - protein, 9 aa, Homo sapiens
  light chain complementarity determining region 3 for antibody 11869
QQYYISPLT

SEQ ID NO: 23738 - protein, 15 aa, Homo sapiens
  heavy chain complementarity determining region 3 for antibody 11869
ARTHPKSSSWIFFDY

SEQ ID NO: 23739 - protein, 9 aa, Homo sapiens
  light chain complementarity determining region 3 for antibody 11870
QQYYISPLT

SEQ ID NO: 23740 - protein, 15 aa, Homo sapiens
  heavy chain complementarity determining region 3 for antibody 11870
ARDHPKSSSWIFFDY

SEQ ID NO: 23741 - protein, 9 aa, Homo sapiens
  light chain complementarity determining region 3 for antibody 11871
QQYNTYTYN

SEQ ID NO: 23742 - protein, 9 aa, Homo sapiens
  heavy chain complementarity determining region 3 for antibody 11871
AKGRDTFDY

SEQ ID NO: 23743 - protein, 9 aa, Homo sapiens
  light chain complementarity determining region 3 for antibody 11872
QQYNSYPYT

SEQ ID NO: 23744 - protein, 19 aa, Homo sapiens
  heavy chain complementarity determining region 3 for antibody 11872
ARDQSSSYGDYYYHYGMDV

SEQ ID NO: 23745 - protein, 9 aa, Homo sapiens
  light chain complementarity determining region 3 for antibody 11873
QQYGRSPST

SEQ ID NO: 23746 - protein, 11 aa, Homo sapiens
  heavy chain complementarity determining region 3 for antibody 11873
ARATLIQQLEC

SEQ ID NO: 23747 - protein, 10 aa, Homo sapiens
  light chain complementarity determining region 3 for antibody 11874
QQYDSYSEYT

SEQ ID NO: 23748 - protein, 20 aa, Homo sapiens
  heavy chain complementarity determining region 3 for antibody 11874
ARERPFSDVSGYYPVGSFDI

SEQ ID NO: 23749 - protein, 9 aa, Homo sapiens
  light chain complementarity determining region 3 for antibody 11875
QQYDNLLWT

SEQ ID NO: 23750 - protein, 11 aa, Homo sapiens
  heavy chain complementarity determining region 3 for antibody 11875
ARGWELLSPDY

SEQ ID NO: 23751 - protein, 9 aa, Homo sapiens
  light chain complementarity determining region 3 for antibody 11876
QQSYSTVTT

SEQ ID NO: 23752 - protein, 18 aa, Homo sapiens
  heavy chain complementarity determining region 3 for antibody 11876
ARGAGYFYHRKVYSSFDY

SEQ ID NO: 23753 - protein, 8 aa, Homo sapiens
  light chain complementarity determining region 3 for antibody 11877
QQSYSTLT

SEQ ID NO: 23754 - protein, 11 aa, Homo sapiens
  heavy chain complementarity determining region 3 for antibody 11877
ARHVYYSHLDV

SEQ ID NO: 23755 - protein, 9 aa, Homo sapiens
  light chain complementarity determining region 3 for antibody 11878
QQRSNWPRT

SEQ ID NO: 23756 - protein, 21 aa, Homo sapiens
  heavy chain complementarity determining region 3 for antibody 11878
ARDVTFYHDMSSPQTPSWFDP

SEQ ID NO: 23757 - protein, 10 aa, Homo sapiens
  light chain complementarity determining region 3 for antibody 11879
QQRSNWPPWT

SEQ ID NO: 23758 - protein, 10 aa, Homo sapiens
  heavy chain complementarity determining region 3 for antibody 11879
VRQIGGGNCY

SEQ ID NO: 23759 - protein, 9 aa, Homo sapiens
  light chain complementarity determining region 3 for antibody 11880
QQLNNYPPT

SEQ ID NO: 23760 - protein, 14 aa, Homo sapiens
  heavy chain complementarity determining region 3 for antibody 11880
AREGSVAGIRSFDY

SEQ ID NO: 23761 - protein, 9 aa, Homo sapiens
  light chain complementarity determining region 3 for antibody 11881
QQHSKWPIT

SEQ ID NO: 23762 - protein, 15 aa, Homo sapiens
  heavy chain complementarity determining region 3 for antibody 11881
AKDWGVSGWYNWFDP

SEQ ID NO: 23763 - protein, 9 aa, Homo sapiens
  light chain complementarity determining region 3 for antibody 11882
QQGHSFPFT

SEQ ID NO: 23764 - protein, 19 aa, Homo sapiens
  heavy chain complementarity determining region 3 for antibody 11882
ARSAYSGDTDRYYDYGMDV

SEQ ID NO: 23765 - protein, 9 aa, Homo sapiens
  light chain complementarity determining region 3 for antibody 11883
QQANSFPPT

SEQ ID NO: 23766 - protein, 13 aa, Homo sapiens
  heavy chain complementarity determining region 3 for antibody 11883
ATEALSELSGFDI

SEQ ID NO: 23767 - protein, 9 aa, Homo sapiens
  light chain complementarity determining region 3 for antibody 11884
QQANSFPLT

SEQ ID NO: 23768 - protein, 15 aa, Homo sapiens
  heavy chain complementarity determining region 3 for antibody 11884
ARDPMRTSDGYPFDY

SEQ ID NO: 23769 - protein, 9 aa, Homo sapiens
  light chain complementarity determining region 3 for antibody 11885
QHYASHSHT

SEQ ID NO: 23770 - protein, 21 aa, Homo sapiens
  heavy chain complementarity determining region 3 for antibody 11885
ARHRNYFTSDYFTNSGWGADY

SEQ ID NO: 23771 - protein, 9 aa, Homo sapiens
  light chain complementarity determining region 3 for antibody 11886
MQGTHWPLT

SEQ ID NO: 23772 - protein, 18 aa, Homo sapiens
  heavy chain complementarity determining region 3 for antibody 11886
AHWTLNYDDSGGYKYFQH

SEQ ID NO: 23773 - protein, 9 aa, Homo sapiens
  light chain complementarity determining region 3 for antibody 11887
MQALQTPIT

SEQ ID NO: 23774 - protein, 19 aa, Homo sapiens
  heavy chain complementarity determining region 3 for antibody 11887
ARDECSGDVCLTFPWCIDL

SEQ ID NO: 23775 - protein, 8 aa, Homo sapiens
  light chain complementarity determining region 3 for antibody 11888
MQALQSRT

SEQ ID NO: 23776 - protein, 25 aa, Homo sapiens
  heavy chain complementarity determining region 3 for antibody 11888
ARESPFDYCTSTTCYQGYYYHVMDV

SEQ ID NO: 23777 - protein, 10 aa, Homo sapiens
  light chain complementarity determining region 3 for antibody 11889
MESTHWPFYT

SEQ ID NO: 23778 - protein, 8 aa, Homo sapiens
  heavy chain complementarity determining region 3 for antibody 11889
ATSPAVGY

SEQ ID NO: 23779 - protein, 8 aa, Homo sapiens
  light chain complementarity determining region 3 for antibody 11890
HQSYTNPA

SEQ ID NO: 23780 - protein, 16 aa, Homo sapiens
  heavy chain complementarity determining region 3 for antibody 11890
AATVTTRPYYYYGMDV

SEQ ID NO: 23781 - protein, 9 aa, Homo sapiens
  light chain complementarity determining region 3 for antibody 11891
HHYGSLPRA

SEQ ID NO: 23782 - protein, 13 aa, Homo sapiens
  heavy chain complementarity determining region 3 for antibody 11891
ARSGHYQFDPFDI

SEQ ID NO: 23783 - protein, 9 aa, Homo sapiens
  light chain complementarity determining region 3 for antibody 11892
QQYNSYPWE

SEQ ID NO: 23784 - protein, 16 aa, Homo sapiens
  heavy chain complementarity determining region 3 for antibody 11892
AKDMFRGVLRWDASDI

SEQ ID NO: 23785 - protein, 9 aa, Homo sapiens
  light chain complementarity determining region 3 for antibody 11893
QQYHASPCT

SEQ ID NO: 23786 - protein, 18 aa, Homo sapiens
  heavy chain complementarity determining region 3 for antibody 11893
ARGLARRTVATQTYYFDY

SEQ ID NO: 23787 - protein, 8 aa, Homo sapiens
  light chain complementarity determining region 3 for antibody 11894
QQYGTLLT

SEQ ID NO: 23788 - protein, 10 aa, Homo sapiens
  heavy chain complementarity determining region 3 for antibody 11894
SRRVNEVRDY

SEQ ID NO: 23789 - protein, 9 aa, Homo sapiens
  light chain complementarity determining region 3 for antibody 11895
QQYGNLPLT

SEQ ID NO: 23790 - protein, 13 aa, Homo sapiens
  heavy chain complementarity determining region 3 for antibody 11895
ARDLAAPPVGFDS

SEQ ID NO: 23791 - protein, 11 aa, Homo sapiens
  light chain complementarity determining region 3 for antibody 11896
QQYDTSSRLFT

SEQ ID NO: 23792 - protein, 18 aa, Homo sapiens
  heavy chain complementarity determining region 3 for antibody 11896
ARAPSYDSSGYGKYPFEI

SEQ ID NO: 23793 - protein, 9 aa, Homo sapiens
  light chain complementarity determining region 3 for antibody 11897
QQYDDLPIT

SEQ ID NO: 23794 - protein, 10 aa, Homo sapiens
  heavy chain complementarity determining region 3 for antibody 11897
ARGKAGIYLY

SEQ ID NO: 23795 - protein, 9 aa, Homo sapiens
  light chain complementarity determining region 3 for antibody 11898
QQTNSFPLT

SEQ ID NO: 23796 - protein, 19 aa, Homo sapiens
  heavy chain complementarity determining region 3 for antibody 11898
ATFPESGDCYDCYYFGMDV

SEQ ID NO: 23797 - protein, 9 aa, Homo sapiens
  light chain complementarity determining region 3 for antibody 11899
QQSYSTPYT

SEQ ID NO: 23798 - protein, 16 aa, Homo sapiens
  heavy chain complementarity determining region 3 for antibody 11899
ARNQLAFHNYNYGMDV

SEQ ID NO: 23799 - protein, 9 aa, Homo sapiens
  light chain complementarity determining region 3 for antibody 11900
QQSYSIPQT

SEQ ID NO: 23800 - protein, 13 aa, Homo sapiens
  heavy chain complementarity determining region 3 for antibody 11900
ARIRYFDWLPLDY

SEQ ID NO: 23801 - protein, 9 aa, Homo sapiens
  light chain complementarity determining region 3 for antibody 11901
QQSHSFPYT

SEQ ID NO: 23802 - protein, 10 aa, Homo sapiens
  heavy chain complementarity determining region 3 for antibody 11901
ARVDAAIMDV

SEQ ID NO: 23803 - protein, 10 aa, Homo sapiens
  light chain complementarity determining region 3 for antibody 11902
QQRSNWPPLT

SEQ ID NO: 23804 - protein, 27 aa, Homo sapiens
  heavy chain complementarity determining region 3 for antibody 11902
ARDLGPQAVESCGGDCYSPEGVDAFDF

SEQ ID NO: 23805 - protein, 11 aa, Homo sapiens
  light chain complementarity determining region 3 for antibody 11903
QQRSNWPLTYT

SEQ ID NO: 23806 - protein, 15 aa, Homo sapiens
  heavy chain complementarity determining region 3 for antibody 11903
ARDHDSSGYYYYFGF

SEQ ID NO: 23807 - protein, 8 aa, Homo sapiens
  light chain complementarity determining region 3 for antibody 11904
QQCENLPP

SEQ ID NO: 23808 - protein, 18 aa, Homo sapiens
  heavy chain complementarity determining region 3 for antibody 11904
ARDNVHMATTWGDDAFDI

SEQ ID NO: 23809 - protein, 9 aa, Homo sapiens
  light chain complementarity determining region 3 for antibody 11905
QKYDSVPFT

SEQ ID NO: 23810 - protein, 11 aa, Homo sapiens
  heavy chain complementarity determining region 3 for antibody 11905
ARGEYKMPGDV

SEQ ID NO: 23811 - protein, 9 aa, Homo sapiens
  light chain complementarity determining region 3 for antibody 11906
MQALQTPRT

SEQ ID NO: 23812 - protein, 11 aa, Homo sapiens
  heavy chain complementarity determining region 3 for antibody 11906
AHIGGWNWFDA

SEQ ID NO: 23813 - protein, 9 aa, Homo sapiens
  light chain complementarity determining region 3 for antibody 11907
HHYGGSPET

SEQ ID NO: 23814 - protein, 21 aa, Homo sapiens
  heavy chain complementarity determining region 3 for antibody 11907
ARYLNERAEIGGTFYYYGMDV

SEQ ID NO: 23815 - protein, 8 aa, Homo sapiens
  light chain complementarity determining region 3 for antibody 11908
QQYYSWPF

SEQ ID NO: 23816 - protein, 14 aa, Homo sapiens
  heavy chain complementarity determining region 3 for antibody 11908
ARMGVPYSTSPFDY

SEQ ID NO: 23817 - protein, 9 aa, Homo sapiens
  light chain complementarity determining region 3 for antibody 11909
QQYYHTPYT

SEQ ID NO: 23818 - protein, 13 aa, Homo sapiens
  heavy chain complementarity determining region 3 for antibody 11909
TRLEGSGSYWFDP

SEQ ID NO: 23819 - protein, 10 aa, Homo sapiens
  light chain complementarity determining region 3 for antibody 11910
QQYVNSALFT

SEQ ID NO: 23820 - protein, 16 aa, Homo sapiens
  heavy chain complementarity determining region 3 for antibody 11910
ARELFKGEYDYYAMDV

SEQ ID NO: 23821 - protein, 8 aa, Homo sapiens
  light chain complementarity determining region 3 for antibody 11911
QQYNRPFS

SEQ ID NO: 23822 - protein, 20 aa, Homo sapiens
  heavy chain complementarity determining region 3 for antibody 11911
TTALEGSYYDFWSGYRCFDY

SEQ ID NO: 23823 - protein, 9 aa, Homo sapiens
  light chain complementarity determining region 3 for antibody 11912
QQYGTSPAT

SEQ ID NO: 23824 - protein, 13 aa, Homo sapiens
  heavy chain complementarity determining region 3 for antibody 11912
ARGSVYNSTPYFF

SEQ ID NO: 23825 - protein, 10 aa, Homo sapiens
  light chain complementarity determining region 3 for antibody 11913
QQYANSPPIT

SEQ ID NO: 23826 - protein, 16 aa, Homo sapiens
  heavy chain complementarity determining region 3 for antibody 11913
ARVPFPNSYNNHYFDI

SEQ ID NO: 23827 - protein, 8 aa, Homo sapiens
  light chain complementarity determining region 3 for antibody 11914
QQSYTTPT

SEQ ID NO: 23828 - protein, 17 aa, Homo sapiens
  heavy chain complementarity determining region 3 for antibody 11914
ARNTMVGTWQRQGNLDH

SEQ ID NO: 23829 - protein, 10 aa, Homo sapiens
  light chain complementarity determining region 3 for antibody 11915
QQSYSTPSIT

SEQ ID NO: 23830 - protein, 11 aa, Homo sapiens
  heavy chain complementarity determining region 3 for antibody 11915
ARDSGGGDYYY

SEQ ID NO: 23831 - protein, 9 aa, Homo sapiens
  light chain complementarity determining region 3 for antibody 11916
QQSYSTPRT

SEQ ID NO: 23832 - protein, 16 aa, Homo sapiens
  heavy chain complementarity determining region 3 for antibody 11916
AKDIGTGTYLWDAFDM

SEQ ID NO: 23833 - protein, 9 aa, Homo sapiens
  light chain complementarity determining region 3 for antibody 11917
QQSYSTPLT

SEQ ID NO: 23834 - protein, 17 aa, Homo sapiens
  heavy chain complementarity determining region 3 for antibody 11917
ARGRVRSTAEGDYYFDY

SEQ ID NO: 23835 - protein, 8 aa, Homo sapiens
  light chain complementarity determining region 3 for antibody 11918
QQSYSTPA

SEQ ID NO: 23836 - protein, 16 aa, Homo sapiens
  heavy chain complementarity determining region 3 for antibody 11918
ASERDYGDSTGGFFDF

SEQ ID NO: 23837 - protein, 10 aa, Homo sapiens
  light chain complementarity determining region 3 for antibody 11919
QQSYSTHMYT

SEQ ID NO: 23838 - protein, 21 aa, Homo sapiens
  heavy chain complementarity determining region 3 for antibody 11919
ARGYLESLYGDYLHYYYALDV

SEQ ID NO: 23839 - protein, 9 aa, Homo sapiens
  light chain complementarity determining region 3 for antibody 11920
QQSYSLPYT

SEQ ID NO: 23840 - protein, 15 aa, Homo sapiens
  heavy chain complementarity determining region 3 for antibody 11920
ARGGAVRPRYYGLDV

SEQ ID NO: 23841 - protein, 9 aa, Homo sapiens
  light chain complementarity determining region 3 for antibody 11921
QQSYSIPWT

SEQ ID NO: 23842 - protein, 20 aa, Homo sapiens
  heavy chain complementarity determining region 3 for antibody 11921
ARDQPEVVVLLGDSYNWFDP

SEQ ID NO: 23843 - protein, 9 aa, Homo sapiens
  light chain complementarity determining region 3 for antibody 11922
QQSYITPRT

SEQ ID NO: 23844 - protein, 14 aa, Homo sapiens
  heavy chain complementarity determining region 3 for antibody 11922
ATESRSGSHLKLDY

SEQ ID NO: 23845 - protein, 9 aa, Homo sapiens
  light chain complementarity determining region 3 for antibody 11923
QQRNNWPST

SEQ ID NO: 23846 - protein, 24 aa, Homo sapiens
  heavy chain complementarity determining region 3 for antibody 11923
ARRRVEGSNLGSCTSRTCPFYSNH

SEQ ID NO: 23847 - protein, 8 aa, Homo sapiens
  light chain complementarity determining region 3 for antibody 11924
QQHGSSYT

SEQ ID NO: 23848 - protein, 22 aa, Homo sapiens
  heavy chain complementarity determining region 3 for antibody 11924
ARDRRKYESIWESYRHYDPFDM

SEQ ID NO: 23849 - protein, 9 aa, Homo sapiens
  light chain complementarity determining region 3 for antibody 11925
QQFNSYPLT

SEQ ID NO: 23850 - protein, 14 aa, Homo sapiens
  heavy chain complementarity determining region 3 for antibody 11925
AGLGSSGFFSGFDP

SEQ ID NO: 23851 - protein, 9 aa, Homo sapiens
  light chain complementarity determining region 3 for antibody 11926
QQANSFPFT

SEQ ID NO: 23852 - protein, 19 aa, Homo sapiens
  heavy chain complementarity determining region 3 for antibody 11926
ARADYSGDTDRYYDHGMDV

SEQ ID NO: 23853 - protein, 10 aa, Homo sapiens
  light chain complementarity determining region 3 for antibody 11927
MQTLQILPIT

SEQ ID NO: 23854 - protein, 20 aa, Homo sapiens
  heavy chain complementarity determining region 3 for antibody 11927
ARHLLTTVIDGIYYYYGMDV

SEQ ID NO: 23855 - protein, 9 aa, Homo sapiens
  light chain complementarity determining region 3 for antibody 11928
MQALQTPYT

SEQ ID NO: 23856 - protein, 7 aa, Homo sapiens
  heavy chain complementarity determining region 3 for antibody 11928
AILGTDY

SEQ ID NO: 23857 - protein, 9 aa, Homo sapiens
  light chain complementarity determining region 3 for antibody 11929
MQALQTPVT

SEQ ID NO: 23858 - protein, 15 aa, Homo sapiens
  heavy chain complementarity determining region 3 for antibody 11929
ARTVSLLGYYYNMDV

SEQ ID NO: 23859 - protein, 9 aa, Homo sapiens
  light chain complementarity determining region 3 for antibody 11930
MQALQTPTT

SEQ ID NO: 23860 - protein, 23 aa, Homo sapiens
  heavy chain complementarity determining region 3 for antibody 11930
ARGGYSAYEVSPDIPVTYYGVDI

SEQ ID NO: 23861 - protein, 9 aa, Homo sapiens
  light chain complementarity determining region 3 for antibody 11931
LQHRSYPWT

SEQ ID NO: 23862 - protein, 18 aa, Homo sapiens
  heavy chain complementarity determining region 3 for antibody 11931
VRGPSGAPGAMAYYYLDV

SEQ ID NO: 23863 - protein, 8 aa, Homo sapiens
  light chain complementarity determining region 3 for antibody 11932
HQYNNWLS

SEQ ID NO: 23864 - protein, 16 aa, Homo sapiens
  heavy chain complementarity determining region 3 for antibody 11932
ATSRGSRGFKLGWSDP

SEQ ID NO: 23865 - protein, 9 aa, Homo sapiens
  light chain complementarity determining region 3 for antibody 11933
QRYNMYPAT

SEQ ID NO: 23866 - protein, 13 aa, Homo sapiens
  heavy chain complementarity determining region 3 for antibody 11933
TRGGSTSSWYWRS

SEQ ID NO: 23867 - protein, 10 aa, Homo sapiens
  light chain complementarity determining region 3 for antibody 11934
QQYYTYPDVT

SEQ ID NO: 23868 - protein, 20 aa, Homo sapiens
  heavy chain complementarity determining region 3 for antibody 11934
ARSLFFRGVIFGRGLIVHDF

SEQ ID NO: 23869 - protein, 9 aa, Homo sapiens
  light chain complementarity determining region 3 for antibody 11935
QQYYNTPYT

SEQ ID NO: 23870 - protein, 11 aa, Homo sapiens
  heavy chain complementarity determining region 3 for antibody 11935
KAGVTAGYGLP

SEQ ID NO: 23871 - protein, 10 aa, Homo sapiens
  light chain complementarity determining region 3 for antibody 11936
QQYVSSALYT

SEQ ID NO: 23872 - protein, 16 aa, Homo sapiens
  heavy chain complementarity determining region 3 for antibody 11936
AKELFKGEYDYYAMDV

SEQ ID NO: 23873 - protein, 9 aa, Homo sapiens
  light chain complementarity determining region 3 for antibody 11937
QQYNTYPLT

SEQ ID NO: 23874 - protein, 10 aa, Homo sapiens
  heavy chain complementarity determining region 3 for antibody 11937
ARDFSDGQPQ

SEQ ID NO: 23875 - protein, 9 aa, Homo sapiens
  light chain complementarity determining region 3 for antibody 11938
QQYIHYPWT

SEQ ID NO: 23876 - protein, 24 aa, Homo sapiens
  heavy chain complementarity determining region 3 for antibody 11938
AREPHGRWFGEFDEVRNYYYEMDV

SEQ ID NO: 23877 - protein, 9 aa, Homo sapiens
  light chain complementarity determining region 3 for antibody 11939
QQYHSTPYT

SEQ ID NO: 23878 - protein, 21 aa, Homo sapiens
  heavy chain complementarity determining region 3 for antibody 11939
ARPGGQYCSGNNCYYDNWFGS

SEQ ID NO: 23879 - protein, 9 aa, Homo sapiens
  light chain complementarity determining region 3 for antibody 11940
QQYGTSPYT

SEQ ID NO: 23880 - protein, 12 aa, Homo sapiens
  heavy chain complementarity determining region 3 for antibody 11940
ARPHSGPYAFDI

SEQ ID NO: 23881 - protein, 10 aa, Homo sapiens
  light chain complementarity determining region 3 for antibody 11941
QQYGSSPALT

SEQ ID NO: 23882 - protein, 17 aa, Homo sapiens
  heavy chain complementarity determining region 3 for antibody 11941
ARGPLSYTSGFFHWFDP

SEQ ID NO: 23883 - protein, 9 aa, Homo sapiens
  light chain complementarity determining region 3 for antibody 11942
QQYDSYPIT

SEQ ID NO: 23884 - protein, 19 aa, Homo sapiens
  heavy chain complementarity determining region 3 for antibody 11942
AKDIRGGCIGGNCWEMFDS

SEQ ID NO: 23885 - protein, 9 aa, Homo sapiens
  light chain complementarity determining region 3 for antibody 11943
QQYDSLPLT

SEQ ID NO: 23886 - protein, 12 aa, Homo sapiens
  heavy chain complementarity determining region 3 for antibody 11943
AAWYSTWSAFDY

SEQ ID NO: 23887 - protein, 9 aa, Homo sapiens
  light chain complementarity determining region 3 for antibody 11944
QQSYSAPYT

SEQ ID NO: 23888 - protein, 16 aa, Homo sapiens
  heavy chain complementarity determining region 3 for antibody 11944
ARDGHHDILTAYGMDV

SEQ ID NO: 23889 - protein, 9 aa, Homo sapiens
  light chain complementarity determining region 3 for antibody 11945
QQRNSWGLT

SEQ ID NO: 23890 - protein, 22 aa, Homo sapiens
  heavy chain complementarity determining region 3 for antibody 11945
ARHSGYSNTWYMNYYYYYGMDV

SEQ ID NO: 23891 - protein, 9 aa, Homo sapiens
  light chain complementarity determining region 3 for antibody 11946
QQLNTYPLT

SEQ ID NO: 23892 - protein, 16 aa, Homo sapiens
  heavy chain complementarity determining region 3 for antibody 11946
ATDPMHDSSGFDPFSI

SEQ ID NO: 23893 - protein, 8 aa, Homo sapiens
  light chain complementarity determining region 3 for antibody 11947
QQHNSYWT

SEQ ID NO: 23894 - protein, 12 aa, Homo sapiens
  heavy chain complementarity determining region 3 for antibody 11947
ARGRVLTGGMDV

SEQ ID NO: 23895 - protein, 11 aa, Homo sapiens
  light chain complementarity determining region 3 for antibody 11948
QQCSNWPPLYT

SEQ ID NO: 23896 - protein, 14 aa, Homo sapiens
  heavy chain complementarity determining region 3 for antibody 11948
AKDRGAGHYYGMDV

SEQ ID NO: 23897 - protein, 9 aa, Homo sapiens
  light chain complementarity determining region 3 for antibody 11949
QQAYRFPLS

SEQ ID NO: 23898 - protein, 13 aa, Homo sapiens
  heavy chain complementarity determining region 3 for antibody 11949
TRAYGSGRNWFDP

SEQ ID NO: 23899 - protein, 9 aa, Homo sapiens
  light chain complementarity determining region 3 for antibody 11950
QQANSFPIT

SEQ ID NO: 23900 - protein, 15 aa, Homo sapiens
  heavy chain complementarity determining region 3 for antibody 11950
ARCVDAACNYYGMDV

SEQ ID NO: 23901 - protein, 9 aa, Homo sapiens
  light chain complementarity determining region 3 for antibody 11951
QKYNSAPRT

SEQ ID NO: 23902 - protein, 17 aa, Homo sapiens
  heavy chain complementarity determining region 3 for antibody 11951
ARGRVRSTAEGDYYFDY

SEQ ID NO: 23903 - protein, 9 aa, Homo sapiens
  light chain complementarity determining region 3 for antibody 11952
QKFTGAPRT

SEQ ID NO: 23904 - protein, 18 aa, Homo sapiens
  heavy chain complementarity determining region 3 for antibody 11952
ARPKSPYYGDYDPVGLDS

SEQ ID NO: 23905 - protein, 9 aa, Homo sapiens
  light chain complementarity determining region 3 for antibody 11953
QHYYGYPRT

SEQ ID NO: 23906 - protein, 22 aa, Homo sapiens
  heavy chain complementarity determining region 3 for antibody 11953
MRDTYNFGSGSHRAEDYHGMDV

SEQ ID NO: 23907 - protein, 9 aa, Homo sapiens
  light chain complementarity determining region 3 for antibody 11954
QHNYSPSPA

SEQ ID NO: 23908 - protein, 11 aa, Homo sapiens
  heavy chain complementarity determining region 3 for antibody 11954
TRDPPGNGMDV

SEQ ID NO: 23909 - protein, 9 aa, Homo sapiens
  light chain complementarity determining region 3 for antibody 11955
QEFPGAPIT

SEQ ID NO: 23910 - protein, 12 aa, Homo sapiens
  heavy chain complementarity determining region 3 for antibody 11955
ARDDGTDWDLDY

SEQ ID NO: 23911 - protein, 9 aa, Homo sapiens
  light chain complementarity determining region 3 for antibody 11956
MQALQTPRT

SEQ ID NO: 23912 - protein, 23 aa, Homo sapiens
  heavy chain complementarity determining region 3 for antibody 11956
ARGGYSARDLSPDIPVTYYGVDV

SEQ ID NO: 23913 - protein, 9 aa, Homo sapiens
  light chain complementarity determining region 3 for antibody 11957
MQALQTPLT

SEQ ID NO: 23914 - protein, 24 aa, Homo sapiens
  heavy chain complementarity determining region 3 for antibody 11957
ARDKGEGSGKFGELKKNYYYGMDV

SEQ ID NO: 23915 - protein, 9 aa, Homo sapiens
  light chain complementarity determining region 3 for antibody 11958
LQHNSYPRT

SEQ ID NO: 23916 - protein, 12 aa, Homo sapiens
  heavy chain complementarity determining region 3 for antibody 11958
VQAPTWRGDFDL

SEQ ID NO: 23917 - protein, 9 aa, Homo sapiens
  light chain complementarity determining region 3 for antibody 11959
LHTFTAPRT

SEQ ID NO: 23918 - protein, 15 aa, Homo sapiens
  heavy chain complementarity determining region 3 for antibody 11959
SRDYIEASNLLRLDY

SEQ ID NO: 23919 - protein, 9 aa, Homo sapiens
  light chain complementarity determining region 3 for antibody 11960
HQYGNFPRT

SEQ ID NO: 23920 - protein, 10 aa, Homo sapiens
  heavy chain complementarity determining region 3 for antibody 11960
ARSISMGRDY

SEQ ID NO: 23921 - protein, 9 aa, Homo sapiens
  light chain complementarity determining region 3 for antibody 11961
QQYYNTPWT

SEQ ID NO: 23922 - protein, 17 aa, Homo sapiens
  heavy chain complementarity determining region 3 for antibody 11961
STDLPITAVRDPPKLDY

SEQ ID NO: 23923 - protein, 9 aa, Homo sapiens
  light chain complementarity determining region 3 for antibody 11962
QQYSNSPGT

SEQ ID NO: 23924 - protein, 20 aa, Homo sapiens
  heavy chain complementarity determining region 3 for antibody 11962
ARHPGRGSGTFLSKLYYFDY

SEQ ID NO: 23925 - protein, 9 aa, Homo sapiens
  light chain complementarity determining region 3 for antibody 11963
QQYRNYPYT

SEQ ID NO: 23926 - protein, 17 aa, Homo sapiens
  heavy chain complementarity determining region 3 for antibody 11963
AREDWNDVDLREFYIDF

SEQ ID NO: 23927 - protein, 9 aa, Homo sapiens
  light chain complementarity determining region 3 for antibody 11964
QQYNSYPLT

SEQ ID NO: 23928 - protein, 11 aa, Homo sapiens
  heavy chain complementarity determining region 3 for antibody 11964
ARDVVEWESDY

SEQ ID NO: 23929 - protein, 10 aa, Homo sapiens
  light chain complementarity determining region 3 for antibody 11965
QQYNNWPPHT

SEQ ID NO: 23930 - protein, 21 aa, Homo sapiens
  heavy chain complementarity determining region 3 for antibody 11965
ARSMFTGYHYDSSGYSNWFDP

SEQ ID NO: 23931 - protein, 9 aa, Homo sapiens
  light chain complementarity determining region 3 for antibody 11966
QQYGTSPWT

SEQ ID NO: 23932 - protein, 14 aa, Homo sapiens
  heavy chain complementarity determining region 3 for antibody 11966
AKDALVIGHDAFDV

SEQ ID NO: 23933 - protein, 9 aa, Homo sapiens
  light chain complementarity determining region 3 for antibody 11967
QQYGSSPYT

SEQ ID NO: 23934 - protein, 22 aa, Homo sapiens
  heavy chain complementarity determining region 3 for antibody 11967
ARHSGYSNTWYMNYYYYYGMDV

SEQ ID NO: 23935 - protein, 9 aa, Homo sapiens
  light chain complementarity determining region 3 for antibody 11968
QQYGSSPRT

SEQ ID NO: 23936 - protein, 11 aa, Homo sapiens
  heavy chain complementarity determining region 3 for antibody 11968
ARSPRGYSSDC

SEQ ID NO: 23937 - protein, 8 aa, Homo sapiens
  light chain complementarity determining region 3 for antibody 11969
QQYGSSPL

SEQ ID NO: 23938 - protein, 23 aa, Homo sapiens
  heavy chain complementarity determining region 3 for antibody 11969
ARGGVTNQPAAMRRSQELDPLQL

SEQ ID NO: 23939 - protein, 10 aa, Homo sapiens
  light chain complementarity determining region 3 for antibody 11970
QQYFNWPLIT

SEQ ID NO: 23940 - protein, 15 aa, Homo sapiens
  heavy chain complementarity determining region 3 for antibody 11970
ASIFEFDSGTYYSNF

SEQ ID NO: 23941 - protein, 8 aa, Homo sapiens
  light chain complementarity determining region 3 for antibody 11971
QQYDNLYT

SEQ ID NO: 23942 - protein, 18 aa, Homo sapiens
  heavy chain complementarity determining region 3 for antibody 11971
ARPKSPYYGDYDPVGLDS

SEQ ID NO: 23943 - protein, 9 aa, Homo sapiens
  light chain complementarity determining region 3 for antibody 11972
QQYATSPIT

SEQ ID NO: 23944 - protein, 20 aa, Homo sapiens
  heavy chain complementarity determining region 3 for antibody 11972
ASRIVIVPAGDLYLYYGMAV

SEQ ID NO: 23945 - protein, 10 aa, Homo sapiens
  light chain complementarity determining region 3 for antibody 11973
QQSYSTPPLT

SEQ ID NO: 23946 - protein, 25 aa, Homo sapiens
  heavy chain complementarity determining region 3 for antibody 11973
ARVNTYYYGSGSYYPEDPYYYGMDV

SEQ ID NO: 23947 - protein, 10 aa, Homo sapiens
  light chain complementarity determining region 3 for antibody 11974
QQSYSSPQST

SEQ ID NO: 23948 - protein, 22 aa, Homo sapiens
  heavy chain complementarity determining region 3 for antibody 11974
ARHRCSTSCYGGFWTHYNWFDP

SEQ ID NO: 23949 - protein, 9 aa, Homo sapiens
  light chain complementarity determining region 3 for antibody 11975
QQSSTSPLT

SEQ ID NO: 23950 - protein, 10 aa, Homo sapiens
  heavy chain complementarity determining region 3 for antibody 11975
ATGGGWLPED

SEQ ID NO: 23951 - protein, 8 aa, Homo sapiens
  light chain complementarity determining region 3 for antibody 11976
QQSSGSLN

SEQ ID NO: 23952 - protein, 18 aa, Homo sapiens
  heavy chain complementarity determining region 3 for antibody 11976
AKNTGTPWFAETVYGMDV

SEQ ID NO: 23953 - protein, 9 aa, Homo sapiens
  light chain complementarity determining region 3 for antibody 11977
QQRSSWPLT

SEQ ID NO: 23954 - protein, 22 aa, Homo sapiens
  heavy chain complementarity determining region 3 for antibody 11977
ARDRGEETVVRGVIGRANWFDS

SEQ ID NO: 23955 - protein, 10 aa, Homo sapiens
  light chain complementarity determining region 3 for antibody 11978
QQRSGWLGIT

SEQ ID NO: 23956 - protein, 13 aa, Homo sapiens
  heavy chain complementarity determining region 3 for antibody 11978
AGTLKDYGDYFDD

SEQ ID NO: 23957 - protein, 9 aa, Homo sapiens
  light chain complementarity determining region 3 for antibody 11979
QQLNTYPRT

SEQ ID NO: 23958 - protein, 9 aa, Homo sapiens
  heavy chain complementarity determining region 3 for antibody 11979
ARYLGAFDL

SEQ ID NO: 23959 - protein, 9 aa, Homo sapiens
  light chain complementarity determining region 3 for antibody 11980
QQLNSYPLT

SEQ ID NO: 23960 - protein, 18 aa, Homo sapiens
  heavy chain complementarity determining region 3 for antibody 11980
ARYEDYGDSPTVYYRMDA

SEQ ID NO: 23961 - protein, 10 aa, Homo sapiens
  light chain complementarity determining region 3 for antibody 11981
MQGTHWPPLT

SEQ ID NO: 23962 - protein, 14 aa, Homo sapiens
  heavy chain complementarity determining region 3 for antibody 11981
SNGGGPYDDAGFDY

SEQ ID NO: 23963 - protein, 7 aa, Homo sapiens
  light chain complementarity determining region 3 for antibody 11982
MQGLQIV

SEQ ID NO: 23964 - protein, 23 aa, Homo sapiens
  heavy chain complementarity determining region 3 for antibody 11982
ARTYDILTNHFRIGYDYHYNMDV

SEQ ID NO: 23965 - protein, 11 aa, Homo sapiens
  light chain complementarity determining region 3 for antibody 11983
MQALQTPPSVT

SEQ ID NO: 23966 - protein, 17 aa, Homo sapiens
  heavy chain complementarity determining region 3 for antibody 11983
ARPSETSRGMSYYGMDV

SEQ ID NO: 23967 - protein, 9 aa, Homo sapiens
  light chain complementarity determining region 3 for antibody 11984
MQALQTPIT

SEQ ID NO: 23968 - protein, 12 aa, Homo sapiens
  heavy chain complementarity determining region 3 for antibody 11984
AKDSRDKWELHD

SEQ ID NO: 23969 - protein, 9 aa, Homo sapiens
  light chain complementarity determining region 3 for antibody 11985
LQENTYPLT

SEQ ID NO: 23970 - protein, 19 aa, Homo sapiens
  heavy chain complementarity determining region 3 for antibody 11985
AREEGYYSGSGSFHPESDS

SEQ ID NO: 23971 - protein, 9 aa, Homo sapiens
  light chain complementarity determining region 3 for antibody 11986
QQYNSYPLT

SEQ ID NO: 23972 - protein, 19 aa, Homo sapiens
  heavy chain complementarity determining region 3 for antibody 11986
ARDHSDTTMEPGGEGCFDY

SEQ ID NO: 23973 - protein, 9 aa, Homo sapiens
  light chain complementarity determining region 3 for antibody 11987
QQYNSYFLT

SEQ ID NO: 23974 - protein, 20 aa, Homo sapiens
  heavy chain complementarity determining region 3 for antibody 11987
ARDRQDYYDSSDYFGPHFDH

SEQ ID NO: 23975 - protein, 8 aa, Homo sapiens
  light chain complementarity determining region 3 for antibody 11988
QQYGSSLT

SEQ ID NO: 23976 - protein, 18 aa, Homo sapiens
  heavy chain complementarity determining region 3 for antibody 11988
ARISHYYDPSGYYGSFDY

SEQ ID NO: 23977 - protein, 9 aa, Homo sapiens
  light chain complementarity determining region 3 for antibody 11989
QQYFNTPLT

SEQ ID NO: 23978 - protein, 17 aa, Homo sapiens
  heavy chain complementarity determining region 3 for antibody 11989
AHFQTSAAGHQHWHFDS

SEQ ID NO: 23979 - protein, 9 aa, Homo sapiens
  light chain complementarity determining region 3 for antibody 11990
QQYENVPYT

SEQ ID NO: 23980 - protein, 16 aa, Homo sapiens
  heavy chain complementarity determining region 3 for antibody 11990
ARGGAFGGVVIEGFDY

SEQ ID NO: 23981 - protein, 9 aa, Homo sapiens
  light chain complementarity determining region 3 for antibody 11991
QQYDSLPYT

SEQ ID NO: 23982 - protein, 12 aa, Homo sapiens
  heavy chain complementarity determining region 3 for antibody 11991
ARGWEFQGWFDP

SEQ ID NO: 23983 - protein, 12 aa, Homo sapiens
  light chain complementarity determining region 3 for antibody 11992
QQYDNLPPGVWT

SEQ ID NO: 23984 - protein, 16 aa, Homo sapiens
  heavy chain complementarity determining region 3 for antibody 11992
ARELFKGEYDYYALDV

SEQ ID NO: 23985 - protein, 9 aa, Homo sapiens
  light chain complementarity determining region 3 for antibody 11993
QQYDKHPLT

SEQ ID NO: 23986 - protein, 13 aa, Homo sapiens
  heavy chain complementarity determining region 3 for antibody 11993
AATRTSGFYHLDY

SEQ ID NO: 23987 - protein, 9 aa, Homo sapiens
  light chain complementarity determining region 3 for antibody 11994
QQSYSTPIT

SEQ ID NO: 23988 - protein, 14 aa, Homo sapiens
  heavy chain complementarity determining region 3 for antibody 11994
TRFLYGDHVKFFDY

SEQ ID NO: 23989 - protein, 8 aa, Homo sapiens
  light chain complementarity determining region 3 for antibody 11995
QQSYSPLT

SEQ ID NO: 23990 - protein, 15 aa, Homo sapiens
  heavy chain complementarity determining region 3 for antibody 11995
AHSRDASMVYDAFDI

SEQ ID NO: 23991 - protein, 9 aa, Homo sapiens
  light chain complementarity determining region 3 for antibody 11996
QQSYSNPPA

SEQ ID NO: 23992 - protein, 16 aa, Homo sapiens
  heavy chain complementarity determining region 3 for antibody 11996
AREARGATVTLNWFDP

SEQ ID NO: 23993 - protein, 11 aa, Homo sapiens
  light chain complementarity determining region 3 for antibody 11997
QQRSNWPFIFT

SEQ ID NO: 23994 - protein, 7 aa, Homo sapiens
  heavy chain complementarity determining region 3 for antibody 11997
ARSVGDY

SEQ ID NO: 23995 - protein, 9 aa, Homo sapiens
  light chain complementarity determining region 3 for antibody 11998
QQRSNWHQT

SEQ ID NO: 23996 - protein, 10 aa, Homo sapiens
  heavy chain complementarity determining region 3 for antibody 11998
DSEIEKGFDY

SEQ ID NO: 23997 - protein, 9 aa, Homo sapiens
  light chain complementarity determining region 3 for antibody 11999
QQRHNWGLT

SEQ ID NO: 23998 - protein, 22 aa, Homo sapiens
  heavy chain complementarity determining region 3 for antibody 11999
ARHSGYSNTWYMNYYYYYGMDV

SEQ ID NO: 23999 - protein, 9 aa, Homo sapiens
  light chain complementarity determining region 3 for antibody 12000
QQAYSFPLS

SEQ ID NO: 24000 - protein, 13 aa, Homo sapiens
  heavy chain complementarity determining region 3 for antibody 12000
TRTYGSGRNWFDP

SEQ ID NO: 24001 - protein, 9 aa, Homo sapiens
  light chain complementarity determining region 3 for antibody 12001
QQANTFPPN

SEQ ID NO: 24002 - protein, 17 aa, Homo sapiens
  heavy chain complementarity determining region 3 for antibody 12001
AMVRYTCGGDCYYKFDY

SEQ ID NO: 24003 - protein, 10 aa, Homo sapiens
  light chain complementarity determining region 3 for antibody 12002
QQAKSFPSFT

SEQ ID NO: 24004 - protein, 18 aa, Homo sapiens
  heavy chain complementarity determining region 3 for antibody 12002
ARNPWRAGPNFYYYAIDV

SEQ ID NO: 24005 - protein, 9 aa, Homo sapiens
  light chain complementarity determining region 3 for antibody 12003
QKYNSAPFT

SEQ ID NO: 24006 - protein, 17 aa, Homo sapiens
  heavy chain complementarity determining region 3 for antibody 12003
ARDRDSSGWDYWGPLPN

SEQ ID NO: 24007 - protein, 9 aa, Homo sapiens
  light chain complementarity determining region 3 for antibody 12004
MQGLLSPPA

SEQ ID NO: 24008 - protein, 18 aa, Homo sapiens
  heavy chain complementarity determining region 3 for antibody 12004
ARTRFGVYSGGSPFMFDP

SEQ ID NO: 24009 - protein, 9 aa, Homo sapiens
  light chain complementarity determining region 3 for antibody 12005
LQHNSYPWT

SEQ ID NO: 24010 - protein, 19 aa, Homo sapiens
  heavy chain complementarity determining region 3 for antibody 12005
ARGVGSDFSGFYLLGYFDF

SEQ ID NO: 24011 - protein, 9 aa, Homo sapiens
  light chain complementarity determining region 3 for antibody 12006
LQENSYPLT

SEQ ID NO: 24012 - protein, 19 aa, Homo sapiens
  heavy chain complementarity determining region 3 for antibody 12006
AREEGYYDGSGSWHPESDY

SEQ ID NO: 24013 - protein, 10 aa, Homo sapiens
  light chain complementarity determining region 3 for antibody 12007
QYHGYSPPYT

SEQ ID NO: 24014 - protein, 12 aa, Homo sapiens
  heavy chain complementarity determining region 3 for antibody 12007
AKGILGRGGMDV

SEQ ID NO: 24015 - protein, 9 aa, Homo sapiens
  light chain complementarity determining region 3 for antibody 12008
QQYNTYPYT

SEQ ID NO: 24016 - protein, 14 aa, Homo sapiens
  heavy chain complementarity determining region 3 for antibody 12008
ANKAIGANSGTSDY

SEQ ID NO: 24017 - protein, 8 aa, Homo sapiens
  light chain complementarity determining region 3 for antibody 12009
QQYNRHWA

SEQ ID NO: 24018 - protein, 12 aa, Homo sapiens
  heavy chain complementarity determining region 3 for antibody 12009
ATEWDLGAVFDH

SEQ ID NO: 24019 - protein, 8 aa, Homo sapiens
  light chain complementarity determining region 3 for antibody 12010
QQYNNYWT

SEQ ID NO: 24020 - protein, 15 aa, Homo sapiens
  heavy chain complementarity determining region 3 for antibody 12010
ARWDFDSESYDWFDP

SEQ ID NO: 24021 - protein, 9 aa, Homo sapiens
  light chain complementarity determining region 3 for antibody 12011
QQYHSPAIT

SEQ ID NO: 24022 - protein, 15 aa, Homo sapiens
  heavy chain complementarity determining region 3 for antibody 12011
AKEKSVQQWPEYFSN

SEQ ID NO: 24023 - protein, 10 aa, Homo sapiens
  light chain complementarity determining region 3 for antibody 12012
QQYGSSPPYT

SEQ ID NO: 24024 - protein, 15 aa, Homo sapiens
  heavy chain complementarity determining region 3 for antibody 12012
ARGRNTMVRGVSFDY

SEQ ID NO: 24025 - protein, 9 aa, Homo sapiens
  light chain complementarity determining region 3 for antibody 12013
QQYGSSPLT

SEQ ID NO: 24026 - protein, 14 aa, Homo sapiens
  heavy chain complementarity determining region 3 for antibody 12013
ARQDGHSIPRHLDH

SEQ ID NO: 24027 - protein, 9 aa, Homo sapiens
  light chain complementarity determining region 3 for antibody 12014
QQYGNSPYT

SEQ ID NO: 24028 - protein, 13 aa, Homo sapiens
  heavy chain complementarity determining region 3 for antibody 12014
ARAPQTWLLYFDY

SEQ ID NO: 24029 - protein, 9 aa, Homo sapiens
  light chain complementarity determining region 3 for antibody 12015
QQYENWPYT

SEQ ID NO: 24030 - protein, 15 aa, Homo sapiens
  heavy chain complementarity determining region 3 for antibody 12015
ARDGVRSSGWYNFDF

SEQ ID NO: 24031 - protein, 8 aa, Homo sapiens
  light chain complementarity determining region 3 for antibody 12016
QQYDYVFT

SEQ ID NO: 24032 - protein, 18 aa, Homo sapiens
  heavy chain complementarity determining region 3 for antibody 12016
ARGGDGIFLLYFFYGMDV

SEQ ID NO: 24033 - protein, 9 aa, Homo sapiens
  light chain complementarity determining region 3 for antibody 12017
QQYCTTPWT

SEQ ID NO: 24034 - protein, 10 aa, Homo sapiens
  heavy chain complementarity determining region 3 for antibody 12017
ANEFWYGGGS

SEQ ID NO: 24035 - protein, 9 aa, Homo sapiens
  light chain complementarity determining region 3 for antibody 12018
QQSYSQGLT

SEQ ID NO: 24036 - protein, 16 aa, Homo sapiens
  heavy chain complementarity determining region 3 for antibody 12018
TKPGDRGWYTAEYFQH

SEQ ID NO: 24037 - protein, 9 aa, Homo sapiens
  light chain complementarity determining region 3 for antibody 12019
QQSFSTPPT

SEQ ID NO: 24038 - protein, 18 aa, Homo sapiens
  heavy chain complementarity determining region 3 for antibody 12019
ARQRPYSSSWYAEYYFDY

SEQ ID NO: 24039 - protein, 10 aa, Homo sapiens
  light chain complementarity determining region 3 for antibody 12020
QQRSNWPPWS

SEQ ID NO: 24040 - protein, 21 aa, Homo sapiens
  heavy chain complementarity determining region 3 for antibody 12020
ARSHYDSSGYYSNHYYYAMDV

SEQ ID NO: 24041 - protein, 9 aa, Homo sapiens
  light chain complementarity determining region 3 for antibody 12021
QQRSNWPNT

SEQ ID NO: 24042 - protein, 16 aa, Homo sapiens
  heavy chain complementarity determining region 3 for antibody 12021
ARGGFGELGLHNAFDV

SEQ ID NO: 24043 - protein, 9 aa, Homo sapiens
  light chain complementarity determining region 3 for antibody 12022
QQRNSWPLT

SEQ ID NO: 24044 - protein, 11 aa, Homo sapiens
  heavy chain complementarity determining region 3 for antibody 12022
VRDAAARRLDS

SEQ ID NO: 24045 - protein, 9 aa, Homo sapiens
  light chain complementarity determining region 3 for antibody 12023
QQLNSYPPA

SEQ ID NO: 24046 - protein, 21 aa, Homo sapiens
  heavy chain complementarity determining region 3 for antibody 12023
ARGEAHCGGDCYSRPPWYFDF

SEQ ID NO: 24047 - protein, 9 aa, Homo sapiens
  light chain complementarity determining region 3 for antibody 12024
QQLNNYLVT

SEQ ID NO: 24048 - protein, 13 aa, Homo sapiens
  heavy chain complementarity determining region 3 for antibody 12024
AKDYDYGDFHFDY

SEQ ID NO: 24049 - protein, 9 aa, Homo sapiens
  light chain complementarity determining region 3 for antibody 12025
QQANSFPLT

SEQ ID NO: 24050 - protein, 19 aa, Homo sapiens
  heavy chain complementarity determining region 3 for antibody 12025
ARAPAVVRGVIPDTLTFDY

SEQ ID NO: 24051 - protein, 9 aa, Homo sapiens
  light chain complementarity determining region 3 for antibody 12026
QQAHIFPLT

SEQ ID NO: 24052 - protein, 16 aa, Homo sapiens
  heavy chain complementarity determining region 3 for antibody 12026
ARDPAVDGSGWFYFDY

SEQ ID NO: 24053 - protein, 9 aa, Homo sapiens
  light chain complementarity determining region 3 for antibody 12027
QHYGTSPFT

SEQ ID NO: 24054 - protein, 16 aa, Homo sapiens
  heavy chain complementarity determining region 3 for antibody 12027
ARGGQLTRNYYFPMDV

SEQ ID NO: 24055 - protein, 9 aa, Homo sapiens
  light chain complementarity determining region 3 for antibody 12028
MQALQTPFT

SEQ ID NO: 24056 - protein, 28 aa, Homo sapiens
  heavy chain complementarity determining region 3 for antibody 12028
ARDQWKTRAPMLFRGVISEGEPVYGMGV

SEQ ID NO: 24057 - protein, 8 aa, Homo sapiens
  light chain complementarity determining region 3 for antibody 12029
MQALQTFT

SEQ ID NO: 24058 - protein, 16 aa, Homo sapiens
  heavy chain complementarity determining region 3 for antibody 12029
ARVGVSDTNYYYGMDV

SEQ ID NO: 24059 - protein, 9 aa, Homo sapiens
  light chain complementarity determining region 3 for antibody 12030
LQYYNTPHT

SEQ ID NO: 24060 - protein, 14 aa, Homo sapiens
  heavy chain complementarity determining region 3 for antibody 12030
ARASPKDGYNIIDY

SEQ ID NO: 24061 - protein, 9 aa, Homo sapiens
  light chain complementarity determining region 3 for antibody 12031
LQHNSCPLT

SEQ ID NO: 24062 - protein, 13 aa, Homo sapiens
  heavy chain complementarity determining region 3 for antibody 12031
TRLIVAPGTYFDF

SEQ ID NO: 24063 - protein, 9 aa, Homo sapiens
  light chain complementarity determining region 3 for antibody 12032
LQDYNPHWT

SEQ ID NO: 24064 - protein, 14 aa, Homo sapiens
  heavy chain complementarity determining region 3 for antibody 12032
AKFRGATGDYHFDS

SEQ ID NO: 24065 - protein, 9 aa, Homo sapiens
  light chain complementarity determining region 3 for antibody 12033
QQYYTTPPT

SEQ ID NO: 24066 - protein, 25 aa, Homo sapiens
  heavy chain complementarity determining region 3 for antibody 12033
GRERGDVLLWFGESLDPERRDAFDV

SEQ ID NO: 24067 - protein, 9 aa, Homo sapiens
  light chain complementarity determining region 3 for antibody 12034
QQYYTTPLT

SEQ ID NO: 24068 - protein, 17 aa, Homo sapiens
  heavy chain complementarity determining region 3 for antibody 12034
ARERSVAGAVRFYGMDV

SEQ ID NO: 24069 - protein, 9 aa, Homo sapiens
  light chain complementarity determining region 3 for antibody 12035
QQYSSYPLT

SEQ ID NO: 24070 - protein, 11 aa, Homo sapiens
  heavy chain complementarity determining region 3 for antibody 12035
ARSPYLSGPDY

SEQ ID NO: 24071 - protein, 8 aa, Homo sapiens
  light chain complementarity determining region 3 for antibody 12036
QQYSSSPT

SEQ ID NO: 24072 - protein, 19 aa, Homo sapiens
  heavy chain complementarity determining region 3 for antibody 12036
ARDRFPSSGWNSPPDAFDI

SEQ ID NO: 24073 - protein, 10 aa, Homo sapiens
  light chain complementarity determining region 3 for antibody 12037
QQYNSYSPWT

SEQ ID NO: 24074 - protein, 23 aa, Homo sapiens
  heavy chain complementarity determining region 3 for antibody 12037
ARHGGVDNYDSSGYYYPPGGFDI

SEQ ID NO: 24075 - protein, 9 aa, Homo sapiens
  light chain complementarity determining region 3 for antibody 12038
QQYNSYSHT

SEQ ID NO: 24076 - protein, 21 aa, Homo sapiens
  heavy chain complementarity determining region 3 for antibody 12038
AREQSYTVAGVNYYYYYAMDV

SEQ ID NO: 24077 - protein, 9 aa, Homo sapiens
  light chain complementarity determining region 3 for antibody 12039
QQYGSSPYT

SEQ ID NO: 24078 - protein, 13 aa, Homo sapiens
  heavy chain complementarity determining region 3 for antibody 12039
ARSEQLPTGWFDP

SEQ ID NO: 24079 - protein, 9 aa, Homo sapiens
  light chain complementarity determining region 3 for antibody 12040
QQYGSSPQT

SEQ ID NO: 24080 - protein, 13 aa, Homo sapiens
  heavy chain complementarity determining region 3 for antibody 12040
ARQFHGAAKHFDF

SEQ ID NO: 24081 - protein, 10 aa, Homo sapiens
  light chain complementarity determining region 3 for antibody 12041
QQYGSSPPIT

SEQ ID NO: 24082 - protein, 18 aa, Homo sapiens
  heavy chain complementarity determining region 3 for antibody 12041
ARGGKTYYEISGIDAFDI

SEQ ID NO: 24083 - protein, 9 aa, Homo sapiens
  light chain complementarity determining region 3 for antibody 12042
QQYGGSPLT

SEQ ID NO: 24084 - protein, 12 aa, Homo sapiens
  heavy chain complementarity determining region 3 for antibody 12042
AAWYGSWSAFDH

SEQ ID NO: 24085 - protein, 9 aa, Homo sapiens
  light chain complementarity determining region 3 for antibody 12043
QQYDTSSYT

SEQ ID NO: 24086 - protein, 15 aa, Homo sapiens
  heavy chain complementarity determining region 3 for antibody 12043
ARAPRKAAAFVRFDP

SEQ ID NO: 24087 - protein, 9 aa, Homo sapiens
  light chain complementarity determining region 3 for antibody 12044
QQSYSTPYT

SEQ ID NO: 24088 - protein, 17 aa, Homo sapiens
  heavy chain complementarity determining region 3 for antibody 12044
ARRPDYDSSGPLDAFDI

SEQ ID NO: 24089 - protein, 9 aa, Homo sapiens
  light chain complementarity determining region 3 for antibody 12045
QQSYSTPVT

SEQ ID NO: 24090 - protein, 17 aa, Homo sapiens
  heavy chain complementarity determining region 3 for antibody 12045
ARNRGSTLVRDQDGMDV

SEQ ID NO: 24091 - protein, 10 aa, Homo sapiens
  light chain complementarity determining region 3 for antibody 12046
QQSYSTPGYT

SEQ ID NO: 24092 - protein, 17 aa, Homo sapiens
  heavy chain complementarity determining region 3 for antibody 12046
ATRRDVGVVVADVAQYF

SEQ ID NO: 24093 - protein, 6 aa, Homo sapiens
  light chain complementarity determining region 3 for antibody 12047
QQSGTA

SEQ ID NO: 24094 - protein, 14 aa, Homo sapiens
  heavy chain complementarity determining region 3 for antibody 12047
ATLGQGTVVGSYSD

SEQ ID NO: 24095 - protein, 11 aa, Homo sapiens
  light chain complementarity determining region 3 for antibody 12048
QQRSNWPPAFT

SEQ ID NO: 24096 - protein, 16 aa, Homo sapiens
  heavy chain complementarity determining region 3 for antibody 12048
ARGSVMWINREGALDV

SEQ ID NO: 24097 - protein, 10 aa, Homo sapiens
  light chain complementarity determining region 3 for antibody 12049
QQNYDTGTIT

SEQ ID NO: 24098 - protein, 19 aa, Homo sapiens
  heavy chain complementarity determining region 3 for antibody 12049
AHQKGDDDSGLNYYHGMDV

SEQ ID NO: 24099 - protein, 10 aa, Homo sapiens
  light chain complementarity determining region 3 for antibody 12050
MQHTHWPPYT

SEQ ID NO: 24100 - protein, 14 aa, Homo sapiens
  heavy chain complementarity determining region 3 for antibody 12050
ASAQSSGWNWYFDL

SEQ ID NO: 24101 - protein, 9 aa, Homo sapiens
  light chain complementarity determining region 3 for antibody 12051
LQHNSYPYT

SEQ ID NO: 24102 - protein, 10 aa, Homo sapiens
  heavy chain complementarity determining region 3 for antibody 12051
ARDGYYGMDV

SEQ ID NO: 24103 - protein, 9 aa, Homo sapiens
  light chain complementarity determining region 3 for antibody 12052
LQHNSYPPT

SEQ ID NO: 24104 - protein, 11 aa, Homo sapiens
  heavy chain complementarity determining region 3 for antibody 12052
VTWVESVGPRD

SEQ ID NO: 24105 - protein, 10 aa, Homo sapiens
  light chain complementarity determining region 3 for antibody 12053
QYHGYSPLHT

SEQ ID NO: 24106 - protein, 12 aa, Homo sapiens
  heavy chain complementarity determining region 3 for antibody 12053
AKGILGRGGMDV

SEQ ID NO: 24107 - protein, 9 aa, Homo sapiens
  light chain complementarity determining region 3 for antibody 12054
QQYYSTPYT

SEQ ID NO: 24108 - protein, 13 aa, Homo sapiens
  heavy chain complementarity determining region 3 for antibody 12054
AKATSDGSGALHY

SEQ ID NO: 24109 - protein, 9 aa, Homo sapiens
  light chain complementarity determining region 3 for antibody 12055
QQYYSFPCT

SEQ ID NO: 24110 - protein, 12 aa, Homo sapiens
  heavy chain complementarity determining region 3 for antibody 12055
ARDSRGYKYGHV

SEQ ID NO: 24111 - protein, 9 aa, Homo sapiens
  light chain complementarity determining region 3 for antibody 12056
QQYYNWPFT

SEQ ID NO: 24112 - protein, 13 aa, Homo sapiens
  heavy chain complementarity determining region 3 for antibody 12056
AKDYGAMVGASDY

SEQ ID NO: 24113 - protein, 9 aa, Homo sapiens
  light chain complementarity determining region 3 for antibody 12057
QQYYNAPRT

SEQ ID NO: 24114 - protein, 22 aa, Homo sapiens
  heavy chain complementarity determining region 3 for antibody 12057
ARCRGSTGFFILGPPGFYGLDV

SEQ ID NO: 24115 - protein, 10 aa, Homo sapiens
  light chain complementarity determining region 3 for antibody 12058
QQYNSFSSYT

SEQ ID NO: 24116 - protein, 16 aa, Homo sapiens
  heavy chain complementarity determining region 3 for antibody 12058
VRDRLKGYTDYPTLDR

SEQ ID NO: 24117 - protein, 10 aa, Homo sapiens
  light chain complementarity determining region 3 for antibody 12059
QQYNNWPPIT

SEQ ID NO: 24118 - protein, 20 aa, Homo sapiens
  heavy chain complementarity determining region 3 for antibody 12059
AHRLETYGGSVSHYYYAMDV

SEQ ID NO: 24119 - protein, 9 aa, Homo sapiens
  light chain complementarity determining region 3 for antibody 12060
QQYDNLPRT

SEQ ID NO: 24120 - protein, 9 aa, Homo sapiens
  heavy chain complementarity determining region 3 for antibody 12060
ARGRSNFRH

SEQ ID NO: 24121 - protein, 10 aa, Homo sapiens
  light chain complementarity determining region 3 for antibody 12061
QQTKTFPRIT

SEQ ID NO: 24122 - protein, 23 aa, Homo sapiens
  heavy chain complementarity determining region 3 for antibody 12061
VRMPFKVPFGENSNFFYYYAMDV

SEQ ID NO: 24123 - protein, 9 aa, Homo sapiens
  light chain complementarity determining region 3 for antibody 12062
QQSYSTPLT

SEQ ID NO: 24124 - protein, 22 aa, Homo sapiens
  heavy chain complementarity determining region 3 for antibody 12062
LRDGDTYYYDGDRYYYGPGFDF

SEQ ID NO: 24125 - protein, 9 aa, Homo sapiens
  light chain complementarity determining region 3 for antibody 12063
QQSYSTPHT

SEQ ID NO: 24126 - protein, 16 aa, Homo sapiens
  heavy chain complementarity determining region 3 for antibody 12063
ARGGFGELGLQNAFDI

SEQ ID NO: 24127 - protein, 10 aa, Homo sapiens
  light chain complementarity determining region 3 for antibody 12064
QQSYSFSPYT

SEQ ID NO: 24128 - protein, 21 aa, Homo sapiens
  heavy chain complementarity determining region 3 for antibody 12064
ARFKYNGSGYYSRARLNWFDS

SEQ ID NO: 24129 - protein, 9 aa, Homo sapiens
  light chain complementarity determining region 3 for antibody 12065
QQLYTYPWT

SEQ ID NO: 24130 - protein, 9 aa, Homo sapiens
  heavy chain complementarity determining region 3 for antibody 12065
ARYFGAFEM

SEQ ID NO: 24131 - protein, 11 aa, Homo sapiens
  light chain complementarity determining region 3 for antibody 12066
QQCSNWPPLYT

SEQ ID NO: 24132 - protein, 14 aa, Homo sapiens
  heavy chain complementarity determining region 3 for antibody 12066
AKDRGAGHYYSMDV

SEQ ID NO: 24133 - protein, 8 aa, Homo sapiens
  light chain complementarity determining region 3 for antibody 12067
QQAGSSPT

SEQ ID NO: 24134 - protein, 12 aa, Homo sapiens
  heavy chain complementarity determining region 3 for antibody 12067
ARNDWAATDFDS

SEQ ID NO: 24135 - protein, 9 aa, Homo sapiens
  light chain complementarity determining region 3 for antibody 12068
QKYNSAPRT

SEQ ID NO: 24136 - protein, 20 aa, Homo sapiens
  heavy chain complementarity determining region 3 for antibody 12068
ARGGRYSDNFPYYYHYGMDV

SEQ ID NO: 24137 - protein, 9 aa, Homo sapiens
  light chain complementarity determining region 3 for antibody 12069
QHYYNTPLT

SEQ ID NO: 24138 - protein, 14 aa, Homo sapiens
  heavy chain complementarity determining region 3 for antibody 12069
ARAPPRGELSPLNH

SEQ ID NO: 24139 - protein, 9 aa, Homo sapiens
  light chain complementarity determining region 3 for antibody 12070
QHYNSYPWT

SEQ ID NO: 24140 - protein, 16 aa, Homo sapiens
  heavy chain complementarity determining region 3 for antibody 12070
VRHSSGLFWVGLPIEP

SEQ ID NO: 24141 - protein, 9 aa, Homo sapiens
  light chain complementarity determining region 3 for antibody 12071
MQSLQIPYT

SEQ ID NO: 24142 - protein, 12 aa, Homo sapiens
  heavy chain complementarity determining region 3 for antibody 12071
ARVVGAATTVDY

SEQ ID NO: 24143 - protein, 9 aa, Homo sapiens
  light chain complementarity determining region 3 for antibody 12072
MQGTHWPGT

SEQ ID NO: 24144 - protein, 27 aa, Homo sapiens
  heavy chain complementarity determining region 3 for antibody 12072
ARDLGPQAVESCGGDCYSPEGVDAFDF

SEQ ID NO: 24145 - protein, 7 aa, Homo sapiens
  light chain complementarity determining region 3 for antibody 12073
MQGAPPT

SEQ ID NO: 24146 - protein, 13 aa, Homo sapiens
  heavy chain complementarity determining region 3 for antibody 12073
ARGFWHYFYGMDV

SEQ ID NO: 24147 - protein, 8 aa, Homo sapiens
  light chain complementarity determining region 3 for antibody 12074
MQALLGIT

SEQ ID NO: 24148 - protein, 22 aa, Homo sapiens
  heavy chain complementarity determining region 3 for antibody 12074
AKSVDILTGYYSGVSGVYGMDV

SEQ ID NO: 24149 - protein, 9 aa, Homo sapiens
  light chain complementarity determining region 3 for antibody 12075
LQHNAFPRT

SEQ ID NO: 24150 - protein, 16 aa, Homo sapiens
  heavy chain complementarity determining region 3 for antibody 12075
AKDDREDFYDTDGFYT

SEQ ID NO: 24151 - protein, 9 aa, Homo sapiens
  light chain complementarity determining region 3 for antibody 12076
LQDYNYPRT

SEQ ID NO: 24152 - protein, 18 aa, Homo sapiens
  heavy chain complementarity determining region 3 for antibody 12076
ARDTSPGDSSAWYDAFDI

SEQ ID NO: 24153 - protein, 11 aa, Homo sapiens
  light chain complementarity determining region 3 for antibody 12077
HQCNKWPPRDT

SEQ ID NO: 24154 - protein, 14 aa, Homo sapiens
  heavy chain complementarity determining region 3 for antibody 12077
AKDEFGDGYYGMDV

SEQ ID NO: 24155 - protein, 9 aa, Homo sapiens
  light chain complementarity determining region 3 for antibody 12078
QQYYSTPYT

SEQ ID NO: 24156 - protein, 9 aa, Homo sapiens
  heavy chain complementarity determining region 3 for antibody 12078
AKDQWWWNS

SEQ ID NO: 24157 - protein, 10 aa, Homo sapiens
  light chain complementarity determining region 3 for antibody 12079
QQYYNWPPFT

SEQ ID NO: 24158 - protein, 14 aa, Homo sapiens
  heavy chain complementarity determining region 3 for antibody 12079
ARGMIRAPEFCFDL

SEQ ID NO: 24159 - protein, 9 aa, Homo sapiens
  light chain complementarity determining region 3 for antibody 12080
QQYSNSPIT

SEQ ID NO: 24160 - protein, 25 aa, Homo sapiens
  heavy chain complementarity determining region 3 for antibody 12080
ARNKEGFCSGSSCYSTRNWYWYFDL

SEQ ID NO: 24161 - protein, 9 aa, Homo sapiens
  light chain complementarity determining region 3 for antibody 12081
QQYNSYPIT

SEQ ID NO: 24162 - protein, 18 aa, Homo sapiens
  heavy chain complementarity determining region 3 for antibody 12081
AKLGISLWFGETYGWMDV

SEQ ID NO: 24163 - protein, 9 aa, Homo sapiens
  light chain complementarity determining region 3 for antibody 12082
QQYNNYPYT

SEQ ID NO: 24164 - protein, 17 aa, Homo sapiens
  heavy chain complementarity determining region 3 for antibody 12082
AREDWSDVDLQNYYFDL

SEQ ID NO: 24165 - protein, 11 aa, Homo sapiens
  light chain complementarity determining region 3 for antibody 12083
QQYKSPSPEYT

SEQ ID NO: 24166 - protein, 15 aa, Homo sapiens
  heavy chain complementarity determining region 3 for antibody 12083
ARSYGDIRFYYGMDV

SEQ ID NO: 24167 - protein, 9 aa, Homo sapiens
  light chain complementarity determining region 3 for antibody 12084
QQYDSFPLT

SEQ ID NO: 24168 - protein, 19 aa, Homo sapiens
  heavy chain complementarity determining region 3 for antibody 12084
ARLGVNMVRGITHWGWFDP

SEQ ID NO: 24169 - protein, 9 aa, Homo sapiens
  light chain complementarity determining region 3 for antibody 12085
QQYDNLPVT

SEQ ID NO: 24170 - protein, 16 aa, Homo sapiens
  heavy chain complementarity determining region 3 for antibody 12085
SREGYNSGWIPEKFKY

SEQ ID NO: 24171 - protein, 9 aa, Homo sapiens
  light chain complementarity determining region 3 for antibody 12086
QQYDNLPIT

SEQ ID NO: 24172 - protein, 12 aa, Homo sapiens
  heavy chain complementarity determining region 3 for antibody 12086
GADWYLLDSFDY

SEQ ID NO: 24173 - protein, 9 aa, Homo sapiens
  light chain complementarity determining region 3 for antibody 12087
QQRSNWPLT

SEQ ID NO: 24174 - protein, 13 aa, Homo sapiens
  heavy chain complementarity determining region 3 for antibody 12087
ASGLHSGYDYFDY

SEQ ID NO: 24175 - protein, 9 aa, Homo sapiens
  light chain complementarity determining region 3 for antibody 12088
QQRSNWPLT

SEQ ID NO: 24176 - protein, 14 aa, Homo sapiens
  heavy chain complementarity determining region 3 for antibody 12088
AKDRGLLWFGELSH

SEQ ID NO: 24177 - protein, 9 aa, Homo sapiens
  light chain complementarity determining region 3 for antibody 12089
QQRDNWPLT

SEQ ID NO: 24178 - protein, 14 aa, Homo sapiens
  heavy chain complementarity determining region 3 for antibody 12089
ARRFDGSNSNWFDP

SEQ ID NO: 24179 - protein, 8 aa, Homo sapiens
  light chain complementarity determining region 3 for antibody 12090
QQCYNKPT

SEQ ID NO: 24180 - protein, 13 aa, Homo sapiens
  heavy chain complementarity determining region 3 for antibody 12090
IKAFSDASDAFQI

SEQ ID NO: 24181 - protein, 9 aa, Homo sapiens
  light chain complementarity determining region 3 for antibody 12091
QHYNGYPAT

SEQ ID NO: 24182 - protein, 15 aa, Homo sapiens
  heavy chain complementarity determining region 3 for antibody 12091
ARDVGLWFGDFGFDY

SEQ ID NO: 24183 - protein, 12 aa, Homo sapiens
  light chain complementarity determining region 3 for antibody 12092
QHYGSYGSSPGT

SEQ ID NO: 24184 - protein, 17 aa, Homo sapiens
  heavy chain complementarity determining region 3 for antibody 12092
VRLFRGVINNGVGWIDP

SEQ ID NO: 24185 - protein, 9 aa, Homo sapiens
  light chain complementarity determining region 3 for antibody 12093
MQALQTPLT

SEQ ID NO: 24186 - protein, 19 aa, Homo sapiens
  heavy chain complementarity determining region 3 for antibody 12093
ARGFFDYDSSAYRSGWFDP

SEQ ID NO: 24187 - protein, 10 aa, Homo sapiens
  light chain complementarity determining region 3 for antibody 12094
MQALQTPGFT

SEQ ID NO: 24188 - protein, 21 aa, Homo sapiens
  heavy chain complementarity determining region 3 for antibody 12094
ARASPTGYSSSPRTHYSGMDV

SEQ ID NO: 24189 - protein, 9 aa, Homo sapiens
  light chain complementarity determining region 3 for antibody 12095
HQSFTTPWT

SEQ ID NO: 24190 - protein, 12 aa, Homo sapiens
  heavy chain complementarity determining region 3 for antibody 12095
ARDWGTGWYIHS

SEQ ID NO: 24191 - protein, 10 aa, Homo sapiens
  light chain complementarity determining region 3 for antibody 12096
QYHGYSPLYT

SEQ ID NO: 24192 - protein, 12 aa, Homo sapiens
  heavy chain complementarity determining region 3 for antibody 12096
AKGIWGRGGMDV

SEQ ID NO: 24193 - protein, 9 aa, Homo sapiens
  light chain complementarity determining region 3 for antibody 12097
QQYSSFPYT

SEQ ID NO: 24194 - protein, 17 aa, Homo sapiens
  heavy chain complementarity determining region 3 for antibody 12097
AREDWNDVDLREFYFDH

SEQ ID NO: 24195 - protein, 9 aa, Homo sapiens
  light chain complementarity determining region 3 for antibody 12098
QQYGWLPYS

SEQ ID NO: 24196 - protein, 11 aa, Homo sapiens
  heavy chain complementarity determining region 3 for antibody 12098
GRSHTENAFDI

SEQ ID NO: 24197 - protein, 9 aa, Homo sapiens
  light chain complementarity determining region 3 for antibody 12099
QQYGSSSGT

SEQ ID NO: 24198 - protein, 11 aa, Homo sapiens
  heavy chain complementarity determining region 3 for antibody 12099
ARDVGYNYFDS

SEQ ID NO: 24199 - protein, 9 aa, Homo sapiens
  light chain complementarity determining region 3 for antibody 12100
QQSYSTPLT

SEQ ID NO: 24200 - protein, 12 aa, Homo sapiens
  heavy chain complementarity determining region 3 for antibody 12100
ASCIYGSGTLKV

SEQ ID NO: 24201 - protein, 10 aa, Homo sapiens
  light chain complementarity determining region 3 for antibody 12101
QQSYSSPRIT

SEQ ID NO: 24202 - protein, 17 aa, Homo sapiens
  heavy chain complementarity determining region 3 for antibody 12101
ARHRSRSARYENHGMDV

SEQ ID NO: 24203 - protein, 9 aa, Homo sapiens
  light chain complementarity determining region 3 for antibody 12102
QQSYSIPYT

SEQ ID NO: 24204 - protein, 20 aa, Homo sapiens
  heavy chain complementarity determining region 3 for antibody 12102
ARDRSVNAAMDYYFYSGMDL

SEQ ID NO: 24205 - protein, 9 aa, Homo sapiens
  light chain complementarity determining region 3 for antibody 12103
QQSYSIPLT

SEQ ID NO: 24206 - protein, 10 aa, Homo sapiens
  heavy chain complementarity determining region 3 for antibody 12103
TTTMQWTGGY

SEQ ID NO: 24207 - protein, 9 aa, Homo sapiens
  light chain complementarity determining region 3 for antibody 12104
QQSGSSSYT

SEQ ID NO: 24208 - protein, 24 aa, Homo sapiens
  heavy chain complementarity determining region 3 for antibody 12104
ARDFLGSHYEVLTGYYDQYYGLDV

SEQ ID NO: 24209 - protein, 9 aa, Homo sapiens
  light chain complementarity determining region 3 for antibody 12105
QQRSNWPWT

SEQ ID NO: 24210 - protein, 11 aa, Homo sapiens
  heavy chain complementarity determining region 3 for antibody 12105
VRGGRGGGLDF

SEQ ID NO: 24211 - protein, 10 aa, Homo sapiens
  light chain complementarity determining region 3 for antibody 12106
QQRSNWPQLT

SEQ ID NO: 24212 - protein, 18 aa, Homo sapiens
  heavy chain complementarity determining region 3 for antibody 12106
TKDVSYYNSGSYVEPRDH

SEQ ID NO: 24213 - protein, 9 aa, Homo sapiens
  light chain complementarity determining region 3 for antibody 12107
QQRSNWPLT

SEQ ID NO: 24214 - protein, 20 aa, Homo sapiens
  heavy chain complementarity determining region 3 for antibody 12107
TRERRERLAFGALYYYGMDV

SEQ ID NO: 24215 - protein, 11 aa, Homo sapiens
  light chain complementarity determining region 3 for antibody 12108
QQRDNWPPLYA

SEQ ID NO: 24216 - protein, 14 aa, Homo sapiens
  heavy chain complementarity determining region 3 for antibody 12108
ARGPNYKDPRLRDY

SEQ ID NO: 24217 - protein, 9 aa, Homo sapiens
  light chain complementarity determining region 3 for antibody 12109
QQAYSTPLT

SEQ ID NO: 24218 - protein, 15 aa, Homo sapiens
  heavy chain complementarity determining region 3 for antibody 12109
ARGKRNIAAAGTSDF

SEQ ID NO: 24219 - protein, 9 aa, Homo sapiens
  light chain complementarity determining region 3 for antibody 12110
QHFSSWPPA

SEQ ID NO: 24220 - protein, 13 aa, Homo sapiens
  heavy chain complementarity determining region 3 for antibody 12110
ATRWQQFGPGFDY

SEQ ID NO: 24221 - protein, 10 aa, Homo sapiens
  light chain complementarity determining region 3 for antibody 12111
MQGTHWPPLT

SEQ ID NO: 24222 - protein, 26 aa, Homo sapiens
  heavy chain complementarity determining region 3 for antibody 12111
ARELITSIATPGHEFPNYYYYYGMDV

SEQ ID NO: 24223 - protein, 9 aa, Homo sapiens
  light chain complementarity determining region 3 for antibody 12112
MQALQTPWT

SEQ ID NO: 24224 - protein, 13 aa, Homo sapiens
  heavy chain complementarity determining region 3 for antibody 12112
ATSRDSSSWYSNY

SEQ ID NO: 24225 - protein, 10 aa, Homo sapiens
  light chain complementarity determining region 3 for antibody 12113
MQALQTPPLT

SEQ ID NO: 24226 - protein, 16 aa, Homo sapiens
  heavy chain complementarity determining region 3 for antibody 12113
ARGGFGELGLHNAFDI

SEQ ID NO: 24227 - protein, 9 aa, Homo sapiens
  light chain complementarity determining region 3 for antibody 12114
MQALQTLLT

SEQ ID NO: 24228 - protein, 14 aa, Homo sapiens
  heavy chain complementarity determining region 3 for antibody 12114
ARLPGRYPRHGFDV

SEQ ID NO: 24229 - protein, 10 aa, Homo sapiens
  light chain complementarity determining region 3 for antibody 12115
HQSSNLFQIT

SEQ ID NO: 24230 - protein, 13 aa, Homo sapiens
  heavy chain complementarity determining region 3 for antibody 12115
ARRTPTKTYFFDY

SEQ ID NO: 24231 - protein, 7 aa, Homo sapiens
  light chain complementarity determining region 3 for antibody 12116
TQGTHNT

SEQ ID NO: 24232 - protein, 14 aa, Homo sapiens
  heavy chain complementarity determining region 3 for antibody 12116
ARSLYGDYANWIDP

SEQ ID NO: 24233 - protein, 9 aa, Homo sapiens
  light chain complementarity determining region 3 for antibody 12117
QQYYSYPWT

SEQ ID NO: 24234 - protein, 10 aa, Homo sapiens
  heavy chain complementarity determining region 3 for antibody 12117
AKPNNVLAGY

SEQ ID NO: 24235 - protein, 9 aa, Homo sapiens
  light chain complementarity determining region 3 for antibody 12118
QQYSTFPYT

SEQ ID NO: 24236 - protein, 17 aa, Homo sapiens
  heavy chain complementarity determining region 3 for antibody 12118
AREVWNDVDLRQYYFDY

SEQ ID NO: 24237 - protein, 9 aa, Homo sapiens
  light chain complementarity determining region 3 for antibody 12119
QQYNSYSWT

SEQ ID NO: 24238 - protein, 21 aa, Homo sapiens
  heavy chain complementarity determining region 3 for antibody 12119
AREHYHDGSGYYFYHYTGMDV

SEQ ID NO: 24239 - protein, 9 aa, Homo sapiens
  light chain complementarity determining region 3 for antibody 12120
QQYGSSRYT

SEQ ID NO: 24240 - protein, 23 aa, Homo sapiens
  heavy chain complementarity determining region 3 for antibody 12120
ARVGCSGEKCSFMSGYYYYPLDV

SEQ ID NO: 24241 - protein, 10 aa, Homo sapiens
  light chain complementarity determining region 3 for antibody 12121
QQYEDLPPFT

SEQ ID NO: 24242 - protein, 9 aa, Homo sapiens
  heavy chain complementarity determining region 3 for antibody 12121
ARYFGAFEM

SEQ ID NO: 24243 - protein, 9 aa, Homo sapiens
  light chain complementarity determining region 3 for antibody 12122
QQYDSYPPT

SEQ ID NO: 24244 - protein, 26 aa, Homo sapiens
  heavy chain complementarity determining region 3 for antibody 12122
ARDEGVNIVPTGQNIPAGDTAGTFDF

SEQ ID NO: 24245 - protein, 11 aa, Homo sapiens
  light chain complementarity determining region 3 for antibody 12123
QQSYSTPPGVT

SEQ ID NO: 24246 - protein, 16 aa, Homo sapiens
  heavy chain complementarity determining region 3 for antibody 12123
ARGGFGELGLHNAFDI

SEQ ID NO: 24247 - protein, 9 aa, Homo sapiens
  light chain complementarity determining region 3 for antibody 12124
QQSYSTPLT

SEQ ID NO: 24248 - protein, 20 aa, Homo sapiens
  heavy chain complementarity determining region 3 for antibody 12124
ARATLLRYFDWPPPLVGVDV

SEQ ID NO: 24249 - protein, 11 aa, Homo sapiens
  light chain complementarity determining region 3 for antibody 12125
QQCHNWPPAIT

SEQ ID NO: 24250 - protein, 19 aa, Homo sapiens
  heavy chain complementarity determining region 3 for antibody 12125
VRSHQDFYDSRGWPIYFDS

SEQ ID NO: 24251 - protein, 9 aa, Homo sapiens
  light chain complementarity determining region 3 for antibody 12126
QQANSFPLT

SEQ ID NO: 24252 - protein, 14 aa, Homo sapiens
  heavy chain complementarity determining region 3 for antibody 12126
VKGRYYDSSGPIEY

SEQ ID NO: 24253 - protein, 9 aa, Homo sapiens
  light chain complementarity determining region 3 for antibody 12127
QNYDSSPRI

SEQ ID NO: 24254 - protein, 13 aa, Homo sapiens
  heavy chain complementarity determining region 3 for antibody 12127
TRDEDGSNTPFDY

SEQ ID NO: 24255 - protein, 9 aa, Homo sapiens
  light chain complementarity determining region 3 for antibody 12128
QHFKSAPYT

SEQ ID NO: 24256 - protein, 13 aa, Homo sapiens
  heavy chain complementarity determining region 3 for antibody 12128
ARYLGAPVKAFDI

SEQ ID NO: 24257 - protein, 9 aa, Homo sapiens
  light chain complementarity determining region 3 for antibody 12129
MQALQTSIT

SEQ ID NO: 24258 - protein, 22 aa, Homo sapiens
  heavy chain complementarity determining region 3 for antibody 12129
ARRARGAAHSSGYSYYYYGMDV

SEQ ID NO: 24259 - protein, 10 aa, Homo sapiens
  light chain complementarity determining region 3 for antibody 12130
MQALETLMYT

SEQ ID NO: 24260 - protein, 16 aa, Homo sapiens
  heavy chain complementarity determining region 3 for antibody 12130
ARGMGSVGYYYYGLDV

SEQ ID NO: 24261 - protein, 9 aa, Homo sapiens
  light chain complementarity determining region 3 for antibody 12131
HQSSSFPLT

SEQ ID NO: 24262 - protein, 15 aa, Homo sapiens
  heavy chain complementarity determining region 3 for antibody 12131
ARGGIHYDILTGLDN

SEQ ID NO: 24263 - protein, 10 aa, Homo sapiens
  light chain complementarity determining region 3 for antibody 12132
QYHGYSPLDT

SEQ ID NO: 24264 - protein, 12 aa, Homo sapiens
  heavy chain complementarity determining region 3 for antibody 12132
AKGILGRGGMDV

SEQ ID NO: 24265 - protein, 10 aa, Homo sapiens
  light chain complementarity determining region 3 for antibody 12133
QRYGGSPLFT

SEQ ID NO: 24266 - protein, 16 aa, Homo sapiens
  heavy chain complementarity determining region 3 for antibody 12133
AREVFKGEIDYYGMDV

SEQ ID NO: 24267 - protein, 9 aa, Homo sapiens
  light chain complementarity determining region 3 for antibody 12134
QQYNSYWYT

SEQ ID NO: 24268 - protein, 20 aa, Homo sapiens
  heavy chain complementarity determining region 3 for antibody 12134
AGTYGSGTYSPDYYYCGMDV

SEQ ID NO: 24269 - protein, 9 aa, Homo sapiens
  light chain complementarity determining region 3 for antibody 12135
QQYNSFSWT

SEQ ID NO: 24270 - protein, 20 aa, Homo sapiens
  heavy chain complementarity determining region 3 for antibody 12135
ARDLSTHYHDASGGENWFDP

SEQ ID NO: 24271 - protein, 10 aa, Homo sapiens
  light chain complementarity determining region 3 for antibody 12136
QQYNNWPPFT

SEQ ID NO: 24272 - protein, 9 aa, Homo sapiens
  heavy chain complementarity determining region 3 for antibody 12136
VRGYFDFEN

SEQ ID NO: 24273 - protein, 9 aa, Homo sapiens
  light chain complementarity determining region 3 for antibody 12137
QQYKSYPPT

SEQ ID NO: 24274 - protein, 17 aa, Homo sapiens
  heavy chain complementarity determining region 3 for antibody 12137
AKSIFADYDDYYYGMDV

SEQ ID NO: 24275 - protein, 9 aa, Homo sapiens
  light chain complementarity determining region 3 for antibody 12138
QQYITFPYT

SEQ ID NO: 24276 - protein, 17 aa, Homo sapiens
  heavy chain complementarity determining region 3 for antibody 12138
AREQWSDVDLRQFYFDY

SEQ ID NO: 24277 - protein, 10 aa, Homo sapiens
  light chain complementarity determining region 3 for antibody 12139
QQYGSSALGT

SEQ ID NO: 24278 - protein, 17 aa, Homo sapiens
  heavy chain complementarity determining region 3 for antibody 12139
ARDDVSPANLIGRGLHP

SEQ ID NO: 24279 - protein, 9 aa, Homo sapiens
  light chain complementarity determining region 3 for antibody 12140
QQTYSPPWT

SEQ ID NO: 24280 - protein, 16 aa, Homo sapiens
  heavy chain complementarity determining region 3 for antibody 12140
SREAGSDYGGYAPSDY

SEQ ID NO: 24281 - protein, 9 aa, Homo sapiens
  light chain complementarity determining region 3 for antibody 12141
QQSYSTSFT

SEQ ID NO: 24282 - protein, 19 aa, Homo sapiens
  heavy chain complementarity determining region 3 for antibody 12141
VLSKQPSGAYSVYYYGMDV

SEQ ID NO: 24283 - protein, 10 aa, Homo sapiens
  light chain complementarity determining region 3 for antibody 12142
QQRSNWPPLT

SEQ ID NO: 24284 - protein, 13 aa, Homo sapiens
  heavy chain complementarity determining region 3 for antibody 12142
ARSRSGYYSFFDY

SEQ ID NO: 24285 - protein, 8 aa, Homo sapiens
  light chain complementarity determining region 3 for antibody 12143
QQRSNWPA

SEQ ID NO: 24286 - protein, 16 aa, Homo sapiens
  heavy chain complementarity determining region 3 for antibody 12143
ARGGFGELGLHNAFDV

SEQ ID NO: 24287 - protein, 9 aa, Homo sapiens
  light chain complementarity determining region 3 for antibody 12144
QQFHSYPLT

SEQ ID NO: 24288 - protein, 16 aa, Homo sapiens
  heavy chain complementarity determining region 3 for antibody 12144
ARTQGTRDYYYYAMDV

SEQ ID NO: 24289 - protein, 9 aa, Homo sapiens
  light chain complementarity determining region 3 for antibody 12145
QKYYSDSWT

SEQ ID NO: 24290 - protein, 13 aa, Homo sapiens
  heavy chain complementarity determining region 3 for antibody 12145
AKDKGDSEGGMDV

SEQ ID NO: 24291 - protein, 9 aa, Homo sapiens
  light chain complementarity determining region 3 for antibody 12146
MQHVEFPST

SEQ ID NO: 24292 - protein, 17 aa, Homo sapiens
  heavy chain complementarity determining region 3 for antibody 12146
ARDEYHGDRRSYSGMDV

SEQ ID NO: 24293 - protein, 8 aa, Homo sapiens
  light chain complementarity determining region 3 for antibody 12147
MQALQTWT

SEQ ID NO: 24294 - protein, 20 aa, Homo sapiens
  heavy chain complementarity determining region 3 for antibody 12147
AKDSPYYRSGINHYYYALDV

SEQ ID NO: 24295 - protein, 9 aa, Homo sapiens
  light chain complementarity determining region 3 for antibody 12148
MQALQTSIT

SEQ ID NO: 24296 - protein, 15 aa, Homo sapiens
  heavy chain complementarity determining region 3 for antibody 12148
ARSDTGTDYGVYFDH

SEQ ID NO: 24297 - protein, 9 aa, Homo sapiens
  light chain complementarity determining region 3 for antibody 12149
MQALQTPRT

SEQ ID NO: 24298 - protein, 19 aa, Homo sapiens
  heavy chain complementarity determining region 3 for antibody 12149
ARVLVRGVIIRDYYYGMDV

SEQ ID NO: 24299 - protein, 10 aa, Homo sapiens
  light chain complementarity determining region 3 for antibody 12150
MQALQTPAYT

SEQ ID NO: 24300 - protein, 17 aa, Homo sapiens
  heavy chain complementarity determining region 3 for antibody 12150
TRSIVSGSGWNAGGFDC

SEQ ID NO: 24301 - protein, 10 aa, Homo sapiens
  light chain complementarity determining region 3 for antibody 12151
QYHGSSPLYT

SEQ ID NO: 24302 - protein, 12 aa, Homo sapiens
  heavy chain complementarity determining region 3 for antibody 12151
AKGILGRGGMDV

SEQ ID NO: 24303 - protein, 9 aa, Homo sapiens
  light chain complementarity determining region 3 for antibody 12152
QQYYSTPWT

SEQ ID NO: 24304 - protein, 16 aa, Homo sapiens
  heavy chain complementarity determining region 3 for antibody 12152
IRQGECSVGGCPFPDY

SEQ ID NO: 24305 - protein, 8 aa, Homo sapiens
  light chain complementarity determining region 3 for antibody 12153
QQYYSTLL

SEQ ID NO: 24306 - protein, 22 aa, Homo sapiens
  heavy chain complementarity determining region 3 for antibody 12153
VHRSTVTNWPERHYYYNYGMEV

SEQ ID NO: 24307 - protein, 8 aa, Homo sapiens
  light chain complementarity determining region 3 for antibody 12154
QQYNTYST

SEQ ID NO: 24308 - protein, 13 aa, Homo sapiens
  heavy chain complementarity determining region 3 for antibody 12154
ARGNLNTAMVVDF

SEQ ID NO: 24309 - protein, 8 aa, Homo sapiens
  light chain complementarity determining region 3 for antibody 12155
QQYKTYCS

SEQ ID NO: 24310 - protein, 16 aa, Homo sapiens
  heavy chain complementarity determining region 3 for antibody 12155
ASPLTGDNYYYYGLDV

SEQ ID NO: 24311 - protein, 9 aa, Homo sapiens
  light chain complementarity determining region 3 for antibody 12156
QQYHDLPLT

SEQ ID NO: 24312 - protein, 14 aa, Homo sapiens
  heavy chain complementarity determining region 3 for antibody 12156
QRVWGNDADDAFDI

SEQ ID NO: 24313 - protein, 9 aa, Homo sapiens
  light chain complementarity determining region 3 for antibody 12157
QQYGYSPGT

SEQ ID NO: 24314 - protein, 19 aa, Homo sapiens
  heavy chain complementarity determining region 3 for antibody 12157
ARAVWGRNFWSGYIPYFDS

SEQ ID NO: 24315 - protein, 10 aa, Homo sapiens
  light chain complementarity determining region 3 for antibody 12158
QQYGSSPLYS

SEQ ID NO: 24316 - protein, 21 aa, Homo sapiens
  heavy chain complementarity determining region 3 for antibody 12158
ARAGYYDGTGYYYYSFYGMDI

SEQ ID NO: 24317 - protein, 9 aa, Homo sapiens
  light chain complementarity determining region 3 for antibody 12159
QQSYSTSIT

SEQ ID NO: 24318 - protein, 16 aa, Homo sapiens
  heavy chain complementarity determining region 3 for antibody 12159
ARENAVAGTPLYGMDV

SEQ ID NO: 24319 - protein, 9 aa, Homo sapiens
  light chain complementarity determining region 3 for antibody 12160
QQSYSTLRT

SEQ ID NO: 24320 - protein, 16 aa, Homo sapiens
  heavy chain complementarity determining region 3 for antibody 12160
AKCRSQWLQIGGAFDY

SEQ ID NO: 24321 - protein, 9 aa, Homo sapiens
  light chain complementarity determining region 3 for antibody 12161
QQSYSMPWT

SEQ ID NO: 24322 - protein, 14 aa, Homo sapiens
  heavy chain complementarity determining region 3 for antibody 12161
ATGNEAGWGHWFDP

SEQ ID NO: 24323 - protein, 9 aa, Homo sapiens
  light chain complementarity determining region 3 for antibody 12162
QQSYRFPRT

SEQ ID NO: 24324 - protein, 11 aa, Homo sapiens
  heavy chain complementarity determining region 3 for antibody 12162
TIDGGGSSWPE

SEQ ID NO: 24325 - protein, 10 aa, Homo sapiens
  light chain complementarity determining region 3 for antibody 12163
QQRSNWPPYT

SEQ ID NO: 24326 - protein, 21 aa, Homo sapiens
  heavy chain complementarity determining region 3 for antibody 12163
VRVYDTSVYNRDEYHYHPVDV

SEQ ID NO: 24327 - protein, 9 aa, Homo sapiens
  light chain complementarity determining region 3 for antibody 12164
QQRGGGPLT

SEQ ID NO: 24328 - protein, 16 aa, Homo sapiens
  heavy chain complementarity determining region 3 for antibody 12164
AAGVKAYRRAVRYFDY

SEQ ID NO: 24329 - protein, 9 aa, Homo sapiens
  light chain complementarity determining region 3 for antibody 12165
QQLHSYPIT

SEQ ID NO: 24330 - protein, 16 aa, Homo sapiens
  heavy chain complementarity determining region 3 for antibody 12165
ARTQGTRDYYYYAMDV

SEQ ID NO: 24331 - protein, 9 aa, Homo sapiens
  light chain complementarity determining region 3 for antibody 12166
QQFATTPYT

SEQ ID NO: 24332 - protein, 13 aa, Homo sapiens
  heavy chain complementarity determining region 3 for antibody 12166
ARAANGDHEYFDF

SEQ ID NO: 24333 - protein, 9 aa, Homo sapiens
  light chain complementarity determining region 3 for antibody 12167
QKYDTAPFT

SEQ ID NO: 24334 - protein, 10 aa, Homo sapiens
  heavy chain complementarity determining region 3 for antibody 12167
VREGNWNLDY

SEQ ID NO: 24335 - protein, 10 aa, Homo sapiens
  light chain complementarity determining region 3 for antibody 12168
MQVLQTPLFG

SEQ ID NO: 24336 - protein, 11 aa, Homo sapiens
  heavy chain complementarity determining region 3 for antibody 12168
AAGEYSDAFGM

SEQ ID NO: 24337 - protein, 9 aa, Homo sapiens
  light chain complementarity determining region 3 for antibody 12169
MQATQWPPT

SEQ ID NO: 24338 - protein, 15 aa, Homo sapiens
  heavy chain complementarity determining region 3 for antibody 12169
ARAAVPYYYNYGVDV

SEQ ID NO: 24339 - protein, 10 aa, Homo sapiens
  light chain complementarity determining region 3 for antibody 12170
MQALQTPPIT

SEQ ID NO: 24340 - protein, 14 aa, Homo sapiens
  heavy chain complementarity determining region 3 for antibody 12170
ARGGPYQLPSYLDY

SEQ ID NO: 24341 - protein, 9 aa, Homo sapiens
  light chain complementarity determining region 3 for antibody 12171
LQHNSYPWT

SEQ ID NO: 24342 - protein, 12 aa, Homo sapiens
  heavy chain complementarity determining region 3 for antibody 12171
ASLHPLVNWFDP

SEQ ID NO: 24343 - protein, 9 aa, Homo sapiens
  light chain complementarity determining region 3 for antibody 12172
LQESTYPLT

SEQ ID NO: 24344 - protein, 19 aa, Homo sapiens
  heavy chain complementarity determining region 3 for antibody 12172
AREEGYYSGSGSFLPESDS

SEQ ID NO: 24345 - protein, 9 aa, Homo sapiens
  light chain complementarity determining region 3 for antibody 12173
HQSSTLPPT

SEQ ID NO: 24346 - protein, 16 aa, Homo sapiens
  heavy chain complementarity determining region 3 for antibody 12173
ARHGPTMFRGVSFFDP

SEQ ID NO: 24347 - protein, 9 aa, Homo sapiens
  light chain complementarity determining region 3 for antibody 12174
HQRSNWRDT

SEQ ID NO: 24348 - protein, 15 aa, Homo sapiens
  heavy chain complementarity determining region 3 for antibody 12174
ARGRGGTISRYYFDS

SEQ ID NO: 24349 - protein, 10 aa, Homo sapiens
  light chain complementarity determining region 3 for antibody 12175
QYHGYSPLYT

SEQ ID NO: 24350 - protein, 12 aa, Homo sapiens
  heavy chain complementarity determining region 3 for antibody 12175
AKGSLGRGGMDV

SEQ ID NO: 24351 - protein, 10 aa, Homo sapiens
  light chain complementarity determining region 3 for antibody 12176
QYHGHSPLYT

SEQ ID NO: 24352 - protein, 12 aa, Homo sapiens
  heavy chain complementarity determining region 3 for antibody 12176
AKGILGRGGMDV

SEQ ID NO: 24353 - protein, 9 aa, Homo sapiens
  light chain complementarity determining region 3 for antibody 12177
QQYYSSPIT

SEQ ID NO: 24354 - protein, 24 aa, Homo sapiens
  heavy chain complementarity determining region 3 for antibody 12177
ARDEGCSGGRCSSHVFHYYYGMDV

SEQ ID NO: 24355 - protein, 9 aa, Homo sapiens
  light chain complementarity determining region 3 for antibody 12178
QQYYNLPIS

SEQ ID NO: 24356 - protein, 14 aa, Homo sapiens
  heavy chain complementarity determining region 3 for antibody 12178
ARAEAAAGPTFFDV

SEQ ID NO: 24357 - protein, 9 aa, Homo sapiens
  light chain complementarity determining region 3 for antibody 12179
QQYYGSPLT

SEQ ID NO: 24358 - protein, 15 aa, Homo sapiens
  heavy chain complementarity determining region 3 for antibody 12179
ATSLTYGGDSFLCDS

SEQ ID NO: 24359 - protein, 10 aa, Homo sapiens
  light chain complementarity determining region 3 for antibody 12180
QQYVSSLMYT

SEQ ID NO: 24360 - protein, 16 aa, Homo sapiens
  heavy chain complementarity determining region 3 for antibody 12180
VRDRKILLRRFDVFDI

SEQ ID NO: 24361 - protein, 10 aa, Homo sapiens
  light chain complementarity determining region 3 for antibody 12181
QQYVSSELLT

SEQ ID NO: 24362 - protein, 16 aa, Homo sapiens
  heavy chain complementarity determining region 3 for antibody 12181
AREIFKGEIDYYAMDV

SEQ ID NO: 24363 - protein, 9 aa, Homo sapiens
  light chain complementarity determining region 3 for antibody 12182
QQYNDFPYT

SEQ ID NO: 24364 - protein, 13 aa, Homo sapiens
  heavy chain complementarity determining region 3 for antibody 12182
ARDRLIAEAGMDS

SEQ ID NO: 24365 - protein, 10 aa, Homo sapiens
  light chain complementarity determining region 3 for antibody 12183
QQYGSSPKWT

SEQ ID NO: 24366 - protein, 23 aa, Homo sapiens
  heavy chain complementarity determining region 3 for antibody 12183
ASPLGHYCTSTNCLIGGYYGMDV

SEQ ID NO: 24367 - protein, 10 aa, Homo sapiens
  light chain complementarity determining region 3 for antibody 12184
QQYGRSPPIT

SEQ ID NO: 24368 - protein, 10 aa, Homo sapiens
  heavy chain complementarity determining region 3 for antibody 12184
AREARNWFDP

SEQ ID NO: 24369 - protein, 9 aa, Homo sapiens
  light chain complementarity determining region 3 for antibody 12185
QQYDNLPLT

SEQ ID NO: 24370 - protein, 23 aa, Homo sapiens
  heavy chain complementarity determining region 3 for antibody 12185
ATGRGEGIVAAGRGRYHYYAMDV

SEQ ID NO: 24371 - protein, 9 aa, Homo sapiens
  light chain complementarity determining region 3 for antibody 12186
QQYDNFPLT

SEQ ID NO: 24372 - protein, 13 aa, Homo sapiens
  heavy chain complementarity determining region 3 for antibody 12186
TTDLRGTDGRGNW

SEQ ID NO: 24373 - protein, 10 aa, Homo sapiens
  light chain complementarity determining region 3 for antibody 12187
QQSYSTYLFT

SEQ ID NO: 24374 - protein, 14 aa, Homo sapiens
  heavy chain complementarity determining region 3 for antibody 12187
ARMAYGGSDYWFDP

SEQ ID NO: 24375 - protein, 8 aa, Homo sapiens
  light chain complementarity determining region 3 for antibody 12188
QQSYSTQT

SEQ ID NO: 24376 - protein, 16 aa, Homo sapiens
  heavy chain complementarity determining region 3 for antibody 12188
ARGGFGELGLHNAFDI

SEQ ID NO: 24377 - protein, 9 aa, Homo sapiens
  light chain complementarity determining region 3 for antibody 12189
QQSYSTLYT

SEQ ID NO: 24378 - protein, 16 aa, Homo sapiens
  heavy chain complementarity determining region 3 for antibody 12189
VKDMDSGTYSWHSFDY

SEQ ID NO: 24379 - protein, 9 aa, Homo sapiens
  light chain complementarity determining region 3 for antibody 12190
QQSYSHPET

SEQ ID NO: 24380 - protein, 15 aa, Homo sapiens
  heavy chain complementarity determining region 3 for antibody 12190
ARDRGTSWSSTGMDV

SEQ ID NO: 24381 - protein, 13 aa, Homo sapiens
  light chain complementarity determining region 3 for antibody 12191
QQSYITSGRSGYT

SEQ ID NO: 24382 - protein, 17 aa, Homo sapiens
  heavy chain complementarity determining region 3 for antibody 12191
AREPFDIMTGTRAYFDY

SEQ ID NO: 24383 - protein, 9 aa, Homo sapiens
  light chain complementarity determining region 3 for antibody 12192
QQRSNWPLT

SEQ ID NO: 24384 - protein, 14 aa, Homo sapiens
  heavy chain complementarity determining region 3 for antibody 12192
TNSRDGSGWYDFDS

SEQ ID NO: 24385 - protein, 9 aa, Homo sapiens
  light chain complementarity determining region 3 for antibody 12193
QQRSNWPFT

SEQ ID NO: 24386 - protein, 16 aa, Homo sapiens
  heavy chain complementarity determining region 3 for antibody 12193
ARDEGKGSGGYGDFDY

SEQ ID NO: 24387 - protein, 9 aa, Homo sapiens
  light chain complementarity determining region 3 for antibody 12194
QQHATSPLT

SEQ ID NO: 24388 - protein, 10 aa, Homo sapiens
  heavy chain complementarity determining region 3 for antibody 12194
AGGTGWHIDH

SEQ ID NO: 24389 - protein, 9 aa, Homo sapiens
  light chain complementarity determining region 3 for antibody 12195
QQFNNYPIT

SEQ ID NO: 24390 - protein, 14 aa, Homo sapiens
  heavy chain complementarity determining region 3 for antibody 12195
AKEKGGGGAAGLDD

SEQ ID NO: 24391 - protein, 9 aa, Homo sapiens
  light chain complementarity determining region 3 for antibody 12196
QHYNNWLYT

SEQ ID NO: 24392 - protein, 13 aa, Homo sapiens
  heavy chain complementarity determining region 3 for antibody 12196
AYSPSTTVTPLDY

SEQ ID NO: 24393 - protein, 9 aa, Homo sapiens
  light chain complementarity determining region 3 for antibody 12197
QHNYRPSPA

SEQ ID NO: 24394 - protein, 11 aa, Homo sapiens
  heavy chain complementarity determining region 3 for antibody 12197
TRGPPGNGMDV

SEQ ID NO: 24395 - protein, 8 aa, Homo sapiens
  light chain complementarity determining region 3 for antibody 12198
MQGTHLWG

SEQ ID NO: 24396 - protein, 13 aa, Homo sapiens
  heavy chain complementarity determining region 3 for antibody 12198
AKTTVTDQYYFDY

SEQ ID NO: 24397 - protein, 10 aa, Homo sapiens
  light chain complementarity determining region 3 for antibody 12199
MQATHWPLLT

SEQ ID NO: 24398 - protein, 10 aa, Homo sapiens
  heavy chain complementarity determining region 3 for antibody 12199
ARESNWGPDY

SEQ ID NO: 24399 - protein, 9 aa, Homo sapiens
  light chain complementarity determining region 3 for antibody 12200
MQALQTPRT

SEQ ID NO: 24400 - protein, 12 aa, Homo sapiens
  heavy chain complementarity determining region 3 for antibody 12200
ASWYYYGSGSCP

SEQ ID NO: 24401 - protein, 9 aa, Homo sapiens
  light chain complementarity determining region 3 for antibody 12201
MQALQTPLA

SEQ ID NO: 24402 - protein, 15 aa, Homo sapiens
  heavy chain complementarity determining region 3 for antibody 12201
ARLTQLWPDYYGMDV

SEQ ID NO: 24403 - protein, 8 aa, Homo sapiens
  light chain complementarity determining region 3 for antibody 12202
MQALQRIT

SEQ ID NO: 24404 - protein, 10 aa, Homo sapiens
  heavy chain complementarity determining region 3 for antibody 12202
ATSGNSGFGY

SEQ ID NO: 24405 - protein, 8 aa, Homo sapiens
  light chain complementarity determining region 3 for antibody 12203
MQALQPRT

SEQ ID NO: 24406 - protein, 16 aa, Homo sapiens
  heavy chain complementarity determining region 3 for antibody 12203
ARGGFGELGLHNAFDI

SEQ ID NO: 24407 - protein, 9 aa, Homo sapiens
  light chain complementarity determining region 3 for antibody 12204
MQALQAPLT

SEQ ID NO: 24408 - protein, 23 aa, Homo sapiens
  heavy chain complementarity determining region 3 for antibody 12204
ATAAGSRTMVRGGISGWAWGVDV

SEQ ID NO: 24409 - protein, 8 aa, Homo sapiens
  light chain complementarity determining region 3 for antibody 12205
HQYDTSPT

SEQ ID NO: 24410 - protein, 17 aa, Homo sapiens
  heavy chain complementarity determining region 3 for antibody 12205
ARDGSYGDRMYYYGMGV

SEQ ID NO: 24411 - protein, 9 aa, Homo sapiens
  light chain complementarity determining region 3 for antibody 12206
QQYYSPALT

SEQ ID NO: 24412 - protein, 11 aa, Homo sapiens
  heavy chain complementarity determining region 3 for antibody 12206
ARGLAVGGRVY

SEQ ID NO: 24413 - protein, 9 aa, Homo sapiens
  light chain complementarity determining region 3 for antibody 12207
QQYSTFPYT

SEQ ID NO: 24414 - protein, 17 aa, Homo sapiens
  heavy chain complementarity determining region 3 for antibody 12207
AREQYNDVDLRQFFFDY

SEQ ID NO: 24415 - protein, 9 aa, Homo sapiens
  light chain complementarity determining region 3 for antibody 12208
QQYSSFPYT

SEQ ID NO: 24416 - protein, 17 aa, Homo sapiens
  heavy chain complementarity determining region 3 for antibody 12208
AREDYSDVDLRQFYFDY

SEQ ID NO: 24417 - protein, 9 aa, Homo sapiens
  light chain complementarity determining region 3 for antibody 12209
QQYNSYSWT

SEQ ID NO: 24418 - protein, 13 aa, Homo sapiens
  heavy chain complementarity determining region 3 for antibody 12209
ATSLFRGGWALDH

SEQ ID NO: 24419 - protein, 9 aa, Homo sapiens
  light chain complementarity determining region 3 for antibody 12210
QQYNSYSPT

SEQ ID NO: 24420 - protein, 24 aa, Homo sapiens
  heavy chain complementarity determining region 3 for antibody 12210
ARARGRREYYYAGNADYVPYYFDF

SEQ ID NO: 24421 - protein, 9 aa, Homo sapiens
  light chain complementarity determining region 3 for antibody 12211
QQYNNYPWT

SEQ ID NO: 24422 - protein, 12 aa, Homo sapiens
  heavy chain complementarity determining region 3 for antibody 12211
ARDGDSYGYLDY

SEQ ID NO: 24423 - protein, 9 aa, Homo sapiens
  light chain complementarity determining region 3 for antibody 12212
QQYGTLPFT

SEQ ID NO: 24424 - protein, 13 aa, Homo sapiens
  heavy chain complementarity determining region 3 for antibody 12212
AKSAYSPNWYFDV

SEQ ID NO: 24425 - protein, 8 aa, Homo sapiens
  light chain complementarity determining region 3 for antibody 12213
QQYGRSPT

SEQ ID NO: 24426 - protein, 20 aa, Homo sapiens
  heavy chain complementarity determining region 3 for antibody 12213
ARSRGKTVFGVVAAIYYFDF

SEQ ID NO: 24427 - protein, 9 aa, Homo sapiens
  light chain complementarity determining region 3 for antibody 12214
QQYGGSPWT

SEQ ID NO: 24428 - protein, 13 aa, Homo sapiens
  heavy chain complementarity determining region 3 for antibody 12214
AKGAVFGMPPFDS

SEQ ID NO: 24429 - protein, 9 aa, Homo sapiens
  light chain complementarity determining region 3 for antibody 12215
QQYDSYPPT

SEQ ID NO: 24430 - protein, 18 aa, Homo sapiens
  heavy chain complementarity determining region 3 for antibody 12215
ARPINEYSASSSVWYFDL

SEQ ID NO: 24431 - protein, 8 aa, Homo sapiens
  light chain complementarity determining region 3 for antibody 12216
QQTYTIPL

SEQ ID NO: 24432 - protein, 16 aa, Homo sapiens
  heavy chain complementarity determining region 3 for antibody 12216
TTDSLVITAPSGAFDI

SEQ ID NO: 24433 - protein, 9 aa, Homo sapiens
  light chain complementarity determining region 3 for antibody 12217
QQSYSTPYT

SEQ ID NO: 24434 - protein, 8 aa, Homo sapiens
  heavy chain complementarity determining region 3 for antibody 12217
AKSHPPDH

SEQ ID NO: 24435 - protein, 12 aa, Homo sapiens
  light chain complementarity determining region 3 for antibody 12218
QQRSNWPPYMYT

SEQ ID NO: 24436 - protein, 12 aa, Homo sapiens
  heavy chain complementarity determining region 3 for antibody 12218
AREATMVAHFDS

SEQ ID NO: 24437 - protein, 9 aa, Homo sapiens
  light chain complementarity determining region 3 for antibody 12219
QQRSNWPLT

SEQ ID NO: 24438 - protein, 18 aa, Homo sapiens
  heavy chain complementarity determining region 3 for antibody 12219
ARDHRESGSWDGGLYFDY

SEQ ID NO: 24439 - protein, 9 aa, Homo sapiens
  light chain complementarity determining region 3 for antibody 12220
QQRSGWPPP

SEQ ID NO: 24440 - protein, 16 aa, Homo sapiens
  heavy chain complementarity determining region 3 for antibody 12220
ARVFYGSGPNANWFDP

SEQ ID NO: 24441 - protein, 9 aa, Homo sapiens
  light chain complementarity determining region 3 for antibody 12221
QQIYSTPPT

SEQ ID NO: 24442 - protein, 18 aa, Homo sapiens
  heavy chain complementarity determining region 3 for antibody 12221
ARDNWGYCSGGSCYSFDY

SEQ ID NO: 24443 - protein, 9 aa, Homo sapiens
  light chain complementarity determining region 3 for antibody 12222
PQYSTFPYT

SEQ ID NO: 24444 - protein, 17 aa, Homo sapiens
  heavy chain complementarity determining region 3 for antibody 12222
AREDWNDVDLRQFYFDY

SEQ ID NO: 24445 - protein, 9 aa, Homo sapiens
  light chain complementarity determining region 3 for antibody 12223
MQGTHWPPT

SEQ ID NO: 24446 - protein, 15 aa, Homo sapiens
  heavy chain complementarity determining region 3 for antibody 12223
ARGRRGFQEGMTMDV

SEQ ID NO: 24447 - protein, 9 aa, Homo sapiens
  light chain complementarity determining region 3 for antibody 12224
MQGLQTPLT

SEQ ID NO: 24448 - protein, 19 aa, Homo sapiens
  heavy chain complementarity determining region 3 for antibody 12224
VRHDRYCSGGKCFSVWLDP

SEQ ID NO: 24449 - protein, 8 aa, Homo sapiens
  light chain complementarity determining region 3 for antibody 12225
MQALQTPT

SEQ ID NO: 24450 - protein, 10 aa, Homo sapiens
  heavy chain complementarity determining region 3 for antibody 12225
ARRLGGYDAC

SEQ ID NO: 24451 - protein, 9 aa, Homo sapiens
  light chain complementarity determining region 3 for antibody 12226
MQALQTPRT

SEQ ID NO: 24452 - protein, 23 aa, Homo sapiens
  heavy chain complementarity determining region 3 for antibody 12226
ARGGYSAEDLSPDIPVTYYGVDV

SEQ ID NO: 24453 - protein, 8 aa, Homo sapiens
  light chain complementarity determining region 3 for antibody 12227
MQALQTLT

SEQ ID NO: 24454 - protein, 26 aa, Homo sapiens
  heavy chain complementarity determining region 3 for antibody 12227
ARGLPPLYDYVWRSYRWDLSYYGLDV

SEQ ID NO: 24455 - protein, 9 aa, Homo sapiens
  light chain complementarity determining region 3 for antibody 12228
LQTYSTPIT

SEQ ID NO: 24456 - protein, 16 aa, Homo sapiens
  heavy chain complementarity determining region 3 for antibody 12228
AKLMSGSGWSRGWLDP

SEQ ID NO: 24457 - protein, 9 aa, Homo sapiens
  light chain complementarity determining region 3 for antibody 12229
LQHDNFPLT

SEQ ID NO: 24458 - protein, 14 aa, Homo sapiens
  heavy chain complementarity determining region 3 for antibody 12229
AHSRPDKNTGYFDY

SEQ ID NO: 24459 - protein, 9 aa, Homo sapiens
  light chain complementarity determining region 3 for antibody 12230
LQDYTYPFS

SEQ ID NO: 24460 - protein, 16 aa, Homo sapiens
  heavy chain complementarity determining region 3 for antibody 12230
VTDVGDHRDSYTTLDY

SEQ ID NO: 24461 - protein, 7 aa, Homo sapiens
  light chain complementarity determining region 3 for antibody 12231
QRTYIAP

SEQ ID NO: 24462 - protein, 23 aa, Homo sapiens
  heavy chain complementarity determining region 3 for antibody 12231
TKGPYCSGGSCDRDAYYYYGMDV

SEQ ID NO: 24463 - protein, 9 aa, Homo sapiens
  light chain complementarity determining region 3 for antibody 12232
QQYYSTPLS

SEQ ID NO: 24464 - protein, 16 aa, Homo sapiens
  heavy chain complementarity determining region 3 for antibody 12232
ARVGGFSGSRADAFDI

SEQ ID NO: 24465 - protein, 9 aa, Homo sapiens
  light chain complementarity determining region 3 for antibody 12233
QQYYNTPHT

SEQ ID NO: 24466 - protein, 15 aa, Homo sapiens
  heavy chain complementarity determining region 3 for antibody 12233
AGQRESGEVWNWFDS

SEQ ID NO: 24467 - protein, 9 aa, Homo sapiens
  light chain complementarity determining region 3 for antibody 12234
QQYNSYPYT

SEQ ID NO: 24468 - protein, 19 aa, Homo sapiens
  heavy chain complementarity determining region 3 for antibody 12234
ARDQSSSYGDYYYYYRMDV

SEQ ID NO: 24469 - protein, 9 aa, Homo sapiens
  light chain complementarity determining region 3 for antibody 12235
QQYNSRPYT

SEQ ID NO: 24470 - protein, 15 aa, Homo sapiens
  heavy chain complementarity determining region 3 for antibody 12235
ATPDPYGSGWNYFDW

SEQ ID NO: 24471 - protein, 8 aa, Homo sapiens
  light chain complementarity determining region 3 for antibody 12236
QQYNKWLT

SEQ ID NO: 24472 - protein, 15 aa, Homo sapiens
  heavy chain complementarity determining region 3 for antibody 12236
ARHSVTTIVRGPMGY

SEQ ID NO: 24473 - protein, 11 aa, Homo sapiens
  light chain complementarity determining region 3 for antibody 12237
QQYGTSPRIFT

SEQ ID NO: 24474 - protein, 14 aa, Homo sapiens
  heavy chain complementarity determining region 3 for antibody 12237
ARVGFIYGSPTFDS

SEQ ID NO: 24475 - protein, 9 aa, Homo sapiens
  light chain complementarity determining region 3 for antibody 12238
QQYGSSPLT

SEQ ID NO: 24476 - protein, 12 aa, Homo sapiens
  heavy chain complementarity determining region 3 for antibody 12238
AAWYSSWSAFDY

SEQ ID NO: 24477 - protein, 9 aa, Homo sapiens
  light chain complementarity determining region 3 for antibody 12239
QQYENLPLT

SEQ ID NO: 24478 - protein, 18 aa, Homo sapiens
  heavy chain complementarity determining region 3 for antibody 12239
AREVVGLGSRSSLGTLGH

SEQ ID NO: 24479 - protein, 9 aa, Homo sapiens
  light chain complementarity determining region 3 for antibody 12240
QQYATLPLT

SEQ ID NO: 24480 - protein, 19 aa, Homo sapiens
  heavy chain complementarity determining region 3 for antibody 12240
ARARVLRFFDLLQDRWFDS

SEQ ID NO: 24481 - protein, 8 aa, Homo sapiens
  light chain complementarity determining region 3 for antibody 12241
QQSYSIPP

SEQ ID NO: 24482 - protein, 10 aa, Homo sapiens
  heavy chain complementarity determining region 3 for antibody 12241
ARAFQSRYGY

SEQ ID NO: 24483 - protein, 9 aa, Homo sapiens
  light chain complementarity determining region 3 for antibody 12242
QQHDNYPYT

SEQ ID NO: 24484 - protein, 13 aa, Homo sapiens
  heavy chain complementarity determining region 3 for antibody 12242
AKCPYQNWRGFDP

SEQ ID NO: 24485 - protein, 9 aa, Homo sapiens
  light chain complementarity determining region 3 for antibody 12243
QQAYRFPLR

SEQ ID NO: 24486 - protein, 13 aa, Homo sapiens
  heavy chain complementarity determining region 3 for antibody 12243
TRTYGSGRNWFDP

SEQ ID NO: 24487 - protein, 11 aa, Homo sapiens
  light chain complementarity determining region 3 for antibody 12244
QQANSFPPQVT

SEQ ID NO: 24488 - protein, 18 aa, Homo sapiens
  heavy chain complementarity determining region 3 for antibody 12244
ARGRSCSSNRCPTVWFDP

SEQ ID NO: 24489 - protein, 8 aa, Homo sapiens
  light chain complementarity determining region 3 for antibody 12245
MQTLQGPT

SEQ ID NO: 24490 - protein, 20 aa, Homo sapiens
  heavy chain complementarity determining region 3 for antibody 12245
ARNAGYNYGYGYAYYFGLDM

SEQ ID NO: 24491 - protein, 9 aa, Homo sapiens
  light chain complementarity determining region 3 for antibody 12246
MQALQTPRT

SEQ ID NO: 24492 - protein, 27 aa, Homo sapiens
  heavy chain complementarity determining region 3 for antibody 12246
ARDGEWGNTLLLGSGVRPHYYYYGMDV

SEQ ID NO: 24493 - protein, 10 aa, Homo sapiens
  light chain complementarity determining region 3 for antibody 12247
MQALQTLSLT

SEQ ID NO: 24494 - protein, 17 aa, Homo sapiens
  heavy chain complementarity determining region 3 for antibody 12247
ARGPNGYDEHYYYGMDV

SEQ ID NO: 24495 - protein, 9 aa, Homo sapiens
  light chain complementarity determining region 3 for antibody 12248
HQYSIVPHT

SEQ ID NO: 24496 - protein, 18 aa, Homo sapiens
  heavy chain complementarity determining region 3 for antibody 12248
ARPRDCSSSSCFYDPFDY

SEQ ID NO: 24497 - protein, 9 aa, Homo sapiens
  light chain complementarity determining region 3 for antibody 12249
HQSYSAPDT

SEQ ID NO: 24498 - protein, 26 aa, Homo sapiens
  heavy chain complementarity determining region 3 for antibody 12249
ARDPRGLPCETTSCPEPSHYYYGMDV

SEQ ID NO: 24499 - protein, 9 aa, Homo sapiens
  light chain complementarity determining region 3 for antibody 12250
QQYYSTPPT

SEQ ID NO: 24500 - protein, 16 aa, Homo sapiens
  heavy chain complementarity determining region 3 for antibody 12250
AHNYYDILTGSILFDY

SEQ ID NO: 24501 - protein, 9 aa, Homo sapiens
  light chain complementarity determining region 3 for antibody 12251
QQYSTFPLT

SEQ ID NO: 24502 - protein, 14 aa, Homo sapiens
  heavy chain complementarity determining region 3 for antibody 12251
GKDSRYNRLGVFDV

SEQ ID NO: 24503 - protein, 9 aa, Homo sapiens
  light chain complementarity determining region 3 for antibody 12252
QQYNSYPLT

SEQ ID NO: 24504 - protein, 17 aa, Homo sapiens
  heavy chain complementarity determining region 3 for antibody 12252
ARDGSFGDRIYYYGMGV

SEQ ID NO: 24505 - protein, 9 aa, Homo sapiens
  light chain complementarity determining region 3 for antibody 12253
QQYNSFPPT

SEQ ID NO: 24506 - protein, 19 aa, Homo sapiens
  heavy chain complementarity determining region 3 for antibody 12253
AKDPHPVVIGELLEPLFDY

SEQ ID NO: 24507 - protein, 10 aa, Homo sapiens
  light chain complementarity determining region 3 for antibody 12254
QQYNNWPPIT

SEQ ID NO: 24508 - protein, 13 aa, Homo sapiens
  heavy chain complementarity determining region 3 for antibody 12254
ARTYRSFLNWFDP

SEQ ID NO: 24509 - protein, 9 aa, Homo sapiens
  light chain complementarity determining region 3 for antibody 12255
QQYGYSPGT

SEQ ID NO: 24510 - protein, 16 aa, Homo sapiens
  heavy chain complementarity determining region 3 for antibody 12255
ARRGENHYHIPYYYDY

SEQ ID NO: 24511 - protein, 9 aa, Homo sapiens
  light chain complementarity determining region 3 for antibody 12256
QQYGSSPYT

SEQ ID NO: 24512 - protein, 20 aa, Homo sapiens
  heavy chain complementarity determining region 3 for antibody 12256
ARAGAYSDNYPYYQYLGMDV

SEQ ID NO: 24513 - protein, 9 aa, Homo sapiens
  light chain complementarity determining region 3 for antibody 12257
QQYGSSPPT

SEQ ID NO: 24514 - protein, 23 aa, Homo sapiens
  heavy chain complementarity determining region 3 for antibody 12257
ARTDYYDSSGYYPPFYHYYGMDV

SEQ ID NO: 24515 - protein, 10 aa, Homo sapiens
  light chain complementarity determining region 3 for antibody 12258
QQYGSSPHLT

SEQ ID NO: 24516 - protein, 20 aa, Homo sapiens
  heavy chain complementarity determining region 3 for antibody 12258
ARDSEYSSFGVVSSYYGMDV

SEQ ID NO: 24517 - protein, 9 aa, Homo sapiens
  light chain complementarity determining region 3 for antibody 12259
QQYEDLPLT

SEQ ID NO: 24518 - protein, 21 aa, Homo sapiens
  heavy chain complementarity determining region 3 for antibody 12259
TTDLPNDNNWDKYIPADTFDV

SEQ ID NO: 24519 - protein, 8 aa, Homo sapiens
  light chain complementarity determining region 3 for antibody 12260
QQYDDSPT

SEQ ID NO: 24520 - protein, 15 aa, Homo sapiens
  heavy chain complementarity determining region 3 for antibody 12260
ARGGVTTVTRGTYDF

SEQ ID NO: 24521 - protein, 9 aa, Homo sapiens
  light chain complementarity determining region 3 for antibody 12261
QQSYSTPYT

SEQ ID NO: 24522 - protein, 14 aa, Homo sapiens
  heavy chain complementarity determining region 3 for antibody 12261
ARTTVTTDSDAFDI

SEQ ID NO: 24523 - protein, 9 aa, Homo sapiens
  light chain complementarity determining region 3 for antibody 12262
QQSYSTPRT

SEQ ID NO: 24524 - protein, 21 aa, Homo sapiens
  heavy chain complementarity determining region 3 for antibody 12262
TTDQRQLSSGESFTGNNWFDP

SEQ ID NO: 24525 - protein, 10 aa, Homo sapiens
  light chain complementarity determining region 3 for antibody 12263
QQSYSTPLLT

SEQ ID NO: 24526 - protein, 15 aa, Homo sapiens
  heavy chain complementarity determining region 3 for antibody 12263
AVWGSMTEWLGPFDY

SEQ ID NO: 24527 - protein, 8 aa, Homo sapiens
  light chain complementarity determining region 3 for antibody 12264
QQLSSYPA

SEQ ID NO: 24528 - protein, 23 aa, Homo sapiens
  heavy chain complementarity determining region 3 for antibody 12264
SHISVTSRDVPLDTHYYYYGMDV

SEQ ID NO: 24529 - protein, 10 aa, Homo sapiens
  light chain complementarity determining region 3 for antibody 12265
QQLNSYPRFT

SEQ ID NO: 24530 - protein, 16 aa, Homo sapiens
  heavy chain complementarity determining region 3 for antibody 12265
AREGTPGAPYYYGMDV

SEQ ID NO: 24531 - protein, 9 aa, Homo sapiens
  light chain complementarity determining region 3 for antibody 12266
QQFHSYPIT

SEQ ID NO: 24532 - protein, 16 aa, Homo sapiens
  heavy chain complementarity determining region 3 for antibody 12266
ARTQGARDYYYYAMDV

SEQ ID NO: 24533 - protein, 9 aa, Homo sapiens
  light chain complementarity determining region 3 for antibody 12267
QQASGFRIT

SEQ ID NO: 24534 - protein, 16 aa, Homo sapiens
  heavy chain complementarity determining region 3 for antibody 12267
ARDADPSGWFSYGLDV

SEQ ID NO: 24535 - protein, 9 aa, Homo sapiens
  light chain complementarity determining region 3 for antibody 12268
QQANSLPLT

SEQ ID NO: 24536 - protein, 19 aa, Homo sapiens
  heavy chain complementarity determining region 3 for antibody 12268
ARGLGYCTTSACRADAFDI

SEQ ID NO: 24537 - protein, 9 aa, Homo sapiens
  light chain complementarity determining region 3 for antibody 12269
QHYGTSPYT

SEQ ID NO: 24538 - protein, 23 aa, Homo sapiens
  heavy chain complementarity determining region 3 for antibody 12269
VRRISGYHDNEPVQRAVQGWFDP

SEQ ID NO: 24539 - protein, 10 aa, Homo sapiens
  light chain complementarity determining region 3 for antibody 12270
QHLSIYHALT

SEQ ID NO: 24540 - protein, 17 aa, Homo sapiens
  heavy chain complementarity determining region 3 for antibody 12270
AKDLRAGAKDYYYGMDV

SEQ ID NO: 24541 - protein, 10 aa, Homo sapiens
  light chain complementarity determining region 3 for antibody 12271
MQGTHWPPGT

SEQ ID NO: 24542 - protein, 15 aa, Homo sapiens
  heavy chain complementarity determining region 3 for antibody 12271
AHRARDSGGYYSFDY

SEQ ID NO: 24543 - protein, 8 aa, Homo sapiens
  light chain complementarity determining region 3 for antibody 12272
MQALQTPT

SEQ ID NO: 24544 - protein, 20 aa, Homo sapiens
  heavy chain complementarity determining region 3 for antibody 12272
ARGVTYNAYWSGQHIESFDV

SEQ ID NO: 24545 - protein, 9 aa, Homo sapiens
  light chain complementarity determining region 3 for antibody 12273
LQDYKYPRP

SEQ ID NO: 24546 - protein, 18 aa, Homo sapiens
  heavy chain complementarity determining region 3 for antibody 12273
ARDTSPGDSSAWYDAFDI

SEQ ID NO: 24547 - protein, 10 aa, Homo sapiens
  light chain complementarity determining region 3 for antibody 12274
QYPGYSPLYT

SEQ ID NO: 24548 - protein, 12 aa, Homo sapiens
  heavy chain complementarity determining region 3 for antibody 12274
AKGILGRGGMDV

SEQ ID NO: 24549 - protein, 10 aa, Homo sapiens
  light chain complementarity determining region 3 for antibody 12275
QYHGYSPLNT

SEQ ID NO: 24550 - protein, 12 aa, Homo sapiens
  heavy chain complementarity determining region 3 for antibody 12275
AKGILGRGGMDV

SEQ ID NO: 24551 - protein, 9 aa, Homo sapiens
  light chain complementarity determining region 3 for antibody 12276
QRGNSYPYT

SEQ ID NO: 24552 - protein, 9 aa, Homo sapiens
  heavy chain complementarity determining region 3 for antibody 12276
VAYLAGYPR

SEQ ID NO: 24553 - protein, 9 aa, Homo sapiens
  light chain complementarity determining region 3 for antibody 12277
QQYYSYPRT

SEQ ID NO: 24554 - protein, 19 aa, Homo sapiens
  heavy chain complementarity determining region 3 for antibody 12277
ARAKREQLVDSYSFHGLDV

SEQ ID NO: 24555 - protein, 9 aa, Homo sapiens
  light chain complementarity determining region 3 for antibody 12278
QQYYSTPQT

SEQ ID NO: 24556 - protein, 12 aa, Homo sapiens
  heavy chain complementarity determining region 3 for antibody 12278
ARDMSGYDYYDK

SEQ ID NO: 24557 - protein, 9 aa, Homo sapiens
  light chain complementarity determining region 3 for antibody 12279
QQYSSYPLT

SEQ ID NO: 24558 - protein, 15 aa, Homo sapiens
  heavy chain complementarity determining region 3 for antibody 12279
ARGGIYYDILTGLDN

SEQ ID NO: 24559 - protein, 12 aa, Homo sapiens
  light chain complementarity determining region 3 for antibody 12280
QQYSKWPPEGYT

SEQ ID NO: 24560 - protein, 21 aa, Homo sapiens
  heavy chain complementarity determining region 3 for antibody 12280
ARDQSDFTIVDVPSYFYGLDV

SEQ ID NO: 24561 - protein, 9 aa, Homo sapiens
  light chain complementarity determining region 3 for antibody 12281
QQYNNWLYT

SEQ ID NO: 24562 - protein, 10 aa, Homo sapiens
  heavy chain complementarity determining region 3 for antibody 12281
ATGYYDYVWI

SEQ ID NO: 24563 - protein, 9 aa, Homo sapiens
  light chain complementarity determining region 3 for antibody 12282
QQYLRYPIT

SEQ ID NO: 24564 - protein, 12 aa, Homo sapiens
  heavy chain complementarity determining region 3 for antibody 12282
ARSIIENTCFNY

SEQ ID NO: 24565 - protein, 10 aa, Homo sapiens
  light chain complementarity determining region 3 for antibody 12283
QQYGSSRPLT

SEQ ID NO: 24566 - protein, 12 aa, Homo sapiens
  heavy chain complementarity determining region 3 for antibody 12283
ARKDWGPDIFDI

SEQ ID NO: 24567 - protein, 11 aa, Homo sapiens
  light chain complementarity determining region 3 for antibody 12284
QQYGSSPRMYT

SEQ ID NO: 24568 - protein, 14 aa, Homo sapiens
  heavy chain complementarity determining region 3 for antibody 12284
ANRRVVGITTFGDV

SEQ ID NO: 24569 - protein, 10 aa, Homo sapiens
  light chain complementarity determining region 3 for antibody 12285
QQYGSSLTWT

SEQ ID NO: 24570 - protein, 16 aa, Homo sapiens
  heavy chain complementarity determining region 3 for antibody 12285
ARRLYYLDIRGYPFDY

SEQ ID NO: 24571 - protein, 8 aa, Homo sapiens
  light chain complementarity determining region 3 for antibody 12286
QQYGSSHT

SEQ ID NO: 24572 - protein, 19 aa, Homo sapiens
  heavy chain complementarity determining region 3 for antibody 12286
ARQSGDTMVRGVISDVFDI

SEQ ID NO: 24573 - protein, 9 aa, Homo sapiens
  light chain complementarity determining region 3 for antibody 12287
QQYDSYPLT

SEQ ID NO: 24574 - protein, 19 aa, Homo sapiens
  heavy chain complementarity determining region 3 for antibody 12287
ARDHSPTTMEPGGEGLFDY

SEQ ID NO: 24575 - protein, 9 aa, Homo sapiens
  light chain complementarity determining region 3 for antibody 12288
QQTYRVPFT

SEQ ID NO: 24576 - protein, 17 aa, Homo sapiens
  heavy chain complementarity determining region 3 for antibody 12288
AREGHDRGIVGGTNLDY

SEQ ID NO: 24577 - protein, 9 aa, Homo sapiens
  light chain complementarity determining region 3 for antibody 12289
QQSHSTPRT

SEQ ID NO: 24578 - protein, 17 aa, Homo sapiens
  heavy chain complementarity determining region 3 for antibody 12289
VKDYYRDYMAQYNWFDS

SEQ ID NO: 24579 - protein, 9 aa, Homo sapiens
  light chain complementarity determining region 3 for antibody 12290
QQLKSYPPL

SEQ ID NO: 24580 - protein, 17 aa, Homo sapiens
  heavy chain complementarity determining region 3 for antibody 12290
ARAQHTAMVMALGGMDV

SEQ ID NO: 24581 - protein, 9 aa, Homo sapiens
  light chain complementarity determining region 3 for antibody 12291
QQFNSYPNT

SEQ ID NO: 24582 - protein, 11 aa, Homo sapiens
  heavy chain complementarity determining region 3 for antibody 12291
ASDYGDYSLSF

SEQ ID NO: 24583 - protein, 9 aa, Homo sapiens
  light chain complementarity determining region 3 for antibody 12292
QQCGNSPFT

SEQ ID NO: 24584 - protein, 20 aa, Homo sapiens
  heavy chain complementarity determining region 3 for antibody 12292
AHSINLPSCSAGSCYSYFDF

SEQ ID NO: 24585 - protein, 8 aa, Homo sapiens
  light chain complementarity determining region 3 for antibody 12293
QQANSPFT

SEQ ID NO: 24586 - protein, 18 aa, Homo sapiens
  heavy chain complementarity determining region 3 for antibody 12293
ARVRGYSGYDRPLNWFDP

SEQ ID NO: 24587 - protein, 10 aa, Homo sapiens
  light chain complementarity determining region 3 for antibody 12294
QHRSNWPPLT

SEQ ID NO: 24588 - protein, 15 aa, Homo sapiens
  heavy chain complementarity determining region 3 for antibody 12294
ARDGVTYSGNKPLDY

SEQ ID NO: 24589 - protein, 7 aa, Homo sapiens
  light chain complementarity determining region 3 for antibody 12295
QELNYFT

SEQ ID NO: 24590 - protein, 18 aa, Homo sapiens
  heavy chain complementarity determining region 3 for antibody 12295
ARGTQIFVGLALHHFLDH

SEQ ID NO: 24591 - protein, 8 aa, Homo sapiens
  light chain complementarity determining region 3 for antibody 12296
MQSLQSRT

SEQ ID NO: 24592 - protein, 29 aa, Homo sapiens
  heavy chain complementarity determining region 3 for antibody 12296
VRGAPPLYDHMWRSYRPTSTYSAYDGLDV

SEQ ID NO: 24593 - protein, 9 aa, Homo sapiens
  light chain complementarity determining region 3 for antibody 12297
MQALQTPRT

SEQ ID NO: 24594 - protein, 23 aa, Homo sapiens
  heavy chain complementarity determining region 3 for antibody 12297
ARGGYSAKDLSPDIPVTYYGVDV

SEQ ID NO: 24595 - protein, 9 aa, Homo sapiens
  light chain complementarity determining region 3 for antibody 12298
MQALQTPRT

SEQ ID NO: 24596 - protein, 18 aa, Homo sapiens
  heavy chain complementarity determining region 3 for antibody 12298
ARDPPLHNCTNDFCFGGY

SEQ ID NO: 24597 - protein, 8 aa, Homo sapiens
  light chain complementarity determining region 3 for antibody 12299
MQALQRWT

SEQ ID NO: 24598 - protein, 17 aa, Homo sapiens
  heavy chain complementarity determining region 3 for antibody 12299
ARDSGEIEGPTSVPFVY

SEQ ID NO: 24599 - protein, 9 aa, Homo sapiens
  light chain complementarity determining region 3 for antibody 12300
HQYSVSRGP

SEQ ID NO: 24600 - protein, 21 aa, Homo sapiens
  heavy chain complementarity determining region 3 for antibody 12300
ARDRGGDFHGDSSYYNRPFDY

SEQ ID NO: 24601 - protein, 9 aa, Homo sapiens
  light chain complementarity determining region 3 for antibody 12301
QQYYTTPLT

SEQ ID NO: 24602 - protein, 19 aa, Homo sapiens
  heavy chain complementarity determining region 3 for antibody 12301
ARDRLFYSDTTGYSGLFDS

SEQ ID NO: 24603 - protein, 10 aa, Homo sapiens
  light chain complementarity determining region 3 for antibody 12302
QQYSHWPLRT

SEQ ID NO: 24604 - protein, 13 aa, Homo sapiens
  heavy chain complementarity determining region 3 for antibody 12302
AVFSGPADPPVGY

SEQ ID NO: 24605 - protein, 8 aa, Homo sapiens
  light chain complementarity determining region 3 for antibody 12303
QQYNSYSA

SEQ ID NO: 24606 - protein, 15 aa, Homo sapiens
  heavy chain complementarity determining region 3 for antibody 12303
ARAYSSGWYPESSDF

SEQ ID NO: 24607 - protein, 9 aa, Homo sapiens
  light chain complementarity determining region 3 for antibody 12304
QQYNSFPWT

SEQ ID NO: 24608 - protein, 17 aa, Homo sapiens
  heavy chain complementarity determining region 3 for antibody 12304
ARRSGLYYFDAHDYYDF

SEQ ID NO: 24609 - protein, 9 aa, Homo sapiens
  light chain complementarity determining region 3 for antibody 12305
QQYNNWPYT

SEQ ID NO: 24610 - protein, 16 aa, Homo sapiens
  heavy chain complementarity determining region 3 for antibody 12305
AKDGGAYQNYGLYFQH

SEQ ID NO: 24611 - protein, 9 aa, Homo sapiens
  light chain complementarity determining region 3 for antibody 12306
QQYNNWPPT

SEQ ID NO: 24612 - protein, 15 aa, Homo sapiens
  heavy chain complementarity determining region 3 for antibody 12306
AKDREYRSSWSPFDH

SEQ ID NO: 24613 - protein, 9 aa, Homo sapiens
  light chain complementarity determining region 3 for antibody 12307
QQYGTTPYT

SEQ ID NO: 24614 - protein, 11 aa, Homo sapiens
  heavy chain complementarity determining region 3 for antibody 12307
ARGSSDWWGDY

SEQ ID NO: 24615 - protein, 9 aa, Homo sapiens
  light chain complementarity determining region 3 for antibody 12308
QQYGSSPQT

SEQ ID NO: 24616 - protein, 17 aa, Homo sapiens
  heavy chain complementarity determining region 3 for antibody 12308
ASSPGRKKYYYYYGMDV

SEQ ID NO: 24617 - protein, 9 aa, Homo sapiens
  light chain complementarity determining region 3 for antibody 12309
QQYGRSPQT

SEQ ID NO: 24618 - protein, 20 aa, Homo sapiens
  heavy chain complementarity determining region 3 for antibody 12309
AREGVVTGRGPYYDYFGMDV

SEQ ID NO: 24619 - protein, 9 aa, Homo sapiens
  light chain complementarity determining region 3 for antibody 12310
QQYGRSLYT

SEQ ID NO: 24620 - protein, 16 aa, Homo sapiens
  heavy chain complementarity determining region 3 for antibody 12310
AHRRFGGEWFPNAFDI

SEQ ID NO: 24621 - protein, 9 aa, Homo sapiens
  light chain complementarity determining region 3 for antibody 12311
QQYGGSPYT

SEQ ID NO: 24622 - protein, 10 aa, Homo sapiens
  heavy chain complementarity determining region 3 for antibody 12311
VRGSGAPGKS

SEQ ID NO: 24623 - protein, 10 aa, Homo sapiens
  light chain complementarity determining region 3 for antibody 12312
QQYDNLLTWT

SEQ ID NO: 24624 - protein, 16 aa, Homo sapiens
  heavy chain complementarity determining region 3 for antibody 12312
AKDWHQLVNIGYYFDS

SEQ ID NO: 24625 - protein, 10 aa, Homo sapiens
  light chain complementarity determining region 3 for antibody 12313
QQYDNHPRFT

SEQ ID NO: 24626 - protein, 12 aa, Homo sapiens
  heavy chain complementarity determining region 3 for antibody 12313
TRSRGALGLHDY

SEQ ID NO: 24627 - protein, 9 aa, Homo sapiens
  light chain complementarity determining region 3 for antibody 12314
QQSYSTPFT

SEQ ID NO: 24628 - protein, 15 aa, Homo sapiens
  heavy chain complementarity determining region 3 for antibody 12314
AKGGDTAMLDWYFDL

SEQ ID NO: 24629 - protein, 8 aa, Homo sapiens
  light chain complementarity determining region 3 for antibody 12315
QQRSNWPT

SEQ ID NO: 24630 - protein, 17 aa, Homo sapiens
  heavy chain complementarity determining region 3 for antibody 12315
AKEREGPYHDSGGYSDY

SEQ ID NO: 24631 - protein, 10 aa, Homo sapiens
  light chain complementarity determining region 3 for antibody 12316
QQRSNWPLST

SEQ ID NO: 24632 - protein, 24 aa, Homo sapiens
  heavy chain complementarity determining region 3 for antibody 12316
GKDHRVGFGDPMGVGFYYYYAMDV

SEQ ID NO: 24633 - protein, 9 aa, Homo sapiens
  light chain complementarity determining region 3 for antibody 12317
QQRINWPLT

SEQ ID NO: 24634 - protein, 14 aa, Homo sapiens
  heavy chain complementarity determining region 3 for antibody 12317
ARGGSATPVGWFDL

SEQ ID NO: 24635 - protein, 9 aa, Homo sapiens
  light chain complementarity determining region 3 for antibody 12318
QQLNSYPLT

SEQ ID NO: 24636 - protein, 21 aa, Homo sapiens
  heavy chain complementarity determining region 3 for antibody 12318
ARGSRAFTYDNYYVPMGTFDI

SEQ ID NO: 24637 - protein, 9 aa, Homo sapiens
  light chain complementarity determining region 3 for antibody 12319
QQFDNLPFT

SEQ ID NO: 24638 - protein, 24 aa, Homo sapiens
  heavy chain complementarity determining region 3 for antibody 12319
ARTPGARISMIRGKKMVLGRRFDP

SEQ ID NO: 24639 - protein, 9 aa, Homo sapiens
  light chain complementarity determining region 3 for antibody 12320
QQAYRFPLS

SEQ ID NO: 24640 - protein, 13 aa, Homo sapiens
  heavy chain complementarity determining region 3 for antibody 12320
TRTYGSGRNWLDP

SEQ ID NO: 24641 - protein, 9 aa, Homo sapiens
  light chain complementarity determining region 3 for antibody 12321
QQASKWPLT

SEQ ID NO: 24642 - protein, 17 aa, Homo sapiens
  heavy chain complementarity determining region 3 for antibody 12321
ARYCSSDSCYTNGGVDV

SEQ ID NO: 24643 - protein, 10 aa, Homo sapiens
  light chain complementarity determining region 3 for antibody 12322
QKYGRSPMYT

SEQ ID NO: 24644 - protein, 22 aa, Homo sapiens
  heavy chain complementarity determining region 3 for antibody 12322
ARGPSINGPYDSGSRISMWGDV

SEQ ID NO: 24645 - protein, 9 aa, Homo sapiens
  light chain complementarity determining region 3 for antibody 12323
QHYNSPSLS

SEQ ID NO: 24646 - protein, 20 aa, Homo sapiens
  heavy chain complementarity determining region 3 for antibody 12323
ARSTYYDYVWGSYRSLYFDF

SEQ ID NO: 24647 - protein, 9 aa, Homo sapiens
  light chain complementarity determining region 3 for antibody 12324
QGDNNAPWT

SEQ ID NO: 24648 - protein, 15 aa, Homo sapiens
  heavy chain complementarity determining region 3 for antibody 12324
GRHRYSSSQGYGMDV

SEQ ID NO: 24649 - protein, 8 aa, Homo sapiens
  light chain complementarity determining region 3 for antibody 12325
MQDLETPT

SEQ ID NO: 24650 - protein, 22 aa, Homo sapiens
  heavy chain complementarity determining region 3 for antibody 12325
ARGGVYKYGVGDSYYYYYGMDV

SEQ ID NO: 24651 - protein, 9 aa, Homo sapiens
  light chain complementarity determining region 3 for antibody 12326
MQALQAPLT

SEQ ID NO: 24652 - protein, 18 aa, Homo sapiens
  heavy chain complementarity determining region 3 for antibody 12326
ARFTNKPNYSSAYYGLDV

SEQ ID NO: 24653 - protein, 9 aa, Homo sapiens
  light chain complementarity determining region 3 for antibody 12327
LQDYNYPRT

SEQ ID NO: 24654 - protein, 19 aa, Homo sapiens
  heavy chain complementarity determining region 3 for antibody 12327
TRRRLVQKTWGYYYYGMEV

SEQ ID NO: 24655 - protein, 9 aa, Homo sapiens
  light chain complementarity determining region 3 for antibody 12328
HQYYDSPPT

SEQ ID NO: 24656 - protein, 19 aa, Homo sapiens
  heavy chain complementarity determining region 3 for antibody 12328
ARQSRGYYERSGYSKPPDS

SEQ ID NO: 24657 - protein, 8 aa, Homo sapiens
  light chain complementarity determining region 3 for antibody 12329
HQAYSFRP

SEQ ID NO: 24658 - protein, 22 aa, Homo sapiens
  heavy chain complementarity determining region 3 for antibody 12329
ARHSGYSNTWYMNYYYYYGMDV

SEQ ID NO: 24659 - protein, 9 aa, Homo sapiens
  light chain complementarity determining region 3 for antibody 12330
HHYATSPLT

SEQ ID NO: 24660 - protein, 10 aa, Homo sapiens
  heavy chain complementarity determining region 3 for antibody 12330
GYSNGWLVHY

SEQ ID NO: 24661 - protein, 9 aa, Homo sapiens
  light chain complementarity determining region 3 for antibody 12331
QQYYSVPFT

SEQ ID NO: 24662 - protein, 14 aa, Homo sapiens
  heavy chain complementarity determining region 3 for antibody 12331
AHSPSYRSGPPFDY

SEQ ID NO: 24663 - protein, 9 aa, Homo sapiens
  light chain complementarity determining region 3 for antibody 12332
QQYNSFPIT

SEQ ID NO: 24664 - protein, 19 aa, Homo sapiens
  heavy chain complementarity determining region 3 for antibody 12332
ARDRDYTIVDDYGSGVFDY

SEQ ID NO: 24665 - protein, 9 aa, Homo sapiens
  light chain complementarity determining region 3 for antibody 12333
QQYNNYPYS

SEQ ID NO: 24666 - protein, 26 aa, Homo sapiens
  heavy chain complementarity determining region 3 for antibody 12333
ARDEGVNIVPTGQNIPAGDTAGTFDF

SEQ ID NO: 24667 - protein, 9 aa, Homo sapiens
  light chain complementarity determining region 3 for antibody 12334
QQYNNWPLT

SEQ ID NO: 24668 - protein, 20 aa, Homo sapiens
  heavy chain complementarity determining region 3 for antibody 12334
ARRGDFLGHCSGGSCLWLDA

SEQ ID NO: 24669 - protein, 9 aa, Homo sapiens
  light chain complementarity determining region 3 for antibody 12335
QQYIHYPWT

SEQ ID NO: 24670 - protein, 24 aa, Homo sapiens
  heavy chain complementarity determining region 3 for antibody 12335
AREPHGRWFGEFDEVRNYYYGMDV

SEQ ID NO: 24671 - protein, 9 aa, Homo sapiens
  light chain complementarity determining region 3 for antibody 12336
QQYHSTPYT

SEQ ID NO: 24672 - protein, 20 aa, Homo sapiens
  heavy chain complementarity determining region 3 for antibody 12336
VRLPHYASGTSGTTYGWFDP

SEQ ID NO: 24673 - protein, 8 aa, Homo sapiens
  light chain complementarity determining region 3 for antibody 12337
QQYGTSQT

SEQ ID NO: 24674 - protein, 15 aa, Homo sapiens
  heavy chain complementarity determining region 3 for antibody 12337
AKGVVPAAMKGYFQH

SEQ ID NO: 24675 - protein, 9 aa, Homo sapiens
  light chain complementarity determining region 3 for antibody 12338
QQYGNSVLT

SEQ ID NO: 24676 - protein, 19 aa, Homo sapiens
  heavy chain complementarity determining region 3 for antibody 12338
ARSTDYVSGSYSVGYFFDY

SEQ ID NO: 24677 - protein, 9 aa, Homo sapiens
  light chain complementarity determining region 3 for antibody 12339
QQYDNWQRT

SEQ ID NO: 24678 - protein, 14 aa, Homo sapiens
  heavy chain complementarity determining region 3 for antibody 12339
ARGFRVSSFSAFDT

SEQ ID NO: 24679 - protein, 9 aa, Homo sapiens
  light chain complementarity determining region 3 for antibody 12340
QQYDAFPYT

SEQ ID NO: 24680 - protein, 17 aa, Homo sapiens
  heavy chain complementarity determining region 3 for antibody 12340
AREDYSDVDLRAFYFDS

SEQ ID NO: 24681 - protein, 9 aa, Homo sapiens
  light chain complementarity determining region 3 for antibody 12341
QQSYSTPYT

SEQ ID NO: 24682 - protein, 15 aa, Homo sapiens
  heavy chain complementarity determining region 3 for antibody 12341
ARGGAVRPRYYGMDV

SEQ ID NO: 24683 - protein, 9 aa, Homo sapiens
  light chain complementarity determining region 3 for antibody 12342
QQSYSTPRT

SEQ ID NO: 24684 - protein, 19 aa, Homo sapiens
  heavy chain complementarity determining region 3 for antibody 12342
ARDYPLTYCNGDCYSGFDC

SEQ ID NO: 24685 - protein, 9 aa, Homo sapiens
  light chain complementarity determining region 3 for antibody 12343
QQRSNGPRT

SEQ ID NO: 24686 - protein, 17 aa, Homo sapiens
  heavy chain complementarity determining region 3 for antibody 12343
AREGVGDTPMTWGTFDY

SEQ ID NO: 24687 - protein, 10 aa, Homo sapiens
  light chain complementarity determining region 3 for antibody 12344
QQIYSSPPLT

SEQ ID NO: 24688 - protein, 17 aa, Homo sapiens
  heavy chain complementarity determining region 3 for antibody 12344
ARVHFYGSKTYSYWFDP

SEQ ID NO: 24689 - protein, 10 aa, Homo sapiens
  light chain complementarity determining region 3 for antibody 12345
QQHYNWPPDT

SEQ ID NO: 24690 - protein, 11 aa, Homo sapiens
  heavy chain complementarity determining region 3 for antibody 12345
ARWFRGSNYDY

SEQ ID NO: 24691 - protein, 9 aa, Homo sapiens
  light chain complementarity determining region 3 for antibody 12346
QQFNNYPQT

SEQ ID NO: 24692 - protein, 11 aa, Homo sapiens
  heavy chain complementarity determining region 3 for antibody 12346
AREATRGYSHN

SEQ ID NO: 24693 - protein, 9 aa, Homo sapiens
  light chain complementarity determining region 3 for antibody 12347
QQFAALPIT

SEQ ID NO: 24694 - protein, 22 aa, Homo sapiens
  heavy chain complementarity determining region 3 for antibody 12347
AQPLFHPVQIGARVSRLHGMDV

SEQ ID NO: 24695 - protein, 9 aa, Homo sapiens
  light chain complementarity determining region 3 for antibody 12348
QQAYRFPLG

SEQ ID NO: 24696 - protein, 13 aa, Homo sapiens
  heavy chain complementarity determining region 3 for antibody 12348
TRTYGSGRNWFDP

SEQ ID NO: 24697 - protein, 9 aa, Homo sapiens
  light chain complementarity determining region 3 for antibody 12349
QHRSSWLYT

SEQ ID NO: 24698 - protein, 16 aa, Homo sapiens
  heavy chain complementarity determining region 3 for antibody 12349
VTHLVVYDSGEGYVDY

SEQ ID NO: 24699 - protein, 9 aa, Homo sapiens
  light chain complementarity determining region 3 for antibody 12350
MQGTHWPYT

SEQ ID NO: 24700 - protein, 19 aa, Homo sapiens
  heavy chain complementarity determining region 3 for antibody 12350
ARDPWGSDSSGYYYGAFDI

SEQ ID NO: 24701 - protein, 7 aa, Homo sapiens
  light chain complementarity determining region 3 for antibody 12351
MQGTHWD

SEQ ID NO: 24702 - protein, 15 aa, Homo sapiens
  heavy chain complementarity determining region 3 for antibody 12351
ARRPFGESAPDAFDI

SEQ ID NO: 24703 - protein, 9 aa, Homo sapiens
  light chain complementarity determining region 3 for antibody 12352
MQALQTPYT

SEQ ID NO: 24704 - protein, 21 aa, Homo sapiens
  heavy chain complementarity determining region 3 for antibody 12352
AREKYYDSSGHRNYYYYGLDV

SEQ ID NO: 24705 - protein, 9 aa, Homo sapiens
  light chain complementarity determining region 3 for antibody 12353
LRDYTFPPT

SEQ ID NO: 24706 - protein, 14 aa, Homo sapiens
  heavy chain complementarity determining region 3 for antibody 12353
AKGLVEKTTGRVDS

SEQ ID NO: 24707 - protein, 9 aa, Homo sapiens
  light chain complementarity determining region 3 for antibody 12354
HQYATSPLT

SEQ ID NO: 24708 - protein, 10 aa, Homo sapiens
  heavy chain complementarity determining region 3 for antibody 12354
MGGSGWLSDY

SEQ ID NO: 24709 - protein, 10 aa, Homo sapiens
  light chain complementarity determining region 3 for antibody 12355
HQSSSFPRLT

SEQ ID NO: 24710 - protein, 18 aa, Homo sapiens
  heavy chain complementarity determining region 3 for antibody 12355
ARDVGYDSNAHYHWYFDL

SEQ ID NO: 24711 - protein, 10 aa, Homo sapiens
  light chain complementarity determining region 3 for antibody 12356
QQYSSSPPLT

SEQ ID NO: 24712 - protein, 13 aa, Homo sapiens
  heavy chain complementarity determining region 3 for antibody 12356
ARSAGYYPNWLES

SEQ ID NO: 24713 - protein, 9 aa, Homo sapiens
  light chain complementarity determining region 3 for antibody 12357
QQYSSIPRT

SEQ ID NO: 24714 - protein, 16 aa, Homo sapiens
  heavy chain complementarity determining region 3 for antibody 12357
TRSPRSDYRDNFEYKY

SEQ ID NO: 24715 - protein, 9 aa, Homo sapiens
  light chain complementarity determining region 3 for antibody 12358
QQYNNWPYT

SEQ ID NO: 24716 - protein, 17 aa, Homo sapiens
  heavy chain complementarity determining region 3 for antibody 12358
AKERSRNSYVDYNGFDV

SEQ ID NO: 24717 - protein, 10 aa, Homo sapiens
  light chain complementarity determining region 3 for antibody 12359
QQYNNWPPLT

SEQ ID NO: 24718 - protein, 13 aa, Homo sapiens
  heavy chain complementarity determining region 3 for antibody 12359
AREYCSGGACYSF

SEQ ID NO: 24719 - protein, 9 aa, Homo sapiens
  light chain complementarity determining region 3 for antibody 12360
QQYNNLPST

SEQ ID NO: 24720 - protein, 13 aa, Homo sapiens
  heavy chain complementarity determining region 3 for antibody 12360
ARAKWDLFGYFDF

SEQ ID NO: 24721 - protein, 9 aa, Homo sapiens
  light chain complementarity determining region 3 for antibody 12361
QQYNIYSWT

SEQ ID NO: 24722 - protein, 20 aa, Homo sapiens
  heavy chain complementarity determining region 3 for antibody 12361
ARGSGETYYDILTGYCYFDH

SEQ ID NO: 24723 - protein, 9 aa, Homo sapiens
  light chain complementarity determining region 3 for antibody 12362
QQYHSYPYT

SEQ ID NO: 24724 - protein, 17 aa, Homo sapiens
  heavy chain complementarity determining region 3 for antibody 12362
AREDWNDVDLRLFYFDY

SEQ ID NO: 24725 - protein, 9 aa, Homo sapiens
  light chain complementarity determining region 3 for antibody 12363
QQYGTSPFT

SEQ ID NO: 24726 - protein, 11 aa, Homo sapiens
  heavy chain complementarity determining region 3 for antibody 12363
ARGGSIGLAGY

SEQ ID NO: 24727 - protein, 9 aa, Homo sapiens
  light chain complementarity determining region 3 for antibody 12364
QQYFDYPPT

SEQ ID NO: 24728 - protein, 15 aa, Homo sapiens
  heavy chain complementarity determining region 3 for antibody 12364
AAREFDYADYGVFDY

SEQ ID NO: 24729 - protein, 9 aa, Homo sapiens
  light chain complementarity determining region 3 for antibody 12365
QQTESFPYT

SEQ ID NO: 24730 - protein, 14 aa, Homo sapiens
  heavy chain complementarity determining region 3 for antibody 12365
ARVNLYDNSHYLDS

SEQ ID NO: 24731 - protein, 10 aa, Homo sapiens
  light chain complementarity determining region 3 for antibody 12366
QQSYSTPPLT

SEQ ID NO: 24732 - protein, 16 aa, Homo sapiens
  heavy chain complementarity determining region 3 for antibody 12366
AKCRSQWLQIGGAFDY

SEQ ID NO: 24733 - protein, 9 aa, Homo sapiens
  light chain complementarity determining region 3 for antibody 12367
QQSYSTPLT

SEQ ID NO: 24734 - protein, 18 aa, Homo sapiens
  heavy chain complementarity determining region 3 for antibody 12367
AHLMISLGGLIGTYSFDI

SEQ ID NO: 24735 - protein, 10 aa, Homo sapiens
  light chain complementarity determining region 3 for antibody 12368
QQRSNWPSLT

SEQ ID NO: 24736 - protein, 13 aa, Homo sapiens
  heavy chain complementarity determining region 3 for antibody 12368
ARAKWDLFGYFDF

SEQ ID NO: 24737 - protein, 9 aa, Homo sapiens
  light chain complementarity determining region 3 for antibody 12369
QQRSNWPRT

SEQ ID NO: 24738 - protein, 12 aa, Homo sapiens
  heavy chain complementarity determining region 3 for antibody 12369
ATYHYGSGSFDY

SEQ ID NO: 24739 - protein, 10 aa, Homo sapiens
  light chain complementarity determining region 3 for antibody 12370
QQRSNWPLFT

SEQ ID NO: 24740 - protein, 14 aa, Homo sapiens
  heavy chain complementarity determining region 3 for antibody 12370
ARLNKMTRIRYFDS

SEQ ID NO: 24741 - protein, 10 aa, Homo sapiens
  light chain complementarity determining region 3 for antibody 12371
QQRSNWPLFT

SEQ ID NO: 24742 - protein, 11 aa, Homo sapiens
  heavy chain complementarity determining region 3 for antibody 12371
ARHTDYGGFDY

SEQ ID NO: 24743 - protein, 9 aa, Homo sapiens
  light chain complementarity determining region 3 for antibody 12372
QQRGRWPLT

SEQ ID NO: 24744 - protein, 16 aa, Homo sapiens
  heavy chain complementarity determining region 3 for antibody 12372
AAGVKAYRRSVRYFDY

SEQ ID NO: 24745 - protein, 10 aa, Homo sapiens
  light chain complementarity determining region 3 for antibody 12373
QQRGNWPPYN

SEQ ID NO: 24746 - protein, 12 aa, Homo sapiens
  heavy chain complementarity determining region 3 for antibody 12373
AISYYNSNSVDY

SEQ ID NO: 24747 - protein, 9 aa, Homo sapiens
  light chain complementarity determining region 3 for antibody 12374
QQAYRFPLS

SEQ ID NO: 24748 - protein, 13 aa, Homo sapiens
  heavy chain complementarity determining region 3 for antibody 12374
ARTYGSGRNWFDP

SEQ ID NO: 24749 - protein, 10 aa, Homo sapiens
  light chain complementarity determining region 3 for antibody 12375
QKYNSAPGGT

SEQ ID NO: 24750 - protein, 9 aa, Homo sapiens
  heavy chain complementarity determining region 3 for antibody 12375
AKGRDTFDY

SEQ ID NO: 24751 - protein, 10 aa, Homo sapiens
  light chain complementarity determining region 3 for antibody 12376
QKYDSAPPFT

SEQ ID NO: 24752 - protein, 19 aa, Homo sapiens
  heavy chain complementarity determining region 3 for antibody 12376
ARELDFDILTSYLGGLFQH

SEQ ID NO: 24753 - protein, 9 aa, Homo sapiens
  light chain complementarity determining region 3 for antibody 12377
QHYNTFPLT

SEQ ID NO: 24754 - protein, 14 aa, Homo sapiens
  heavy chain complementarity determining region 3 for antibody 12377
ARLPGRYPRYGMDV

SEQ ID NO: 24755 - protein, 9 aa, Homo sapiens
  light chain complementarity determining region 3 for antibody 12378
MQNSRRPIT

SEQ ID NO: 24756 - protein, 11 aa, Homo sapiens
  heavy chain complementarity determining region 3 for antibody 12378
AREEEYGSSYH

SEQ ID NO: 24757 - protein, 10 aa, Homo sapiens
  light chain complementarity determining region 3 for antibody 12379
MQATYWPPYT

SEQ ID NO: 24758 - protein, 14 aa, Homo sapiens
  heavy chain complementarity determining region 3 for antibody 12379
ARDHYEGVNSGPDY

SEQ ID NO: 24759 - protein, 9 aa, Homo sapiens
  light chain complementarity determining region 3 for antibody 12380
MQALQTPWT

SEQ ID NO: 24760 - protein, 13 aa, Homo sapiens
  heavy chain complementarity determining region 3 for antibody 12380
AHTSMARGVGMDV

SEQ ID NO: 24761 - protein, 9 aa, Homo sapiens
  light chain complementarity determining region 3 for antibody 12381
MQALQTPLD

SEQ ID NO: 24762 - protein, 24 aa, Homo sapiens
  heavy chain complementarity determining region 3 for antibody 12381
VRDRFPYSYFWDGGIHYYYYTMDV

SEQ ID NO: 24763 - protein, 9 aa, Homo sapiens
  light chain complementarity determining region 3 for antibody 12382
MQALQTPHT

SEQ ID NO: 24764 - protein, 19 aa, Homo sapiens
  heavy chain complementarity determining region 3 for antibody 12382
AKGLYQNYWSGYTGDGFDI

SEQ ID NO: 24765 - protein, 8 aa, Homo sapiens
  light chain complementarity determining region 3 for antibody 12383
MQALQMWT

SEQ ID NO: 24766 - protein, 15 aa, Homo sapiens
  heavy chain complementarity determining region 3 for antibody 12383
ARQRHLLSGSSWFDP

SEQ ID NO: 24767 - protein, 9 aa, Homo sapiens
  light chain complementarity determining region 3 for antibody 12384
LQYYRYPRT

SEQ ID NO: 24768 - protein, 13 aa, Homo sapiens
  heavy chain complementarity determining region 3 for antibody 12384
TRTYGSGRNWFDP

SEQ ID NO: 24769 - protein, 9 aa, Homo sapiens
  light chain complementarity determining region 3 for antibody 12385
LQYNSYPRT

SEQ ID NO: 24770 - protein, 19 aa, Homo sapiens
  heavy chain complementarity determining region 3 for antibody 12385
AKEGDSFGYGGGLRMGFGS

SEQ ID NO: 24771 - protein, 9 aa, Homo sapiens
  light chain complementarity determining region 3 for antibody 12386
LQENTYPWT

SEQ ID NO: 24772 - protein, 18 aa, Homo sapiens
  heavy chain complementarity determining region 3 for antibody 12386
VAVELLRTEYDTYYGLDI

SEQ ID NO: 24773 - protein, 9 aa, Homo sapiens
  light chain complementarity determining region 3 for antibody 12387
LQATHWPDT

SEQ ID NO: 24774 - protein, 11 aa, Homo sapiens
  heavy chain complementarity determining region 3 for antibody 12387
AKDTQWLPFDC

SEQ ID NO: 24775 - protein, 10 aa, Homo sapiens
  light chain complementarity determining region 3 for antibody 12388
HQRGDWPPYT

SEQ ID NO: 24776 - protein, 22 aa, Homo sapiens
  heavy chain complementarity determining region 3 for antibody 12388
ARDRSAGPPWVGDLLSKRYFDY

SEQ ID NO: 24777 - protein, 9 aa, Homo sapiens
  light chain complementarity determining region 3 for antibody 12389
VQGTHAGFT

SEQ ID NO: 24778 - protein, 10 aa, Homo sapiens
  heavy chain complementarity determining region 3 for antibody 12389
AKYLRRAFDV

SEQ ID NO: 24779 - protein, 10 aa, Homo sapiens
  light chain complementarity determining region 3 for antibody 12390
QYHGYSPLFT

SEQ ID NO: 24780 - protein, 12 aa, Homo sapiens
  heavy chain complementarity determining region 3 for antibody 12390
AKGILGRGGMDV

SEQ ID NO: 24781 - protein, 10 aa, Homo sapiens
  light chain complementarity determining region 3 for antibody 12391
QYHGYSHLYT

SEQ ID NO: 24782 - protein, 12 aa, Homo sapiens
  heavy chain complementarity determining region 3 for antibody 12391
AKGILGRGGMDV

SEQ ID NO: 24783 - protein, 9 aa, Homo sapiens
  light chain complementarity determining region 3 for antibody 12392
QRYNSVPRT

SEQ ID NO: 24784 - protein, 14 aa, Homo sapiens
  heavy chain complementarity determining region 3 for antibody 12392
AREGGYSGYDPLDY

SEQ ID NO: 24785 - protein, 9 aa, Homo sapiens
  light chain complementarity determining region 3 for antibody 12393
QQYYSTPWT

SEQ ID NO: 24786 - protein, 16 aa, Homo sapiens
  heavy chain complementarity determining region 3 for antibody 12393
IRQGECSVGGCPLPDY

SEQ ID NO: 24787 - protein, 9 aa, Homo sapiens
  light chain complementarity determining region 3 for antibody 12394
QQYYSTPLT

SEQ ID NO: 24788 - protein, 16 aa, Homo sapiens
  heavy chain complementarity determining region 3 for antibody 12394
ARARAPGLGGENWFDP

SEQ ID NO: 24789 - protein, 9 aa, Homo sapiens
  light chain complementarity determining region 3 for antibody 12395
QQYYGSPLT

SEQ ID NO: 24790 - protein, 14 aa, Homo sapiens
  heavy chain complementarity determining region 3 for antibody 12395
AKPTPGSGSFLIDY

SEQ ID NO: 24791 - protein, 9 aa, Homo sapiens
  light chain complementarity determining region 3 for antibody 12396
QQYNTYPET

SEQ ID NO: 24792 - protein, 17 aa, Homo sapiens
  heavy chain complementarity determining region 3 for antibody 12396
ATHMVVRGLMKLGYFDY

SEQ ID NO: 24793 - protein, 9 aa, Homo sapiens
  light chain complementarity determining region 3 for antibody 12397
QQYNSYWYT

SEQ ID NO: 24794 - protein, 20 aa, Homo sapiens
  heavy chain complementarity determining region 3 for antibody 12397
AGTYGSGTYSPDYYYVGMDV

SEQ ID NO: 24795 - protein, 9 aa, Homo sapiens
  light chain complementarity determining region 3 for antibody 12398
QQYNSYSST

SEQ ID NO: 24796 - protein, 22 aa, Homo sapiens
  heavy chain complementarity determining region 3 for antibody 12398
ARVRPGREILRYFDGTGRELDY

SEQ ID NO: 24797 - protein, 9 aa, Homo sapiens
  light chain complementarity determining region 3 for antibody 12399
QQYNNLPHT

SEQ ID NO: 24798 - protein, 13 aa, Homo sapiens
  heavy chain complementarity determining region 3 for antibody 12399
ARAKWDLFGYFDF

SEQ ID NO: 24799 - protein, 9 aa, Homo sapiens
  light chain complementarity determining region 3 for antibody 12400
QQYNKWPKT

SEQ ID NO: 24800 - protein, 23 aa, Homo sapiens
  heavy chain complementarity determining region 3 for antibody 12400
ARSNVKASVIRGVTTYILGPFDY

SEQ ID NO: 24801 - protein, 10 aa, Homo sapiens
  light chain complementarity determining region 3 for antibody 12401
QQYNDWPPGT

SEQ ID NO: 24802 - protein, 14 aa, Homo sapiens
  heavy chain complementarity determining region 3 for antibody 12401
ARASKYQPLYYFDS

SEQ ID NO: 24803 - protein, 10 aa, Homo sapiens
  light chain complementarity determining region 3 for antibody 12402
QQYKNWPPYT

SEQ ID NO: 24804 - protein, 14 aa, Homo sapiens
  heavy chain complementarity determining region 3 for antibody 12402
VRENCYGTGSCFDY

SEQ ID NO: 24805 - protein, 9 aa, Homo sapiens
  light chain complementarity determining region 3 for antibody 12403
QQYGSSSYT

SEQ ID NO: 24806 - protein, 21 aa, Homo sapiens
  heavy chain complementarity determining region 3 for antibody 12403
ARGMLPVGDANGWGRFDALDI

SEQ ID NO: 24807 - protein, 9 aa, Homo sapiens
  light chain complementarity determining region 3 for antibody 12404
QQYGSSSWT

SEQ ID NO: 24808 - protein, 14 aa, Homo sapiens
  heavy chain complementarity determining region 3 for antibody 12404
ARSGHDYGSLGIDS

SEQ ID NO: 24809 - protein, 9 aa, Homo sapiens
  light chain complementarity determining region 3 for antibody 12405
QQYGSSPRT

SEQ ID NO: 24810 - protein, 17 aa, Homo sapiens
  heavy chain complementarity determining region 3 for antibody 12405
ARGGRGWPLLSNGADRD

SEQ ID NO: 24811 - protein, 9 aa, Homo sapiens
  light chain complementarity determining region 3 for antibody 12406
QQYGSSPFT

SEQ ID NO: 24812 - protein, 17 aa, Homo sapiens
  heavy chain complementarity determining region 3 for antibody 12406
AREPDGSRYNRYNYFDP

SEQ ID NO: 24813 - protein, 10 aa, Homo sapiens
  light chain complementarity determining region 3 for antibody 12407
QQYGSSELFT

SEQ ID NO: 24814 - protein, 16 aa, Homo sapiens
  heavy chain complementarity determining region 3 for antibody 12407
AREIFKGEIDYYAMDV

SEQ ID NO: 24815 - protein, 9 aa, Homo sapiens
  light chain complementarity determining region 3 for antibody 12408
QQSYSTPTT

SEQ ID NO: 24816 - protein, 16 aa, Homo sapiens
  heavy chain complementarity determining region 3 for antibody 12408
ARSWGWQQLAQSYFDY

SEQ ID NO: 24817 - protein, 9 aa, Homo sapiens
  light chain complementarity determining region 3 for antibody 12409
QQSYSTPPT

SEQ ID NO: 24818 - protein, 18 aa, Homo sapiens
  heavy chain complementarity determining region 3 for antibody 12409
AHLMISFGGLIGTYSFDI

SEQ ID NO: 24819 - protein, 9 aa, Homo sapiens
  light chain complementarity determining region 3 for antibody 12410
QQSYSSTWT

SEQ ID NO: 24820 - protein, 23 aa, Homo sapiens
  heavy chain complementarity determining region 3 for antibody 12410
ARGVIGPYTNNWYESDYYYGMDV

SEQ ID NO: 24821 - protein, 9 aa, Homo sapiens
  light chain complementarity determining region 3 for antibody 12411
QQSYSAPRT

SEQ ID NO: 24822 - protein, 14 aa, Homo sapiens
  heavy chain complementarity determining region 3 for antibody 12411
AREDRWLAELSFDY

SEQ ID NO: 24823 - protein, 10 aa, Homo sapiens
  light chain complementarity determining region 3 for antibody 12412
QQSFSSPPGT

SEQ ID NO: 24824 - protein, 24 aa, Homo sapiens
  heavy chain complementarity determining region 3 for antibody 12412
ARARPSETYYDILTGFRGDDAFDV

SEQ ID NO: 24825 - protein, 10 aa, Homo sapiens
  light chain complementarity determining region 3 for antibody 12413
QQRTNWPPLT

SEQ ID NO: 24826 - protein, 20 aa, Homo sapiens
  heavy chain complementarity determining region 3 for antibody 12413
ARDFILYYETTDYVEDAFDL

SEQ ID NO: 24827 - protein, 8 aa, Homo sapiens
  light chain complementarity determining region 3 for antibody 12414
QQRSNWPT

SEQ ID NO: 24828 - protein, 18 aa, Homo sapiens
  heavy chain complementarity determining region 3 for antibody 12414
ARDLYFWSGHYTGSHFDY

SEQ ID NO: 24829 - protein, 11 aa, Homo sapiens
  light chain complementarity determining region 3 for antibody 12415
QQRSNWPPRIT

SEQ ID NO: 24830 - protein, 12 aa, Homo sapiens
  heavy chain complementarity determining region 3 for antibody 12415
ARGGTWRGWLDV

SEQ ID NO: 24831 - protein, 9 aa, Homo sapiens
  light chain complementarity determining region 3 for antibody 12416
QQRSNWPLT

SEQ ID NO: 24832 - protein, 22 aa, Homo sapiens
  heavy chain complementarity determining region 3 for antibody 12416
ARDRSYCSSGGWCDSATEYFQY

SEQ ID NO: 24833 - protein, 9 aa, Homo sapiens
  light chain complementarity determining region 3 for antibody 12417
QQLDSNPLT

SEQ ID NO: 24834 - protein, 31 aa, Homo sapiens
  heavy chain complementarity determining region 3 for antibody 12417
AKDLLESGGVTVGDFDGGEIQVPVFSNGMDV

SEQ ID NO: 24835 - protein, 9 aa, Homo sapiens
  light chain complementarity determining region 3 for antibody 12418
QQHYTTPHT

SEQ ID NO: 24836 - protein, 10 aa, Homo sapiens
  heavy chain complementarity determining region 3 for antibody 12418
TRWSYDSSPY

SEQ ID NO: 24837 - protein, 9 aa, Homo sapiens
  light chain complementarity determining region 3 for antibody 12419
QQGNSFPLT

SEQ ID NO: 24838 - protein, 20 aa, Homo sapiens
  heavy chain complementarity determining region 3 for antibody 12419
ARTPVLRYFDAHVPRPCFDY

SEQ ID NO: 24839 - protein, 9 aa, Homo sapiens
  light chain complementarity determining region 3 for antibody 12420
QQFNTYPLP

SEQ ID NO: 24840 - protein, 17 aa, Homo sapiens
  heavy chain complementarity determining region 3 for antibody 12420
AKDLSGVHYDIHHGLDV

SEQ ID NO: 24841 - protein, 9 aa, Homo sapiens
  light chain complementarity determining region 3 for antibody 12421
QQANTSPFT

SEQ ID NO: 24842 - protein, 19 aa, Homo sapiens
  heavy chain complementarity determining region 3 for antibody 12421
ARNDYSGDTDRYYDFGMDV

SEQ ID NO: 24843 - protein, 9 aa, Homo sapiens
  light chain complementarity determining region 3 for antibody 12422
MQGTHWPWT

SEQ ID NO: 24844 - protein, 16 aa, Homo sapiens
  heavy chain complementarity determining region 3 for antibody 12422
TTHFAPRRWLVREGDH

SEQ ID NO: 24845 - protein, 9 aa, Homo sapiens
  light chain complementarity determining region 3 for antibody 12423
MQGTHWPRT

SEQ ID NO: 24846 - protein, 15 aa, Homo sapiens
  heavy chain complementarity determining region 3 for antibody 12423
VIEGYNVLTLDGFYV

SEQ ID NO: 24847 - protein, 9 aa, Homo sapiens
  light chain complementarity determining region 3 for antibody 12424
MQARQSPIT

SEQ ID NO: 24848 - protein, 16 aa, Homo sapiens
  heavy chain complementarity determining region 3 for antibody 12424
ARGERYNHDSTGSLDN

SEQ ID NO: 24849 - protein, 8 aa, Homo sapiens
  light chain complementarity determining region 3 for antibody 12425
MQALQTRT

SEQ ID NO: 24850 - protein, 17 aa, Homo sapiens
  heavy chain complementarity determining region 3 for antibody 12425
ARLPAYCSGDNCYRFDY

SEQ ID NO: 24851 - protein, 9 aa, Homo sapiens
  light chain complementarity determining region 3 for antibody 12426
MQALQTPYT

SEQ ID NO: 24852 - protein, 15 aa, Homo sapiens
  heavy chain complementarity determining region 3 for antibody 12426
ARKTRVRHNPYYFDY

SEQ ID NO: 24853 - protein, 9 aa, Homo sapiens
  light chain complementarity determining region 3 for antibody 12427
MQALQTPGT

SEQ ID NO: 24854 - protein, 19 aa, Homo sapiens
  heavy chain complementarity determining region 3 for antibody 12427
VRGLYSTYWSGYVGDGFDM

SEQ ID NO: 24855 - protein, 9 aa, Homo sapiens
  light chain complementarity determining region 3 for antibody 12428
MQALQTPGT

SEQ ID NO: 24856 - protein, 17 aa, Homo sapiens
  heavy chain complementarity determining region 3 for antibody 12428
AREPMVTDRYYYDGLDV

SEQ ID NO: 24857 - protein, 10 aa, Homo sapiens
  light chain complementarity determining region 3 for antibody 12429
MQALETPGFT

SEQ ID NO: 24858 - protein, 19 aa, Homo sapiens
  heavy chain complementarity determining region 3 for antibody 12429
ARGPYSSSWDDFYYYGMDV

SEQ ID NO: 24859 - protein, 9 aa, Homo sapiens
  light chain complementarity determining region 3 for antibody 12430
MQALETALS

SEQ ID NO: 24860 - protein, 12 aa, Homo sapiens
  heavy chain complementarity determining region 3 for antibody 12430
ARRRVADAGVDY

SEQ ID NO: 24861 - protein, 15 aa, Homo sapiens
  light chain complementarity determining region 3 for antibody 12431
MEALQTLASSTNSFT

SEQ ID NO: 24862 - protein, 17 aa, Homo sapiens
  heavy chain complementarity determining region 3 for antibody 12431
ARDGSYGDRMNYHGMDV

SEQ ID NO: 24863 - protein, 9 aa, Homo sapiens
  light chain complementarity determining region 3 for antibody 12432
LQGRHWPWT

SEQ ID NO: 24864 - protein, 8 aa, Homo sapiens
  heavy chain complementarity determining region 3 for antibody 12432
ARDDWFDP

SEQ ID NO: 24865 - protein, 9 aa, Homo sapiens
  light chain complementarity determining region 3 for antibody 12433
HQYYSIPNT

SEQ ID NO: 24866 - protein, 11 aa, Homo sapiens
  heavy chain complementarity determining region 3 for antibody 12433
AGGRPIFGLDY

SEQ ID NO: 24867 - protein, 10 aa, Homo sapiens
  light chain complementarity determining region 3 for antibody 12434
QQYYSTPPWT

SEQ ID NO: 24868 - protein, 17 aa, Homo sapiens
  heavy chain complementarity determining region 3 for antibody 12434
ARSPYDGSGYYSGYFDY

SEQ ID NO: 24869 - protein, 9 aa, Homo sapiens
  light chain complementarity determining region 3 for antibody 12435
QQYSSSRWT

SEQ ID NO: 24870 - protein, 11 aa, Homo sapiens
  heavy chain complementarity determining region 3 for antibody 12435
ARFDFYYGMDV

SEQ ID NO: 24871 - protein, 9 aa, Homo sapiens
  light chain complementarity determining region 3 for antibody 12436
QQYNNWPPT

SEQ ID NO: 24872 - protein, 15 aa, Homo sapiens
  heavy chain complementarity determining region 3 for antibody 12436
AKDREYRSSWSPFDF

SEQ ID NO: 24873 - protein, 9 aa, Homo sapiens
  light chain complementarity determining region 3 for antibody 12437
QQYNNWPLT

SEQ ID NO: 24874 - protein, 20 aa, Homo sapiens
  heavy chain complementarity determining region 3 for antibody 12437
AKGRDESRFCSGGGCYVLDS

SEQ ID NO: 24875 - protein, 9 aa, Homo sapiens
  light chain complementarity determining region 3 for antibody 12438
QQYNHWPPT

SEQ ID NO: 24876 - protein, 16 aa, Homo sapiens
  heavy chain complementarity determining region 3 for antibody 12438
VKVWADSAYSPMLFDY

SEQ ID NO: 24877 - protein, 9 aa, Homo sapiens
  light chain complementarity determining region 3 for antibody 12439
QQYHSTPLT

SEQ ID NO: 24878 - protein, 20 aa, Homo sapiens
  heavy chain complementarity determining region 3 for antibody 12439
ARDKFEVDSTATRFYRFFDL

SEQ ID NO: 24879 - protein, 9 aa, Homo sapiens
  light chain complementarity determining region 3 for antibody 12440
QQYGSSPYT

SEQ ID NO: 24880 - protein, 13 aa, Homo sapiens
  heavy chain complementarity determining region 3 for antibody 12440
ARAPQTWLLYFDY

SEQ ID NO: 24881 - protein, 10 aa, Homo sapiens
  light chain complementarity determining region 3 for antibody 12441
QQYGSSPPVT

SEQ ID NO: 24882 - protein, 15 aa, Homo sapiens
  heavy chain complementarity determining region 3 for antibody 12441
AKDLGTNGSAPYFDY

SEQ ID NO: 24883 - protein, 10 aa, Homo sapiens
  light chain complementarity determining region 3 for antibody 12442
QQYDNLTPIT

SEQ ID NO: 24884 - protein, 17 aa, Homo sapiens
  heavy chain complementarity determining region 3 for antibody 12442
ATDESYRRNFYYYGMDV

SEQ ID NO: 24885 - protein, 9 aa, Homo sapiens
  light chain complementarity determining region 3 for antibody 12443
QQYDNLPLT

SEQ ID NO: 24886 - protein, 14 aa, Homo sapiens
  heavy chain complementarity determining region 3 for antibody 12443
ARLPGRYPRHGFDV

SEQ ID NO: 24887 - protein, 9 aa, Homo sapiens
  light chain complementarity determining region 3 for antibody 12444
QQYDGSALI

SEQ ID NO: 24888 - protein, 9 aa, Homo sapiens
  heavy chain complementarity determining region 3 for antibody 12444
TRGGWYGVY

SEQ ID NO: 24889 - protein, 10 aa, Homo sapiens
  light chain complementarity determining region 3 for antibody 12445
QQSYSTPPFT

SEQ ID NO: 24890 - protein, 17 aa, Homo sapiens
  heavy chain complementarity determining region 3 for antibody 12445
AREDWSDVDLRAFYFDS

SEQ ID NO: 24891 - protein, 8 aa, Homo sapiens
  light chain complementarity determining region 3 for antibody 12446
QQSYSTPA

SEQ ID NO: 24892 - protein, 16 aa, Homo sapiens
  heavy chain complementarity determining region 3 for antibody 12446
ASERDYGDSTGGFLDF

SEQ ID NO: 24893 - protein, 9 aa, Homo sapiens
  light chain complementarity determining region 3 for antibody 12447
QQSCSAPRT

SEQ ID NO: 24894 - protein, 21 aa, Homo sapiens
  heavy chain complementarity determining region 3 for antibody 12447
ARESAGYSRGRAAYFYYGMDV

SEQ ID NO: 24895 - protein, 10 aa, Homo sapiens
  light chain complementarity determining region 3 for antibody 12448
QQRSSWPPLT

SEQ ID NO: 24896 - protein, 14 aa, Homo sapiens
  heavy chain complementarity determining region 3 for antibody 12448
ARDDYFYSSGYYTY

SEQ ID NO: 24897 - protein, 10 aa, Homo sapiens
  light chain complementarity determining region 3 for antibody 12449
QQRSNWPPLT

SEQ ID NO: 24898 - protein, 17 aa, Homo sapiens
  heavy chain complementarity determining region 3 for antibody 12449
ARFKGIAPRPHKGTFDY

SEQ ID NO: 24899 - protein, 10 aa, Homo sapiens
  light chain complementarity determining region 3 for antibody 12450
QQRSIWPPVT

SEQ ID NO: 24900 - protein, 20 aa, Homo sapiens
  heavy chain complementarity determining region 3 for antibody 12450
ARDIGSYDSRGLSPTGYFDP

SEQ ID NO: 24901 - protein, 9 aa, Homo sapiens
  light chain complementarity determining region 3 for antibody 12451
QQRNNWGLP

SEQ ID NO: 24902 - protein, 22 aa, Homo sapiens
  heavy chain complementarity determining region 3 for antibody 12451
ARHSGYSNTWYMNYYYYYGMDV

SEQ ID NO: 24903 - protein, 9 aa, Homo sapiens
  light chain complementarity determining region 3 for antibody 12452
QQRGGWALT

SEQ ID NO: 24904 - protein, 16 aa, Homo sapiens
  heavy chain complementarity determining region 3 for antibody 12452
AAGVKAYRRAVRYFDY

SEQ ID NO: 24905 - protein, 10 aa, Homo sapiens
  light chain complementarity determining region 3 for antibody 12453
QQLNGYPQFT

SEQ ID NO: 24906 - protein, 17 aa, Homo sapiens
  heavy chain complementarity determining region 3 for antibody 12453
ARLPGGVISDFYYGMDV

SEQ ID NO: 24907 - protein, 9 aa, Homo sapiens
  light chain complementarity determining region 3 for antibody 12454
QQFHSYPTT

SEQ ID NO: 24908 - protein, 16 aa, Homo sapiens
  heavy chain complementarity determining region 3 for antibody 12454
ARTQGTRDYYYYAMDV

SEQ ID NO: 24909 - protein, 9 aa, Homo sapiens
  light chain complementarity determining region 3 for antibody 12455
QQFHSYPIT

SEQ ID NO: 24910 - protein, 16 aa, Homo sapiens
  heavy chain complementarity determining region 3 for antibody 12455
ARTQGTRDYYYCAMDV

SEQ ID NO: 24911 - protein, 9 aa, Homo sapiens
  light chain complementarity determining region 3 for antibody 12456
QQAYRLPLS

SEQ ID NO: 24912 - protein, 13 aa, Homo sapiens
  heavy chain complementarity determining region 3 for antibody 12456
TRTYGSGRNWFDP

SEQ ID NO: 24913 - protein, 9 aa, Homo sapiens
  light chain complementarity determining region 3 for antibody 12457
QQAYRFPLS

SEQ ID NO: 24914 - protein, 13 aa, Homo sapiens
  heavy chain complementarity determining region 3 for antibody 12457
TRTYGSGRNWFGP

SEQ ID NO: 24915 - protein, 9 aa, Homo sapiens
  light chain complementarity determining region 3 for antibody 12458
QQANSFPLT

SEQ ID NO: 24916 - protein, 16 aa, Homo sapiens
  heavy chain complementarity determining region 3 for antibody 12458
ARGGFGELGLQNALDI

SEQ ID NO: 24917 - protein, 10 aa, Homo sapiens
  light chain complementarity determining region 3 for antibody 12459
QDYNDWPPIT

SEQ ID NO: 24918 - protein, 16 aa, Homo sapiens
  heavy chain complementarity determining region 3 for antibody 12459
ARLKRISYSTGWFFQY

SEQ ID NO: 24919 - protein, 9 aa, Homo sapiens
  light chain complementarity determining region 3 for antibody 12460
MQSTHRPPT

SEQ ID NO: 24920 - protein, 8 aa, Homo sapiens
  heavy chain complementarity determining region 3 for antibody 12460
VRAEQFDY

SEQ ID NO: 24921 - protein, 9 aa, Homo sapiens
  light chain complementarity determining region 3 for antibody 12461
MQGLQTPLP

SEQ ID NO: 24922 - protein, 16 aa, Homo sapiens
  heavy chain complementarity determining region 3 for antibody 12461
ARGGFGELGLHNAFDV

SEQ ID NO: 24923 - protein, 9 aa, Homo sapiens
  light chain complementarity determining region 3 for antibody 12462
MQATHWPIT

SEQ ID NO: 24924 - protein, 14 aa, Homo sapiens
  heavy chain complementarity determining region 3 for antibody 12462
ARDFAHDYGANSGN

SEQ ID NO: 24925 - protein, 9 aa, Homo sapiens
  light chain complementarity determining region 3 for antibody 12463
MQALQTSIT

SEQ ID NO: 24926 - protein, 10 aa, Homo sapiens
  heavy chain complementarity determining region 3 for antibody 12463
ARGIGVLGDF

SEQ ID NO: 24927 - protein, 9 aa, Homo sapiens
  light chain complementarity determining region 3 for antibody 12464
MQALQTPWT

SEQ ID NO: 24928 - protein, 9 aa, Homo sapiens
  heavy chain complementarity determining region 3 for antibody 12464
VRGGRQDEY

SEQ ID NO: 24929 - protein, 9 aa, Homo sapiens
  light chain complementarity determining region 3 for antibody 12465
MQALQIPRT

SEQ ID NO: 24930 - protein, 9 aa, Homo sapiens
  heavy chain complementarity determining region 3 for antibody 12465
AREWFHFDY

SEQ ID NO: 24931 - protein, 9 aa, Homo sapiens
  light chain complementarity determining region 3 for antibody 12466
MQALLTPPT

SEQ ID NO: 24932 - protein, 14 aa, Homo sapiens
  heavy chain complementarity determining region 3 for antibody 12466
ARGLQWLNDNWFDP

SEQ ID NO: 24933 - protein, 9 aa, Homo sapiens
  light chain complementarity determining region 3 for antibody 12467
MQALKTPFT

SEQ ID NO: 24934 - protein, 19 aa, Homo sapiens
  heavy chain complementarity determining region 3 for antibody 12467
TRLDRYCSGSRCYSFWFEP

SEQ ID NO: 24935 - protein, 15 aa, Homo sapiens
  light chain complementarity determining region 3 for antibody 12468
MEALQTLASSTNSFT

SEQ ID NO: 24936 - protein, 17 aa, Homo sapiens
  heavy chain complementarity determining region 3 for antibody 12468
ARDGSYGDRMYYYGMDV

SEQ ID NO: 24937 - protein, 9 aa, Homo sapiens
  light chain complementarity determining region 3 for antibody 12469
LQYNNWPRT

SEQ ID NO: 24938 - protein, 16 aa, Homo sapiens
  heavy chain complementarity determining region 3 for antibody 12469
ARDSGTESRGLWYFDL

SEQ ID NO: 24939 - protein, 9 aa, Homo sapiens
  light chain complementarity determining region 3 for antibody 12470
HQYATSPLP

SEQ ID NO: 24940 - protein, 10 aa, Homo sapiens
  heavy chain complementarity determining region 3 for antibody 12470
GYSNGWLVHY

SEQ ID NO: 24941 - protein, 10 aa, Homo sapiens
  light chain complementarity determining region 3 for antibody 12471
HQSSSLPRLP

SEQ ID NO: 24942 - protein, 18 aa, Homo sapiens
  heavy chain complementarity determining region 3 for antibody 12471
ARDVGYDSNAHYHWYFDL

SEQ ID NO: 24943 - protein, 10 aa, Homo sapiens
  light chain complementarity determining region 3 for antibody 12472
QYHGYSTLYT

SEQ ID NO: 24944 - protein, 12 aa, Homo sapiens
  heavy chain complementarity determining region 3 for antibody 12472
AKGILGRGGMDV

SEQ ID NO: 24945 - protein, 10 aa, Homo sapiens
  light chain complementarity determining region 3 for antibody 12473
QYHGYSPRYT

SEQ ID NO: 24946 - protein, 12 aa, Homo sapiens
  heavy chain complementarity determining region 3 for antibody 12473
AKGILGRGGMDV

SEQ ID NO: 24947 - protein, 10 aa, Homo sapiens
  light chain complementarity determining region 3 for antibody 12474
QYHGYSPLYT

SEQ ID NO: 24948 - protein, 12 aa, Homo sapiens
  heavy chain complementarity determining region 3 for antibody 12474
AKGIVGRGGMDV

SEQ ID NO: 24949 - protein, 10 aa, Homo sapiens
  light chain complementarity determining region 3 for antibody 12475
QQYVSSALST

SEQ ID NO: 24950 - protein, 16 aa, Homo sapiens
  heavy chain complementarity determining region 3 for antibody 12475
ARELFKGEYDYYAMDV

SEQ ID NO: 24951 - protein, 9 aa, Homo sapiens
  light chain complementarity determining region 3 for antibody 12476
QQYNSYSRT

SEQ ID NO: 24952 - protein, 25 aa, Homo sapiens
  heavy chain complementarity determining region 3 for antibody 12476
ARHEGYCSSSTCYVRRLEAAAGIDC

SEQ ID NO: 24953 - protein, 9 aa, Homo sapiens
  light chain complementarity determining region 3 for antibody 12477
QQYNSYPRT

SEQ ID NO: 24954 - protein, 19 aa, Homo sapiens
  heavy chain complementarity determining region 3 for antibody 12477
ARDSPSVRKRPTEYYGMDA

SEQ ID NO: 24955 - protein, 11 aa, Homo sapiens
  light chain complementarity determining region 3 for antibody 12478
QQYNNWPPVLT

SEQ ID NO: 24956 - protein, 21 aa, Homo sapiens
  heavy chain complementarity determining region 3 for antibody 12478
ARSRVDDYVWGGYRAPYEMDV

SEQ ID NO: 24957 - protein, 11 aa, Homo sapiens
  light chain complementarity determining region 3 for antibody 12479
QQYNNWPPALT

SEQ ID NO: 24958 - protein, 13 aa, Homo sapiens
  heavy chain complementarity determining region 3 for antibody 12479
ARGITGTNFVMDV

SEQ ID NO: 24959 - protein, 9 aa, Homo sapiens
  light chain complementarity determining region 3 for antibody 12480
QQYKNYPWT

SEQ ID NO: 24960 - protein, 16 aa, Homo sapiens
  heavy chain complementarity determining region 3 for antibody 12480
VRDRLKGYTDYPTLDR

SEQ ID NO: 24961 - protein, 9 aa, Homo sapiens
  light chain complementarity determining region 3 for antibody 12481
QQYGSSRYT

SEQ ID NO: 24962 - protein, 22 aa, Homo sapiens
  heavy chain complementarity determining region 3 for antibody 12481
ARVYDDSIHYYSAGYYYYAMDV

SEQ ID NO: 24963 - protein, 9 aa, Homo sapiens
  light chain complementarity determining region 3 for antibody 12482
QQYGSSPRT

SEQ ID NO: 24964 - protein, 16 aa, Homo sapiens
  heavy chain complementarity determining region 3 for antibody 12482
TSWARDGYNSVVTGDY

SEQ ID NO: 24965 - protein, 10 aa, Homo sapiens
  light chain complementarity determining region 3 for antibody 12483
QQYGRSPGHT

SEQ ID NO: 24966 - protein, 19 aa, Homo sapiens
  heavy chain complementarity determining region 3 for antibody 12483
ARDPLVTAIQNYYYYGMDV

SEQ ID NO: 24967 - protein, 10 aa, Homo sapiens
  light chain complementarity determining region 3 for antibody 12484
QQYGGSRGWT

SEQ ID NO: 24968 - protein, 13 aa, Homo sapiens
  heavy chain complementarity determining region 3 for antibody 12484
TRTYGSGRNWFDP

SEQ ID NO: 24969 - protein, 8 aa, Homo sapiens
  light chain complementarity determining region 3 for antibody 12485
QQYGASPT

SEQ ID NO: 24970 - protein, 15 aa, Homo sapiens
  heavy chain complementarity determining region 3 for antibody 12485
ARNTLRMSEDGAFDM

SEQ ID NO: 24971 - protein, 9 aa, Homo sapiens
  light chain complementarity determining region 3 for antibody 12486
QQYDSFPST

SEQ ID NO: 24972 - protein, 17 aa, Homo sapiens
  heavy chain complementarity determining region 3 for antibody 12486
AREDWSDVDLRAFYFDS

SEQ ID NO: 24973 - protein, 8 aa, Homo sapiens
  light chain complementarity determining region 3 for antibody 12487
QQYDNLPT

SEQ ID NO: 24974 - protein, 12 aa, Homo sapiens
  heavy chain complementarity determining region 3 for antibody 12487
ASLHPLVNWFDP

SEQ ID NO: 24975 - protein, 9 aa, Homo sapiens
  light chain complementarity determining region 3 for antibody 12488
QQSYSTPQT

SEQ ID NO: 24976 - protein, 19 aa, Homo sapiens
  heavy chain complementarity determining region 3 for antibody 12488
ARENGGRGWVSYYYYGMVV

SEQ ID NO: 24977 - protein, 10 aa, Homo sapiens
  light chain complementarity determining region 3 for antibody 12489
QQSYSTPPFT

SEQ ID NO: 24978 - protein, 21 aa, Homo sapiens
  heavy chain complementarity determining region 3 for antibody 12489
ASLDNGSGKRDRQNYYYGMDV

SEQ ID NO: 24979 - protein, 9 aa, Homo sapiens
  light chain complementarity determining region 3 for antibody 12490
QQSYSNPYT

SEQ ID NO: 24980 - protein, 17 aa, Homo sapiens
  heavy chain complementarity determining region 3 for antibody 12490
ARGSYYDVDLNRFYFDY

SEQ ID NO: 24981 - protein, 8 aa, Homo sapiens
  light chain complementarity determining region 3 for antibody 12491
QQSYRAPS

SEQ ID NO: 24982 - protein, 10 aa, Homo sapiens
  heavy chain complementarity determining region 3 for antibody 12491
AHLSRGVNFF

SEQ ID NO: 24983 - protein, 9 aa, Homo sapiens
  light chain complementarity determining region 3 for antibody 12492
QQSLTAPLP

SEQ ID NO: 24984 - protein, 17 aa, Homo sapiens
  heavy chain complementarity determining region 3 for antibody 12492
TRSIVSGSGWNAGGFDC

SEQ ID NO: 24985 - protein, 9 aa, Homo sapiens
  light chain complementarity determining region 3 for antibody 12493
QQSERFPYT

SEQ ID NO: 24986 - protein, 16 aa, Homo sapiens
  heavy chain complementarity determining region 3 for antibody 12493
ARDQGLGFGVPDACDI

SEQ ID NO: 24987 - protein, 11 aa, Homo sapiens
  light chain complementarity determining region 3 for antibody 12494
QQRSNWPPGFT

SEQ ID NO: 24988 - protein, 16 aa, Homo sapiens
  heavy chain complementarity determining region 3 for antibody 12494
AKDLSRGNYLRGDFDY

SEQ ID NO: 24989 - protein, 10 aa, Homo sapiens
  light chain complementarity determining region 3 for antibody 12495
QQRSNWPIFP

SEQ ID NO: 24990 - protein, 14 aa, Homo sapiens
  heavy chain complementarity determining region 3 for antibody 12495
ARLNKMTRIRYFDS

SEQ ID NO: 24991 - protein, 9 aa, Homo sapiens
  light chain complementarity determining region 3 for antibody 12496
QQRHNWPLT

SEQ ID NO: 24992 - protein, 16 aa, Homo sapiens
  heavy chain complementarity determining region 3 for antibody 12496
ARGGELVGGFNNWFDP

SEQ ID NO: 24993 - protein, 9 aa, Homo sapiens
  light chain complementarity determining region 3 for antibody 12497
QQQFTGRGT

SEQ ID NO: 24994 - protein, 15 aa, Homo sapiens
  heavy chain complementarity determining region 3 for antibody 12497
AKEGCSGGICYGFDV

SEQ ID NO: 24995 - protein, 9 aa, Homo sapiens
  light chain complementarity determining region 3 for antibody 12498
QQLHGYPLP

SEQ ID NO: 24996 - protein, 21 aa, Homo sapiens
  heavy chain complementarity determining region 3 for antibody 12498
ARDWAQSNGYPVGHYYYGMDV

SEQ ID NO: 24997 - protein, 8 aa, Homo sapiens
  light chain complementarity determining region 3 for antibody 12499
QQHNNWWT

SEQ ID NO: 24998 - protein, 16 aa, Homo sapiens
  heavy chain complementarity determining region 3 for antibody 12499
AKLVNYDSSGNAAFDI

SEQ ID NO: 24999 - protein, 9 aa, Homo sapiens
  light chain complementarity determining region 3 for antibody 12500
QQFHSYPIT

SEQ ID NO: 25000 - protein, 15 aa, Homo sapiens
  heavy chain complementarity determining region 3 for antibody 12500
ARTQGTRDYYYAMDV

SEQ ID NO: 25001 - protein, 9 aa, Homo sapiens
  light chain complementarity determining region 3 for antibody 12501
QQAYRFQLS

SEQ ID NO: 25002 - protein, 13 aa, Homo sapiens
  heavy chain complementarity determining region 3 for antibody 12501
TRTYGSGRNWFDP

SEQ ID NO: 25003 - protein, 9 aa, Homo sapiens
  light chain complementarity determining region 3 for antibody 12502
QQAYRFPFS

SEQ ID NO: 25004 - protein, 13 aa, Homo sapiens
  heavy chain complementarity determining region 3 for antibody 12502
TRTYGSGRNWFDP

SEQ ID NO: 25005 - protein, 9 aa, Homo sapiens
  light chain complementarity determining region 3 for antibody 12503
QHYNNWPLT

SEQ ID NO: 25006 - protein, 19 aa, Homo sapiens
  heavy chain complementarity determining region 3 for antibody 12503
VRSYDSGGYYSLPTEYFQL

SEQ ID NO: 25007 - protein, 10 aa, Homo sapiens
  light chain complementarity determining region 3 for antibody 12504
QHHGYSPLYT

SEQ ID NO: 25008 - protein, 12 aa, Homo sapiens
  heavy chain complementarity determining region 3 for antibody 12504
AKGILGRGGMDV

SEQ ID NO: 25009 - protein, 9 aa, Homo sapiens
  light chain complementarity determining region 3 for antibody 12505
MQGLPTPLT

SEQ ID NO: 25010 - protein, 16 aa, Homo sapiens
  heavy chain complementarity determining region 3 for antibody 12505
ARGGFGELGLHNAFDV

SEQ ID NO: 25011 - protein, 9 aa, Homo sapiens
  light chain complementarity determining region 3 for antibody 12506
MQGLLTPPA

SEQ ID NO: 25012 - protein, 18 aa, Homo sapiens
  heavy chain complementarity determining region 3 for antibody 12506
ARTRFGVYSGGSPYMFDP

SEQ ID NO: 25013 - protein, 9 aa, Homo sapiens
  light chain complementarity determining region 3 for antibody 12507
MQALQTPPT

SEQ ID NO: 25014 - protein, 18 aa, Homo sapiens
  heavy chain complementarity determining region 3 for antibody 12507
GRDGRGGGISVAAPGFDL

SEQ ID NO: 25015 - protein, 9 aa, Homo sapiens
  light chain complementarity determining region 3 for antibody 12508
MQALQTPPT

SEQ ID NO: 25016 - protein, 14 aa, Homo sapiens
  heavy chain complementarity determining region 3 for antibody 12508
ARGLQWLNDNWFDP

SEQ ID NO: 25017 - protein, 9 aa, Homo sapiens
  light chain complementarity determining region 3 for antibody 12509
MQALHLPFT

SEQ ID NO: 25018 - protein, 19 aa, Homo sapiens
  heavy chain complementarity determining region 3 for antibody 12509
VRHDRYCSGDRCFSFWFDP

SEQ ID NO: 25019 - protein, 9 aa, Homo sapiens
  light chain complementarity determining region 3 for antibody 12510
MQAINWPWT

SEQ ID NO: 25020 - protein, 11 aa, Homo sapiens
  heavy chain complementarity determining region 3 for antibody 12510
ARDFLNRAFDI

SEQ ID NO: 25021 - protein, 9 aa, Homo sapiens
  light chain complementarity determining region 3 for antibody 12511
LQCAYSPLT

SEQ ID NO: 25022 - protein, 10 aa, Homo sapiens
  heavy chain complementarity determining region 3 for antibody 12511
AGGLGWTLDL

SEQ ID NO: 25023 - protein, 10 aa, Homo sapiens
  light chain complementarity determining region 3 for antibody 12512
QYNGYSPLYT

SEQ ID NO: 25024 - protein, 12 aa, Homo sapiens
  heavy chain complementarity determining region 3 for antibody 12512
AKGILGRGGMDV

SEQ ID NO: 25025 - protein, 10 aa, Homo sapiens
  light chain complementarity determining region 3 for antibody 12513
QYHGYSPLYT

SEQ ID NO: 25026 - protein, 12 aa, Homo sapiens
  heavy chain complementarity determining region 3 for antibody 12513
AKGILGRGGRDV

SEQ ID NO: 25027 - protein, 10 aa, Homo sapiens
  light chain complementarity determining region 3 for antibody 12514
QYHGYSPLYT

SEQ ID NO: 25028 - protein, 12 aa, Homo sapiens
  heavy chain complementarity determining region 3 for antibody 12514
AKGILGRGGMDA

SEQ ID NO: 25029 - protein, 10 aa, Homo sapiens
  light chain complementarity determining region 3 for antibody 12515
QSYGPSHIWT

SEQ ID NO: 25030 - protein, 12 aa, Homo sapiens
  heavy chain complementarity determining region 3 for antibody 12515
AQGQRTPYVFEI

SEQ ID NO: 25031 - protein, 10 aa, Homo sapiens
  light chain complementarity determining region 3 for antibody 12516
QQYYVWPPWT

SEQ ID NO: 25032 - protein, 9 aa, Homo sapiens
  heavy chain complementarity determining region 3 for antibody 12516
TRGYSTGLD

SEQ ID NO: 25033 - protein, 9 aa, Homo sapiens
  light chain complementarity determining region 3 for antibody 12517
QQYYSYPLT

SEQ ID NO: 25034 - protein, 16 aa, Homo sapiens
  heavy chain complementarity determining region 3 for antibody 12517
ARDAKYCGGDCFAFDY

SEQ ID NO: 25035 - protein, 9 aa, Homo sapiens
  light chain complementarity determining region 3 for antibody 12518
QQYSSLPYT

SEQ ID NO: 25036 - protein, 17 aa, Homo sapiens
  heavy chain complementarity determining region 3 for antibody 12518
AREQWNDVDLRQFYFDY

SEQ ID NO: 25037 - protein, 9 aa, Homo sapiens
  light chain complementarity determining region 3 for antibody 12519
QQYNSYWYT

SEQ ID NO: 25038 - protein, 20 aa, Homo sapiens
  heavy chain complementarity determining region 3 for antibody 12519
AGAYGSGTYSPDYYYFGMDV

SEQ ID NO: 25039 - protein, 9 aa, Homo sapiens
  light chain complementarity determining region 3 for antibody 12520
QQYNSYPLT

SEQ ID NO: 25040 - protein, 13 aa, Homo sapiens
  heavy chain complementarity determining region 3 for antibody 12520
AKGGGETQTTLDS

SEQ ID NO: 25041 - protein, 9 aa, Homo sapiens
  light chain complementarity determining region 3 for antibody 12521
QQYNSLPIT

SEQ ID NO: 25042 - protein, 19 aa, Homo sapiens
  heavy chain complementarity determining region 3 for antibody 12521
ARDRDYTIVDDYDSGVFDY

SEQ ID NO: 25043 - protein, 9 aa, Homo sapiens
  light chain complementarity determining region 3 for antibody 12522
QQYNSFPWT

SEQ ID NO: 25044 - protein, 13 aa, Homo sapiens
  heavy chain complementarity determining region 3 for antibody 12522
AGDSSGWYTYIRQ

SEQ ID NO: 25045 - protein, 8 aa, Homo sapiens
  light chain complementarity determining region 3 for antibody 12523
QQYNNYWT

SEQ ID NO: 25046 - protein, 12 aa, Homo sapiens
  heavy chain complementarity determining region 3 for antibody 12523
ARGGGVREVINY

SEQ ID NO: 25047 - protein, 10 aa, Homo sapiens
  light chain complementarity determining region 3 for antibody 12524
QQYNNWPTWT

SEQ ID NO: 25048 - protein, 14 aa, Homo sapiens
  heavy chain complementarity determining region 3 for antibody 12524
ARAMYNDFWSGYGY

SEQ ID NO: 25049 - protein, 8 aa, Homo sapiens
  light chain complementarity determining region 3 for antibody 12525
QQYNNWPS

SEQ ID NO: 25050 - protein, 12 aa, Homo sapiens
  heavy chain complementarity determining region 3 for antibody 12525
VQGNGAGSYSSH

SEQ ID NO: 25051 - protein, 9 aa, Homo sapiens
  light chain complementarity determining region 3 for antibody 12526
QQYNNWPKT

SEQ ID NO: 25052 - protein, 16 aa, Homo sapiens
  heavy chain complementarity determining region 3 for antibody 12526
ARDGAGSYMGEKWFDP

SEQ ID NO: 25053 - protein, 7 aa, Homo sapiens
  light chain complementarity determining region 3 for antibody 12527
QQYNGYL

SEQ ID NO: 25054 - protein, 15 aa, Homo sapiens
  heavy chain complementarity determining region 3 for antibody 12527
ARNVLPDYYAGAFHL

SEQ ID NO: 25055 - protein, 9 aa, Homo sapiens
  light chain complementarity determining region 3 for antibody 12528
QQYGTSPWT

SEQ ID NO: 25056 - protein, 20 aa, Homo sapiens
  heavy chain complementarity determining region 3 for antibody 12528
ARDSYYVASYGDYVIYWFDP

SEQ ID NO: 25057 - protein, 10 aa, Homo sapiens
  light chain complementarity determining region 3 for antibody 12529
QQYGSSPPVT

SEQ ID NO: 25058 - protein, 18 aa, Homo sapiens
  heavy chain complementarity determining region 3 for antibody 12529
TRLSFNYVSSGYYQIFDY

SEQ ID NO: 25059 - protein, 8 aa, Homo sapiens
  light chain complementarity determining region 3 for antibody 12530
QQYGNLLT

SEQ ID NO: 25060 - protein, 20 aa, Homo sapiens
  heavy chain complementarity determining region 3 for antibody 12530
SKDRSVNAAMDYYYYSAMDA

SEQ ID NO: 25061 - protein, 9 aa, Homo sapiens
  light chain complementarity determining region 3 for antibody 12531
QQYDNLPPT

SEQ ID NO: 25062 - protein, 17 aa, Homo sapiens
  heavy chain complementarity determining region 3 for antibody 12531
ARVHDSSDYYVAEYFQY

SEQ ID NO: 25063 - protein, 10 aa, Homo sapiens
  light chain complementarity determining region 3 for antibody 12532
QQTYSSPPPT

SEQ ID NO: 25064 - protein, 17 aa, Homo sapiens
  heavy chain complementarity determining region 3 for antibody 12532
ARLTPYTSNWNPFYYDY

SEQ ID NO: 25065 - protein, 10 aa, Homo sapiens
  light chain complementarity determining region 3 for antibody 12533
QQTYSSPPPP

SEQ ID NO: 25066 - protein, 17 aa, Homo sapiens
  heavy chain complementarity determining region 3 for antibody 12533
ARLTPYTSNWNPFYCDY

SEQ ID NO: 25067 - protein, 9 aa, Homo sapiens
  light chain complementarity determining region 3 for antibody 12534
QQSYRTPPT

SEQ ID NO: 25068 - protein, 15 aa, Homo sapiens
  heavy chain complementarity determining region 3 for antibody 12534
AKLRDGYYYYYGMDV

SEQ ID NO: 25069 - protein, 9 aa, Homo sapiens
  light chain complementarity determining region 3 for antibody 12535
QQRTNWPYT

SEQ ID NO: 25070 - protein, 16 aa, Homo sapiens
  heavy chain complementarity determining region 3 for antibody 12535
VREGPSYTSGTYYFDY

SEQ ID NO: 25071 - protein, 8 aa, Homo sapiens
  light chain complementarity determining region 3 for antibody 12536
QQRSSWPS

SEQ ID NO: 25072 - protein, 12 aa, Homo sapiens
  heavy chain complementarity determining region 3 for antibody 12536
ARHRPEYNSFDP

SEQ ID NO: 25073 - protein, 10 aa, Homo sapiens
  light chain complementarity determining region 3 for antibody 12537
QQRSNWPPLT

SEQ ID NO: 25074 - protein, 10 aa, Homo sapiens
  heavy chain complementarity determining region 3 for antibody 12537
AVMGYYAMDV

SEQ ID NO: 25075 - protein, 10 aa, Homo sapiens
  light chain complementarity determining region 3 for antibody 12538
QQRSNWPPIT

SEQ ID NO: 25076 - protein, 16 aa, Homo sapiens
  heavy chain complementarity determining region 3 for antibody 12538
AKDLTTVVSHGGYFDS

SEQ ID NO: 25077 - protein, 10 aa, Homo sapiens
  light chain complementarity determining region 3 for antibody 12539
QQRNNWPPYT

SEQ ID NO: 25078 - protein, 11 aa, Homo sapiens
  heavy chain complementarity determining region 3 for antibody 12539
ARDGRVGAFDI

SEQ ID NO: 25079 - protein, 9 aa, Homo sapiens
  light chain complementarity determining region 3 for antibody 12540
QQFHTYPWT

SEQ ID NO: 25080 - protein, 32 aa, Homo sapiens
  heavy chain complementarity determining region 3 for antibody 12540
AREEGILVLTGYDGAPVSNPSPSEATPYGVGL

SEQ ID NO: 25081 - protein, 9 aa, Homo sapiens
  light chain complementarity determining region 3 for antibody 12541
QQFHSYPIT

SEQ ID NO: 25082 - protein, 16 aa, Homo sapiens
  heavy chain complementarity determining region 3 for antibody 12541
ARTQGTGDYYYYAMDV

SEQ ID NO: 25083 - protein, 9 aa, Homo sapiens
  light chain complementarity determining region 3 for antibody 12542
QQFDSLPIT

SEQ ID NO: 25084 - protein, 18 aa, Homo sapiens
  heavy chain complementarity determining region 3 for antibody 12542
ASAPQYTRSTYYYYGLDV

SEQ ID NO: 25085 - protein, 11 aa, Homo sapiens
  light chain complementarity determining region 3 for antibody 12543
QQCYSAPPANT

SEQ ID NO: 25086 - protein, 16 aa, Homo sapiens
  heavy chain complementarity determining region 3 for antibody 12543
AREAGEDYYYKDIFDI

SEQ ID NO: 25087 - protein, 9 aa, Homo sapiens
  light chain complementarity determining region 3 for antibody 12544
QQAYRFPPS

SEQ ID NO: 25088 - protein, 13 aa, Homo sapiens
  heavy chain complementarity determining region 3 for antibody 12544
TRTYGSGRNWFDP

SEQ ID NO: 25089 - protein, 9 aa, Homo sapiens
  light chain complementarity determining region 3 for antibody 12545
QQAYRFPLS

SEQ ID NO: 25090 - protein, 13 aa, Homo sapiens
  heavy chain complementarity determining region 3 for antibody 12545
TRTYGSGRSWFDP

SEQ ID NO: 25091 - protein, 9 aa, Homo sapiens
  light chain complementarity determining region 3 for antibody 12546
QQAYRFPLS

SEQ ID NO: 25092 - protein, 13 aa, Homo sapiens
  heavy chain complementarity determining region 3 for antibody 12546
TGTYGSGRNWFDP

SEQ ID NO: 25093 - protein, 8 aa, Homo sapiens
  light chain complementarity determining region 3 for antibody 12547
QQAHSLPP

SEQ ID NO: 25094 - protein, 22 aa, Homo sapiens
  heavy chain complementarity determining region 3 for antibody 12547
ARHSGYSNTWYMNYYYYYGMDV

SEQ ID NO: 25095 - protein, 8 aa, Homo sapiens
  light chain complementarity determining region 3 for antibody 12548
QQAHSFPP

SEQ ID NO: 25096 - protein, 22 aa, Homo sapiens
  heavy chain complementarity determining region 3 for antibody 12548
ARHSGYSNTWYMNYCYYYGMDV

SEQ ID NO: 25097 - protein, 10 aa, Homo sapiens
  light chain complementarity determining region 3 for antibody 12549
QHYDHLPLFN

SEQ ID NO: 25098 - protein, 18 aa, Homo sapiens
  heavy chain complementarity determining region 3 for antibody 12549
ARIPEFGNYSGSKNYFDY

SEQ ID NO: 25099 - protein, 10 aa, Homo sapiens
  light chain complementarity determining region 3 for antibody 12550
MQRKEFPLIS

SEQ ID NO: 25100 - protein, 19 aa, Homo sapiens
  heavy chain complementarity determining region 3 for antibody 12550
ARDSVQVPTAILYYYGLDV

SEQ ID NO: 25101 - protein, 9 aa, Homo sapiens
  light chain complementarity determining region 3 for antibody 12551
MQGTHWPYT

SEQ ID NO: 25102 - protein, 17 aa, Homo sapiens
  heavy chain complementarity determining region 3 for antibody 12551
ARDRPHLLGSANNLLDH

SEQ ID NO: 25103 - protein, 9 aa, Homo sapiens
  light chain complementarity determining region 3 for antibody 12552
MQGTHWPRT

SEQ ID NO: 25104 - protein, 16 aa, Homo sapiens
  heavy chain complementarity determining region 3 for antibody 12552
AKDGRYAYGYHDAFDI

SEQ ID NO: 25105 - protein, 9 aa, Homo sapiens
  light chain complementarity determining region 3 for antibody 12553
MQGTHWPPT

SEQ ID NO: 25106 - protein, 28 aa, Homo sapiens
  heavy chain complementarity determining region 3 for antibody 12553
ARTRREAPYYDPLTGYYESVHYYYAMDV

SEQ ID NO: 25107 - protein, 9 aa, Homo sapiens
  light chain complementarity determining region 3 for antibody 12554
MQGLLSPPA

SEQ ID NO: 25108 - protein, 18 aa, Homo sapiens
  heavy chain complementarity determining region 3 for antibody 12554
ARTRVGIYSGGSPFMFDP

SEQ ID NO: 25109 - protein, 9 aa, Homo sapiens
  light chain complementarity determining region 3 for antibody 12555
MQALQTPWT

SEQ ID NO: 25110 - protein, 12 aa, Homo sapiens
  heavy chain complementarity determining region 3 for antibody 12555
ARELRDYDGMDV

SEQ ID NO: 25111 - protein, 9 aa, Homo sapiens
  light chain complementarity determining region 3 for antibody 12556
MQALQTPLT

SEQ ID NO: 25112 - protein, 28 aa, Homo sapiens
  heavy chain complementarity determining region 3 for antibody 12556
AKHHRGRDDSGTYTMWDGMKYYYYGVDV

SEQ ID NO: 25113 - protein, 9 aa, Homo sapiens
  light chain complementarity determining region 3 for antibody 12557
LQHNGYPWT

SEQ ID NO: 25114 - protein, 17 aa, Homo sapiens
  heavy chain complementarity determining region 3 for antibody 12557
AREPRVFEFGYVSSFDH

SEQ ID NO: 25115 - protein, 9 aa, Homo sapiens
  light chain complementarity determining region 3 for antibody 12558
LQGYGTPYT

SEQ ID NO: 25116 - protein, 17 aa, Homo sapiens
  heavy chain complementarity determining region 3 for antibody 12558
AKEGGGYCSGGTCYPEN

SEQ ID NO: 25117 - protein, 8 aa, Homo sapiens
  light chain complementarity determining region 3 for antibody 12559
LLYGGSPT

SEQ ID NO: 25118 - protein, 12 aa, Homo sapiens
  heavy chain complementarity determining region 3 for antibody 12559
ARGSLINMVVSE

SEQ ID NO: 25119 - protein, 9 aa, Homo sapiens
  light chain complementarity determining region 3 for antibody 12560
HQYGSSPLT

SEQ ID NO: 25120 - protein, 18 aa, Homo sapiens
  heavy chain complementarity determining region 3 for antibody 12560
ARYPQTPGYFYEGNWFDP

SEQ ID NO: 25121 - protein, 10 aa, Homo sapiens
  light chain complementarity determining region 3 for antibody 12561
HQSFSPPSLT

SEQ ID NO: 25122 - protein, 10 aa, Homo sapiens
  heavy chain complementarity determining region 3 for antibody 12561
ARDWGWGFDP

SEQ ID NO: 25123 - protein, 8 aa, Homo sapiens
  light chain complementarity determining region 3 for antibody 12562
RQYNSYSA

SEQ ID NO: 25124 - protein, 15 aa, Homo sapiens
  heavy chain complementarity determining region 3 for antibody 12562
ARAYSSGWYPESFDF

SEQ ID NO: 25125 - protein, 10 aa, Homo sapiens
  light chain complementarity determining region 3 for antibody 12563
QYHGYSPLYT

SEQ ID NO: 25126 - protein, 12 aa, Homo sapiens
  heavy chain complementarity determining region 3 for antibody 12563
AKGILGRGCMDV

SEQ ID NO: 25127 - protein, 10 aa, Homo sapiens
  light chain complementarity determining region 3 for antibody 12564
QYHGYSPLYT

SEQ ID NO: 25128 - protein, 12 aa, Homo sapiens
  heavy chain complementarity determining region 3 for antibody 12564
AEGILGRGGMDV

SEQ ID NO: 25129 - protein, 10 aa, Homo sapiens
  light chain complementarity determining region 3 for antibody 12565
QYHGYPPLYT

SEQ ID NO: 25130 - protein, 12 aa, Homo sapiens
  heavy chain complementarity determining region 3 for antibody 12565
AKGILGRGGMDV

SEQ ID NO: 25131 - protein, 10 aa, Homo sapiens
  light chain complementarity determining region 3 for antibody 12566
QYHAYSPLYT

SEQ ID NO: 25132 - protein, 12 aa, Homo sapiens
  heavy chain complementarity determining region 3 for antibody 12566
AKGILGRGGMDV

SEQ ID NO: 25133 - protein, 22 aa, Homo sapiens
  light chain complementarity determining region 3 for antibody 12567
QRFNNYPRQIHFRPWDQSGYRT

SEQ ID NO: 25134 - protein, 15 aa, Homo sapiens
  heavy chain complementarity determining region 3 for antibody 12567
ATLRVVGITSEWSGS

SEQ ID NO: 25135 - protein, 9 aa, Homo sapiens
  light chain complementarity determining region 3 for antibody 12568
QQYYSVPLT

SEQ ID NO: 25136 - protein, 19 aa, Homo sapiens
  heavy chain complementarity determining region 3 for antibody 12568
AKDLQPFHRSTVAGPTFDF

SEQ ID NO: 25137 - protein, 9 aa, Homo sapiens
  light chain complementarity determining region 3 for antibody 12569
QQYYSTPRT

SEQ ID NO: 25138 - protein, 22 aa, Homo sapiens
  heavy chain complementarity determining region 3 for antibody 12569
ARDQIGGEAGDVLTDLHGSFDL

SEQ ID NO: 25139 - protein, 10 aa, Homo sapiens
  light chain complementarity determining region 3 for antibody 12570
QQYYNWPPVT

SEQ ID NO: 25140 - protein, 16 aa, Homo sapiens
  heavy chain complementarity determining region 3 for antibody 12570
AKDLVRVVAGGGTLGN

SEQ ID NO: 25141 - protein, 10 aa, Homo sapiens
  light chain complementarity determining region 3 for antibody 12571
QQYVSSELFT

SEQ ID NO: 25142 - protein, 16 aa, Homo sapiens
  heavy chain complementarity determining region 3 for antibody 12571
ARESFKGEIDYYAMDV

SEQ ID NO: 25143 - protein, 9 aa, Homo sapiens
  light chain complementarity determining region 3 for antibody 12572
QQYNSYWYT

SEQ ID NO: 25144 - protein, 20 aa, Homo sapiens
  heavy chain complementarity determining region 3 for antibody 12572
AGTDGSGTYSPDYYYFGMDV

SEQ ID NO: 25145 - protein, 8 aa, Homo sapiens
  light chain complementarity determining region 3 for antibody 12573
QQYNSVWT

SEQ ID NO: 25146 - protein, 21 aa, Homo sapiens
  heavy chain complementarity determining region 3 for antibody 12573
ARVRSPYYDTNGHGGYDAFDI

SEQ ID NO: 25147 - protein, 9 aa, Homo sapiens
  light chain complementarity determining region 3 for antibody 12574
QQYNNYSWT

SEQ ID NO: 25148 - protein, 19 aa, Homo sapiens
  heavy chain complementarity determining region 3 for antibody 12574
ARHTDGSGNFIGDSVWFDP

SEQ ID NO: 25149 - protein, 10 aa, Homo sapiens [sequence omitted]

SEQ ID NO: 25150 - protein, 17 aa, Homo sapiens
  heavy chain complementarity determining region 3 for antibody 12575
ARLSITAQNYYYYTLDL

SEQ ID NO: 25151 - protein, 11 aa, Homo sapiens
  light chain complementarity determining region 3 for antibody 12576
QQYNNWPPWGT

SEQ ID NO: 25152 - protein, 10 aa, Homo sapiens
  heavy chain complementarity determining region 3 for antibody 12576
AKDSTGDPTG

SEQ ID NO: 25153 - protein, 9 aa, Homo sapiens
  light chain complementarity determining region 3 for antibody 12577
QQYNNWPFT

SEQ ID NO: 25154 - protein, 20 aa, Homo sapiens
  heavy chain complementarity determining region 3 for antibody 12577
ARGVSGKVPVGAYRGFFFDY

SEQ ID NO: 25155 - protein, 9 aa, Homo sapiens
  light chain complementarity determining region 3 for antibody 12578
QQYGYSPIT

SEQ ID NO: 25156 - protein, 19 aa, Homo sapiens
  heavy chain complementarity determining region 3 for antibody 12578
ARGGTIYYYDTSGYSPDDY

SEQ ID NO: 25157 - protein, 9 aa, Homo sapiens
  light chain complementarity determining region 3 for antibody 12579
QQYDDLPLT

SEQ ID NO: 25158 - protein, 14 aa, Homo sapiens
  heavy chain complementarity determining region 3 for antibody 12579
AKHSRGGAGSYLDY

SEQ ID NO: 25159 - protein, 9 aa, Homo sapiens
  light chain complementarity determining region 3 for antibody 12580
QQTYSTPVT

SEQ ID NO: 25160 - protein, 16 aa, Homo sapiens
  heavy chain complementarity determining region 3 for antibody 12580
APLFTASGWSRGWLDP

SEQ ID NO: 25161 - protein, 9 aa, Homo sapiens
  light chain complementarity determining region 3 for antibody 12581
QQSYTTPRT

SEQ ID NO: 25162 - protein, 14 aa, Homo sapiens
  heavy chain complementarity determining region 3 for antibody 12581
ARQYCIGGICPLDS

SEQ ID NO: 25163 - protein, 9 aa, Homo sapiens
  light chain complementarity determining region 3 for antibody 12582
QQSYRTPYT

SEQ ID NO: 25164 - protein, 16 aa, Homo sapiens
  heavy chain complementarity determining region 3 for antibody 12582
VTDRDHYCCGWSYFDS

SEQ ID NO: 25165 - protein, 9 aa, Homo sapiens
  light chain complementarity determining region 3 for antibody 12583
QQSYNLRRT

SEQ ID NO: 25166 - protein, 14 aa, Homo sapiens
  heavy chain complementarity determining region 3 for antibody 12583
ARAGPSGTYSGFDS

SEQ ID NO: 25167 - protein, 9 aa, Homo sapiens
  light chain complementarity determining region 3 for antibody 12584
QQSFRKIRT

SEQ ID NO: 25168 - protein, 18 aa, Homo sapiens
  heavy chain complementarity determining region 3 for antibody 12584
ARDSRYCTSPKCYFWFDS

SEQ ID NO: 25169 - protein, 9 aa, Homo sapiens
  light chain complementarity determining region 3 for antibody 12585
QQRSNWRGT

SEQ ID NO: 25170 - protein, 15 aa, Homo sapiens
  heavy chain complementarity determining region 3 for antibody 12585
ARGRGGEISRAYSDF

SEQ ID NO: 25171 - protein, 8 aa, Homo sapiens
  light chain complementarity determining region 3 for antibody 12586
QQRSNWPT

SEQ ID NO: 25172 - protein, 19 aa, Homo sapiens
  heavy chain complementarity determining region 3 for antibody 12586
ARRFYPDSNGYYGTPLDDP

SEQ ID NO: 25173 - protein, 10 aa, Homo sapiens
  light chain complementarity determining region 3 for antibody 12587
QQRSNWPPWT

SEQ ID NO: 25174 - protein, 24 aa, Homo sapiens
  heavy chain complementarity determining region 3 for antibody 12587
ARDVVRPPAKDGRETNYYYYGTDV

SEQ ID NO: 25175 - protein, 11 aa, Homo sapiens
  light chain complementarity determining region 3 for antibody 12588
QQRSNWPPGFT

SEQ ID NO: 25176 - protein, 16 aa, Homo sapiens
  heavy chain complementarity determining region 3 for antibody 12588
ARRLGETAMALDAFDI

SEQ ID NO: 25177 - protein, 9 aa, Homo sapiens
  light chain complementarity determining region 3 for antibody 12589
QQRSNWLFT

SEQ ID NO: 25178 - protein, 15 aa, Homo sapiens
  heavy chain complementarity determining region 3 for antibody 12589
VRALSEVVVPYGMDV

SEQ ID NO: 25179 - protein, 9 aa, Homo sapiens
  light chain complementarity determining region 3 for antibody 12590
QQRRNWPLT

SEQ ID NO: 25180 - protein, 19 aa, Homo sapiens
  heavy chain complementarity determining region 3 for antibody 12590
ARDQSSSYGDYYSYYGMDV

SEQ ID NO: 25181 - protein, 9 aa, Homo sapiens
  light chain complementarity determining region 3 for antibody 12591
QQRGSWPET

SEQ ID NO: 25182 - protein, 18 aa, Homo sapiens
  heavy chain complementarity determining region 3 for antibody 12591
ARDHGGAYYDSNGYHFDY

SEQ ID NO: 25183 - protein, 11 aa, Homo sapiens
  light chain complementarity determining region 3 for antibody 12592
QQLNSFFGGLT

SEQ ID NO: 25184 - protein, 17 aa, Homo sapiens
  heavy chain complementarity determining region 3 for antibody 12592
AQRRRGSTGDLHAGFGS

SEQ ID NO: 25185 - protein, 9 aa, Homo sapiens
  light chain complementarity determining region 3 for antibody 12593
QQLHGYPLT

SEQ ID NO: 25186 - protein, 21 aa, Homo sapiens
  heavy chain complementarity determining region 3 for antibody 12593
ARDWAQANGYPVGHYYYGMDV

SEQ ID NO: 25187 - protein, 9 aa, Homo sapiens
  light chain complementarity determining region 3 for antibody 12594
QQFHSYPVT

SEQ ID NO: 25188 - protein, 16 aa, Homo sapiens
  heavy chain complementarity determining region 3 for antibody 12594
ARTQGTRDYYYYAMDV

SEQ ID NO: 25189 - protein, 9 aa, Homo sapiens
  light chain complementarity determining region 3 for antibody 12595
QQFHSYPIT

SEQ ID NO: 25190 - protein, 16 aa, Homo sapiens
  heavy chain complementarity determining region 3 for antibody 12595
ARTQGTRDYYCYAMDV

SEQ ID NO: 25191 - protein, 9 aa, Homo sapiens
  light chain complementarity determining region 3 for antibody 12596
QQFHSYPFT

SEQ ID NO: 25192 - protein, 16 aa, Homo sapiens
  heavy chain complementarity determining region 3 for antibody 12596
ARTQGTRDYYYYAMDV

SEQ ID NO: 25193 - protein, 10 aa, Homo sapiens
  light chain complementarity determining region 3 for antibody 12597
QQFDDPFPFT

SEQ ID NO: 25194 - protein, 13 aa, Homo sapiens
  heavy chain complementarity determining region 3 for antibody 12597
ARDSVGDSGYGST

SEQ ID NO: 25195 - protein, 9 aa, Homo sapiens
  light chain complementarity determining region 3 for antibody 12598
QQAYRFPLS

SEQ ID NO: 25196 - protein, 13 aa, Homo sapiens
  heavy chain complementarity determining region 3 for antibody 12598
TRTYGAGRNWFDP

SEQ ID NO: 25197 - protein, 9 aa, Homo sapiens
  light chain complementarity determining region 3 for antibody 12599
QQAISFPIT

SEQ ID NO: 25198 - protein, 21 aa, Homo sapiens
  heavy chain complementarity determining region 3 for antibody 12599
ATDRSFGSGSYDYYYFYGMDI

SEQ ID NO: 25199 - protein, 9 aa, Homo sapiens
  light chain complementarity determining region 3 for antibody 12600
QHYYSTPFT

SEQ ID NO: 25200 - protein, 25 aa, Homo sapiens
  heavy chain complementarity determining region 3 for antibody 12600
AKTERLYYFDSSNGRGYYYDGYFDS

SEQ ID NO: 25201 - protein, 9 aa, Homo sapiens
  light chain complementarity determining region 3 for antibody 12601
QHYNSYSST

SEQ ID NO: 25202 - protein, 21 aa, Homo sapiens
  heavy chain complementarity determining region 3 for antibody 12601
ASAVDIANVGRFGNYHYTMDV

SEQ ID NO: 25203 - protein, 9 aa, Homo sapiens
  light chain complementarity determining region 3 for antibody 12602
QHYKMSSVT

SEQ ID NO: 25204 - protein, 12 aa, Homo sapiens
  heavy chain complementarity determining region 3 for antibody 12602
ARLNWGVATIKY

SEQ ID NO: 25205 - protein, 10 aa, Homo sapiens
  light chain complementarity determining region 3 for antibody 12603
QHYGSSPPYI

SEQ ID NO: 25206 - protein, 14 aa, Homo sapiens
  heavy chain complementarity determining region 3 for antibody 12603
ARDLVAVAGTGLDS

SEQ ID NO: 25207 - protein, 9 aa, Homo sapiens
  light chain complementarity determining region 3 for antibody 12604
QHYGGSPYT

SEQ ID NO: 25208 - protein, 14 aa, Homo sapiens
  heavy chain complementarity determining region 3 for antibody 12604
ARDSTRLGGGDFDY

SEQ ID NO: 25209 - protein, 9 aa, Homo sapiens
  light chain complementarity determining region 3 for antibody 12605
QHNYRPSPA

SEQ ID NO: 25210 - protein, 11 aa, Homo sapiens
  heavy chain complementarity determining region 3 for antibody 12605
TRDPPGNGMGV

SEQ ID NO: 25211 - protein, 9 aa, Homo sapiens
  light chain complementarity determining region 3 for antibody 12606
MQAVQTPPT

SEQ ID NO: 25212 - protein, 17 aa, Homo sapiens
  heavy chain complementarity determining region 3 for antibody 12606
TKETDLAVAGYAEYFLH

SEQ ID NO: 25213 - protein, 10 aa, Homo sapiens
  light chain complementarity determining region 3 for antibody 12607
MQALQTPGFT

SEQ ID NO: 25214 - protein, 14 aa, Homo sapiens
  heavy chain complementarity determining region 3 for antibody 12607
ARDLNGYYYYGMDV

SEQ ID NO: 25215 - protein, 8 aa, Homo sapiens
  light chain complementarity determining region 3 for antibody 12608
MQALQTPF

SEQ ID NO: 25216 - protein, 24 aa, Homo sapiens
  heavy chain complementarity determining region 3 for antibody 12608
ARNWRSDSAYDYSTSSYFYYGMDV

SEQ ID NO: 25217 - protein, 10 aa, Homo sapiens
  light chain complementarity determining region 3 for antibody 12609
MQALQNPRFT

SEQ ID NO: 25218 - protein, 19 aa, Homo sapiens
  heavy chain complementarity determining region 3 for antibody 12609
ATAPYRRSTASVPQPQFDS

SEQ ID NO: 25219 - protein, 9 aa, Homo sapiens
  light chain complementarity determining region 3 for antibody 12610
LQHYSYPWT

SEQ ID NO: 25220 - protein, 13 aa, Homo sapiens
  heavy chain complementarity determining region 3 for antibody 12610
TTDLRGTDGRGNW

SEQ ID NO: 25221 - protein, 9 aa, Homo sapiens
  light chain complementarity determining region 3 for antibody 12611
LQANSFPPT

SEQ ID NO: 25222 - protein, 15 aa, Homo sapiens
  heavy chain complementarity determining region 3 for antibody 12611
AKFTFGDFWSAYPDY

SEQ ID NO: 25223 - protein, 10 aa, Homo sapiens
  light chain complementarity determining region 3 for antibody 12612
HYHGYSPLYT

SEQ ID NO: 25224 - protein, 12 aa, Homo sapiens
  heavy chain complementarity determining region 3 for antibody 12612
AKGILGRGGMDV

SEQ ID NO: 25225 - protein, 9 aa, Homo sapiens
  light chain complementarity determining region 3 for antibody 12613
HQYGGSWYT

SEQ ID NO: 25226 - protein, 20 aa, Homo sapiens
  heavy chain complementarity determining region 3 for antibody 12613
ARDPHRYGGKDSLYHYGLDV

SEQ ID NO: 25227 - protein, 9 aa, Homo sapiens
  light chain complementarity determining region 3 for antibody 12614
HQSIRLPQT

SEQ ID NO: 25228 - protein, 10 aa, Homo sapiens
  heavy chain complementarity determining region 3 for antibody 12614
ARDDFDAFDI

SEQ ID NO: 25229 - protein, 10 aa, Homo sapiens
  light chain complementarity determining region 3 for antibody 12615
FQGSHWPPFT

SEQ ID NO: 25230 - protein, 9 aa, Homo sapiens
  heavy chain complementarity determining region 3 for antibody 12615
VRNNYHMDV

SEQ ID NO: 25231 - protein, 10 aa, Homo sapiens
  light chain complementarity determining region 3 for antibody 12616
QYHGYSPLYT

SEQ ID NO: 25232 - protein, 12 aa, Homo sapiens
  heavy chain complementarity determining region 3 for antibody 12616
AKGISGRGGMDV

SEQ ID NO: 25233 - protein, 10 aa, Homo sapiens
  light chain complementarity determining region 3 for antibody 12617
QYHGYSPLYT

SEQ ID NO: 25234 - protein, 12 aa, Homo sapiens
  heavy chain complementarity determining region 3 for antibody 12617
AKGILGRGGMGV

SEQ ID NO: 25235 - protein, 9 aa, Homo sapiens
  light chain complementarity determining region 3 for antibody 12618
QVYNNAPWT

SEQ ID NO: 25236 - protein, 15 aa, Homo sapiens
  heavy chain complementarity determining region 3 for antibody 12618
GRHRYSSSQGYGMDV

SEQ ID NO: 25237 - protein, 9 aa, Homo sapiens
  light chain complementarity determining region 3 for antibody 12619
QRRNSYPYT

SEQ ID NO: 25238 - protein, 9 aa, Homo sapiens
  heavy chain complementarity determining region 3 for antibody 12619
VAYLAGYPR

SEQ ID NO: 25239 - protein, 9 aa, Homo sapiens
  light chain complementarity determining region 3 for antibody 12620
QQYYTSPLT

SEQ ID NO: 25240 - protein, 16 aa, Homo sapiens
  heavy chain complementarity determining region 3 for antibody 12620
AGRGGLVIGPGGWFDP

SEQ ID NO: 25241 - protein, 10 aa, Homo sapiens
  light chain complementarity determining region 3 for antibody 12621
QQYVSSELFT

SEQ ID NO: 25242 - protein, 16 aa, Homo sapiens
  heavy chain complementarity determining region 3 for antibody 12621
AREIFKGESDYYAMDV

SEQ ID NO: 25243 - protein, 8 aa, Homo sapiens
  light chain complementarity determining region 3 for antibody 12622
QQYVSPYT

SEQ ID NO: 25244 - protein, 13 aa, Homo sapiens
  heavy chain complementarity determining region 3 for antibody 12622
AYKVRYANYYFDV

SEQ ID NO: 25245 - protein, 9 aa, Homo sapiens
  light chain complementarity determining region 3 for antibody 12623
QQYSTYSYT

SEQ ID NO: 25246 - protein, 17 aa, Homo sapiens
  heavy chain complementarity determining region 3 for antibody 12623
ARGAMQQWLGGLNWFDP

SEQ ID NO: 25247 - protein, 9 aa, Homo sapiens
  light chain complementarity determining region 3 for antibody 12624
QQYSDWPRT

SEQ ID NO: 25248 - protein, 12 aa, Homo sapiens
  heavy chain complementarity determining region 3 for antibody 12624
ARGKKRADVFDL

SEQ ID NO: 25249 - protein, 9 aa, Homo sapiens
  light chain complementarity determining region 3 for antibody 12625
QQYNYWPRT

SEQ ID NO: 25250 - protein, 17 aa, Homo sapiens
  heavy chain complementarity determining region 3 for antibody 12625
ATEDPNSCSGGSCFLDS

SEQ ID NO: 25251 - protein, 8 aa, Homo sapiens
  light chain complementarity determining region 3 for antibody 12626
QQYNTFSS

SEQ ID NO: 25252 - protein, 20 aa, Homo sapiens
  heavy chain complementarity determining region 3 for antibody 12626
AKSLTYHYGSGSFREWYFDV

SEQ ID NO: 25253 - protein, 9 aa, Homo sapiens
  light chain complementarity determining region 3 for antibody 12627
QQYNTFPYT

SEQ ID NO: 25254 - protein, 17 aa, Homo sapiens
  heavy chain complementarity determining region 3 for antibody 12627
AREDWNDVDLRQFYFDY

SEQ ID NO: 25255 - protein, 9 aa, Homo sapiens
  light chain complementarity determining region 3 for antibody 12628
QQYNSYRYT

SEQ ID NO: 25256 - protein, 20 aa, Homo sapiens
  heavy chain complementarity determining region 3 for antibody 12628
AGTYGSGTYSPDYYYFGMDV

SEQ ID NO: 25257 - protein, 8 aa, Homo sapiens
  light chain complementarity determining region 3 for antibody 12629
QQYNNWYT

SEQ ID NO: 25258 - protein, 15 aa, Homo sapiens
  heavy chain complementarity determining region 3 for antibody 12629
AKRPYHFATEYYFDS

SEQ ID NO: 25259 - protein, 11 aa, Homo sapiens
  light chain complementarity determining region 3 for antibody 12630
QQYNNWPPVLT

SEQ ID NO: 25260 - protein, 19 aa, Homo sapiens
  heavy chain complementarity determining region 3 for antibody 12630
ARDRDYTIVDDYGSGVFDY

SEQ ID NO: 25261 - protein, 9 aa, Homo sapiens
  light chain complementarity determining region 3 for antibody 12631
QQYHSPLYT

SEQ ID NO: 25262 - protein, 13 aa, Homo sapiens
  heavy chain complementarity determining region 3 for antibody 12631
AHIGCRGASCYPV

SEQ ID NO: 25263 - protein, 9 aa, Homo sapiens
  light chain complementarity determining region 3 for antibody 12632
QQYGSSPYT

SEQ ID NO: 25264 - protein, 13 aa, Homo sapiens
  heavy chain complementarity determining region 3 for antibody 12632
ARGAIYNSGPYSL

SEQ ID NO: 25265 - protein, 8 aa, Homo sapiens
  light chain complementarity determining region 3 for antibody 12633
QQYGSSPT

SEQ ID NO: 25266 - protein, 20 aa, Homo sapiens
  heavy chain complementarity determining region 3 for antibody 12633
ATRTSGKYSSSDDYYYGMDV

SEQ ID NO: 25267 - protein, 9 aa, Homo sapiens
  light chain complementarity determining region 3 for antibody 12634
QQYGSSPET

SEQ ID NO: 25268 - protein, 13 aa, Homo sapiens
  heavy chain complementarity determining region 3 for antibody 12634
ATSLFRGGWALDH

SEQ ID NO: 25269 - protein, 9 aa, Homo sapiens
  light chain complementarity determining region 3 for antibody 12635
QQYGHSPQT

SEQ ID NO: 25270 - protein, 9 aa, Homo sapiens
  heavy chain complementarity determining region 3 for antibody 12635
ARGRGPTHY

SEQ ID NO: 25271 - protein, 10 aa, Homo sapiens
  light chain complementarity determining region 3 for antibody 12636
QQYDTSLMYT

SEQ ID NO: 25272 - protein, 17 aa, Homo sapiens
  heavy chain complementarity determining region 3 for antibody 12636
AKDGRHSSTWYPRGFDF

SEQ ID NO: 25273 - protein, 9 aa, Homo sapiens
  light chain complementarity determining region 3 for antibody 12637
QQYDSYPYT

SEQ ID NO: 25274 - protein, 13 aa, Homo sapiens
  heavy chain complementarity determining region 3 for antibody 12637
AKGLDGYDLIGDT

SEQ ID NO: 25275 - protein, 10 aa, Homo sapiens
  light chain complementarity determining region 3 for antibody 12638
QQYDNLPPIT

SEQ ID NO: 25276 - protein, 16 aa, Homo sapiens
  heavy chain complementarity determining region 3 for antibody 12638
AKATHGDYDRRIWFDP

SEQ ID NO: 25277 - protein, 9 aa, Homo sapiens
  light chain complementarity determining region 3 for antibody 12639
QQYDNLPLT

SEQ ID NO: 25278 - protein, 11 aa, Homo sapiens
  heavy chain complementarity determining region 3 for antibody 12639
AREVRSGIYSR

SEQ ID NO: 25279 - protein, 9 aa, Homo sapiens
  light chain complementarity determining region 3 for antibody 12640
QQTYIAPIT

SEQ ID NO: 25280 - protein, 18 aa, Homo sapiens
  heavy chain complementarity determining region 3 for antibody 12640
VRDHRYCRGGSCCHLFDS

SEQ ID NO: 25281 - protein, 9 aa, Homo sapiens
  light chain complementarity determining region 3 for antibody 12641
QQSYSTPVT

SEQ ID NO: 25282 - protein, 17 aa, Homo sapiens
  heavy chain complementarity determining region 3 for antibody 12641
ARNRGSTLVRDQDSMDV

SEQ ID NO: 25283 - protein, 9 aa, Homo sapiens
  light chain complementarity determining region 3 for antibody 12642
QQSYSTPRT

SEQ ID NO: 25284 - protein, 21 aa, Homo sapiens
  heavy chain complementarity determining region 3 for antibody 12642
ARDWPDYGGNFGPLGWYGMDV

SEQ ID NO: 25285 - protein, 9 aa, Homo sapiens
  light chain complementarity determining region 3 for antibody 12643
QQSYSTPLT

SEQ ID NO: 25286 - protein, 15 aa, Homo sapiens
  heavy chain complementarity determining region 3 for antibody 12643
TRYCDTANCHASLDL

SEQ ID NO: 25287 - protein, 9 aa, Homo sapiens
  light chain complementarity determining region 3 for antibody 12644
QQSYSTPHT

SEQ ID NO: 25288 - protein, 15 aa, Homo sapiens
  heavy chain complementarity determining region 3 for antibody 12644
ARDSDDSGGLYRFED

SEQ ID NO: 25289 - protein, 9 aa, Homo sapiens
  light chain complementarity determining region 3 for antibody 12645
QQSHTIRWT

SEQ ID NO: 25290 - protein, 14 aa, Homo sapiens
  heavy chain complementarity determining region 3 for antibody 12645
ARTGPSGTYSGFDS

SEQ ID NO: 25291 - protein, 10 aa, Homo sapiens
  light chain complementarity determining region 3 for antibody 12646
QQSFSPPSPT

SEQ ID NO: 25292 - protein, 10 aa, Homo sapiens
  heavy chain complementarity determining region 3 for antibody 12646
ARDWGWGFDP

SEQ ID NO: 25293 - protein, 9 aa, Homo sapiens
  light chain complementarity determining region 3 for antibody 12647
QQSFSPPRA

SEQ ID NO: 25294 - protein, 19 aa, Homo sapiens
  heavy chain complementarity determining region 3 for antibody 12647
ATMRYGSGELTYDYYGMDV

SEQ ID NO: 25295 - protein, 9 aa, Homo sapiens
  light chain complementarity determining region 3 for antibody 12648
QQRSNWRDP

SEQ ID NO: 25296 - protein, 15 aa, Homo sapiens
  heavy chain complementarity determining region 3 for antibody 12648
ARGRGGEISRAYSDF

SEQ ID NO: 25297 - protein, 8 aa, Homo sapiens
  light chain complementarity determining region 3 for antibody 12649
QQRSNWPT

SEQ ID NO: 25298 - protein, 17 aa, Homo sapiens
  heavy chain complementarity determining region 3 for antibody 12649
AREDLGYYHDSGGYIQH

SEQ ID NO: 25299 - protein, 10 aa, Homo sapiens
  light chain complementarity determining region 3 for antibody 12650
QQRSNWPILT

SEQ ID NO: 25300 - protein, 14 aa, Homo sapiens
  heavy chain complementarity determining region 3 for antibody 12650
ARLNKMTRIRYFDS

SEQ ID NO: 25301 - protein, 9 aa, Homo sapiens
  light chain complementarity determining region 3 for antibody 12651
QQRSNWGLT

SEQ ID NO: 25302 - protein, 22 aa, Homo sapiens
  heavy chain complementarity determining region 3 for antibody 12651
ARHSGYSNTWYMNYYYYYGMDV

SEQ ID NO: 25303 - protein, 9 aa, Homo sapiens
  light chain complementarity determining region 3 for antibody 12652
QQRSNGPWT

SEQ ID NO: 25304 - protein, 16 aa, Homo sapiens
  heavy chain complementarity determining region 3 for antibody 12652
AKDLGGWFGNDNALDI

SEQ ID NO: 25305 - protein, 9 aa, Homo sapiens
  light chain complementarity determining region 3 for antibody 12653
QQRSIWPPT

SEQ ID NO: 25306 - protein, 17 aa, Homo sapiens
  heavy chain complementarity determining region 3 for antibody 12653
ARGFIKGVRTRPGWFDP

SEQ ID NO: 25307 - protein, 8 aa, Homo sapiens
  light chain complementarity determining region 3 for antibody 12654
QQRSHWPT

SEQ ID NO: 25308 - protein, 16 aa, Homo sapiens
  heavy chain complementarity determining region 3 for antibody 12654
ARATDYTGDLPWYFDL

SEQ ID NO: 25309 - protein, 12 aa, Homo sapiens
  light chain complementarity determining region 3 for antibody 12655
QQRISWPWGSWT

SEQ ID NO: 25310 - protein, 10 aa, Homo sapiens
  heavy chain complementarity determining region 3 for antibody 12655
ARAFTRFAGL

SEQ ID NO: 25311 - protein, 9 aa, Homo sapiens
  light chain complementarity determining region 3 for antibody 12656
QQIYSTPYT

SEQ ID NO: 25312 - protein, 19 aa, Homo sapiens
  heavy chain complementarity determining region 3 for antibody 12656
VRGFMEDYYDGSDSYHGDC

SEQ ID NO: 25313 - protein, 9 aa, Homo sapiens
  light chain complementarity determining region 3 for antibody 12657
QQFNTYPLT

SEQ ID NO: 25314 - protein, 17 aa, Homo sapiens
  heavy chain complementarity determining region 3 for antibody 12657
AKDLSGVHYDIHRGLDV

SEQ ID NO: 25315 - protein, 9 aa, Homo sapiens
  light chain complementarity determining region 3 for antibody 12658
QQFNTYPIT

SEQ ID NO: 25316 - protein, 19 aa, Homo sapiens
  heavy chain complementarity determining region 3 for antibody 12658
ARVNNRYSSDSLDTDPFDI

SEQ ID NO: 25317 - protein, 9 aa, Homo sapiens
  light chain complementarity determining region 3 for antibody 12659
QQFNSYPLT

SEQ ID NO: 25318 - protein, 16 aa, Homo sapiens
  heavy chain complementarity determining region 3 for antibody 12659
ARGGLLWSGELTWFDP

SEQ ID NO: 25319 - protein, 10 aa, Homo sapiens
  light chain complementarity determining region 3 for antibody 12660
QQFDNWPPWT

SEQ ID NO: 25320 - protein, 17 aa, Homo sapiens
  heavy chain complementarity determining region 3 for antibody 12660
GRNRRGFSYGYGGFFDS

SEQ ID NO: 25321 - protein, 9 aa, Homo sapiens
  light chain complementarity determining region 3 for antibody 12661
QQANSFPYP

SEQ ID NO: 25322 - protein, 22 aa, Homo sapiens
  heavy chain complementarity determining region 3 for antibody 12661
ARDRVGEAAAGTRYYHYYGMDV

SEQ ID NO: 25323 - protein, 11 aa, Homo sapiens
  light chain complementarity determining region 3 for antibody 12662
QQANSFPPQGT

SEQ ID NO: 25324 - protein, 18 aa, Homo sapiens
  heavy chain complementarity determining region 3 for antibody 12662
ARGRSCSSNRCPTVWFDP

SEQ ID NO: 25325 - protein, 9 aa, Homo sapiens
  light chain complementarity determining region 3 for antibody 12663
QQANSFPLT

SEQ ID NO: 25326 - protein, 13 aa, Homo sapiens
  heavy chain complementarity determining region 3 for antibody 12663
AKDRWGSSGPFDY

SEQ ID NO: 25327 - protein, 8 aa, Homo sapiens
  light chain complementarity determining region 3 for antibody 12664
QQAHSFPP

SEQ ID NO: 25328 - protein, 22 aa, Homo sapiens
  heavy chain complementarity determining region 3 for antibody 12664
ARHSGYSNTWYMNYYYYCGMDV

SEQ ID NO: 25329 - protein, 9 aa, Homo sapiens
  light chain complementarity determining region 3 for antibody 12665
QQAHIFPLT

SEQ ID NO: 25330 - protein, 16 aa, Homo sapiens
  heavy chain complementarity determining region 3 for antibody 12665
ARDTAVDGSGWFYFDY

SEQ ID NO: 25331 - protein, 9 aa, Homo sapiens
  light chain complementarity determining region 3 for antibody 12666
QHNYRPSPP

SEQ ID NO: 25332 - protein, 11 aa, Homo sapiens
  heavy chain complementarity determining region 3 for antibody 12666
TRDPPGNGMDV

SEQ ID NO: 25333 - protein, 9 aa, Homo sapiens
  light chain complementarity determining region 3 for antibody 12667
QHAYRFPLS

SEQ ID NO: 25334 - protein, 13 aa, Homo sapiens
  heavy chain complementarity determining region 3 for antibody 12667
TRTYGSGRNWFDP

SEQ ID NO: 25335 - protein, 9 aa, Homo sapiens
  light chain complementarity determining region 3 for antibody 12668
QGHNNAPWT

SEQ ID NO: 25336 - protein, 15 aa, Homo sapiens
  heavy chain complementarity determining region 3 for antibody 12668
GRHRYSSSQGYGMDV

SEQ ID NO: 25337 - protein, 10 aa, Homo sapiens
  light chain complementarity determining region 3 for antibody 12669
QFYRDWPGGT

SEQ ID NO: 25338 - protein, 17 aa, Homo sapiens
  heavy chain complementarity determining region 3 for antibody 12669
AKEIWIVNRPGGDAFDM

SEQ ID NO: 25339 - protein, 9 aa, Homo sapiens
  light chain complementarity determining region 3 for antibody 12670
MQSTHWPYT

SEQ ID NO: 25340 - protein, 14 aa, Homo sapiens
  heavy chain complementarity determining region 3 for antibody 12670
VRDSYFDWPASGDY

SEQ ID NO: 25341 - protein, 10 aa, Homo sapiens
  light chain complementarity determining region 3 for antibody 12671
MQSLQTPHFT

SEQ ID NO: 25342 - protein, 19 aa, Homo sapiens
  heavy chain complementarity determining region 3 for antibody 12671
ARHPRDKTVAGIRLGGGDY

SEQ ID NO: 25343 - protein, 9 aa, Homo sapiens
  light chain complementarity determining region 3 for antibody 12672
MQGTHWPYT

SEQ ID NO: 25344 - protein, 15 aa, Homo sapiens
  heavy chain complementarity determining region 3 for antibody 12672
ATLLTWGSRTTNFDY

SEQ ID NO: 25345 - protein, 9 aa, Homo sapiens
  light chain complementarity determining region 3 for antibody 12673
MQGSHWPHT

SEQ ID NO: 25346 - protein, 11 aa, Homo sapiens
  heavy chain complementarity determining region 3 for antibody 12673
GRDPCHGAIDY

SEQ ID NO: 25347 - protein, 9 aa, Homo sapiens
  light chain complementarity determining region 3 for antibody 12674
MQATHWPLT

SEQ ID NO: 25348 - protein, 15 aa, Homo sapiens
  heavy chain complementarity determining region 3 for antibody 12674
ARDRPHILTGVLMDV

SEQ ID NO: 25349 - protein, 6 aa, Homo sapiens
  light chain complementarity determining region 3 for antibody 12675
MQAPWT

SEQ ID NO: 25350 - protein, 13 aa, Homo sapiens
  heavy chain complementarity determining region 3 for antibody 12675
ARVPIGESLFFDY

SEQ ID NO: 25351 - protein, 10 aa, Homo sapiens
  light chain complementarity determining region 3 for antibody 12676
MQALQTPRFT

SEQ ID NO: 25352 - protein, 18 aa, Homo sapiens
  heavy chain complementarity determining region 3 for antibody 12676
ARMGSRQPGKIYYYESVV

SEQ ID NO: 25353 - protein, 9 aa, Homo sapiens
  light chain complementarity determining region 3 for antibody 12677
LQRSTCPLT

SEQ ID NO: 25354 - protein, 21 aa, Homo sapiens
  heavy chain complementarity determining region 3 for antibody 12677
TTYCSSGTCYSSLAAEGAFDV

SEQ ID NO: 25355 - protein, 8 aa, Homo sapiens
  light chain complementarity determining region 3 for antibody 12678
LQRSNRGT

SEQ ID NO: 25356 - protein, 16 aa, Homo sapiens
  heavy chain complementarity determining region 3 for antibody 12678
ATHDYVWGIYRKKVDY

SEQ ID NO: 25357 - protein, 8 aa, Homo sapiens
  light chain complementarity determining region 3 for antibody 12679
HQYYRIPT

SEQ ID NO: 25358 - protein, 28 aa, Homo sapiens
  heavy chain complementarity determining region 3 for antibody 12679
ARTRREAPYYDPLTGYYESVHYYYAMDV

SEQ ID NO: 25359 - protein, 9 aa, Homo sapiens
  light chain complementarity determining region 3 for antibody 12680
VQALQTPTT

SEQ ID NO: 25360 - protein, 21 aa, Homo sapiens
  heavy chain complementarity determining region 3 for antibody 12680
VRGEAYNDILTGLPRLRRLDN

SEQ ID NO: 25361 - protein, 9 aa, Homo sapiens
  light chain complementarity determining region 3 for antibody 12681
RKYDSAPLT

SEQ ID NO: 25362 - protein, 18 aa, Homo sapiens
  heavy chain complementarity determining region 3 for antibody 12681
ARDSYDVLTGPNPGGLDV

SEQ ID NO: 25363 - protein, 10 aa, Homo sapiens
  light chain complementarity determining region 3 for antibody 12682
QYHGYSPMYT

SEQ ID NO: 25364 - protein, 12 aa, Homo sapiens
  heavy chain complementarity determining region 3 for antibody 12682
AKGILGRGGMDV

SEQ ID NO: 25365 - protein, 10 aa, Homo sapiens
  light chain complementarity determining region 3 for antibody 12683
QYHGYSPLCT

SEQ ID NO: 25366 - protein, 12 aa, Homo sapiens
  heavy chain complementarity determining region 3 for antibody 12683
AKGILGRGGMDV

SEQ ID NO: 25367 - protein, 8 aa, Homo sapiens
  light chain complementarity determining region 3 for antibody 12684
QRYGNLLT

SEQ ID NO: 25368 - protein, 20 aa, Homo sapiens
  heavy chain complementarity determining region 3 for antibody 12684
SKDRSVNAAMDYYYYSAMDV

SEQ ID NO: 25369 - protein, 9 aa, Homo sapiens
  light chain complementarity determining region 3 for antibody 12685
QRTCTAPIT

SEQ ID NO: 25370 - protein, 9 aa, Homo sapiens
  heavy chain complementarity determining region 3 for antibody 12685
VRGYDVFDY

SEQ ID NO: 25371 - protein, 9 aa, Homo sapiens
  light chain complementarity determining region 3 for antibody 12686
QQYYSYPLT

SEQ ID NO: 25372 - protein, 20 aa, Homo sapiens
  heavy chain complementarity determining region 3 for antibody 12686
ARLRGSGLTSSYQHRDGADV

SEQ ID NO: 25373 - protein, 8 aa, Homo sapiens
  light chain complementarity determining region 3 for antibody 12687
QQYYSTRT

SEQ ID NO: 25374 - protein, 16 aa, Homo sapiens
  heavy chain complementarity determining region 3 for antibody 12687
VTHLVVYDSGEGYVDY

SEQ ID NO: 25375 - protein, 9 aa, Homo sapiens
  light chain complementarity determining region 3 for antibody 12688
QQYYSTPYR

SEQ ID NO: 25376 - protein, 13 aa, Homo sapiens
  heavy chain complementarity determining region 3 for antibody 12688
AKATSDGSGALHY

SEQ ID NO: 25377 - protein, 9 aa, Homo sapiens
  light chain complementarity determining region 3 for antibody 12689
QQYYHLPVT

SEQ ID NO: 25378 - protein, 20 aa, Homo sapiens
  heavy chain complementarity determining region 3 for antibody 12689
ARGRGESRLSGGRGSYILDS

SEQ ID NO: 25379 - protein, 10 aa, Homo sapiens
  light chain complementarity determining region 3 for antibody 12690
QQYVSSELFT

SEQ ID NO: 25380 - protein, 16 aa, Homo sapiens
  heavy chain complementarity determining region 3 for antibody 12690
AREIFKGEIDYCAMDV

SEQ ID NO: 25381 - protein, 10 aa, Homo sapiens
  light chain complementarity determining region 3 for antibody 12691
QQYVRSELFT

SEQ ID NO: 25382 - protein, 16 aa, Homo sapiens
  heavy chain complementarity determining region 3 for antibody 12691
AREIFKGEIDYYAMDV

SEQ ID NO: 25383 - protein, 10 aa, Homo sapiens
  light chain complementarity determining region 3 for antibody 12692
QQYVPSPKYT

SEQ ID NO: 25384 - protein, 22 aa, Homo sapiens
  heavy chain complementarity determining region 3 for antibody 12692
ARHSPFLEMLGERWLQFGAFDI

SEQ ID NO: 25385 - protein, 9 aa, Homo sapiens
  light chain complementarity determining region 3 for antibody 12693
QQYSSFPYT

SEQ ID NO: 25386 - protein, 17 aa, Homo sapiens
  heavy chain complementarity determining region 3 for antibody 12693
AREDWNDVDLRQWYFDS

SEQ ID NO: 25387 - protein, 9 aa, Homo sapiens
  light chain complementarity determining region 3 for antibody 12694
QQYSRYPGT

SEQ ID NO: 25388 - protein, 11 aa, Homo sapiens
  heavy chain complementarity determining region 3 for antibody 12694
AREQTGYYPLY

SEQ ID NO: 25389 - protein, 8 aa, Homo sapiens
  light chain complementarity determining region 3 for antibody 12695
QQYSDWWT

SEQ ID NO: 25390 - protein, 11 aa, Homo sapiens
  heavy chain complementarity determining region 3 for antibody 12695
ARSSWMVGFDH

SEQ ID NO: 25391 - protein, 9 aa, Homo sapiens
  light chain complementarity determining region 3 for antibody 12696
QQYNSYWYT

SEQ ID NO: 25392 - protein, 20 aa, Homo sapiens
  heavy chain complementarity determining region 3 for antibody 12696
AGTYGSGTYSPDYYCFGMDV

SEQ ID NO: 25393 - protein, 9 aa, Homo sapiens
  light chain complementarity determining region 3 for antibody 12697
QQYNSYWYT

SEQ ID NO: 25394 - protein, 20 aa, Homo sapiens
  heavy chain complementarity determining region 3 for antibody 12697
AGTYGAGTYSPDYYYFGMDV

SEQ ID NO: 25395 - protein, 8 aa, Homo sapiens
  light chain complementarity determining region 3 for antibody 12698
QQYNSYSA

SEQ ID NO: 25396 - protein, 15 aa, Homo sapiens
  heavy chain complementarity determining region 3 for antibody 12698
ARAYSRGWYPESFDF

SEQ ID NO: 25397 - protein, 9 aa, Homo sapiens
  light chain complementarity determining region 3 for antibody 12699
QQYNSYCYT

SEQ ID NO: 25398 - protein, 20 aa, Homo sapiens
  heavy chain complementarity determining region 3 for antibody 12699
AGTYGSGTYSPDYYYFGMDV

SEQ ID NO: 25399 - protein, 10 aa, Homo sapiens
  light chain complementarity determining region 3 for antibody 12700
QQYNNWPPLT

SEQ ID NO: 25400 - protein, 13 aa, Homo sapiens
  heavy chain complementarity determining region 3 for antibody 12700
AVFSGPADPPVGY

SEQ ID NO: 25401 - protein, 9 aa, Homo sapiens
  light chain complementarity determining region 3 for antibody 12701
QQYNNWPLT

SEQ ID NO: 25402 - protein, 16 aa, Homo sapiens
  heavy chain complementarity determining region 3 for antibody 12701
ARTISVDAAMVEVFDY

SEQ ID NO: 25403 - protein, 9 aa, Homo sapiens
  light chain complementarity determining region 3 for antibody 12702
QQYNNLPYT

SEQ ID NO: 25404 - protein, 13 aa, Homo sapiens
  heavy chain complementarity determining region 3 for antibody 12702
ARAKWGLFGYFDF

SEQ ID NO: 25405 - protein, 9 aa, Homo sapiens
  light chain complementarity determining region 3 for antibody 12703
QQYHSYPLT

SEQ ID NO: 25406 - protein, 15 aa, Homo sapiens
  heavy chain complementarity determining region 3 for antibody 12703
ARGGIHYDILTGLGY

SEQ ID NO: 25407 - protein, 9 aa, Homo sapiens
  light chain complementarity determining region 3 for antibody 12704
QQYGTSWST

SEQ ID NO: 25408 - protein, 20 aa, Homo sapiens
  heavy chain complementarity determining region 3 for antibody 12704
ARDPHRYGGKDLLYHYGMDV

SEQ ID NO: 25409 - protein, 9 aa, Homo sapiens
  light chain complementarity determining region 3 for antibody 12705
QQYGSSSRT

SEQ ID NO: 25410 - protein, 20 aa, Homo sapiens
  heavy chain complementarity determining region 3 for antibody 12705
AREVSSGWFAFRVDYYGMDV

SEQ ID NO: 25411 - protein, 9 aa, Homo sapiens
  light chain complementarity determining region 3 for antibody 12706
QQYGSSRYT

SEQ ID NO: 25412 - protein, 23 aa, Homo sapiens
  heavy chain complementarity determining region 3 for antibody 12706
ARVGCSGEKCSSMSGYYYCALDV

SEQ ID NO: 25413 - protein, 9 aa, Homo sapiens
  light chain complementarity determining region 3 for antibody 12707
QQYGSSPPP

SEQ ID NO: 25414 - protein, 12 aa, Homo sapiens
  heavy chain complementarity determining region 3 for antibody 12707
ASGFLEWSLYEY

SEQ ID NO: 25415 - protein, 11 aa, Homo sapiens
  light chain complementarity determining region 3 for antibody 12708
QQYGSSPPKLT

SEQ ID NO: 25416 - protein, 12 aa, Homo sapiens
  heavy chain complementarity determining region 3 for antibody 12708
AMSVNIAAPPVA

SEQ ID NO: 25417 - protein, 9 aa, Homo sapiens
  light chain complementarity determining region 3 for antibody 12709
QQYGSSPIT

SEQ ID NO: 25418 - protein, 21 aa, Homo sapiens
  heavy chain complementarity determining region 3 for antibody 12709
AGAQYYWSRGRASYQYYGMEA

SEQ ID NO: 25419 - protein, 9 aa, Homo sapiens
  light chain complementarity determining region 3 for antibody 12710
QQYGSSPIP

SEQ ID NO: 25420 - protein, 6 aa, Homo sapiens
  heavy chain complementarity determining region 3 for antibody 12710
AITILG

SEQ ID NO: 25421 - protein, 9 aa, Homo sapiens
  light chain complementarity determining region 3 for antibody 12711
QQYGSSLWT

SEQ ID NO: 25422 - protein, 16 aa, Homo sapiens
  heavy chain complementarity determining region 3 for antibody 12711
ARGGFGELGLHNAFDV

SEQ ID NO: 25423 - protein, 13 aa, Homo sapiens
  light chain complementarity determining region 3 for antibody 12712
QQYGSSGGASART

SEQ ID NO: 25424 - protein, 19 aa, Homo sapiens
  heavy chain complementarity determining region 3 for antibody 12712
ASLWVDPTAQNYYSYGLDV

SEQ ID NO: 25425 - protein, 8 aa, Homo sapiens
  light chain complementarity determining region 3 for antibody 12713
QQYGSSFT

SEQ ID NO: 25426 - protein, 11 aa, Homo sapiens
  heavy chain complementarity determining region 3 for antibody 12713
ARTHPSGYFDH

SEQ ID NO: 25427 - protein, 8 aa, Homo sapiens
  light chain complementarity determining region 3 for antibody 12714
QQYGNLLT

SEQ ID NO: 25428 - protein, 20 aa, Homo sapiens
  heavy chain complementarity determining region 3 for antibody 12714
SKDRAVNAAMDYYYYSAMDV

SEQ ID NO: 25429 - protein, 10 aa, Homo sapiens
  light chain complementarity determining region 3 for antibody 12715
QQYGALPPWT

SEQ ID NO: 25430 - protein, 16 aa, Homo sapiens
  heavy chain complementarity determining region 3 for antibody 12715
ARGGIEAWRYFYGMEV

SEQ ID NO: 25431 - protein, 10 aa, Homo sapiens
  light chain complementarity determining region 3 for antibody 12716
QQYGALPPWT

SEQ ID NO: 25432 - protein, 16 aa, Homo sapiens
  heavy chain complementarity determining region 3 for antibody 12716
ARGGIEAWRYCYGMDV

SEQ ID NO: 25433 - protein, 9 aa, Homo sapiens
  light chain complementarity determining region 3 for antibody 12717
QQYFSTPLT

SEQ ID NO: 25434 - protein, 14 aa, Homo sapiens
  heavy chain complementarity determining region 3 for antibody 12717
ARRGAGDAAMLTAY

SEQ ID NO: 25435 - protein, 9 aa, Homo sapiens
  light chain complementarity determining region 3 for antibody 12718
QQYDSLPLT

SEQ ID NO: 25436 - protein, 18 aa, Homo sapiens
  heavy chain complementarity determining region 3 for antibody 12718
ARAPGEYDMLRRGYYFDH

SEQ ID NO: 25437 - protein, 10 aa, Homo sapiens
  light chain complementarity determining region 3 for antibody 12719
QQYDNVPPFT

SEQ ID NO: 25438 - protein, 7 aa, Homo sapiens
  heavy chain complementarity determining region 3 for antibody 12719
ARVPGFS

SEQ ID NO: 25439 - protein, 9 aa, Homo sapiens
  light chain complementarity determining region 3 for antibody 12720
QQYDNLLWT

SEQ ID NO: 25440 - protein, 11 aa, Homo sapiens
  heavy chain complementarity determining region 3 for antibody 12720
AGGWELLSPDY

SEQ ID NO: 25441 - protein, 8 aa, Homo sapiens
  light chain complementarity determining region 3 for antibody 12721
QQYDNLLT

SEQ ID NO: 25442 - protein, 20 aa, Homo sapiens
  heavy chain complementarity determining region 3 for antibody 12721
AKDRSANAAMDYYYYSGMDV

SEQ ID NO: 25443 - protein, 9 aa, Homo sapiens
  light chain complementarity determining region 3 for antibody 12722
QQYDNFPPP

SEQ ID NO: 25444 - protein, 20 aa, Homo sapiens
  heavy chain complementarity determining region 3 for antibody 12722
ARLLGYCSGGSCQAHKLFDF

SEQ ID NO: 25445 - protein, 9 aa, Homo sapiens
  light chain complementarity determining region 3 for antibody 12723
QQSYTTPRT

SEQ ID NO: 25446 - protein, 19 aa, Homo sapiens
  heavy chain complementarity determining region 3 for antibody 12723
ARDGPILRFFDDPVYGIDV

SEQ ID NO: 25447 - protein, 9 aa, Homo sapiens
  light chain complementarity determining region 3 for antibody 12724
QQSYSTPYT

SEQ ID NO: 25448 - protein, 15 aa, Homo sapiens
  heavy chain complementarity determining region 3 for antibody 12724
ARDPTAAGFPAHFDY

SEQ ID NO: 25449 - protein, 9 aa, Homo sapiens
  light chain complementarity determining region 3 for antibody 12725
QQSYSTPWT

SEQ ID NO: 25450 - protein, 15 aa, Homo sapiens
  heavy chain complementarity determining region 3 for antibody 12725
AVDIVAKNYYYGMDV

SEQ ID NO: 25451 - protein, 10 aa, Homo sapiens
  light chain complementarity determining region 3 for antibody 12726
QQSYSTPPIA

SEQ ID NO: 25452 - protein, 10 aa, Homo sapiens
  heavy chain complementarity determining region 3 for antibody 12726
ARQPAGHLDL

SEQ ID NO: 25453 - protein, 9 aa, Homo sapiens
  light chain complementarity determining region 3 for antibody 12727
QQSYSTLWT

SEQ ID NO: 25454 - protein, 20 aa, Homo sapiens
  heavy chain complementarity determining region 3 for antibody 12727
AHSLDTPVLKHATVSDAFDI

SEQ ID NO: 25455 - protein, 8 aa, Homo sapiens
  light chain complementarity determining region 3 for antibody 12728
QQSYSTLT

SEQ ID NO: 25456 - protein, 11 aa, Homo sapiens
  heavy chain complementarity determining region 3 for antibody 12728
ARHVYSYHLDV

SEQ ID NO: 25457 - protein, 9 aa, Homo sapiens
  light chain complementarity determining region 3 for antibody 12729
QQSYSTLGR

SEQ ID NO: 25458 - protein, 13 aa, Homo sapiens
  heavy chain complementarity determining region 3 for antibody 12729
ASGGYSYGDVADY

SEQ ID NO: 25459 - protein, 7 aa, Homo sapiens
  light chain complementarity determining region 3 for antibody 12730
QQSYPVI

SEQ ID NO: 25460 - protein, 17 aa, Homo sapiens
  heavy chain complementarity determining region 3 for antibody 12730
AKYGSPQGGFYYHGMDV

SEQ ID NO: 25461 - protein, 11 aa, Homo sapiens
  light chain complementarity determining region 3 for antibody 12731
QQSHSTPPEYT

SEQ ID NO: 25462 - protein, 18 aa, Homo sapiens
  heavy chain complementarity determining region 3 for antibody 12731
ARAPIYDTDGYLFTWFDP

SEQ ID NO: 25463 - protein, 8 aa, Homo sapiens
  light chain complementarity determining region 3 for antibody 12732
QQSHSFPP

SEQ ID NO: 25464 - protein, 22 aa, Homo sapiens
  heavy chain complementarity determining region 3 for antibody 12732
ARHSGYSNTWYMNYYYYYGMDV

SEQ ID NO: 25465 - protein, 10 aa, Homo sapiens
  light chain complementarity determining region 3 for antibody 12733
QQSFSTLLIT

SEQ ID NO: 25466 - protein, 21 aa, Homo sapiens
  heavy chain complementarity determining region 3 for antibody 12733
ARRGEKYYGSGTYFGPYGMDV

SEQ ID NO: 25467 - protein, 9 aa, Homo sapiens
  light chain complementarity determining region 3 for antibody 12734
QQRYSTPYT

SEQ ID NO: 25468 - protein, 17 aa, Homo sapiens
  heavy chain complementarity determining region 3 for antibody 12734
ARGSYYDVDLNRFYFDY

SEQ ID NO: 25469 - protein, 11 aa, Homo sapiens
  light chain complementarity determining region 3 for antibody 12735
QQRSNWPPSVT

SEQ ID NO: 25470 - protein, 16 aa, Homo sapiens
  heavy chain complementarity determining region 3 for antibody 12735
VRGALVVLVDLNAFDI

SEQ ID NO: 25471 - protein, 10 aa, Homo sapiens
  light chain complementarity determining region 3 for antibody 12736
QQRSNWPPLT

SEQ ID NO: 25472 - protein, 10 aa, Homo sapiens
  heavy chain complementarity determining region 3 for antibody 12736
VARVGAPPSY

SEQ ID NO: 25473 - protein, 9 aa, Homo sapiens
  light chain complementarity determining region 3 for antibody 12737
QQRSGWPPA

SEQ ID NO: 25474 - protein, 16 aa, Homo sapiens
  heavy chain complementarity determining region 3 for antibody 12737
ARVFYGSGPNANWFDP

SEQ ID NO: 25475 - protein, 9 aa, Homo sapiens
  light chain complementarity determining region 3 for antibody 12738
QQNDNLPLT

SEQ ID NO: 25476 - protein, 18 aa, Homo sapiens
  heavy chain complementarity determining region 3 for antibody 12738
ARAPGDYDMLRRGYYFDH

SEQ ID NO: 25477 - protein, 9 aa, Homo sapiens
  light chain complementarity determining region 3 for antibody 12739
QQLHGYHLT

SEQ ID NO: 25478 - protein, 21 aa, Homo sapiens
  heavy chain complementarity determining region 3 for antibody 12739
ARDWAQSNGYPVGHYYYGMDV

SEQ ID NO: 25479 - protein, 9 aa, Homo sapiens
  light chain complementarity determining region 3 for antibody 12740
QQHGDSPWT

SEQ ID NO: 25480 - protein, 11 aa, Homo sapiens
  heavy chain complementarity determining region 3 for antibody 12740
ARGVAVARLIW

SEQ ID NO: 25481 - protein, 9 aa, Homo sapiens
  light chain complementarity determining region 3 for antibody 12741
QQGRSLPFT

SEQ ID NO: 25482 - protein, 19 aa, Homo sapiens
  heavy chain complementarity determining region 3 for antibody 12741
ARSDYSGDTDRYYDYGMDV

SEQ ID NO: 25483 - protein, 9 aa, Homo sapiens
  light chain complementarity determining region 3 for antibody 12742
QQGHSLPFT

SEQ ID NO: 25484 - protein, 19 aa, Homo sapiens
  heavy chain complementarity determining region 3 for antibody 12742
ARSDYSGDTDRYYGYGMDV

SEQ ID NO: 25485 - protein, 9 aa, Homo sapiens
  light chain complementarity determining region 3 for antibody 12743
QQGHSLPFP

SEQ ID NO: 25486 - protein, 19 aa, Homo sapiens
  heavy chain complementarity determining region 3 for antibody 12743
ARSDYSGDTDRYYDYGMDV

SEQ ID NO: 25487 - protein, 9 aa, Homo sapiens
  light chain complementarity determining region 3 for antibody 12744
QQFYHLPVT

SEQ ID NO: 25488 - protein, 20 aa, Homo sapiens
  heavy chain complementarity determining region 3 for antibody 12744
AKHRDESRFCSGGSCYVLAS

SEQ ID NO: 25489 - protein, 9 aa, Homo sapiens
  light chain complementarity determining region 3 for antibody 12745
QQFNTYPLT

SEQ ID NO: 25490 - protein, 17 aa, Homo sapiens
  heavy chain complementarity determining region 3 for antibody 12745
AKDLSGVHYDSHHGLDV

SEQ ID NO: 25491 - protein, 9 aa, Homo sapiens
  light chain complementarity determining region 3 for antibody 12746
QQFNTYPLT

SEQ ID NO: 25492 - protein, 17 aa, Homo sapiens
  heavy chain complementarity determining region 3 for antibody 12746
AKDLSGVHYDIRHGLDV

SEQ ID NO: 25493 - protein, 9 aa, Homo sapiens
  light chain complementarity determining region 3 for antibody 12747
QQFHSYPIT

SEQ ID NO: 25494 - protein, 16 aa, Homo sapiens
  heavy chain complementarity determining region 3 for antibody 12747
ARTQGTRDYYYYATDV

SEQ ID NO: 25495 - protein, 9 aa, Homo sapiens
  light chain complementarity determining region 3 for antibody 12748
QQFHSYPIT

SEQ ID NO: 25496 - protein, 16 aa, Homo sapiens
  heavy chain complementarity determining region 3 for antibody 12748
ARTQGTRDYSYYAMDV

SEQ ID NO: 25497 - protein, 9 aa, Homo sapiens
  light chain complementarity determining region 3 for antibody 12749
QQFHSYPIT

SEQ ID NO: 25498 - protein, 16 aa, Homo sapiens
  heavy chain complementarity determining region 3 for antibody 12749
ARTQGTRDYCYYAMDV

SEQ ID NO: 25499 - protein, 9 aa, Homo sapiens
  light chain complementarity determining region 3 for antibody 12750
QQFHSYPIT

SEQ ID NO: 25500 - protein, 16 aa, Homo sapiens
  heavy chain complementarity determining region 3 for antibody 12750
ARAQGTRDYYYYAMDV

SEQ ID NO: 25501 - protein, 9 aa, Homo sapiens
  light chain complementarity determining region 3 for antibody 12751
QQFHSSPIT

SEQ ID NO: 25502 - protein, 16 aa, Homo sapiens
  heavy chain complementarity determining region 3 for antibody 12751
ARTQGTRDYYYYAMDV

SEQ ID NO: 25503 - protein, 9 aa, Homo sapiens
  light chain complementarity determining region 3 for antibody 12752
QQDYRFPLS

SEQ ID NO: 25504 - protein, 13 aa, Homo sapiens
  heavy chain complementarity determining region 3 for antibody 12752
TRTYGSGRNWFDP

SEQ ID NO: 25505 - protein, 10 aa, Homo sapiens
  light chain complementarity determining region 3 for antibody 12753
QQDVSSELFT

SEQ ID NO: 25506 - protein, 16 aa, Homo sapiens
  heavy chain complementarity determining region 3 for antibody 12753
AREIFKGEIDYYAMDV

SEQ ID NO: 25507 - protein, 9 aa, Homo sapiens
  light chain complementarity determining region 3 for antibody 12754
QQAYRSPLS

SEQ ID NO: 25508 - protein, 13 aa, Homo sapiens
  heavy chain complementarity determining region 3 for antibody 12754
TRTYGSGRNWFDP

SEQ ID NO: 25509 - protein, 9 aa, Homo sapiens
  light chain complementarity determining region 3 for antibody 12755
QQAYRIPLS

SEQ ID NO: 25510 - protein, 13 aa, Homo sapiens
  heavy chain complementarity determining region 3 for antibody 12755
TRTYGSGRNWFDP

SEQ ID NO: 25511 - protein, 9 aa, Homo sapiens
  light chain complementarity determining region 3 for antibody 12756
QQAYRFPLS

SEQ ID NO: 25512 - protein, 13 aa, Homo sapiens
  heavy chain complementarity determining region 3 for antibody 12756
TRPYGSGRNWFDP

SEQ ID NO: 25513 - protein, 9 aa, Homo sapiens
  light chain complementarity determining region 3 for antibody 12757
QQASSFPLT

SEQ ID NO: 25514 - protein, 21 aa, Homo sapiens
  heavy chain complementarity determining region 3 for antibody 12757
VRDRSFGSGSYEYYYYYGMDA

SEQ ID NO: 25515 - protein, 10 aa, Homo sapiens
  light chain complementarity determining region 3 for antibody 12758
QQANSFPSIT

SEQ ID NO: 25516 - protein, 11 aa, Homo sapiens
  heavy chain complementarity determining region 3 for antibody 12758
AREQTGYYPLY

SEQ ID NO: 25517 - protein, 9 aa, Homo sapiens
  light chain complementarity determining region 3 for antibody 12759
QPYYSTPYS

SEQ ID NO: 25518 - protein, 13 aa, Homo sapiens
  heavy chain complementarity determining region 3 for antibody 12759
AKATSDGSGALHY

SEQ ID NO: 25519 - protein, 9 aa, Homo sapiens
  light chain complementarity determining region 3 for antibody 12760
QNYDSSPRL

SEQ ID NO: 25520 - protein, 13 aa, Homo sapiens
  heavy chain complementarity determining region 3 for antibody 12760
TRDEDGNNTPFDY

SEQ ID NO: 25521 - protein, 9 aa, Homo sapiens
  light chain complementarity determining region 3 for antibody 12761
QKNNSAPIT

SEQ ID NO: 25522 - protein, 22 aa, Homo sapiens
  heavy chain complementarity determining region 3 for antibody 12761
ARGLGTINYNDILTGYFQYFDL

SEQ ID NO: 25523 - protein, 8 aa, Homo sapiens
  light chain complementarity determining region 3 for antibody 12762
QHYYGVKT

SEQ ID NO: 25524 - protein, 9 aa, Homo sapiens
  heavy chain complementarity determining region 3 for antibody 12762
VKEAYYFDI

SEQ ID NO: 25525 - protein, 9 aa, Homo sapiens
  light chain complementarity determining region 3 for antibody 12763
QHYYGGPIT

SEQ ID NO: 25526 - protein, 13 aa, Homo sapiens
  heavy chain complementarity determining region 3 for antibody 12763
ARGKDSGSWMFDY

SEQ ID NO: 25527 - protein, 9 aa, Homo sapiens
  light chain complementarity determining region 3 for antibody 12764
QHNYRPSPA

SEQ ID NO: 25528 - protein, 11 aa, Homo sapiens
  heavy chain complementarity determining region 3 for antibody 12764
ARDPPGNGMDV

SEQ ID NO: 25529 - protein, 10 aa, Homo sapiens
  light chain complementarity determining region 3 for antibody 12765
QDHGYSPLYT

SEQ ID NO: 25530 - protein, 12 aa, Homo sapiens
  heavy chain complementarity determining region 3 for antibody 12765
AKGILGRGGMDV

SEQ ID NO: 25531 - protein, 9 aa, Homo sapiens
  light chain complementarity determining region 3 for antibody 12766
PGYNNAPWT

SEQ ID NO: 25532 - protein, 15 aa, Homo sapiens
  heavy chain complementarity determining region 3 for antibody 12766
GRHRYSSSQGYGMDV

SEQ ID NO: 25533 - protein, 9 aa, Homo sapiens
  light chain complementarity determining region 3 for antibody 12767
MQHVEFPST

SEQ ID NO: 25534 - protein, 17 aa, Homo sapiens
  heavy chain complementarity determining region 3 for antibody 12767
ARDEYNGDRRSYYGMDV

SEQ ID NO: 25535 - protein, 9 aa, Homo sapiens
  light chain complementarity determining region 3 for antibody 12768
MQGTHWPWT

SEQ ID NO: 25536 - protein, 11 aa, Homo sapiens
  heavy chain complementarity determining region 3 for antibody 12768
ARHVYSYHLDV

SEQ ID NO: 25537 - protein, 9 aa, Homo sapiens
  light chain complementarity determining region 3 for antibody 12769
MQGTHWPGT

SEQ ID NO: 25538 - protein, 12 aa, Homo sapiens
  heavy chain complementarity determining region 3 for antibody 12769
VHVSGWPYYFDQ

SEQ ID NO: 25539 - protein, 9 aa, Homo sapiens
  light chain complementarity determining region 3 for antibody 12770
MQGTHWPGT

SEQ ID NO: 25540 - protein, 10 aa, Homo sapiens
  heavy chain complementarity determining region 3 for antibody 12770
ARETNWGPDY

SEQ ID NO: 25541 - protein, 9 aa, Homo sapiens
  light chain complementarity determining region 3 for antibody 12771
MQGSHWPPT

SEQ ID NO: 25542 - protein, 16 aa, Homo sapiens
  heavy chain complementarity determining region 3 for antibody 12771
ARDLRASAAAGANFDY

SEQ ID NO: 25543 - protein, 9 aa, Homo sapiens
  light chain complementarity determining region 3 for antibody 12772
MQGLQTPYT

SEQ ID NO: 25544 - protein, 16 aa, Homo sapiens
  heavy chain complementarity determining region 3 for antibody 12772
ARHDAAGGGNYYGMDV

SEQ ID NO: 25545 - protein, 9 aa, Homo sapiens
  light chain complementarity determining region 3 for antibody 12773
MQGLLTPPA

SEQ ID NO: 25546 - protein, 18 aa, Homo sapiens
  heavy chain complementarity determining region 3 for antibody 12773
ARTRVGLYSGGSPCMFDP

SEQ ID NO: 25547 - protein, 9 aa, Homo sapiens
  light chain complementarity determining region 3 for antibody 12774
MQATNWPPA

SEQ ID NO: 25548 - protein, 17 aa, Homo sapiens
  heavy chain complementarity determining region 3 for antibody 12774
ARGFLDRGSGWTYYFDY

SEQ ID NO: 25549 - protein, 10 aa, Homo sapiens
  light chain complementarity determining region 3 for antibody 12775
MQALQTPLFT

SEQ ID NO: 25550 - protein, 18 aa, Homo sapiens
  heavy chain complementarity determining region 3 for antibody 12775
AKDPLWFGELYYYYGMDV

SEQ ID NO: 25551 - protein, 8 aa, Homo sapiens
  light chain complementarity determining region 3 for antibody 12776
MQALQTLT

SEQ ID NO: 25552 - protein, 12 aa, Homo sapiens
  heavy chain complementarity determining region 3 for antibody 12776
ATTYGAIAGMNV

SEQ ID NO: 25553 - protein, 9 aa, Homo sapiens
  light chain complementarity determining region 3 for antibody 12777
MQALQTEVT

SEQ ID NO: 25554 - protein, 13 aa, Homo sapiens
  heavy chain complementarity determining region 3 for antibody 12777
ARDRGGQWLVHDY

SEQ ID NO: 25555 - protein, 10 aa, Homo sapiens
  light chain complementarity determining region 3 for antibody 12778
LQHNSYPPVT

SEQ ID NO: 25556 - protein, 12 aa, Homo sapiens
  heavy chain complementarity determining region 3 for antibody 12778
ARGGLRTDPFDY

SEQ ID NO: 25557 - protein, 9 aa, Homo sapiens
  light chain complementarity determining region 3 for antibody 12779
LQDYGYPWT

SEQ ID NO: 25558 - protein, 20 aa, Homo sapiens
  heavy chain complementarity determining region 3 for antibody 12779
ARHTYYYDDSGYYQGGVIDV

SEQ ID NO: 25559 - protein, 9 aa, Homo sapiens
  light chain complementarity determining region 3 for antibody 12780
LQATHWPNT

SEQ ID NO: 25560 - protein, 11 aa, Homo sapiens
  heavy chain complementarity determining region 3 for antibody 12780
AKDTQWLPFDC

SEQ ID NO: 25561 - protein, 10 aa, Homo sapiens
  light chain complementarity determining region 3 for antibody 12781
KYHGYSPLYT

SEQ ID NO: 25562 - protein, 12 aa, Homo sapiens
  heavy chain complementarity determining region 3 for antibody 12781
AKGILGRGGMDV

SEQ ID NO: 25563 - protein, 9 aa, Homo sapiens
  light chain complementarity determining region 3 for antibody 12782
HQYRVSRGT

SEQ ID NO: 25564 - protein, 21 aa, Homo sapiens
  heavy chain complementarity determining region 3 for antibody 12782
ARDRGGDFHGDSSYYNRPFDY

SEQ ID NO: 25565 - protein, 10 aa, Homo sapiens
  light chain complementarity determining region 3 for antibody 12783
RYHGYSPLYT

SEQ ID NO: 25566 - protein, 12 aa, Homo sapiens
  heavy chain complementarity determining region 3 for antibody 12783
AKGILGRGGMDV

SEQ ID NO: 25567 - protein, 9 aa, Homo sapiens
  light chain complementarity determining region 3 for antibody 12784
RRYDNSPYT

SEQ ID NO: 25568 - protein, 15 aa, Homo sapiens
  heavy chain complementarity determining region 3 for antibody 12784
ARSSIVALGYYGMDV

SEQ ID NO: 25569 - protein, 10 aa, Homo sapiens
  light chain complementarity determining region 3 for antibody 12785
QYHGYSPLYT

SEQ ID NO: 25570 - protein, 12 aa, Homo sapiens
  heavy chain complementarity determining region 3 for antibody 12785
VKGILGRGGMDV

SEQ ID NO: 25571 - protein, 10 aa, Homo sapiens
  light chain complementarity determining region 3 for antibody 12786
QYHGYSPLYT

SEQ ID NO: 25572 - protein, 12 aa, Homo sapiens
  heavy chain complementarity determining region 3 for antibody 12786
AKGVLGRGGMDV

SEQ ID NO: 25573 - protein, 10 aa, Homo sapiens
  light chain complementarity determining region 3 for antibody 12787
QYHGYSPLYT

SEQ ID NO: 25574 - protein, 12 aa, Homo sapiens
  heavy chain complementarity determining region 3 for antibody 12787
AKGTLGRGGMDV

SEQ ID NO: 25575 - protein, 10 aa, Homo sapiens
  light chain complementarity determining region 3 for antibody 12788
QYHGYSPLYT

SEQ ID NO: 25576 - protein, 12 aa, Homo sapiens
  heavy chain complementarity determining region 3 for antibody 12788
AKGILGRWGMDV

SEQ ID NO: 25577 - protein, 10 aa, Homo sapiens
  light chain complementarity determining region 3 for antibody 12789
QYHGYSPLYT

SEQ ID NO: 25578 - protein, 12 aa, Homo sapiens
  heavy chain complementarity determining region 3 for antibody 12789
AKGILGRGGIDV

SEQ ID NO: 25579 - protein, 10 aa, Homo sapiens
  light chain complementarity determining region 3 for antibody 12790
QYHGYSPLYN

SEQ ID NO: 25580 - protein, 12 aa, Homo sapiens
  heavy chain complementarity determining region 3 for antibody 12790
AKGILGRGGMDV

SEQ ID NO: 25581 - protein, 9 aa, Homo sapiens
  light chain complementarity determining region 3 for antibody 12791
QRTCNAPIP

SEQ ID NO: 25582 - protein, 9 aa, Homo sapiens
  heavy chain complementarity determining region 3 for antibody 12791
VRGYDVFDY

SEQ ID NO: 25583 - protein, 9 aa, Homo sapiens
  light chain complementarity determining region 3 for antibody 12792
QQYYTYSAT

SEQ ID NO: 25584 - protein, 19 aa, Homo sapiens
  heavy chain complementarity determining region 3 for antibody 12792
ATVKGDQGELDYDYHGVDV

SEQ ID NO: 25585 - protein, 10 aa, Homo sapiens
  light chain complementarity determining region 3 for antibody 12793
QQYYSTLPLT

SEQ ID NO: 25586 - protein, 18 aa, Homo sapiens
  heavy chain complementarity determining region 3 for antibody 12793
ARYPQNPGYFYEGSWFDP

SEQ ID NO: 25587 - protein, 9 aa, Homo sapiens
  light chain complementarity determining region 3 for antibody 12794
QQYYSAPRT

SEQ ID NO: 25588 - protein, 20 aa, Homo sapiens
  heavy chain complementarity determining region 3 for antibody 12794
ARDDILTGYYQSDYYYAMDV

SEQ ID NO: 25589 - protein, 9 aa, Homo sapiens
  light chain complementarity determining region 3 for antibody 12795
QQYYNTPYT

SEQ ID NO: 25590 - protein, 11 aa, Homo sapiens
  heavy chain complementarity determining region 3 for antibody 12795
KAGVTAGYGFP

SEQ ID NO: 25591 - protein, 9 aa, Homo sapiens
  light chain complementarity determining region 3 for antibody 12796
QQYYGTPRT

SEQ ID NO: 25592 - protein, 23 aa, Homo sapiens
  heavy chain complementarity determining region 3 for antibody 12796
ARGGPYRPAPYFYDISGPQYFQH

SEQ ID NO: 25593 - protein, 9 aa, Homo sapiens
  light chain complementarity determining region 3 for antibody 12797
QQYYGSPRT

SEQ ID NO: 25594 - protein, 16 aa, Homo sapiens
  heavy chain complementarity determining region 3 for antibody 12797
ARVGPFDFDSSGFIQL

SEQ ID NO: 25595 - protein, 10 aa, Homo sapiens
  light chain complementarity determining region 3 for antibody 12798
QQYVSSELFT

SEQ ID NO: 25596 - protein, 16 aa, Homo sapiens
  heavy chain complementarity determining region 3 for antibody 12798
AREIFKGEVDYYAMDV

SEQ ID NO: 25597 - protein, 10 aa, Homo sapiens
  light chain complementarity determining region 3 for antibody 12799
QQYVSSELFT

SEQ ID NO: 25598 - protein, 16 aa, Homo sapiens
  heavy chain complementarity determining region 3 for antibody 12799
AREIFKGEIDYYAMGV

SEQ ID NO: 25599 - protein, 10 aa, Homo sapiens
  light chain complementarity determining region 3 for antibody 12800
QQYVSSELFT

SEQ ID NO: 25600 - protein, 16 aa, Homo sapiens
  heavy chain complementarity determining region 3 for antibody 12800
AREIFKGEIDSYAMDV

SEQ ID NO: 25601 - protein, 8 aa, Homo sapiens
  light chain complementarity determining region 3 for antibody 12801
QQYSSSLT

SEQ ID NO: 25602 - protein, 17 aa, Homo sapiens
  heavy chain complementarity determining region 3 for antibody 12801
AKVYRPHCGSYCFYFDS

SEQ ID NO: 25603 - protein, 9 aa, Homo sapiens
  light chain complementarity determining region 3 for antibody 12802
QQYSNFPYT

SEQ ID NO: 25604 - protein, 17 aa, Homo sapiens
  heavy chain complementarity determining region 3 for antibody 12802
AREDWNDVDLRQFYFDY

SEQ ID NO: 25605 - protein, 9 aa, Homo sapiens
  light chain complementarity determining region 3 for antibody 12803
QQYNSYWYT

SEQ ID NO: 25606 - protein, 20 aa, Homo sapiens
  heavy chain complementarity determining region 3 for antibody 12803
AGTYGSGTYSPGYYYFGMDV

SEQ ID NO: 25607 - protein, 9 aa, Homo sapiens
  light chain complementarity determining region 3 for antibody 12804
QQYNSYWYP

SEQ ID NO: 25608 - protein, 20 aa, Homo sapiens
  heavy chain complementarity determining region 3 for antibody 12804
AGTYGSGTYSPDYYYFGMDV

SEQ ID NO: 25609 - protein, 9 aa, Homo sapiens
  light chain complementarity determining region 3 for antibody 12805
QQYNSYSYT

SEQ ID NO: 25610 - protein, 17 aa, Homo sapiens
  heavy chain complementarity determining region 3 for antibody 12805
AKVRSPMVRGVISHFDY

SEQ ID NO: 25611 - protein, 9 aa, Homo sapiens
  light chain complementarity determining region 3 for antibody 12806
QQYNSSWYT

SEQ ID NO: 25612 - protein, 20 aa, Homo sapiens
  heavy chain complementarity determining region 3 for antibody 12806
AGTYGSGTYSPDYYYFGMDV

SEQ ID NO: 25613 - protein, 9 aa, Homo sapiens
  light chain complementarity determining region 3 for antibody 12807
QQYNSLPIN

SEQ ID NO: 25614 - protein, 19 aa, Homo sapiens
  heavy chain complementarity determining region 3 for antibody 12807
ARDRDYTIVDDYGSGVFDY

SEQ ID NO: 25615 - protein, 9 aa, Homo sapiens
  light chain complementarity determining region 3 for antibody 12808
QQYNSAPFT

SEQ ID NO: 25616 - protein, 15 aa, Homo sapiens
  heavy chain complementarity determining region 3 for antibody 12808
ARDRTVAAPNWYFDL

SEQ ID NO: 25617 - protein, 9 aa, Homo sapiens
  light chain complementarity determining region 3 for antibody 12809
QQYNNWPRR

SEQ ID NO: 25618 - protein, 15 aa, Homo sapiens
  heavy chain complementarity determining region 3 for antibody 12809
VKSGTYSSSSGWFDT

SEQ ID NO: 25619 - protein, 9 aa, Homo sapiens
  light chain complementarity determining region 3 for antibody 12810
QQYNNWPLT

SEQ ID NO: 25620 - protein, 13 aa, Homo sapiens
  heavy chain complementarity determining region 3 for antibody 12810
AKDRGRWLAFFDY

SEQ ID NO: 25621 - protein, 9 aa, Homo sapiens
  light chain complementarity determining region 3 for antibody 12811
QQYNNLPYT

SEQ ID NO: 25622 - protein, 13 aa, Homo sapiens
  heavy chain complementarity determining region 3 for antibody 12811
ARAKWDLCGYFDF

SEQ ID NO: 25623 - protein, 10 aa, Homo sapiens
  light chain complementarity determining region 3 for antibody 12812
QQYNKWPSLT

SEQ ID NO: 25624 - protein, 21 aa, Homo sapiens
  heavy chain complementarity determining region 3 for antibody 12812
ARDLNDFWRGYYPDFYYGMDV

SEQ ID NO: 25625 - protein, 9 aa, Homo sapiens
  light chain complementarity determining region 3 for antibody 12813
QQYNDWPRT

SEQ ID NO: 25626 - protein, 23 aa, Homo sapiens
  heavy chain complementarity determining region 3 for antibody 12813
GRAGSSSCSGGSCYSSPMAFLHY

SEQ ID NO: 25627 - protein, 8 aa, Homo sapiens
  light chain complementarity determining region 3 for antibody 12814
QQYGSSPR

SEQ ID NO: 25628 - protein, 13 aa, Homo sapiens
  heavy chain complementarity determining region 3 for antibody 12814
TRDLYSGSSIMGF

SEQ ID NO: 25629 - protein, 11 aa, Homo sapiens
  light chain complementarity determining region 3 for antibody 12815
QQYGSSPPMYT

SEQ ID NO: 25630 - protein, 19 aa, Homo sapiens
  heavy chain complementarity determining region 3 for antibody 12815
ARLVVQDIIGSGPLGNFDL

SEQ ID NO: 25631 - protein, 9 aa, Homo sapiens
  light chain complementarity determining region 3 for antibody 12816
QQYGSSLLT

SEQ ID NO: 25632 - protein, 15 aa, Homo sapiens
  heavy chain complementarity determining region 3 for antibody 12816
ARNVLPDYYAGAFHL

SEQ ID NO: 25633 - protein, 8 aa, Homo sapiens
  light chain complementarity determining region 3 for antibody 12817
QQYGNLLP

SEQ ID NO: 25634 - protein, 20 aa, Homo sapiens
  heavy chain complementarity determining region 3 for antibody 12817
SKDRSVNAAMDYYYYSAMDV

SEQ ID NO: 25635 - protein, 9 aa, Homo sapiens
  light chain complementarity determining region 3 for antibody 12818
QQYDTFPPT

SEQ ID NO: 25636 - protein, 20 aa, Homo sapiens
  heavy chain complementarity determining region 3 for antibody 12818
ARLLGYCSGGSCQAHKLFDY

SEQ ID NO: 25637 - protein, 9 aa, Homo sapiens
  light chain complementarity determining region 3 for antibody 12819
QQYDSFLYT

SEQ ID NO: 25638 - protein, 17 aa, Homo sapiens
  heavy chain complementarity determining region 3 for antibody 12819
AREDWSDVDLRAFYFDS

SEQ ID NO: 25639 - protein, 10 aa, Homo sapiens
  light chain complementarity determining region 3 for antibody 12820
QQYDNLPSVT

SEQ ID NO: 25640 - protein, 11 aa, Homo sapiens
  heavy chain complementarity determining region 3 for antibody 12820
AKSGGFRSFDY

SEQ ID NO: 25641 - protein, 9 aa, Homo sapiens
  light chain complementarity determining region 3 for antibody 12821
QQYDNLPLT

SEQ ID NO: 25642 - protein, 13 aa, Homo sapiens
  heavy chain complementarity determining region 3 for antibody 12821
VRESMFYGDPPDS

SEQ ID NO: 25643 - protein, 9 aa, Homo sapiens
  light chain complementarity determining region 3 for antibody 12822
QQYDNLPLT

SEQ ID NO: 25644 - protein, 18 aa, Homo sapiens
  heavy chain complementarity determining region 3 for antibody 12822
ARATGDYDMLRRGYYFDH

SEQ ID NO: 25645 - protein, 9 aa, Homo sapiens
  light chain complementarity determining region 3 for antibody 12823
QQYDNLPLT

SEQ ID NO: 25646 - protein, 18 aa, Homo sapiens
  heavy chain complementarity determining region 3 for antibody 12823
ARAAGDYDMLRRGYYFDH

SEQ ID NO: 25647 - protein, 9 aa, Homo sapiens
  light chain complementarity determining region 3 for antibody 12824
QQYDNIPYT

SEQ ID NO: 25648 - protein, 10 aa, Homo sapiens
  heavy chain complementarity determining region 3 for antibody 12824
AREGVTDFDY

SEQ ID NO: 25649 - protein, 10 aa, Homo sapiens
  light chain complementarity determining region 3 for antibody 12825
QQYAPSHKYT

SEQ ID NO: 25650 - protein, 22 aa, Homo sapiens
  heavy chain complementarity determining region 3 for antibody 12825
ARHSPFLEMLGERWLQFGAFDI

SEQ ID NO: 25651 - protein, 11 aa, Homo sapiens
  light chain complementarity determining region 3 for antibody 12826
QQVSNYEQGIT

SEQ ID NO: 25652 - protein, 17 aa, Homo sapiens
  heavy chain complementarity determining region 3 for antibody 12826
ARERQYCYGDRCYGEDL

SEQ ID NO: 25653 - protein, 9 aa, Homo sapiens
  light chain complementarity determining region 3 for antibody 12827
QQVHSLPFT

SEQ ID NO: 25654 - protein, 19 aa, Homo sapiens
  heavy chain complementarity determining region 3 for antibody 12827
ARSDYSGDTDRYYDYGMDV

SEQ ID NO: 25655 - protein, 8 aa, Homo sapiens
  light chain complementarity determining region 3 for antibody 12828
QQTYTPLT

SEQ ID NO: 25656 - protein, 12 aa, Homo sapiens
  heavy chain complementarity determining region 3 for antibody 12828
AKDKGMIGSLDY

SEQ ID NO: 25657 - protein, 10 aa, Homo sapiens
  light chain complementarity determining region 3 for antibody 12829
QQTYSSPPPT

SEQ ID NO: 25658 - protein, 17 aa, Homo sapiens
  heavy chain complementarity determining region 3 for antibody 12829
ARLTPYTSNWSPFYCDY

SEQ ID NO: 25659 - protein, 10 aa, Homo sapiens
  light chain complementarity determining region 3 for antibody 12830
QQSYTTPSLP

SEQ ID NO: 25660 - protein, 13 aa, Homo sapiens
  heavy chain complementarity determining region 3 for antibody 12830
ARGMVGETGWFDP

SEQ ID NO: 25661 - protein, 9 aa, Homo sapiens
  light chain complementarity determining region 3 for antibody 12831
QQSYSTPYT

SEQ ID NO: 25662 - protein, 15 aa, Homo sapiens
  heavy chain complementarity determining region 3 for antibody 12831
ARGDCRDETCYPGDY

SEQ ID NO: 25663 - protein, 9 aa, Homo sapiens
  light chain complementarity determining region 3 for antibody 12832
QQSYSTPFT

SEQ ID NO: 25664 - protein, 14 aa, Homo sapiens
  heavy chain complementarity determining region 3 for antibody 12832
ARLPGRCPRHGFDV

SEQ ID NO: 25665 - protein, 9 aa, Homo sapiens
  light chain complementarity determining region 3 for antibody 12833
QQSYSTLWT

SEQ ID NO: 25666 - protein, 17 aa, Homo sapiens
  heavy chain complementarity determining region 3 for antibody 12833
ARVHFYGSGTYSYWFDP

SEQ ID NO: 25667 - protein, 9 aa, Homo sapiens
  light chain complementarity determining region 3 for antibody 12834
QQSYSARLS

SEQ ID NO: 25668 - protein, 12 aa, Homo sapiens
  heavy chain complementarity determining region 3 for antibody 12834
ARMTSYYNGLDV

SEQ ID NO: 25669 - protein, 9 aa, Homo sapiens
  light chain complementarity determining region 3 for antibody 12835
QQSYNTRFT

SEQ ID NO: 25670 - protein, 18 aa, Homo sapiens
  heavy chain complementarity determining region 3 for antibody 12835
ARGTHGGTDYRGVYYFDY

SEQ ID NO: 25671 - protein, 9 aa, Homo sapiens
  light chain complementarity determining region 3 for antibody 12836
QQSHSLPFT

SEQ ID NO: 25672 - protein, 19 aa, Homo sapiens
  heavy chain complementarity determining region 3 for antibody 12836
ARSDYSGDTDRYYDYGMDV

SEQ ID NO: 25673 - protein, 8 aa, Homo sapiens
  light chain complementarity determining region 3 for antibody 12837
QQSFTSWT

SEQ ID NO: 25674 - protein, 14 aa, Homo sapiens
  heavy chain complementarity determining region 3 for antibody 12837
VRERTTVAGPHLDY

SEQ ID NO: 25675 - protein, 9 aa, Homo sapiens
  light chain complementarity determining region 3 for antibody 12838
QQSFSPPWA

SEQ ID NO: 25676 - protein, 19 aa, Homo sapiens
  heavy chain complementarity determining region 3 for antibody 12838
ATMRDGSGELTYDYYGMDV

SEQ ID NO: 25677 - protein, 9 aa, Homo sapiens
  light chain complementarity determining region 3 for antibody 12839
QQSFSPPWA

SEQ ID NO: 25678 - protein, 19 aa, Homo sapiens
  heavy chain complementarity determining region 3 for antibody 12839
ATLRYSSGELTYDYYGMDV

SEQ ID NO: 25679 - protein, 10 aa, Homo sapiens
  light chain complementarity determining region 3 for antibody 12840
QQRTRWPPLP

SEQ ID NO: 25680 - protein, 12 aa, Homo sapiens
  heavy chain complementarity determining region 3 for antibody 12840
TDTHVTGGDWDY

SEQ ID NO: 25681 - protein, 10 aa, Homo sapiens
  light chain complementarity determining region 3 for antibody 12841
QQRTRRPPLT

SEQ ID NO: 25682 - protein, 12 aa, Homo sapiens
  heavy chain complementarity determining region 3 for antibody 12841
TDTHVTGGDWDY

SEQ ID NO: 25683 - protein, 9 aa, Homo sapiens
  light chain complementarity determining region 3 for antibody 12842
QQRTNWPVP

SEQ ID NO: 25684 - protein, 19 aa, Homo sapiens
  heavy chain complementarity determining region 3 for antibody 12842
VRARQYRSSWYGPSDAFDI

SEQ ID NO: 25685 - protein, 9 aa, Homo sapiens
  light chain complementarity determining region 3 for antibody 12843
QQRSNWPVT

SEQ ID NO: 25686 - protein, 12 aa, Homo sapiens
  heavy chain complementarity determining region 3 for antibody 12843
ARDHIDGSSSNY

SEQ ID NO: 25687 - protein, 11 aa, Homo sapiens
  light chain complementarity determining region 3 for antibody 12844
QQRSNWPPEFT

SEQ ID NO: 25688 - protein, 18 aa, Homo sapiens
  heavy chain complementarity determining region 3 for antibody 12844
ARTEPHTFGHDDYYGLDV

SEQ ID NO: 25689 - protein, 11 aa, Homo sapiens
  light chain complementarity determining region 3 for antibody 12845
QQRSNWPPAFT

SEQ ID NO: 25690 - protein, 16 aa, Homo sapiens
  heavy chain complementarity determining region 3 for antibody 12845
ARRLGETAMALDAFDI

SEQ ID NO: 25691 - protein, 10 aa, Homo sapiens
  light chain complementarity determining region 3 for antibody 12846
QQRSNWPIFN

SEQ ID NO: 25692 - protein, 14 aa, Homo sapiens
  heavy chain complementarity determining region 3 for antibody 12846
ARLNKMTRIRYFDS

SEQ ID NO: 25693 - protein, 8 aa, Homo sapiens
  light chain complementarity determining region 3 for antibody 12847
QQRSNWLT

SEQ ID NO: 25694 - protein, 19 aa, Homo sapiens
  heavy chain complementarity determining region 3 for antibody 12847
ARRSYPDSNGYYGTPLDDP

SEQ ID NO: 25695 - protein, 9 aa, Homo sapiens
  light chain complementarity determining region 3 for antibody 12848
QQRSNWGGT

SEQ ID NO: 25696 - protein, 11 aa, Homo sapiens
  heavy chain complementarity determining region 3 for antibody 12848
ARDFVGMADSD

SEQ ID NO: 25697 - protein, 9 aa, Homo sapiens
  light chain complementarity determining region 3 for antibody 12849
QQRNNRGLT

SEQ ID NO: 25698 - protein, 22 aa, Homo sapiens
  heavy chain complementarity determining region 3 for antibody 12849
ARHSGYSNTWYMNYYYYYGMDV

SEQ ID NO: 25699 - protein, 9 aa, Homo sapiens
  light chain complementarity determining region 3 for antibody 12850
QQRNNCGLT

SEQ ID NO: 25700 - protein, 22 aa, Homo sapiens
  heavy chain complementarity determining region 3 for antibody 12850
ARHSGYSNTWYMNYYYYYGMDV

SEQ ID NO: 25701 - protein, 9 aa, Homo sapiens
  light chain complementarity determining region 3 for antibody 12851
QQQFTGRRT

SEQ ID NO: 25702 - protein, 15 aa, Homo sapiens
  heavy chain complementarity determining region 3 for antibody 12851
AKEGCSGGICYGFDV

SEQ ID NO: 25703 - protein, 9 aa, Homo sapiens
  light chain complementarity determining region 3 for antibody 12852
QQLNGYPLT

SEQ ID NO: 25704 - protein, 21 aa, Homo sapiens
  heavy chain complementarity determining region 3 for antibody 12852
ARDWAQSNGYPVGHYYYGMDV

SEQ ID NO: 25705 - protein, 9 aa, Homo sapiens
  light chain complementarity determining region 3 for antibody 12853
QQLHGYPLT

SEQ ID NO: 25706 - protein, 21 aa, Homo sapiens
  heavy chain complementarity determining region 3 for antibody 12853
ARDWAQSNGSPVGHYYYGMDV

SEQ ID NO: 25707 - protein, 9 aa, Homo sapiens
  light chain complementarity determining region 3 for antibody 12854
QQLHGYPLT

SEQ ID NO: 25708 - protein, 21 aa, Homo sapiens
  heavy chain complementarity determining region 3 for antibody 12854
ARDWAQSNGCPVGHYYYGMDV

SEQ ID NO: 25709 - protein, 9 aa, Homo sapiens
  light chain complementarity determining region 3 for antibody 12855
QQHDSFPYT

SEQ ID NO: 25710 - protein, 17 aa, Homo sapiens
  heavy chain complementarity determining region 3 for antibody 12855
AREDWSDVDLRAFYFDS

SEQ ID NO: 25711 - protein, 9 aa, Homo sapiens
  light chain complementarity determining region 3 for antibody 12856
QQGNSFPLT

SEQ ID NO: 25712 - protein, 20 aa, Homo sapiens
  heavy chain complementarity determining region 3 for antibody 12856
ARTPVLGYFDAHVPRPCFDY

SEQ ID NO: 25713 - protein, 9 aa, Homo sapiens
  light chain complementarity determining region 3 for antibody 12857
QQGNSFPFT

SEQ ID NO: 25714 - protein, 19 aa, Homo sapiens
  heavy chain complementarity determining region 3 for antibody 12857
ARADCSGDTDRYYDFGMDV

SEQ ID NO: 25715 - protein, 9 aa, Homo sapiens
  light chain complementarity determining region 3 for antibody 12858
QQGHSLPLT

SEQ ID NO: 25716 - protein, 19 aa, Homo sapiens
  heavy chain complementarity determining region 3 for antibody 12858
ARSDYSGDTDRYYDYGMDV

SEQ ID NO: 25717 - protein, 9 aa, Homo sapiens
  light chain complementarity determining region 3 for antibody 12859
QQGHSLPFT

SEQ ID NO: 25718 - protein, 19 aa, Homo sapiens
  heavy chain complementarity determining region 3 for antibody 12859
ARSDYSGDTDRYYDCGMDV

SEQ ID NO: 25719 - protein, 9 aa, Homo sapiens
  light chain complementarity determining region 3 for antibody 12860
QQFYSYPIT

SEQ ID NO: 25720 - protein, 16 aa, Homo sapiens
  heavy chain complementarity determining region 3 for antibody 12860
ARTQGTRDYYYYAMDV

SEQ ID NO: 25721 - protein, 9 aa, Homo sapiens
  light chain complementarity determining region 3 for antibody 12861
QQFNSYPLT

SEQ ID NO: 25722 - protein, 15 aa, Homo sapiens
  heavy chain complementarity determining region 3 for antibody 12861
ARSREYGNSWPSFDY

SEQ ID NO: 25723 - protein, 9 aa, Homo sapiens
  light chain complementarity determining region 3 for antibody 12862
QQFHSYPIT

SEQ ID NO: 25724 - protein, 16 aa, Homo sapiens
  heavy chain complementarity determining region 3 for antibody 12862
ARTQGTRDYYYYAMDA

SEQ ID NO: 25725 - protein, 9 aa, Homo sapiens
  light chain complementarity determining region 3 for antibody 12863
QQDHSLPFT

SEQ ID NO: 25726 - protein, 19 aa, Homo sapiens
  heavy chain complementarity determining region 3 for antibody 12863
ARSDYSGDTDRYYDYGMDV

SEQ ID NO: 25727 - protein, 11 aa, Homo sapiens
  light chain complementarity determining region 3 for antibody 12864
QQCYSSPPANT

SEQ ID NO: 25728 - protein, 16 aa, Homo sapiens
  heavy chain complementarity determining region 3 for antibody 12864
AREAGEDYYYKDIFDI

SEQ ID NO: 25729 - protein, 9 aa, Homo sapiens
  light chain complementarity determining region 3 for antibody 12865
QQAYRVPLS

SEQ ID NO: 25730 - protein, 13 aa, Homo sapiens
  heavy chain complementarity determining region 3 for antibody 12865
TRTYGSGRNWFDP

SEQ ID NO: 25731 - protein, 9 aa, Homo sapiens
  light chain complementarity determining region 3 for antibody 12866
QQAYRFPLS

SEQ ID NO: 25732 - protein, 13 aa, Homo sapiens
  heavy chain complementarity determining region 3 for antibody 12866
TRTDGSGRNWFDP

SEQ ID NO: 25733 - protein, 9 aa, Homo sapiens
  light chain complementarity determining region 3 for antibody 12867
QQAYRFPLS

SEQ ID NO: 25734 - protein, 13 aa, Homo sapiens
  heavy chain complementarity determining region 3 for antibody 12867
PRTYGSGRNWFDP

SEQ ID NO: 25735 - protein, 9 aa, Homo sapiens
  light chain complementarity determining region 3 for antibody 12868
QQAYGFPLS

SEQ ID NO: 25736 - protein, 13 aa, Homo sapiens
  heavy chain complementarity determining region 3 for antibody 12868
TRTYGSGRNWFDP

SEQ ID NO: 25737 - protein, 10 aa, Homo sapiens
  light chain complementarity determining region 3 for antibody 12869
QQATSFPPIP

SEQ ID NO: 25738 - protein, 21 aa, Homo sapiens
  heavy chain complementarity determining region 3 for antibody 12869
ARGLTDEGYKSGYGYYCGLDV

SEQ ID NO: 25739 - protein, 9 aa, Homo sapiens
  light chain complementarity determining region 3 for antibody 12870
QQANSFPVT

SEQ ID NO: 25740 - protein, 22 aa, Homo sapiens
  heavy chain complementarity determining region 3 for antibody 12870
ARGPFAGSGSYYRRGPNYGMDV

SEQ ID NO: 25741 - protein, 8 aa, Homo sapiens
  light chain complementarity determining region 3 for antibody 12871
QQAHSFPP

SEQ ID NO: 25742 - protein, 21 aa, Homo sapiens
  heavy chain complementarity determining region 3 for antibody 12871
ARHSGYSNTWYMNYYYYGMDV

SEQ ID NO: 25743 - protein, 9 aa, Homo sapiens
  light chain complementarity determining region 3 for antibody 12872
QPFHSYPIT

SEQ ID NO: 25744 - protein, 16 aa, Homo sapiens
  heavy chain complementarity determining region 3 for antibody 12872
ARTQGTRDYYYYAMDV

SEQ ID NO: 25745 - protein, 9 aa, Homo sapiens
  light chain complementarity determining region 3 for antibody 12873
QKGYSFPFT

SEQ ID NO: 25746 - protein, 19 aa, Homo sapiens
  heavy chain complementarity determining region 3 for antibody 12873
ARSDYSGDTDRYYDHGMDV

SEQ ID NO: 25747 - protein, 9 aa, Homo sapiens
  light chain complementarity determining region 3 for antibody 12874
QHTYTIPHT

SEQ ID NO: 25748 - protein, 16 aa, Homo sapiens
  heavy chain complementarity determining region 3 for antibody 12874
ATHDSSGYYYTQRLYY

SEQ ID NO: 25749 - protein, 9 aa, Homo sapiens
  light chain complementarity determining region 3 for antibody 12875
QHRNNWGLT

SEQ ID NO: 25750 - protein, 17 aa, Homo sapiens
  heavy chain complementarity determining region 3 for antibody 12875
ARLSITAQNYYYYTLDL

SEQ ID NO: 25751 - protein, 9 aa, Homo sapiens
  light chain complementarity determining region 3 for antibody 12876
QHNYRHSPA

SEQ ID NO: 25752 - protein, 11 aa, Homo sapiens
  heavy chain complementarity determining region 3 for antibody 12876
TRDPPGNGMDV

SEQ ID NO: 25753 - protein, 9 aa, Homo sapiens
  light chain complementarity determining region 3 for antibody 12877
QHHYRPSPA

SEQ ID NO: 25754 - protein, 11 aa, Homo sapiens
  heavy chain complementarity determining region 3 for antibody 12877
TRDPPGNGMDV

SEQ ID NO: 25755 - protein, 9 aa, Homo sapiens
  light chain complementarity determining region 3 for antibody 12878
QHCDNFSIT

SEQ ID NO: 25756 - protein, 15 aa, Homo sapiens
  heavy chain complementarity determining region 3 for antibody 12878
ARDPTAAGFPAHFDY

SEQ ID NO: 25757 - protein, 9 aa, Homo sapiens
  light chain complementarity determining region 3 for antibody 12879
QHCDHFSIT

SEQ ID NO: 25758 - protein, 15 aa, Homo sapiens
  heavy chain complementarity determining region 3 for antibody 12879
ARDPTAAGCPAHFDY

SEQ ID NO: 25759 - protein, 9 aa, Homo sapiens
  light chain complementarity determining region 3 for antibody 12880
QGYNNAPWP

SEQ ID NO: 25760 - protein, 15 aa, Homo sapiens
  heavy chain complementarity determining region 3 for antibody 12880
GRHRYSSSQGYGMDV

SEQ ID NO: 25761 - protein, 10 aa, Homo sapiens
  light chain complementarity determining region 3 for antibody 12881
PQYVSSELFT

SEQ ID NO: 25762 - protein, 16 aa, Homo sapiens
  heavy chain complementarity determining region 3 for antibody 12881
AREIFKGEIDYYAMDV

SEQ ID NO: 25763 - protein, 9 aa, Homo sapiens
  light chain complementarity determining region 3 for antibody 12882
PQRNNWGLT

SEQ ID NO: 25764 - protein, 22 aa, Homo sapiens
  heavy chain complementarity determining region 3 for antibody 12882
ARHSGYSNTWYMNYYYYYGMDV

SEQ ID NO: 25765 - protein, 9 aa, Homo sapiens
  light chain complementarity determining region 3 for antibody 12883
MQGTYWPPT

SEQ ID NO: 25766 - protein, 15 aa, Homo sapiens
  heavy chain complementarity determining region 3 for antibody 12883
VRDRLHVLTGSSIDS

SEQ ID NO: 25767 - protein, 9 aa, Homo sapiens
  light chain complementarity determining region 3 for antibody 12884
MQGTHWPPT

SEQ ID NO: 25768 - protein, 13 aa, Homo sapiens
  heavy chain complementarity determining region 3 for antibody 12884
ARAYSRTFILLGY

SEQ ID NO: 25769 - protein, 10 aa, Homo sapiens
  light chain complementarity determining region 3 for antibody 12885
MQGTHWPPPN

SEQ ID NO: 25770 - protein, 26 aa, Homo sapiens
  heavy chain complementarity determining region 3 for antibody 12885
ARELITSIATPGHEFPNYYYYYGMDV

SEQ ID NO: 25771 - protein, 8 aa, Homo sapiens
  light chain complementarity determining region 3 for antibody 12886
MQGTHWPP

SEQ ID NO: 25772 - protein, 19 aa, Homo sapiens
  heavy chain complementarity determining region 3 for antibody 12886
ATGPRNNWNYNAWVNRLDP

SEQ ID NO: 25773 - protein, 9 aa, Homo sapiens
  light chain complementarity determining region 3 for antibody 12887
MQGTHWPGT

SEQ ID NO: 25774 - protein, 11 aa, Homo sapiens
  heavy chain complementarity determining region 3 for antibody 12887
ARHVYYSHLDV

SEQ ID NO: 25775 - protein, 9 aa, Homo sapiens
  light chain complementarity determining region 3 for antibody 12888
MQGTHGPPT

SEQ ID NO: 25776 - protein, 15 aa, Homo sapiens
  heavy chain complementarity determining region 3 for antibody 12888
ARGRRGFQEGMGLDV

SEQ ID NO: 25777 - protein, 9 aa, Homo sapiens
  light chain complementarity determining region 3 for antibody 12889
MQGLQTPRT

SEQ ID NO: 25778 - protein, 16 aa, Homo sapiens
  heavy chain complementarity determining region 3 for antibody 12889
ARGGFGELGLHNAFDV

SEQ ID NO: 25779 - protein, 9 aa, Homo sapiens
  light chain complementarity determining region 3 for antibody 12890
MQGLQTPLT

SEQ ID NO: 25780 - protein, 16 aa, Homo sapiens
  heavy chain complementarity determining region 3 for antibody 12890
VRGGFGELGLHNAFDV

SEQ ID NO: 25781 - protein, 9 aa, Homo sapiens
  light chain complementarity determining region 3 for antibody 12891
MQGLQTPLT

SEQ ID NO: 25782 - protein, 16 aa, Homo sapiens
  heavy chain complementarity determining region 3 for antibody 12891
ARGGCGELGLHNAFDV

SEQ ID NO: 25783 - protein, 9 aa, Homo sapiens
  light chain complementarity determining region 3 for antibody 12892
MQGLKTPLT

SEQ ID NO: 25784 - protein, 16 aa, Homo sapiens
  heavy chain complementarity determining region 3 for antibody 12892
ARGGFGELGLHNAFDV

SEQ ID NO: 25785 - protein, 9 aa, Homo sapiens
  light chain complementarity determining region 3 for antibody 12893
MQGAHWPWT

SEQ ID NO: 25786 - protein, 10 aa, Homo sapiens
  heavy chain complementarity determining region 3 for antibody 12893
ARFSRSMSGY

SEQ ID NO: 25787 - protein, 8 aa, Homo sapiens
  light chain complementarity determining region 3 for antibody 12894
MQCLHTRT

SEQ ID NO: 25788 - protein, 14 aa, Homo sapiens
  heavy chain complementarity determining region 3 for antibody 12894
ANSGDHYDHMNRDY

SEQ ID NO: 25789 - protein, 9 aa, Homo sapiens
  light chain complementarity determining region 3 for antibody 12895
MQALQTPWT

SEQ ID NO: 25790 - protein, 19 aa, Homo sapiens
  heavy chain complementarity determining region 3 for antibody 12895
TRRRLVQKTWGYYYYGMEV

SEQ ID NO: 25791 - protein, 9 aa, Homo sapiens
  light chain complementarity determining region 3 for antibody 12896
MQALQTPLT

SEQ ID NO: 25792 - protein, 19 aa, Homo sapiens
  heavy chain complementarity determining region 3 for antibody 12896
ARHKVRGSGSYVYYYAMDV

SEQ ID NO: 25793 - protein, 9 aa, Homo sapiens
  light chain complementarity determining region 3 for antibody 12897
MQALQTPLP

SEQ ID NO: 25794 - protein, 18 aa, Homo sapiens
  heavy chain complementarity determining region 3 for antibody 12897
GRDGRGGGISVAAPGFDL

SEQ ID NO: 25795 - protein, 9 aa, Homo sapiens
  light chain complementarity determining region 3 for antibody 12898
MQALQTPGT

SEQ ID NO: 25796 - protein, 13 aa, Homo sapiens
  heavy chain complementarity determining region 3 for antibody 12898
ARAGRDFYYGMDV

SEQ ID NO: 25797 - protein, 9 aa, Homo sapiens
  light chain complementarity determining region 3 for antibody 12899
MQALQLPLT

SEQ ID NO: 25798 - protein, 19 aa, Homo sapiens
  heavy chain complementarity determining region 3 for antibody 12899
VRHDRYCSGDRCFSFWFDP

SEQ ID NO: 25799 - protein, 9 aa, Homo sapiens
  light chain complementarity determining region 3 for antibody 12900
MQALQLPFP

SEQ ID NO: 25800 - protein, 19 aa, Homo sapiens
  heavy chain complementarity determining region 3 for antibody 12900
VRHDRYCSGDRCFSFWFDP

SEQ ID NO: 25801 - protein, 10 aa, Homo sapiens
  light chain complementarity determining region 3 for antibody 12901
LYHGYSPLYT

SEQ ID NO: 25802 - protein, 12 aa, Homo sapiens
  heavy chain complementarity determining region 3 for antibody 12901
AKGILGRGGMDV

SEQ ID NO: 25803 - protein, 9 aa, Homo sapiens
  light chain complementarity determining region 3 for antibody 12902
LQHNNWPRT

SEQ ID NO: 25804 - protein, 16 aa, Homo sapiens
  heavy chain complementarity determining region 3 for antibody 12902
ARDSGIESRGLWYFDL

SEQ ID NO: 25805 - protein, 9 aa, Homo sapiens
  light chain complementarity determining region 3 for antibody 12903
LQGLQTPLT

SEQ ID NO: 25806 - protein, 16 aa, Homo sapiens
  heavy chain complementarity determining region 3 for antibody 12903
ARGGFGELGLHNAFDV

SEQ ID NO: 25807 - protein, 9 aa, Homo sapiens
  light chain complementarity determining region 3 for antibody 12904
LQDYNYPWT

SEQ ID NO: 25808 - protein, 17 aa, Homo sapiens
  heavy chain complementarity determining region 3 for antibody 12904
IRGMTGTSSTSDYYFDH

SEQ ID NO: 25809 - protein, 8 aa, Homo sapiens
  light chain complementarity determining region 3 for antibody 12905
HQYYGIPT

SEQ ID NO: 25810 - protein, 28 aa, Homo sapiens
  heavy chain complementarity determining region 3 for antibody 12905
ARTRREAPYYDPLTGYYESVHYFYAMDV

SEQ ID NO: 25811 - protein, 9 aa, Homo sapiens
  light chain complementarity determining region 3 for antibody 12906
HQYSVSRGT

SEQ ID NO: 25812 - protein, 21 aa, Homo sapiens
  heavy chain complementarity determining region 3 for antibody 12906
ARDRGGDFHGDSSYYSRPFDY

SEQ ID NO: 25813 - protein, 9 aa, Homo sapiens
  light chain complementarity determining region 3 for antibody 12907
HQYNSFPYT

SEQ ID NO: 25814 - protein, 17 aa, Homo sapiens
  heavy chain complementarity determining region 3 for antibody 12907
AREDWSDIDLRNFYLEF

SEQ ID NO: 25815 - protein, 9 aa, Homo sapiens
  light chain complementarity determining region 3 for antibody 12908
HQYGTSRGP

SEQ ID NO: 25816 - protein, 21 aa, Homo sapiens
  heavy chain complementarity determining region 3 for antibody 12908
ATDRGGDYYRKSGYYYRPFDY

SEQ ID NO: 25817 - protein, 9 aa, Homo sapiens
  light chain complementarity determining region 3 for antibody 12909
HQYGTSRGA

SEQ ID NO: 25818 - protein, 21 aa, Homo sapiens
  heavy chain complementarity determining region 3 for antibody 12909
ATDRGGDYYRKSGYYYRPFDY

SEQ ID NO: 25819 - protein, 9 aa, Homo sapiens
  light chain complementarity determining region 3 for antibody 12910
HQGYTTPHT

SEQ ID NO: 25820 - protein, 14 aa, Homo sapiens
  heavy chain complementarity determining region 3 for antibody 12910
VSRVVEATLDYFDH

SEQ ID NO: 25821 - protein, 11 aa, Homo sapiens
  light chain complementarity determining region 3 for antibody 12911
RQRSNWPPEFT

SEQ ID NO: 25822 - protein, 18 aa, Homo sapiens
  heavy chain complementarity determining region 3 for antibody 12911
ARTEPHTFGHDDYYGLDV

SEQ ID NO: 25823 - protein, 11 aa, Homo sapiens
  light chain complementarity determining region 3 for antibody 12912
QYNGSSPPENP

SEQ ID NO: 25824 - protein, 17 aa, Homo sapiens
  heavy chain complementarity determining region 3 for antibody 12912
ARESYDVLTGYNYGMDV

SEQ ID NO: 25825 - protein, 10 aa, Homo sapiens
  light chain complementarity determining region 3 for antibody 12913
QYHSYSPLYT

SEQ ID NO: 25826 - protein, 12 aa, Homo sapiens
  heavy chain complementarity determining region 3 for antibody 12913
AKGILGRGGMDV

SEQ ID NO: 25827 - protein, 10 aa, Homo sapiens
  light chain complementarity determining region 3 for antibody 12914
QYHGYSPLYT

SEQ ID NO: 25828 - protein, 12 aa, Homo sapiens
  heavy chain complementarity determining region 3 for antibody 12914
ARGILGRGGMDV

SEQ ID NO: 25829 - protein, 10 aa, Homo sapiens
  light chain complementarity determining region 3 for antibody 12915
QYHGYSPLYT

SEQ ID NO: 25830 - protein, 12 aa, Homo sapiens
  heavy chain complementarity determining region 3 for antibody 12915
AKSILGRGGMDV

SEQ ID NO: 25831 - protein, 10 aa, Homo sapiens
  light chain complementarity determining region 3 for antibody 12916
QYHGYSPLYT

SEQ ID NO: 25832 - protein, 12 aa, Homo sapiens
  heavy chain complementarity determining region 3 for antibody 12916
AKGILGRGGTDV

SEQ ID NO: 25833 - protein, 10 aa, Homo sapiens
  light chain complementarity determining region 3 for antibody 12917
QYHGYSPLYT

SEQ ID NO: 25834 - protein, 12 aa, Homo sapiens
  heavy chain complementarity determining region 3 for antibody 12917
AKGILGRGGLDV

SEQ ID NO: 25835 - protein, 10 aa, Homo sapiens
  light chain complementarity determining region 3 for antibody 12918
QYHGYSPLYT

SEQ ID NO: 25836 - protein, 12 aa, Homo sapiens
  heavy chain complementarity determining region 3 for antibody 12918
AKGILGRGDMDV

SEQ ID NO: 25837 - protein, 10 aa, Homo sapiens
  light chain complementarity determining region 3 for antibody 12919
QYHGYSPLYT

SEQ ID NO: 25838 - protein, 12 aa, Homo sapiens
  heavy chain complementarity determining region 3 for antibody 12919
AKGILGREGMDV

SEQ ID NO: 25839 - protein, 10 aa, Homo sapiens
  light chain complementarity determining region 3 for antibody 12920
QYHGYSPLYT

SEQ ID NO: 25840 - protein, 12 aa, Homo sapiens
  heavy chain complementarity determining region 3 for antibody 12920
AKGIFGRGGMDV

SEQ ID NO: 25841 - protein, 10 aa, Homo sapiens
  light chain complementarity determining region 3 for antibody 12921
QYHCYSPLYT

SEQ ID NO: 25842 - protein, 12 aa, Homo sapiens
  heavy chain complementarity determining region 3 for antibody 12921
AKGILGRGGMDV

SEQ ID NO: 25843 - protein, 10 aa, Homo sapiens
  light chain complementarity determining region 3 for antibody 12922
QRYGGSPMYT

SEQ ID NO: 25844 - protein, 20 aa, Homo sapiens
  heavy chain complementarity determining region 3 for antibody 12922
AREFPLAVVDGYYHFYGMNV

SEQ ID NO: 25845 - protein, 9 aa, Homo sapiens
  light chain complementarity determining region 3 for antibody 12923
QRYDNVPLT

SEQ ID NO: 25846 - protein, 16 aa, Homo sapiens
  heavy chain complementarity determining region 3 for antibody 12923
GRVDRLRLGELSGRVY

SEQ ID NO: 25847 - protein, 9 aa, Homo sapiens
  light chain complementarity determining region 3 for antibody 12924
QRPCNAPIT

SEQ ID NO: 25848 - protein, 9 aa, Homo sapiens
  heavy chain complementarity determining region 3 for antibody 12924
VRGYDVFDY

SEQ ID NO: 25849 - protein, 9 aa, Homo sapiens
  light chain complementarity determining region 3 for antibody 12925
QRCNSYPYT

SEQ ID NO: 25850 - protein, 9 aa, Homo sapiens
  heavy chain complementarity determining region 3 for antibody 12925
VAYLAGYQR

SEQ ID NO: 25851 - protein, 9 aa, Homo sapiens
  light chain complementarity determining region 3 for antibody 12926
QRCNSYPST

SEQ ID NO: 25852 - protein, 9 aa, Homo sapiens
  heavy chain complementarity determining region 3 for antibody 12926
VAYLAGYPR

SEQ ID NO: 25853 - protein, 9 aa, Homo sapiens
  light chain complementarity determining region 3 for antibody 12927
QQYYTSSET

SEQ ID NO: 25854 - protein, 19 aa, Homo sapiens
  heavy chain complementarity determining region 3 for antibody 12927
ATVKGDQGELDYDYHGVDV

SEQ ID NO: 25855 - protein, 9 aa, Homo sapiens
  light chain complementarity determining region 3 for antibody 12928
QQYYSYPRT

SEQ ID NO: 25856 - protein, 12 aa, Homo sapiens
  heavy chain complementarity determining region 3 for antibody 12928
VRESAAAGTFDY

SEQ ID NO: 25857 - protein, 9 aa, Homo sapiens
  light chain complementarity determining region 3 for antibody 12929
QQYYSTPPT

SEQ ID NO: 25858 - protein, 19 aa, Homo sapiens
  heavy chain complementarity determining region 3 for antibody 12929
AHGSYYDSNDYYYSEYFQH

SEQ ID NO: 25859 - protein, 9 aa, Homo sapiens
  light chain complementarity determining region 3 for antibody 12930
QQYYSTPLT

SEQ ID NO: 25860 - protein, 12 aa, Homo sapiens
  heavy chain complementarity determining region 3 for antibody 12930
ARDTGGDWEFDF

SEQ ID NO: 25861 - protein, 9 aa, Homo sapiens
  light chain complementarity determining region 3 for antibody 12931
QQYYSTPLT

SEQ ID NO: 25862 - protein, 16 aa, Homo sapiens
  heavy chain complementarity determining region 3 for antibody 12931
ARARAPGQGGENWFDP

SEQ ID NO: 25863 - protein, 9 aa, Homo sapiens
  light chain complementarity determining region 3 for antibody 12932
QQYYSTPHS

SEQ ID NO: 25864 - protein, 13 aa, Homo sapiens
  heavy chain complementarity determining region 3 for antibody 12932
AKATSDGSGALHY

SEQ ID NO: 25865 - protein, 9 aa, Homo sapiens
  light chain complementarity determining region 3 for antibody 12933
QQYYSTPFT

SEQ ID NO: 25866 - protein, 17 aa, Homo sapiens
  heavy chain complementarity determining region 3 for antibody 12933
ARQTDPGTGWHPYYLDS

SEQ ID NO: 25867 - protein, 9 aa, Homo sapiens
  light chain complementarity determining region 3 for antibody 12934
QQYYRAPRT

SEQ ID NO: 25868 - protein, 20 aa, Homo sapiens
  heavy chain complementarity determining region 3 for antibody 12934
VRDDILTGYYQSDYYHAMDV

SEQ ID NO: 25869 - protein, 9 aa, Homo sapiens
  light chain complementarity determining region 3 for antibody 12935
QQYYGGPTT

SEQ ID NO: 25870 - protein, 13 aa, Homo sapiens
  heavy chain complementarity determining region 3 for antibody 12935
ARGKDSGSWMFDY

SEQ ID NO: 25871 - protein, 9 aa, Homo sapiens
  light chain complementarity determining region 3 for antibody 12936
QQYYDNPRT

SEQ ID NO: 25872 - protein, 23 aa, Homo sapiens
  heavy chain complementarity determining region 3 for antibody 12936
ARGGPYRPAPYFYDISGPQYFQH

SEQ ID NO: 25873 - protein, 10 aa, Homo sapiens
  light chain complementarity determining region 3 for antibody 12937
QQYVSSELFT

SEQ ID NO: 25874 - protein, 16 aa, Homo sapiens
  heavy chain complementarity determining region 3 for antibody 12937
SREIFKGEIDYYAMDV

SEQ ID NO: 25875 - protein, 10 aa, Homo sapiens
  light chain complementarity determining region 3 for antibody 12938
QQYVSSELFT

SEQ ID NO: 25876 - protein, 16 aa, Homo sapiens
  heavy chain complementarity determining region 3 for antibody 12938
AREIVKGEIDYYAMDV

SEQ ID NO: 25877 - protein, 10 aa, Homo sapiens
  light chain complementarity determining region 3 for antibody 12939
QQYVSSELFT

SEQ ID NO: 25878 - protein, 16 aa, Homo sapiens
  heavy chain complementarity determining region 3 for antibody 12939
AREIFKGEIYYYAMDV

SEQ ID NO: 25879 - protein, 10 aa, Homo sapiens
  light chain complementarity determining region 3 for antibody 12940
QQYVSSDLFT

SEQ ID NO: 25880 - protein, 16 aa, Homo sapiens
  heavy chain complementarity determining region 3 for antibody 12940
AREIFKGEIDYYAMDV

SEQ ID NO: 25881 - protein, 10 aa, Homo sapiens
  light chain complementarity determining region 3 for antibody 12941
QQYVSSALYT

SEQ ID NO: 25882 - protein, 16 aa, Homo sapiens
  heavy chain complementarity determining region 3 for antibody 12941
ARELFKGEYGYYAMDV

SEQ ID NO: 25883 - protein, 10 aa, Homo sapiens
  light chain complementarity determining region 3 for antibody 12942
QQYVSSALYP

SEQ ID NO: 25884 - protein, 16 aa, Homo sapiens
  heavy chain complementarity determining region 3 for antibody 12942
ARELFKGEYDYYAMDV

SEQ ID NO: 25885 - protein, 10 aa, Homo sapiens
  light chain complementarity determining region 3 for antibody 12943
QQYVPSHQYT

SEQ ID NO: 25886 - protein, 22 aa, Homo sapiens
  heavy chain complementarity determining region 3 for antibody 12943
ARHSPFLEMLGERWLQFGAFDI

SEQ ID NO: 25887 - protein, 10 aa, Homo sapiens
  light chain complementarity determining region 3 for antibody 12944
QQYVPSHKST

SEQ ID NO: 25888 - protein, 22 aa, Homo sapiens
  heavy chain complementarity determining region 3 for antibody 12944
ARHSPFLEMLGERWLQFGAFDI

SEQ ID NO: 25889 - protein, 10 aa, Homo sapiens
  light chain complementarity determining region 3 for antibody 12945
QQYSSSPQLT

SEQ ID NO: 25890 - protein, 13 aa, Homo sapiens
  heavy chain complementarity determining region 3 for antibody 12945
ARSAGYYPNWLEP

SEQ ID NO: 25891 - protein, 10 aa, Homo sapiens
  light chain complementarity determining region 3 for antibody 12946
QQYSSSPKLT

SEQ ID NO: 25892 - protein, 13 aa, Homo sapiens
  heavy chain complementarity determining region 3 for antibody 12946
ARSAGYYPNWLES

SEQ ID NO: 25893 - protein, 9 aa, Homo sapiens
  light chain complementarity determining region 3 for antibody 12947
QQYSRYPVT

SEQ ID NO: 25894 - protein, 11 aa, Homo sapiens
  heavy chain complementarity determining region 3 for antibody 12947
AREQTGYYPHY

SEQ ID NO: 25895 - protein, 9 aa, Homo sapiens
  light chain complementarity determining region 3 for antibody 12948
QQYSRYPVP

SEQ ID NO: 25896 - protein, 11 aa, Homo sapiens
  heavy chain complementarity determining region 3 for antibody 12948
AREQTGYYPLY

SEQ ID NO: 25897 - protein, 9 aa, Homo sapiens
  light chain complementarity determining region 3 for antibody 12949
QQYSNFPYT

SEQ ID NO: 25898 - protein, 17 aa, Homo sapiens
  heavy chain complementarity determining region 3 for antibody 12949
AREQWNDVDLRQFYFDY

SEQ ID NO: 25899 - protein, 10 aa, Homo sapiens
  light chain complementarity determining region 3 for antibody 12950
QQYRSSPQLT

SEQ ID NO: 25900 - protein, 13 aa, Homo sapiens
  heavy chain complementarity determining region 3 for antibody 12950
ARSAGYYPNWLES

SEQ ID NO: 25901 - protein, 9 aa, Homo sapiens
  light chain complementarity determining region 3 for antibody 12951
QQYNTYPLT

SEQ ID NO: 25902 - protein, 19 aa, Homo sapiens
  heavy chain complementarity determining region 3 for antibody 12951
ARDHSHTTMEPGGEGCFDY

SEQ ID NO: 25903 - protein, 7 aa, Homo sapiens
  light chain complementarity determining region 3 for antibody 12952
QQYNTWT

SEQ ID NO: 25904 - protein, 12 aa, Homo sapiens
  heavy chain complementarity determining region 3 for antibody 12952
ARDKGGRNGMDV

SEQ ID NO: 25905 - protein, 9 aa, Homo sapiens
  light chain complementarity determining region 3 for antibody 12953
QQYNSYWYT

SEQ ID NO: 25906 - protein, 20 aa, Homo sapiens
  heavy chain complementarity determining region 3 for antibody 12953
AGTYGSGTYSPDYHYFGMDV

SEQ ID NO: 25907 - protein, 9 aa, Homo sapiens
  light chain complementarity determining region 3 for antibody 12954
QQYNSYWYT

SEQ ID NO: 25908 - protein, 20 aa, Homo sapiens
  heavy chain complementarity determining region 3 for antibody 12954
AGTYGSGTYPPDYYYFGMDV

SEQ ID NO: 25909 - protein, 9 aa, Homo sapiens
  light chain complementarity determining region 3 for antibody 12955
QQYNSYWYT

SEQ ID NO: 25910 - protein, 20 aa, Homo sapiens
  heavy chain complementarity determining region 3 for antibody 12955
AGTYGSGAYSPDYYYFGMDV

SEQ ID NO: 25911 - protein, 9 aa, Homo sapiens
  light chain complementarity determining region 3 for antibody 12956
QQYNSYWYT

SEQ ID NO: 25912 - protein, 20 aa, Homo sapiens
  heavy chain complementarity determining region 3 for antibody 12956
AGSYGSGTYSPDYYYFGMDV

SEQ ID NO: 25913 - protein, 9 aa, Homo sapiens
  light chain complementarity determining region 3 for antibody 12957
QQYNSYWST

SEQ ID NO: 25914 - protein, 20 aa, Homo sapiens
  heavy chain complementarity determining region 3 for antibody 12957
AGTYGSGTYSPDYYYFGMDV

SEQ ID NO: 25915 - protein, 9 aa, Homo sapiens
  light chain complementarity determining region 3 for antibody 12958
QQYNSYWDT

SEQ ID NO: 25916 - protein, 20 aa, Homo sapiens
  heavy chain complementarity determining region 3 for antibody 12958
AGTYGSGTYSPDYYYFGMDV

SEQ ID NO: 25917 - protein, 9 aa, Homo sapiens
  light chain complementarity determining region 3 for antibody 12959
QQYNSYPWT

SEQ ID NO: 25918 - protein, 19 aa, Homo sapiens
  heavy chain complementarity determining region 3 for antibody 12959
ARDSPSVRKRPTEYYGMDV

SEQ ID NO: 25919 - protein, 9 aa, Homo sapiens
  light chain complementarity determining region 3 for antibody 12960
QQYNSYPRT

SEQ ID NO: 25920 - protein, 19 aa, Homo sapiens
  heavy chain complementarity determining region 3 for antibody 12960
ARDSPAVRKRPTEYYGMDV

SEQ ID NO: 25921 - protein, 9 aa, Homo sapiens
  light chain complementarity determining region 3 for antibody 12961
QQYNSLPIT

SEQ ID NO: 25922 - protein, 19 aa, Homo sapiens
  heavy chain complementarity determining region 3 for antibody 12961
ARDRGYTIVDDYGSGVFDY

SEQ ID NO: 25923 - protein, 9 aa, Homo sapiens
  light chain complementarity determining region 3 for antibody 12962
QQYNSLPIT

SEQ ID NO: 25924 - protein, 19 aa, Homo sapiens
  heavy chain complementarity determining region 3 for antibody 12962
ARDRDYAIVDDYGSGVFDY

SEQ ID NO: 25925 - protein, 9 aa, Homo sapiens
  light chain complementarity determining region 3 for antibody 12963
QQYNSLPFT

SEQ ID NO: 25926 - protein, 19 aa, Homo sapiens
  heavy chain complementarity determining region 3 for antibody 12963
ARDRDYTIVDDYGSGVFDY

SEQ ID NO: 25927 - protein, 9 aa, Homo sapiens
  light chain complementarity determining region 3 for antibody 12964
QQYNNWPRG

SEQ ID NO: 25928 - protein, 15 aa, Homo sapiens
  heavy chain complementarity determining region 3 for antibody 12964
VKSGTYSSSSGWFDT

SEQ ID NO: 25929 - protein, 9 aa, Homo sapiens
  light chain complementarity determining region 3 for antibody 12965
QQYNNWPPT

SEQ ID NO: 25930 - protein, 12 aa, Homo sapiens
  heavy chain complementarity determining region 3 for antibody 12965
VSSRTYQLVSDY

SEQ ID NO: 25931 - protein, 9 aa, Homo sapiens
  light chain complementarity determining region 3 for antibody 12966
QQYNNLPYT

SEQ ID NO: 25932 - protein, 13 aa, Homo sapiens
  heavy chain complementarity determining region 3 for antibody 12966
ARAKWDRFGYFDF

SEQ ID NO: 25933 - protein, 10 aa, Homo sapiens
  light chain complementarity determining region 3 for antibody 12967
QQYNKWPSLT

SEQ ID NO: 25934 - protein, 13 aa, Homo sapiens
  heavy chain complementarity determining region 3 for antibody 12967
ARDRGGQWLVHDY

SEQ ID NO: 25935 - protein, 9 aa, Homo sapiens
  light chain complementarity determining region 3 for antibody 12968
QQYNGRPLT

SEQ ID NO: 25936 - protein, 11 aa, Homo sapiens
  heavy chain complementarity determining region 3 for antibody 12968
ARIQQLGALAH

SEQ ID NO: 25937 - protein, 9 aa, Homo sapiens
  light chain complementarity determining region 3 for antibody 12969
QQYKNYPVT

SEQ ID NO: 25938 - protein, 22 aa, Homo sapiens
  heavy chain complementarity determining region 3 for antibody 12969
ARENAHSDYDLGDFSPYDVFDI

SEQ ID NO: 25939 - protein, 9 aa, Homo sapiens
  light chain complementarity determining region 3 for antibody 12970
QQYITYPYT

SEQ ID NO: 25940 - protein, 18 aa, Homo sapiens
  heavy chain complementarity determining region 3 for antibody 12970
GTPVWSGYNHYYHYGMDV

SEQ ID NO: 25941 - protein, 10 aa, Homo sapiens
  light chain complementarity determining region 3 for antibody 12971
QQYHTSLRWT

SEQ ID NO: 25942 - protein, 16 aa, Homo sapiens
  heavy chain complementarity determining region 3 for antibody 12971
AKESPYGTPRTYYFDY

SEQ ID NO: 25943 - protein, 9 aa, Homo sapiens
  light chain complementarity determining region 3 for antibody 12972
QQYHSTPNT

SEQ ID NO: 25944 - protein, 21 aa, Homo sapiens
  heavy chain complementarity determining region 3 for antibody 12972
ARPGGQYCSGSNCYYDNWFGS

SEQ ID NO: 25945 - protein, 10 aa, Homo sapiens
  light chain complementarity determining region 3 for antibody 12973
QQYHNWPPLT

SEQ ID NO: 25946 - protein, 14 aa, Homo sapiens
  heavy chain complementarity determining region 3 for antibody 12973
ARDFSTGIYGWFDP

SEQ ID NO: 25947 - protein, 9 aa, Homo sapiens
  light chain complementarity determining region 3 for antibody 12974
QQYGWSPAT

SEQ ID NO: 25948 - protein, 13 aa, Homo sapiens
  heavy chain complementarity determining region 3 for antibody 12974
GHPTIAATYGVDV

SEQ ID NO: 25949 - protein, 9 aa, Homo sapiens
  light chain complementarity determining region 3 for antibody 12975
QQYGTSPLP

SEQ ID NO: 25950 - protein, 16 aa, Homo sapiens
  heavy chain complementarity determining region 3 for antibody 12975
ARWGAVPESRKNCFDY

SEQ ID NO: 25951 - protein, 9 aa, Homo sapiens
  light chain complementarity determining region 3 for antibody 12976
QQYGTLPPS

SEQ ID NO: 25952 - protein, 13 aa, Homo sapiens
  heavy chain complementarity determining region 3 for antibody 12976
NTWVGGRGDLFDY

SEQ ID NO: 25953 - protein, 9 aa, Homo sapiens
  light chain complementarity determining region 3 for antibody 12977
QQYGSSPWT

SEQ ID NO: 25954 - protein, 11 aa, Homo sapiens
  heavy chain complementarity determining region 3 for antibody 12977
ARGIPHYYFDL

SEQ ID NO: 25955 - protein, 9 aa, Homo sapiens
  light chain complementarity determining region 3 for antibody 12978
QQYGSSPWT

SEQ ID NO: 25956 - protein, 22 aa, Homo sapiens
  heavy chain complementarity determining region 3 for antibody 12978
ARASTHYSDSSGYYVALNTFDL

SEQ ID NO: 25957 - protein, 10 aa, Homo sapiens
  light chain complementarity determining region 3 for antibody 12979
QQYGSSPTWT

SEQ ID NO: 25958 - protein, 16 aa, Homo sapiens
  heavy chain complementarity determining region 3 for antibody 12979
ARDYAASSGYAYWFDP

SEQ ID NO: 25959 - protein, 9 aa, Homo sapiens
  light chain complementarity determining region 3 for antibody 12980
QQYGSSPST

SEQ ID NO: 25960 - protein, 13 aa, Homo sapiens
  heavy chain complementarity determining region 3 for antibody 12980
ARGSTYGSGTYTS

SEQ ID NO: 25961 - protein, 10 aa, Homo sapiens
  light chain complementarity determining region 3 for antibody 12981
QQYGSSPPWT

SEQ ID NO: 25962 - protein, 20 aa, Homo sapiens
  heavy chain complementarity determining region 3 for antibody 12981
AKQKSVGILSSSWKVGPYDY

SEQ ID NO: 25963 - protein, 10 aa, Homo sapiens
  light chain complementarity determining region 3 for antibody 12982
QQYGSSPAGP

SEQ ID NO: 25964 - protein, 17 aa, Homo sapiens
  heavy chain complementarity determining region 3 for antibody 12982
AREDWSDVDLRAFYFDS

SEQ ID NO: 25965 - protein, 10 aa, Homo sapiens
  light chain complementarity determining region 3 for antibody 12983
QQYGRSPRNI

SEQ ID NO: 25966 - protein, 12 aa, Homo sapiens
  heavy chain complementarity determining region 3 for antibody 12983
TRDLGSRYGMDV

SEQ ID NO: 25967 - protein, 10 aa, Homo sapiens
  light chain complementarity determining region 3 for antibody 12984
QQYGRPAGYT

SEQ ID NO: 25968 - protein, 11 aa, Homo sapiens
  heavy chain complementarity determining region 3 for antibody 12984
ARGPATGDFDY

SEQ ID NO: 25969 - protein, 11 aa, Homo sapiens
  light chain complementarity determining region 3 for antibody 12985
QQYGGSPPSYT

SEQ ID NO: 25970 - protein, 10 aa, Homo sapiens
  heavy chain complementarity determining region 3 for antibody 12985
ARGIGVLGDF

SEQ ID NO: 25971 - protein, 10 aa, Homo sapiens
  light chain complementarity determining region 3 for antibody 12986
QQYGALPPWT

SEQ ID NO: 25972 - protein, 16 aa, Homo sapiens
  heavy chain complementarity determining region 3 for antibody 12986
ARGGSEAWRYFYGMDV

SEQ ID NO: 25973 - protein, 10 aa, Homo sapiens
  light chain complementarity determining region 3 for antibody 12987
QQYFNWPLIT

SEQ ID NO: 25974 - protein, 15 aa, Homo sapiens
  heavy chain complementarity determining region 3 for antibody 12987
ASMFEVDSGTYYSNY

SEQ ID NO: 25975 - protein, 9 aa, Homo sapiens
  light chain complementarity determining region 3 for antibody 12988
QQYDTYPLT

SEQ ID NO: 25976 - protein, 19 aa, Homo sapiens
  heavy chain complementarity determining region 3 for antibody 12988
ARDRSDASMDPGGEGCFDH

SEQ ID NO: 25977 - protein, 9 aa, Homo sapiens
  light chain complementarity determining region 3 for antibody 12989
QQYDTSPFT

SEQ ID NO: 25978 - protein, 11 aa, Homo sapiens
  heavy chain complementarity determining region 3 for antibody 12989
GRGSVTPDMGY

SEQ ID NO: 25979 - protein, 10 aa, Homo sapiens
  light chain complementarity determining region 3 for antibody 12990
QQYDSLPPFT

SEQ ID NO: 25980 - protein, 16 aa, Homo sapiens
  heavy chain complementarity determining region 3 for antibody 12990
ARELFKGEYDYYAMDV

SEQ ID NO: 25981 - protein, 9 aa, Homo sapiens
  light chain complementarity determining region 3 for antibody 12991
QQYDSLPLT

SEQ ID NO: 25982 - protein, 18 aa, Homo sapiens
  heavy chain complementarity determining region 3 for antibody 12991
ARAPGDYDMLRRCYYFDH

SEQ ID NO: 25983 - protein, 9 aa, Homo sapiens
  light chain complementarity determining region 3 for antibody 12992
QQYDSLPLT

SEQ ID NO: 25984 - protein, 18 aa, Homo sapiens
  heavy chain complementarity determining region 3 for antibody 12992
ARAAGDYDMLRRGYYFDH

SEQ ID NO: 25985 - protein, 9 aa, Homo sapiens
  light chain complementarity determining region 3 for antibody 12993
QQYDSIPLT

SEQ ID NO: 25986 - protein, 18 aa, Homo sapiens
  heavy chain complementarity determining region 3 for antibody 12993
ARAPGDYDMLRRGYYFDH

SEQ ID NO: 25987 - protein, 9 aa, Homo sapiens
  light chain complementarity determining region 3 for antibody 12994
QQYDSFPYT

SEQ ID NO: 25988 - protein, 17 aa, Homo sapiens
  heavy chain complementarity determining region 3 for antibody 12994
AREDWSDVDSRAFYFDS

SEQ ID NO: 25989 - protein, 8 aa, Homo sapiens
  light chain complementarity determining region 3 for antibody 12995
QQYDQFPT

SEQ ID NO: 25990 - protein, 20 aa, Homo sapiens
  heavy chain complementarity determining region 3 for antibody 12995
ATDRGTYSRSGSYYHYPLDY

SEQ ID NO: 25991 - protein, 8 aa, Homo sapiens
  light chain complementarity determining region 3 for antibody 12996
QQYDQFPT

SEQ ID NO: 25992 - protein, 20 aa, Homo sapiens
  heavy chain complementarity determining region 3 for antibody 12996
ATDRGTYLRSGSYYHYPLDY

SEQ ID NO: 25993 - protein, 11 aa, Homo sapiens
  light chain complementarity determining region 3 for antibody 12997
QQYDNSSPGYP

SEQ ID NO: 25994 - protein, 16 aa, Homo sapiens
  heavy chain complementarity determining region 3 for antibody 12997
AHRFYYGTNGSVAFDI

SEQ ID NO: 25995 - protein, 10 aa, Homo sapiens
  light chain complementarity determining region 3 for antibody 12998
QQYDNLPSVP

SEQ ID NO: 25996 - protein, 11 aa, Homo sapiens
  heavy chain complementarity determining region 3 for antibody 12998
AKSGGFWSFDY

SEQ ID NO: 25997 - protein, 9 aa, Homo sapiens
  light chain complementarity determining region 3 for antibody 12999
QQYDNLPLT

SEQ ID NO: 25998 - protein, 18 aa, Homo sapiens
  heavy chain complementarity determining region 3 for antibody 12999
ARAPGGYDMLRRGYYFDH

SEQ ID NO: 25999 - protein, 10 aa, Homo sapiens
  light chain complementarity determining region 3 for antibody 13000
QQYDNIPPFT

SEQ ID NO: 26000 - protein, 16 aa, Homo sapiens
  heavy chain complementarity determining region 3 for antibody 13000
ARELFKGEYDYYAMDV

SEQ ID NO: 26001 - protein, 9 aa, Homo sapiens
  light chain complementarity determining region 3 for antibody 13001
QQYDILPLT

SEQ ID NO: 26002 - protein, 18 aa, Homo sapiens
  heavy chain complementarity determining region 3 for antibody 13001
ARAPGDYDMLRRGYYFDH

SEQ ID NO: 26003 - protein, 9 aa, Homo sapiens
  light chain complementarity determining region 3 for antibody 13002
QQYASTPRT

SEQ ID NO: 26004 - protein, 14 aa, Homo sapiens
  heavy chain complementarity determining region 3 for antibody 13002
ARGPKWLLPKEFDY

SEQ ID NO: 26005 - protein, 10 aa, Homo sapiens
  light chain complementarity determining region 3 for antibody 13003
QQYASSELFT

SEQ ID NO: 26006 - protein, 16 aa, Homo sapiens
  heavy chain complementarity determining region 3 for antibody 13003
AREIFKGEIDYYAMDV

SEQ ID NO: 26007 - protein, 9 aa, Homo sapiens
  light chain complementarity determining region 3 for antibody 13004
QQVNSYAYT

SEQ ID NO: 26008 - protein, 16 aa, Homo sapiens
  heavy chain complementarity determining region 3 for antibody 13004
ATTTGYSNYYYYGMDV

SEQ ID NO: 26009 - protein, 9 aa, Homo sapiens
  light chain complementarity determining region 3 for antibody 13005
QQVNSFPFT

SEQ ID NO: 26010 - protein, 19 aa, Homo sapiens
  heavy chain complementarity determining region 3 for antibody 13005
ARTDCSGDTDRYYDFGMDV

SEQ ID NO: 26011 - protein, 9 aa, Homo sapiens
  light chain complementarity determining region 3 for antibody 13006
QQTYSTPVT

SEQ ID NO: 26012 - protein, 16 aa, Homo sapiens
  heavy chain complementarity determining region 3 for antibody 13006
ATLSTASGWSRGWLDP

SEQ ID NO: 26013 - protein, 9 aa, Homo sapiens
  light chain complementarity determining region 3 for antibody 13007
QQSYTTPRT

SEQ ID NO: 26014 - protein, 19 aa, Homo sapiens
  heavy chain complementarity determining region 3 for antibody 13007
ARDGPILRFCDDPVYGMDV

SEQ ID NO: 26015 - protein, 9 aa, Homo sapiens
  light chain complementarity determining region 3 for antibody 13008
QQSYTFPWT

SEQ ID NO: 26016 - protein, 14 aa, Homo sapiens
  heavy chain complementarity determining region 3 for antibody 13008
ATDPPTDGYNALDF

SEQ ID NO: 26017 - protein, 9 aa, Homo sapiens
  light chain complementarity determining region 3 for antibody 13009
QQSYSTPYT

SEQ ID NO: 26018 - protein, 12 aa, Homo sapiens
  heavy chain complementarity determining region 3 for antibody 13009
AVELGYGNIPIA

SEQ ID NO: 26019 - protein, 9 aa, Homo sapiens
  light chain complementarity determining region 3 for antibody 13010
QQSYSTPYT

SEQ ID NO: 26020 - protein, 12 aa, Homo sapiens
  heavy chain complementarity determining region 3 for antibody 13010
AVELGYGDIPNA

SEQ ID NO: 26021 - protein, 9 aa, Homo sapiens
  light chain complementarity determining region 3 for antibody 13011
QQSYSTPRT

SEQ ID NO: 26022 - protein, 14 aa, Homo sapiens
  heavy chain complementarity determining region 3 for antibody 13011
ARVQVDYSNYGCDY

SEQ ID NO: 26023 - protein, 10 aa, Homo sapiens
  light chain complementarity determining region 3 for antibody 13012
QQSYSTPPYT

SEQ ID NO: 26024 - protein, 15 aa, Homo sapiens
  heavy chain complementarity determining region 3 for antibody 13012
AKAVVRGVISSYVDY

SEQ ID NO: 26025 - protein, 9 aa, Homo sapiens
  light chain complementarity determining region 3 for antibody 13013
QQSYSTPFT

SEQ ID NO: 26026 - protein, 14 aa, Homo sapiens
  heavy chain complementarity determining region 3 for antibody 13013
ARLPGIYPRYSMDV

SEQ ID NO: 26027 - protein, 9 aa, Homo sapiens
  light chain complementarity determining region 3 for antibody 13014
QQSYSTPFT

SEQ ID NO: 26028 - protein, 15 aa, Homo sapiens
  heavy chain complementarity determining region 3 for antibody 13014
AKGGDTAMLDWYFDP

SEQ ID NO: 26029 - protein, 11 aa, Homo sapiens
  light chain complementarity determining region 3 for antibody 13015
QQSYSSPGGLT

SEQ ID NO: 26030 - protein, 16 aa, Homo sapiens
  heavy chain complementarity determining region 3 for antibody 13015
ARARQGLPRYKNWFDP

SEQ ID NO: 26031 - protein, 8 aa, Homo sapiens
  light chain complementarity determining region 3 for antibody 13016
QQSYSSLT

SEQ ID NO: 26032 - protein, 19 aa, Homo sapiens
  heavy chain complementarity determining region 3 for antibody 13016
VRDSLRYFDWIRPSNWFDA

SEQ ID NO: 26033 - protein, 9 aa, Homo sapiens
  light chain complementarity determining region 3 for antibody 13017
QQSYRPPQP

SEQ ID NO: 26034 - protein, 14 aa, Homo sapiens
  heavy chain complementarity determining region 3 for antibody 13017
ARSKEWFLGAAFDY

SEQ ID NO: 26035 - protein, 8 aa, Homo sapiens
  light chain complementarity determining region 3 for antibody 13018
QQSYRPPA

SEQ ID NO: 26036 - protein, 15 aa, Homo sapiens
  heavy chain complementarity determining region 3 for antibody 13018
AKDSLAGSYYDYFDY

SEQ ID NO: 26037 - protein, 9 aa, Homo sapiens
  light chain complementarity determining region 3 for antibody 13019
QQSYNLPWT

SEQ ID NO: 26038 - protein, 14 aa, Homo sapiens
  heavy chain complementarity determining region 3 for antibody 13019
ARAGPSGTYSGFDS

SEQ ID NO: 26039 - protein, 9 aa, Homo sapiens
  light chain complementarity determining region 3 for antibody 13020
QQSYNKPYS

SEQ ID NO: 26040 - protein, 16 aa, Homo sapiens
  heavy chain complementarity determining region 3 for antibody 13020
AKVPSYGDPTYNWFDP

SEQ ID NO: 26041 - protein, 9 aa, Homo sapiens
  light chain complementarity determining region 3 for antibody 13021
QQSYDVLAT

SEQ ID NO: 26042 - protein, 12 aa, Homo sapiens
  heavy chain complementarity determining region 3 for antibody 13021
AREIDTIFYSDY

SEQ ID NO: 26043 - protein, 9 aa, Homo sapiens
  light chain complementarity determining region 3 for antibody 13022
QQSYDALDT

SEQ ID NO: 26044 - protein, 12 aa, Homo sapiens
  heavy chain complementarity determining region 3 for antibody 13022
AREIDTIFYSDY

SEQ ID NO: 26045 - protein, 10 aa, Homo sapiens
  light chain complementarity determining region 3 for antibody 13023
QQSSSSPQLT

SEQ ID NO: 26046 - protein, 13 aa, Homo sapiens
  heavy chain complementarity determining region 3 for antibody 13023
ARSAGYYPNWLES

SEQ ID NO: 26047 - protein, 9 aa, Homo sapiens
  light chain complementarity determining region 3 for antibody 13024
QQSFTIQFT

SEQ ID NO: 26048 - protein, 13 aa, Homo sapiens
  heavy chain complementarity determining region 3 for antibody 13024
ATDRCVGFSCADS

SEQ ID NO: 26049 - protein, 9 aa, Homo sapiens
  light chain complementarity determining region 3 for antibody 13025
QQSFSPPWA

SEQ ID NO: 26050 - protein, 19 aa, Homo sapiens
  heavy chain complementarity determining region 3 for antibody 13025
ATMRYGSGERTYDYYGMDV

SEQ ID NO: 26051 - protein, 9 aa, Homo sapiens
  light chain complementarity determining region 3 for antibody 13026
QQSFSPPWA

SEQ ID NO: 26052 - protein, 19 aa, Homo sapiens
  heavy chain complementarity determining region 3 for antibody 13026
ATLRYISGELAYDYYGMDV

SEQ ID NO: 26053 - protein, 10 aa, Homo sapiens
  light chain complementarity determining region 3 for antibody 13027
QQSFSPPSLP

SEQ ID NO: 26054 - protein, 10 aa, Homo sapiens
  heavy chain complementarity determining region 3 for antibody 13027
ARDWGWGFDP

SEQ ID NO: 26055 - protein, 9 aa, Homo sapiens
  light chain complementarity determining region 3 for antibody 13028
QQSCSTPRT

SEQ ID NO: 26056 - protein, 23 aa, Homo sapiens
  heavy chain complementarity determining region 3 for antibody 13028
ARGVPSDYDFWSGSTREGGWFDP

SEQ ID NO: 26057 - protein, 9 aa, Homo sapiens
  light chain complementarity determining region 3 for antibody 13029
QQSCSTPLT

SEQ ID NO: 26058 - protein, 13 aa, Homo sapiens
  heavy chain complementarity determining region 3 for antibody 13029
ARVYSSTWYNFDS

SEQ ID NO: 26059 - protein, 9 aa, Homo sapiens
  light chain complementarity determining region 3 for antibody 13030
QQRYSTPRT

SEQ ID NO: 26060 - protein, 14 aa, Homo sapiens
  heavy chain complementarity determining region 3 for antibody 13030
ARVQVDYSNYGCDS

SEQ ID NO: 26061 - protein, 10 aa, Homo sapiens
  light chain complementarity determining region 3 for antibody 13031
QQRTSWPPLT

SEQ ID NO: 26062 - protein, 12 aa, Homo sapiens
  heavy chain complementarity determining region 3 for antibody 13031
TDTHVTGGDWDY

SEQ ID NO: 26063 - protein, 10 aa, Homo sapiens
  light chain complementarity determining region 3 for antibody 13032
QQRTRWPPLT

SEQ ID NO: 26064 - protein, 12 aa, Homo sapiens
  heavy chain complementarity determining region 3 for antibody 13032
TDTHVTRGDWDY

SEQ ID NO: 26065 - protein, 10 aa, Homo sapiens
  light chain complementarity determining region 3 for antibody 13033
QQRTRGPPLT

SEQ ID NO: 26066 - protein, 12 aa, Homo sapiens
  heavy chain complementarity determining region 3 for antibody 13033
TDTHVTGGDWDY

SEQ ID NO: 26067 - protein, 11 aa, Homo sapiens
  light chain complementarity determining region 3 for antibody 13034
QQRTNWPPDVA

SEQ ID NO: 26068 - protein, 19 aa, Homo sapiens
  heavy chain complementarity determining region 3 for antibody 13034
ARDSVQVPTAILYYYGLDV

SEQ ID NO: 26069 - protein, 9 aa, Homo sapiens
  light chain complementarity determining region 3 for antibody 13035
QQRTNWPAT

SEQ ID NO: 26070 - protein, 19 aa, Homo sapiens
  heavy chain complementarity determining region 3 for antibody 13035
VRARQYRSSWYGPSDAFDI

SEQ ID NO: 26071 - protein, 11 aa, Homo sapiens
  light chain complementarity determining region 3 for antibody 13036
QQRSNWPPSGT

SEQ ID NO: 26072 - protein, 16 aa, Homo sapiens
  heavy chain complementarity determining region 3 for antibody 13036
ARGALVVLVDLNAFDI

SEQ ID NO: 26073 - protein, 10 aa, Homo sapiens
  light chain complementarity determining region 3 for antibody 13037
QQRSNWPPLT

SEQ ID NO: 26074 - protein, 17 aa, Homo sapiens
  heavy chain complementarity determining region 3 for antibody 13037
ARFEGIAPRPHKGTFDY

SEQ ID NO: 26075 - protein, 10 aa, Homo sapiens
  light chain complementarity determining region 3 for antibody 13038
QQRSNWPPFT

SEQ ID NO: 26076 - protein, 19 aa, Homo sapiens
  heavy chain complementarity determining region 3 for antibody 13038
ARQANWSPTKTGGNYYLDS

SEQ ID NO: 26077 - protein, 9 aa, Homo sapiens
  light chain complementarity determining region 3 for antibody 13039
QQRSNWPLP

SEQ ID NO: 26078 - protein, 19 aa, Homo sapiens
  heavy chain complementarity determining region 3 for antibody 13039
ARGARDYGDSGFGVYYFDY

SEQ ID NO: 26079 - protein, 10 aa, Homo sapiens
  light chain complementarity determining region 3 for antibody 13040
QQRSNLPIFT

SEQ ID NO: 26080 - protein, 14 aa, Homo sapiens
  heavy chain complementarity determining region 3 for antibody 13040
ARLNKMTRIRYFDS

SEQ ID NO: 26081 - protein, 9 aa, Homo sapiens
  light chain complementarity determining region 3 for antibody 13041
QQRNNWGLT

SEQ ID NO: 26082 - protein, 22 aa, Homo sapiens
  heavy chain complementarity determining region 3 for antibody 13041
ARHAGYSNTWYMNYYYYYGMDV

SEQ ID NO: 26083 - protein, 9 aa, Homo sapiens
  light chain complementarity determining region 3 for antibody 13042
QQRNNWGLT

SEQ ID NO: 26084 - protein, 22 aa, Homo sapiens
  heavy chain complementarity determining region 3 for antibody 13042
AGHSGYSNTWYMNYYYYYGMDV

SEQ ID NO: 26085 - protein, 9 aa, Homo sapiens
  light chain complementarity determining region 3 for antibody 13043
QQRNNWELT

SEQ ID NO: 26086 - protein, 22 aa, Homo sapiens
  heavy chain complementarity determining region 3 for antibody 13043
ARHSGYSNTWYMNYYYYYGMDV

SEQ ID NO: 26087 - protein, 9 aa, Homo sapiens
  light chain complementarity determining region 3 for antibody 13044
QQRGNWPPT

SEQ ID NO: 26088 - protein, 13 aa, Homo sapiens
  heavy chain complementarity determining region 3 for antibody 13044
ARDGVWSTSSADL

SEQ ID NO: 26089 - protein, 9 aa, Homo sapiens
  light chain complementarity determining region 3 for antibody 13045
QQRFSPPWA

SEQ ID NO: 26090 - protein, 19 aa, Homo sapiens
  heavy chain complementarity determining region 3 for antibody 13045
ATMRYGSGELTYDYYGMDV

SEQ ID NO: 26091 - protein, 9 aa, Homo sapiens
  light chain complementarity determining region 3 for antibody 13046
QQQSTGRWT

SEQ ID NO: 26092 - protein, 15 aa, Homo sapiens
  heavy chain complementarity determining region 3 for antibody 13046
AKEGCSGGICYGFDV

SEQ ID NO: 26093 - protein, 9 aa, Homo sapiens
  light chain complementarity determining region 3 for antibody 13047
QQPFTGRWT

SEQ ID NO: 26094 - protein, 15 aa, Homo sapiens
  heavy chain complementarity determining region 3 for antibody 13047
AKEGCSGGICYGFDV

SEQ ID NO: 26095 - protein, 9 aa, Homo sapiens
  light chain complementarity determining region 3 for antibody 13048
QQNNNLPYT

SEQ ID NO: 26096 - protein, 13 aa, Homo sapiens
  heavy chain complementarity determining region 3 for antibody 13048
ARAKWDLFGYFDF

SEQ ID NO: 26097 - protein, 10 aa, Homo sapiens
  light chain complementarity determining region 3 for antibody 13049
QQLNTYPPIP

SEQ ID NO: 26098 - protein, 14 aa, Homo sapiens
  heavy chain complementarity determining region 3 for antibody 13049
AGDADTPHRRAFDV

SEQ ID NO: 26099 - protein, 9 aa, Homo sapiens
  light chain complementarity determining region 3 for antibody 13050
QQHNSYPIT

SEQ ID NO: 26100 - protein, 13 aa, Homo sapiens
  heavy chain complementarity determining region 3 for antibody 13050
ASGLHSGYDYFDY

SEQ ID NO: 26101 - protein, 9 aa, Homo sapiens
  light chain complementarity determining region 3 for antibody 13051
QQHKTDPWT

SEQ ID NO: 26102 - protein, 10 aa, Homo sapiens
  heavy chain complementarity determining region 3 for antibody 13051
IRHEEYVRPY

SEQ ID NO: 26103 - protein, 10 aa, Homo sapiens
  light chain complementarity determining region 3 for antibody 13052
QQHGSSPGLP

SEQ ID NO: 26104 - protein, 19 aa, Homo sapiens
  heavy chain complementarity determining region 3 for antibody 13052
AREREYYGDYVSYYYAMDV

SEQ ID NO: 26105 - protein, 9 aa, Homo sapiens
  light chain complementarity determining region 3 for antibody 13053
QQHGSSIFT

SEQ ID NO: 26106 - protein, 14 aa, Homo sapiens
  heavy chain complementarity determining region 3 for antibody 13053
AKDPNGDYVGTFEM

SEQ ID NO: 26107 - protein, 9 aa, Homo sapiens
  light chain complementarity determining region 3 for antibody 13054
QQGYSVPYT

SEQ ID NO: 26108 - protein, 17 aa, Homo sapiens
  heavy chain complementarity determining region 3 for antibody 13054
ARAPDYYDNSGHYNLDL

SEQ ID NO: 26109 - protein, 9 aa, Homo sapiens
  light chain complementarity determining region 3 for antibody 13055
QQGNSSPFT

SEQ ID NO: 26110 - protein, 19 aa, Homo sapiens
  heavy chain complementarity determining region 3 for antibody 13055
ARTDCSGDTDRYYDFGMDV

SEQ ID NO: 26111 - protein, 9 aa, Homo sapiens
  light chain complementarity determining region 3 for antibody 13056
QQGNSFPFP

SEQ ID NO: 26112 - protein, 19 aa, Homo sapiens
  heavy chain complementarity determining region 3 for antibody 13056
ARTDCSGDTDRYYDFGMDV

SEQ ID NO: 26113 - protein, 9 aa, Homo sapiens
  light chain complementarity determining region 3 for antibody 13057
QQGHSLPFT

SEQ ID NO: 26114 - protein, 19 aa, Homo sapiens
  heavy chain complementarity determining region 3 for antibody 13057
ARSDYSGDADRYYDYGMDV

SEQ ID NO: 26115 - protein, 9 aa, Homo sapiens
  light chain complementarity determining region 3 for antibody 13058
QQGHSLPFT

SEQ ID NO: 26116 - protein, 19 aa, Homo sapiens
  heavy chain complementarity determining region 3 for antibody 13058
AGSDYSGDTDRYYDYGMDV

SEQ ID NO: 26117 - protein, 9 aa, Homo sapiens
  light chain complementarity determining region 3 for antibody 13059
QQFNTYPLT

SEQ ID NO: 26118 - protein, 17 aa, Homo sapiens
  heavy chain complementarity determining region 3 for antibody 13059
AKDLSGAHYDIHHGLDV

SEQ ID NO: 26119 - protein, 8 aa, Homo sapiens
  light chain complementarity determining region 3 for antibody 13060
QQFNSYPL

SEQ ID NO: 26120 - protein, 14 aa, Homo sapiens
  heavy chain complementarity determining region 3 for antibody 13060
ARVGYPRVVGWMEN

SEQ ID NO: 26121 - protein, 9 aa, Homo sapiens
  light chain complementarity determining region 3 for antibody 13061
QQFHSYPIT

SEQ ID NO: 26122 - protein, 16 aa, Homo sapiens
  heavy chain complementarity determining region 3 for antibody 13061
ARTRGTRDYYYYAMDV

SEQ ID NO: 26123 - protein, 9 aa, Homo sapiens
  light chain complementarity determining region 3 for antibody 13062
QQFHSYPIT

SEQ ID NO: 26124 - protein, 16 aa, Homo sapiens
  heavy chain complementarity determining region 3 for antibody 13062
ARTQGTREYYYYAMDV

SEQ ID NO: 26125 - protein, 9 aa, Homo sapiens
  light chain complementarity determining region 3 for antibody 13063
QQFHSYPIT

SEQ ID NO: 26126 - protein, 16 aa, Homo sapiens
  heavy chain complementarity determining region 3 for antibody 13063
ARTQGTRDYYYYAMGV

SEQ ID NO: 26127 - protein, 9 aa, Homo sapiens
  light chain complementarity determining region 3 for antibody 13064
QQFHSYPIT

SEQ ID NO: 26128 - protein, 16 aa, Homo sapiens
  heavy chain complementarity determining region 3 for antibody 13064
AGTQGTRDYYYYAMDV

SEQ ID NO: 26129 - protein, 9 aa, Homo sapiens
  light chain complementarity determining region 3 for antibody 13065
QQCHSLPFT

SEQ ID NO: 26130 - protein, 19 aa, Homo sapiens
  heavy chain complementarity determining region 3 for antibody 13065
ARSDYSGDTDRYYDYGMDV

SEQ ID NO: 26131 - protein, 9 aa, Homo sapiens
  light chain complementarity determining region 3 for antibody 13066
QQAYSFPPT

SEQ ID NO: 26132 - protein, 17 aa, Homo sapiens
  heavy chain complementarity determining region 3 for antibody 13066
AKDLDTPMDYYFYGMDV

SEQ ID NO: 26133 - protein, 9 aa, Homo sapiens
  light chain complementarity determining region 3 for antibody 13067
QQAYRFPLS

SEQ ID NO: 26134 - protein, 13 aa, Homo sapiens
  heavy chain complementarity determining region 3 for antibody 13067
TRTYGPGRNWFDP

SEQ ID NO: 26135 - protein, 9 aa, Homo sapiens
  light chain complementarity determining region 3 for antibody 13068
QQANSFPRT

SEQ ID NO: 26136 - protein, 14 aa, Homo sapiens
  heavy chain complementarity determining region 3 for antibody 13068
ARLNKMTRIRYFDS

SEQ ID NO: 26137 - protein, 11 aa, Homo sapiens
  light chain complementarity determining region 3 for antibody 13069
QQANSFPPPVT

SEQ ID NO: 26138 - protein, 18 aa, Homo sapiens
  heavy chain complementarity determining region 3 for antibody 13069
ARGRSCSSNRCPTVWFDP

SEQ ID NO: 26139 - protein, 9 aa, Homo sapiens
  light chain complementarity determining region 3 for antibody 13070
QQANSFPIT

SEQ ID NO: 26140 - protein, 24 aa, Homo sapiens
  heavy chain complementarity determining region 3 for antibody 13070
TTDSLINDDIMPGYPNYYYYGMDV

SEQ ID NO: 26141 - protein, 9 aa, Homo sapiens
  light chain complementarity determining region 3 for antibody 13071
QQANNFPIT

SEQ ID NO: 26142 - protein, 18 aa, Homo sapiens
  heavy chain complementarity determining region 3 for antibody 13071
AKALPPGIEVVGTNYFDR

SEQ ID NO: 26143 - protein, 8 aa, Homo sapiens
  light chain complementarity determining region 3 for antibody 13072
QQAHSFSP

SEQ ID NO: 26144 - protein, 22 aa, Homo sapiens
  heavy chain complementarity determining region 3 for antibody 13072
ARHSGYSNTWYMNYYYYYGMDV

SEQ ID NO: 26145 - protein, 11 aa, Homo sapiens
  light chain complementarity determining region 3 for antibody 13073
QLLNSHSGGLT

SEQ ID NO: 26146 - protein, 19 aa, Homo sapiens
  heavy chain complementarity determining region 3 for antibody 13073
ARGGPCSGTTCFSYYGVDV

SEQ ID NO: 26147 - protein, 10 aa, Homo sapiens
  light chain complementarity determining region 3 for antibody 13074
QLFGNSPRYP

SEQ ID NO: 26148 - protein, 20 aa, Homo sapiens
  heavy chain complementarity determining region 3 for antibody 13074
ARDRGGRSSSFTNYQYNMDV

SEQ ID NO: 26149 - protein, 9 aa, Homo sapiens
  light chain complementarity determining region 3 for antibody 13075
QLCNSYPYT

SEQ ID NO: 26150 - protein, 9 aa, Homo sapiens
  heavy chain complementarity determining region 3 for antibody 13075
VAYLAGYPR

SEQ ID NO: 26151 - protein, 9 aa, Homo sapiens
  light chain complementarity determining region 3 for antibody 13076
QKYSTFPYT

SEQ ID NO: 26152 - protein, 17 aa, Homo sapiens
  heavy chain complementarity determining region 3 for antibody 13076
AREDWNDVDLRQFYFDY

SEQ ID NO: 26153 - protein, 9 aa, Homo sapiens
  light chain complementarity determining region 3 for antibody 13077
QHYYSTPYS

SEQ ID NO: 26154 - protein, 13 aa, Homo sapiens
  heavy chain complementarity determining region 3 for antibody 13077
AKATSDGSGALHY

SEQ ID NO: 26155 - protein, 9 aa, Homo sapiens
  light chain complementarity determining region 3 for antibody 13078
QHYNSYWYT

SEQ ID NO: 26156 - protein, 20 aa, Homo sapiens
  heavy chain complementarity determining region 3 for antibody 13078
AGTYGSGTYSPDYYYFGMDV

SEQ ID NO: 26157 - protein, 9 aa, Homo sapiens
  light chain complementarity determining region 3 for antibody 13079
QHYHSTPYT

SEQ ID NO: 26158 - protein, 21 aa, Homo sapiens
  heavy chain complementarity determining region 3 for antibody 13079
ARPGGQYCSGSNCYYDNWFGS

SEQ ID NO: 26159 - protein, 10 aa, Homo sapiens
  light chain complementarity determining region 3 for antibody 13080
QHYGSSTGYT

SEQ ID NO: 26160 - protein, 26 aa, Homo sapiens
  heavy chain complementarity determining region 3 for antibody 13080
ARVMGREGIVVLPGSKKRKPRGYLDP

SEQ ID NO: 26161 - protein, 9 aa, Homo sapiens
  light chain complementarity determining region 3 for antibody 13081
QHRTNWPVT

SEQ ID NO: 26162 - protein, 19 aa, Homo sapiens
  heavy chain complementarity determining region 3 for antibody 13081
VRARQYRSSWYGPSDAFDI

SEQ ID NO: 26163 - protein, 9 aa, Homo sapiens
  light chain complementarity determining region 3 for antibody 13082
QHNYRTSPA

SEQ ID NO: 26164 - protein, 11 aa, Homo sapiens
  heavy chain complementarity determining region 3 for antibody 13082
TRDPPGNGMDV

SEQ ID NO: 26165 - protein, 9 aa, Homo sapiens
  light chain complementarity determining region 3 for antibody 13083
QHNYRPSPS

SEQ ID NO: 26166 - protein, 11 aa, Homo sapiens
  heavy chain complementarity determining region 3 for antibody 13083
TRDPPGNGMDV

SEQ ID NO: 26167 - protein, 9 aa, Homo sapiens
  light chain complementarity determining region 3 for antibody 13084
QHNYRPSPA

SEQ ID NO: 26168 - protein, 11 aa, Homo sapiens
  heavy chain complementarity determining region 3 for antibody 13084
TRDPPGSGMDV

SEQ ID NO: 26169 - protein, 9 aa, Homo sapiens
  light chain complementarity determining region 3 for antibody 13085
QHCDHFSIT

SEQ ID NO: 26170 - protein, 15 aa, Homo sapiens
  heavy chain complementarity determining region 3 for antibody 13085
ARDPTAAGSPAHFDY

SEQ ID NO: 26171 - protein, 9 aa, Homo sapiens
  light chain complementarity determining region 3 for antibody 13086
QHCDHFSIT

SEQ ID NO: 26172 - protein, 15 aa, Homo sapiens
  heavy chain complementarity determining region 3 for antibody 13086
ARDPTAAGFPAHLDY

SEQ ID NO: 26173 - protein, 9 aa, Homo sapiens
  light chain complementarity determining region 3 for antibody 13087
QHCDHFSFT

SEQ ID NO: 26174 - protein, 15 aa, Homo sapiens
  heavy chain complementarity determining region 3 for antibody 13087
ARDPTAAGFPAHFDY

SEQ ID NO: 26175 - protein, 9 aa, Homo sapiens
  light chain complementarity determining region 3 for antibody 13088
QGNNNAPWT

SEQ ID NO: 26176 - protein, 15 aa, Homo sapiens
  heavy chain complementarity determining region 3 for antibody 13088
GRHRYSSSQGYGMDV

SEQ ID NO: 26177 - protein, 9 aa, Homo sapiens
  light chain complementarity determining region 3 for antibody 13089
PQYSTFPYT

SEQ ID NO: 26178 - protein, 17 aa, Homo sapiens
  heavy chain complementarity determining region 3 for antibody 13089
AREQWNDVDLRQFYFDY

SEQ ID NO: 26179 - protein, 10 aa, Homo sapiens
  light chain complementarity determining region 3 for antibody 13090
PQYSSSPQLT

SEQ ID NO: 26180 - protein, 13 aa, Homo sapiens
  heavy chain complementarity determining region 3 for antibody 13090
ARSAGYYPNWLES

SEQ ID NO: 26181 - protein, 9 aa, Homo sapiens
  light chain complementarity determining region 3 for antibody 13091
PQYNSYWYT

SEQ ID NO: 26182 - protein, 20 aa, Homo sapiens
  heavy chain complementarity determining region 3 for antibody 13091
AGTYGSGTYSPDYYYFGMDV

SEQ ID NO: 26183 - protein, 9 aa, Homo sapiens
  light chain complementarity determining region 3 for antibody 13092
PQLTIYPLA

SEQ ID NO: 26184 - protein, 17 aa, Homo sapiens
  heavy chain complementarity determining region 3 for antibody 13092
ARGGNPSGNHYYYGLDV

SEQ ID NO: 26185 - protein, 9 aa, Homo sapiens
  light chain complementarity determining region 3 for antibody 13093
MQGTHWPWT

SEQ ID NO: 26186 - protein, 11 aa, Homo sapiens
  heavy chain complementarity determining region 3 for antibody 13093
ARHVYYYHWDV

SEQ ID NO: 26187 - protein, 9 aa, Homo sapiens
  light chain complementarity determining region 3 for antibody 13094
MQGTHWPWT

SEQ ID NO: 26188 - protein, 11 aa, Homo sapiens
  heavy chain complementarity determining region 3 for antibody 13094
ARHVYYCHLDV

SEQ ID NO: 26189 - protein, 10 aa, Homo sapiens
  light chain complementarity determining region 3 for antibody 13095
MQGPHWPPLN

SEQ ID NO: 26190 - protein, 26 aa, Homo sapiens
  heavy chain complementarity determining region 3 for antibody 13095
ARELITSIATPGHEFPNYYYYYGMDV

SEQ ID NO: 26191 - protein, 9 aa, Homo sapiens
  light chain complementarity determining region 3 for antibody 13096
MQGLQPPLT

SEQ ID NO: 26192 - protein, 16 aa, Homo sapiens
  heavy chain complementarity determining region 3 for antibody 13096
ARGGFGELGLHNAFDV

SEQ ID NO: 26193 - protein, 9 aa, Homo sapiens
  light chain complementarity determining region 3 for antibody 13097
MQGLHFPPT

SEQ ID NO: 26194 - protein, 19 aa, Homo sapiens
  heavy chain complementarity determining region 3 for antibody 13097
ARVAYYYDEEDHYYYAMDV

SEQ ID NO: 26195 - protein, 9 aa, Homo sapiens
  light chain complementarity determining region 3 for antibody 13098
MQATHWPPT

SEQ ID NO: 26196 - protein, 14 aa, Homo sapiens
  heavy chain complementarity determining region 3 for antibody 13098
ARDVPVVAANLFDY

SEQ ID NO: 26197 - protein, 10 aa, Homo sapiens
  light chain complementarity determining region 3 for antibody 13099
MQALQTPPWT

SEQ ID NO: 26198 - protein, 17 aa, Homo sapiens
  heavy chain complementarity determining region 3 for antibody 13099
ARVNFYGSGSYSYWFDP

SEQ ID NO: 26199 - protein, 9 aa, Homo sapiens
  light chain complementarity determining region 3 for antibody 13100
MQALQTPPT

SEQ ID NO: 26200 - protein, 24 aa, Homo sapiens
  heavy chain complementarity determining region 3 for antibody 13100
ARDKGEGSGKFGELKKNYYYGMDV

SEQ ID NO: 26201 - protein, 9 aa, Homo sapiens
  light chain complementarity determining region 3 for antibody 13101
MQALQTPLT

SEQ ID NO: 26202 - protein, 19 aa, Homo sapiens
  heavy chain complementarity determining region 3 for antibody 13101
ARLDRYCTGSRCYSFWFEP

SEQ ID NO: 26203 - protein, 9 aa, Homo sapiens
  light chain complementarity determining region 3 for antibody 13102
MQALQTPFT

SEQ ID NO: 26204 - protein, 19 aa, Homo sapiens
  heavy chain complementarity determining region 3 for antibody 13102
ARLDRYCTGSRCYSCWFEP

SEQ ID NO: 26205 - protein, 9 aa, Homo sapiens
  light chain complementarity determining region 3 for antibody 13103
MQALQTPFP

SEQ ID NO: 26206 - protein, 19 aa, Homo sapiens
  heavy chain complementarity determining region 3 for antibody 13103
ARLDRYCTGSRCYSFWFEP

SEQ ID NO: 26207 - protein, 9 aa, Homo sapiens
  light chain complementarity determining region 3 for antibody 13104
MQALQTLPT

SEQ ID NO: 26208 - protein, 16 aa, Homo sapiens
  heavy chain complementarity determining region 3 for antibody 13104
ARLNFDVYSTSVGMDV

SEQ ID NO: 26209 - protein, 9 aa, Homo sapiens
  light chain complementarity determining region 3 for antibody 13105
MQALQTLCT

SEQ ID NO: 26210 - protein, 19 aa, Homo sapiens
  heavy chain complementarity determining region 3 for antibody 13105
VRGLYSTYWSGYVGDGFDM

SEQ ID NO: 26211 - protein, 15 aa, Homo sapiens
  light chain complementarity determining region 3 for antibody 13106
MQALDTLARSTNSFT

SEQ ID NO: 26212 - protein, 17 aa, Homo sapiens
  heavy chain complementarity determining region 3 for antibody 13106
ARDGSYGDRMYYYGMDV

SEQ ID NO: 26213 - protein, 6 aa, Homo sapiens
  light chain complementarity determining region 3 for antibody 13107
MEALQT

SEQ ID NO: 26214 - protein, 17 aa, Homo sapiens
  heavy chain complementarity determining region 3 for antibody 13107
ARDGSYGDRMYYYGMDV

SEQ ID NO: 26215 - protein, 10 aa, Homo sapiens
  light chain complementarity determining region 3 for antibody 13108
LRYVSSELFA

SEQ ID NO: 26216 - protein, 16 aa, Homo sapiens
  heavy chain complementarity determining region 3 for antibody 13108
ARELFKGEYDYYGMDV

SEQ ID NO: 26217 - protein, 12 aa, Homo sapiens
  light chain complementarity determining region 3 for antibody 13109
LQHDNFPLDVRP

SEQ ID NO: 26218 - protein, 11 aa, Homo sapiens
  heavy chain complementarity determining region 3 for antibody 13109
AREQTGYYPLY

SEQ ID NO: 26219 - protein, 9 aa, Homo sapiens
  light chain complementarity determining region 3 for antibody 13110
LQDYKYPRT

SEQ ID NO: 26220 - protein, 18 aa, Homo sapiens
  heavy chain complementarity determining region 3 for antibody 13110
ARDTSPGDSSDWYDAFDI

SEQ ID NO: 26221 - protein, 9 aa, Homo sapiens
  light chain complementarity determining region 3 for antibody 13111
LQDYKYPRT

SEQ ID NO: 26222 - protein, 18 aa, Homo sapiens
  heavy chain complementarity determining region 3 for antibody 13111
ARDTSPGDSSARYDAFDI

SEQ ID NO: 26223 - protein, 9 aa, Homo sapiens
  light chain complementarity determining region 3 for antibody 13112
LQAYKYPRT

SEQ ID NO: 26224 - protein, 18 aa, Homo sapiens
  heavy chain complementarity determining region 3 for antibody 13112
ARDTSPGDSSAWYDAFDI

SEQ ID NO: 26225 - protein, 9 aa, Homo sapiens
  light chain complementarity determining region 3 for antibody 13113
LQATHWPYP

SEQ ID NO: 26226 - protein, 11 aa, Homo sapiens
  heavy chain complementarity determining region 3 for antibody 13113
AKDTQWLPFDC

SEQ ID NO: 26227 - protein, 9 aa, Homo sapiens
  light chain complementarity determining region 3 for antibody 13114
LQATHWPST

SEQ ID NO: 26228 - protein, 11 aa, Homo sapiens
  heavy chain complementarity determining region 3 for antibody 13114
AKDTQWLPFDC

SEQ ID NO: 26229 - protein, 9 aa, Homo sapiens
  light chain complementarity determining region 3 for antibody 13115
KQAYRFPLS

SEQ ID NO: 26230 - protein, 13 aa, Homo sapiens
  heavy chain complementarity determining region 3 for antibody 13115
TRTYGSGRNWFDP

SEQ ID NO: 26231 - protein, 9 aa, Homo sapiens
  light chain complementarity determining region 3 for antibody 13116
HQYYSPSPT

SEQ ID NO: 26232 - protein, 13 aa, Homo sapiens
  heavy chain complementarity determining region 3 for antibody 13116
ARGEGSEFYGMDV

SEQ ID NO: 26233 - protein, 9 aa, Homo sapiens
  light chain complementarity determining region 3 for antibody 13117
HQYGSSPNT

SEQ ID NO: 26234 - protein, 15 aa, Homo sapiens
  heavy chain complementarity determining region 3 for antibody 13117
ARGGGSGWYRGPLDY

SEQ ID NO: 26235 - protein, 9 aa, Homo sapiens
  light chain complementarity determining region 3 for antibody 13118
HQYATSPPT

SEQ ID NO: 26236 - protein, 10 aa, Homo sapiens
  heavy chain complementarity determining region 3 for antibody 13118
GYSNGWLVHY

SEQ ID NO: 26237 - protein, 9 aa, Homo sapiens
  light chain complementarity determining region 3 for antibody 13119
HQSYDTPWT

SEQ ID NO: 26238 - protein, 11 aa, Homo sapiens
  heavy chain complementarity determining region 3 for antibody 13119
VTWVESVGPRD

SEQ ID NO: 26239 - protein, 10 aa, Homo sapiens
  light chain complementarity determining region 3 for antibody 13120
HQSTILPRLT

SEQ ID NO: 26240 - protein, 18 aa, Homo sapiens
  heavy chain complementarity determining region 3 for antibody 13120
ARDVGYDRSANYRWYFDV

SEQ ID NO: 26241 - protein, 10 aa, Homo sapiens
  light chain complementarity determining region 3 for antibody 13121
HQSSSLPRLT

SEQ ID NO: 26242 - protein, 18 aa, Homo sapiens
  heavy chain complementarity determining region 3 for antibody 13121
ARDVGYDSNAHYHWYFDP

SEQ ID NO: 26243 - protein, 10 aa, Homo sapiens
  light chain complementarity determining region 3 for antibody 13122
HQSSSLHRLT

SEQ ID NO: 26244 - protein, 18 aa, Homo sapiens
  heavy chain complementarity determining region 3 for antibody 13122
ARDVGYDSNAHYHWYFDL

SEQ ID NO: 26245 - protein, 10 aa, Homo sapiens
  light chain complementarity determining region 3 for antibody 13123
HQRSSLPRLT

SEQ ID NO: 26246 - protein, 18 aa, Homo sapiens
  heavy chain complementarity determining region 3 for antibody 13123
ARDVGYDSNAHYHWYFDL

SEQ ID NO: 26247 - protein, 9 aa, Homo sapiens
  light chain complementarity determining region 3 for antibody 13124
HQHSVSRGT

SEQ ID NO: 26248 - protein, 21 aa, Homo sapiens
  heavy chain complementarity determining region 3 for antibody 13124
ARDRGGDFHGDSSYYNRPFDY

SEQ ID NO: 26249 - protein, 9 aa, Homo sapiens
  light chain complementarity determining region 3 for antibody 13125
HPYSVSRGT

SEQ ID NO: 26250 - protein, 21 aa, Homo sapiens
  heavy chain complementarity determining region 3 for antibody 13125
ARDRGGDFHGDSSYYNRPFDY

SEQ ID NO: 26251 - protein, 9 aa, Homo sapiens
  light chain complementarity determining region 3 for antibody 13126
VQALQTSIT

SEQ ID NO: 26252 - protein, 15 aa, Homo sapiens
  heavy chain complementarity determining region 3 for antibody 13126
ARSDTGTDYGVYFDH

SEQ ID NO: 26253 - protein, 9 aa, Homo sapiens
  light chain complementarity determining region 3 for antibody 13127
SQYGTSPRP

SEQ ID NO: 26254 - protein, 9 aa, Homo sapiens
  heavy chain complementarity determining region 3 for antibody 13127
AREWSGFDY

SEQ ID NO: 26255 - protein, 9 aa, Homo sapiens
  light chain complementarity determining region 3 for antibody 13128
RQYGTSRGT

SEQ ID NO: 26256 - protein, 21 aa, Homo sapiens
  heavy chain complementarity determining region 3 for antibody 13128
ATDRGGDYYRKSGYYYRPFDY

SEQ ID NO: 26257 - protein, 9 aa, Homo sapiens
  light chain complementarity determining region 3 for antibody 13129
RKYNSVPWT

SEQ ID NO: 26258 - protein, 14 aa, Homo sapiens
  heavy chain complementarity determining region 3 for antibody 13129
ARDESRSRVNVLDI

SEQ ID NO: 26259 - protein, 10 aa, Homo sapiens
  light chain complementarity determining region 3 for antibody 13130
QYRGYSPLYT

SEQ ID NO: 26260 - protein, 12 aa, Homo sapiens
  heavy chain complementarity determining region 3 for antibody 13130
AKGILGRGGMDV

SEQ ID NO: 26261 - protein, 10 aa, Homo sapiens
  light chain complementarity determining region 3 for antibody 13131
QYHGYSPLYT

SEQ ID NO: 26262 - protein, 12 aa, Homo sapiens
  heavy chain complementarity determining region 3 for antibody 13131
SKGILGRGGMDV

SEQ ID NO: 26263 - protein, 10 aa, Homo sapiens
  light chain complementarity determining region 3 for antibody 13132
QYHGYSPLYT

SEQ ID NO: 26264 - protein, 12 aa, Homo sapiens
  heavy chain complementarity determining region 3 for antibody 13132
AKGILSRGGMDV

SEQ ID NO: 26265 - protein, 10 aa, Homo sapiens
  light chain complementarity determining region 3 for antibody 13133
QYHGYSPLYT

SEQ ID NO: 26266 - protein, 20 aa, Homo sapiens
  heavy chain complementarity determining region 3 for antibody 13133
AGTYGSGTYSPDYYYFGMDV

SEQ ID NO: 26267 - protein, 10 aa, Homo sapiens
  light chain complementarity determining region 3 for antibody 13134
QYHGYSPLYI

SEQ ID NO: 26268 - protein, 12 aa, Homo sapiens
  heavy chain complementarity determining region 3 for antibody 13134
AKGILGRGGMDV

SEQ ID NO: 26269 - protein, 10 aa, Homo sapiens
  light chain complementarity determining region 3 for antibody 13135
QYHGYSPLYA

SEQ ID NO: 26270 - protein, 12 aa, Homo sapiens
  heavy chain complementarity determining region 3 for antibody 13135
AKGILGRGGMDV

SEQ ID NO: 26271 - protein, 10 aa, Homo sapiens
  light chain complementarity determining region 3 for antibody 13136
QYHGYSLLYT

SEQ ID NO: 26272 - protein, 12 aa, Homo sapiens
  heavy chain complementarity determining region 3 for antibody 13136
AKGILGRGGMDV

SEQ ID NO: 26273 - protein, 10 aa, Homo sapiens
  light chain complementarity determining region 3 for antibody 13137
QYHGYLPLYT

SEQ ID NO: 26274 - protein, 12 aa, Homo sapiens
  heavy chain complementarity determining region 3 for antibody 13137
AKGILGRGGMDV

SEQ ID NO: 26275 - protein, 9 aa, Homo sapiens
  light chain complementarity determining region 3 for antibody 13138
QRYDNVPLT

SEQ ID NO: 26276 - protein, 16 aa, Homo sapiens
  heavy chain complementarity determining region 3 for antibody 13138
GRVDRLRLGELSGRYY

SEQ ID NO: 26277 - protein, 9 aa, Homo sapiens
  light chain complementarity determining region 3 for antibody 13139
QRCNSYPYT

SEQ ID NO: 26278 - protein, 5 aa, Homo sapiens
  heavy chain complementarity determining region 3 for antibody 13139
AGYPR

SEQ ID NO: 26279 - protein, 9 aa, Homo sapiens
  light chain complementarity determining region 3 for antibody 13140
QRCNSYPHT

SEQ ID NO: 26280 - protein, 9 aa, Homo sapiens
  heavy chain complementarity determining region 3 for antibody 13140
VAYLAGYPR

SEQ ID NO: 26281 - protein, 9 aa, Homo sapiens
  light chain complementarity determining region 3 for antibody 13141
QRCNSSPYT

SEQ ID NO: 26282 - protein, 9 aa, Homo sapiens
  heavy chain complementarity determining region 3 for antibody 13141
VAYLAGYPR

SEQ ID NO: 26283 - protein, 9 aa, Homo sapiens
  light chain complementarity determining region 3 for antibody 13142
QQYYTYSET

SEQ ID NO: 26284 - protein, 19 aa, Homo sapiens
  heavy chain complementarity determining region 3 for antibody 13142
ATVKGDQGERDYDYHGVDV

SEQ ID NO: 26285 - protein, 9 aa, Homo sapiens
  light chain complementarity determining region 3 for antibody 13143
QQYYTYSET

SEQ ID NO: 26286 - protein, 19 aa, Homo sapiens
  heavy chain complementarity determining region 3 for antibody 13143
ATVKGDQGELGYDYHGVDV

SEQ ID NO: 26287 - protein, 9 aa, Homo sapiens
  light chain complementarity determining region 3 for antibody 13144
QQYYTTPFP

SEQ ID NO: 26288 - protein, 17 aa, Homo sapiens
  heavy chain complementarity determining region 3 for antibody 13144
ARGRYESGDYYNNAFDF

SEQ ID NO: 26289 - protein, 9 aa, Homo sapiens
  light chain complementarity determining region 3 for antibody 13145
QQYYTNPFT

SEQ ID NO: 26290 - protein, 17 aa, Homo sapiens
  heavy chain complementarity determining region 3 for antibody 13145
ARGRYESGDYYNNAFDF

SEQ ID NO: 26291 - protein, 9 aa, Homo sapiens
  light chain complementarity determining region 3 for antibody 13146
QQYYSYPII

SEQ ID NO: 26292 - protein, 14 aa, Homo sapiens
  heavy chain complementarity determining region 3 for antibody 13146
TKCVPGDHISRTEY

SEQ ID NO: 26293 - protein, 10 aa, Homo sapiens
  light chain complementarity determining region 3 for antibody 13147
QQYYSTPRLT

SEQ ID NO: 26294 - protein, 15 aa, Homo sapiens
  heavy chain complementarity determining region 3 for antibody 13147
ARHGTAAVVERVFDP

SEQ ID NO: 26295 - protein, 9 aa, Homo sapiens
  light chain complementarity determining region 3 for antibody 13148
QQYYSTPNS

SEQ ID NO: 26296 - protein, 13 aa, Homo sapiens
  heavy chain complementarity determining region 3 for antibody 13148
AKATSDGSGALHY

SEQ ID NO: 26297 - protein, 9 aa, Homo sapiens
  light chain complementarity determining region 3 for antibody 13149
QQYYSAPRK

SEQ ID NO: 26298 - protein, 20 aa, Homo sapiens
  heavy chain complementarity determining region 3 for antibody 13149
VRDDILTGYYQSDYYHAMDV

SEQ ID NO: 26299 - protein, 9 aa, Homo sapiens
  light chain complementarity determining region 3 for antibody 13150
QQYYHLPVT

SEQ ID NO: 26300 - protein, 20 aa, Homo sapiens
  heavy chain complementarity determining region 3 for antibody 13150
ARGRGESRLSGGRGSYILDP

SEQ ID NO: 26301 - protein, 9 aa, Homo sapiens
  light chain complementarity determining region 3 for antibody 13151
QQYYFTPGT

SEQ ID NO: 26302 - protein, 19 aa, Homo sapiens
  heavy chain complementarity determining region 3 for antibody 13151
ARAKREQLVDSYSFHGLDV

SEQ ID NO: 26303 - protein, 9 aa, Homo sapiens
  light chain complementarity determining region 3 for antibody 13152
QQYYDTPRP

SEQ ID NO: 26304 - protein, 23 aa, Homo sapiens
  heavy chain complementarity determining region 3 for antibody 13152
ARGGPYRPAPYFYDISGPQYFQH

SEQ ID NO: 26305 - protein, 9 aa, Homo sapiens
  light chain complementarity determining region 3 for antibody 13153
QQYYDNVWT

SEQ ID NO: 26306 - protein, 16 aa, Homo sapiens
  heavy chain complementarity determining region 3 for antibody 13153
TTQGGLWFGYWQGATS

SEQ ID NO: 26307 - protein, 9 aa, Homo sapiens
  light chain complementarity determining region 3 for antibody 13154
QQYVTTPRP

SEQ ID NO: 26308 - protein, 12 aa, Homo sapiens
  heavy chain complementarity determining region 3 for antibody 13154
ARDVGWYWYFDF

SEQ ID NO: 26309 - protein, 11 aa, Homo sapiens
  light chain complementarity determining region 3 for antibody 13155
QQYVTSPLMYT

SEQ ID NO: 26310 - protein, 10 aa, Homo sapiens
  heavy chain complementarity determining region 3 for antibody 13155
AKNGYYSLEE

SEQ ID NO: 26311 - protein, 10 aa, Homo sapiens
  light chain complementarity determining region 3 for antibody 13156
QQYVSSELFT

SEQ ID NO: 26312 - protein, 16 aa, Homo sapiens
  heavy chain complementarity determining region 3 for antibody 13156
TREIFKGEIDYYAMDV

SEQ ID NO: 26313 - protein, 10 aa, Homo sapiens
  light chain complementarity determining region 3 for antibody 13157
QQYVSSELFT

SEQ ID NO: 26314 - protein, 16 aa, Homo sapiens
  heavy chain complementarity determining region 3 for antibody 13157
AREIFKGEIAYYAMDV

SEQ ID NO: 26315 - protein, 10 aa, Homo sapiens
  light chain complementarity determining region 3 for antibody 13158
QQYVSSELFT

SEQ ID NO: 26316 - protein, 16 aa, Homo sapiens
  heavy chain complementarity determining region 3 for antibody 13158
AREICKGEIDYYAMDV

SEQ ID NO: 26317 - protein, 10 aa, Homo sapiens
  light chain complementarity determining region 3 for antibody 13159
QQYVSSALYT

SEQ ID NO: 26318 - protein, 16 aa, Homo sapiens
  heavy chain complementarity determining region 3 for antibody 13159
ARELFKGKYDYYAMDV

SEQ ID NO: 26319 - protein, 10 aa, Homo sapiens
  light chain complementarity determining region 3 for antibody 13160
QQYVRSALYT

SEQ ID NO: 26320 - protein, 16 aa, Homo sapiens
  heavy chain complementarity determining region 3 for antibody 13160
ARELFKGEYDYYAMDV

SEQ ID NO: 26321 - protein, 10 aa, Homo sapiens
  light chain complementarity determining region 3 for antibody 13161
QQYVRSALFT

SEQ ID NO: 26322 - protein, 16 aa, Homo sapiens
  heavy chain complementarity determining region 3 for antibody 13161
ARELFKGQIDYYGIDV

SEQ ID NO: 26323 - protein, 10 aa, Homo sapiens
  light chain complementarity determining region 3 for antibody 13162
QQYVPSHKYT

SEQ ID NO: 26324 - protein, 22 aa, Homo sapiens
  heavy chain complementarity determining region 3 for antibody 13162
ARHSPFLEMLGERWLQFGAFGI

SEQ ID NO: 26325 - protein, 10 aa, Homo sapiens
  light chain complementarity determining region 3 for antibody 13163
QQYVPSHKYP

SEQ ID NO: 26326 - protein, 22 aa, Homo sapiens
  heavy chain complementarity determining region 3 for antibody 13163
ARHSPFLEMLGERWLQFGAFDI

SEQ ID NO: 26327 - protein, 10 aa, Homo sapiens
  light chain complementarity determining region 3 for antibody 13164
QQYVPSHKHT

SEQ ID NO: 26328 - protein, 22 aa, Homo sapiens
  heavy chain complementarity determining region 3 for antibody 13164
ARHSPFLEMLGERWLQFGAFDI

SEQ ID NO: 26329 - protein, 10 aa, Homo sapiens
  light chain complementarity determining region 3 for antibody 13165
QQYVNSGLFI

SEQ ID NO: 26330 - protein, 16 aa, Homo sapiens
  heavy chain complementarity determining region 3 for antibody 13165
AREIFKGEYDYYAMDV

SEQ ID NO: 26331 - protein, 10 aa, Homo sapiens
  light chain complementarity determining region 3 for antibody 13166
QQYVKSDLFT

SEQ ID NO: 26332 - protein, 16 aa, Homo sapiens
  heavy chain complementarity determining region 3 for antibody 13166
ARELFKGQIDYYGIDV

SEQ ID NO: 26333 - protein, 10 aa, Homo sapiens
  light chain complementarity determining region 3 for antibody 13167
QQYVISELFT

SEQ ID NO: 26334 - protein, 16 aa, Homo sapiens
  heavy chain complementarity determining region 3 for antibody 13167
AREIFKGEIDYYAMDV

SEQ ID NO: 26335 - protein, 10 aa, Homo sapiens
  light chain complementarity determining region 3 for antibody 13168
QQYVGSPEFT

SEQ ID NO: 26336 - protein, 21 aa, Homo sapiens
  heavy chain complementarity determining region 3 for antibody 13168
ARDQGVLVWFGEVLMFNAFNM

SEQ ID NO: 26337 - protein, 9 aa, Homo sapiens
  light chain complementarity determining region 3 for antibody 13169
QQYSTFPYP

SEQ ID NO: 26338 - protein, 17 aa, Homo sapiens
  heavy chain complementarity determining region 3 for antibody 13169
AREDWNDVDLRQFYFDY

SEQ ID NO: 26339 - protein, 9 aa, Homo sapiens
  light chain complementarity determining region 3 for antibody 13170
QQYSSSRYT

SEQ ID NO: 26340 - protein, 23 aa, Homo sapiens
  heavy chain complementarity determining region 3 for antibody 13170
ARVGCSGEKCSSMSGYYYYALDV

SEQ ID NO: 26341 - protein, 10 aa, Homo sapiens
  light chain complementarity determining region 3 for antibody 13171
QQYSSSPQLT

SEQ ID NO: 26342 - protein, 13 aa, Homo sapiens
  heavy chain complementarity determining region 3 for antibody 13171
ARSAGYSPNWLES

SEQ ID NO: 26343 - protein, 10 aa, Homo sapiens
  light chain complementarity determining region 3 for antibody 13172
QQYSSSPQLT

SEQ ID NO: 26344 - protein, 13 aa, Homo sapiens
  heavy chain complementarity determining region 3 for antibody 13172
ARSAGYCPNWLES

SEQ ID NO: 26345 - protein, 10 aa, Homo sapiens
  light chain complementarity determining region 3 for antibody 13173
QQYSSSPQLT

SEQ ID NO: 26346 - protein, 13 aa, Homo sapiens
  heavy chain complementarity determining region 3 for antibody 13173
ARSAGCYPNWLES

SEQ ID NO: 26347 - protein, 10 aa, Homo sapiens
  light chain complementarity determining region 3 for antibody 13174
QQYSSSPQLT

SEQ ID NO: 26348 - protein, 13 aa, Homo sapiens
  heavy chain complementarity determining region 3 for antibody 13174
AGSAGYYPNWLES

SEQ ID NO: 26349 - protein, 9 aa, Homo sapiens
  light chain complementarity determining region 3 for antibody 13175
QQYSRYPVT

SEQ ID NO: 26350 - protein, 11 aa, Homo sapiens
  heavy chain complementarity determining region 3 for antibody 13175
AREQTGCYPLY

SEQ ID NO: 26351 - protein, 8 aa, Homo sapiens
  light chain complementarity determining region 3 for antibody 13176
QQYSRSIT

SEQ ID NO: 26352 - protein, 16 aa, Homo sapiens
  heavy chain complementarity determining region 3 for antibody 13176
ARGRASGWFLESQFDY

SEQ ID NO: 26353 - protein, 9 aa, Homo sapiens
  light chain complementarity determining region 3 for antibody 13177
QQYNSYWYT

SEQ ID NO: 26354 - protein, 20 aa, Homo sapiens
  heavy chain complementarity determining region 3 for antibody 13177
AGTYGSGTYSPDYYYFVMDV

SEQ ID NO: 26355 - protein, 9 aa, Homo sapiens
  light chain complementarity determining region 3 for antibody 13178
QQYNSYWYT

SEQ ID NO: 26356 - protein, 20 aa, Homo sapiens
  heavy chain complementarity determining region 3 for antibody 13178
AGTYGSGTYSPDYYSFGMDV

SEQ ID NO: 26357 - protein, 9 aa, Homo sapiens
  light chain complementarity determining region 3 for antibody 13179
QQYNSYWYT

SEQ ID NO: 26358 - protein, 20 aa, Homo sapiens
  heavy chain complementarity determining region 3 for antibody 13179
AGTYGSGTDSPDYYYFGMDV

SEQ ID NO: 26359 - protein, 9 aa, Homo sapiens
  light chain complementarity determining region 3 for antibody 13180
QQYNSYSYT

SEQ ID NO: 26360 - protein, 15 aa, Homo sapiens
  heavy chain complementarity determining region 3 for antibody 13180
VKSGTYNSSSGWFDT

SEQ ID NO: 26361 - protein, 9 aa, Homo sapiens
  light chain complementarity determining region 3 for antibody 13181
QQYNSYSLT

SEQ ID NO: 26362 - protein, 17 aa, Homo sapiens
  heavy chain complementarity determining region 3 for antibody 13181
ARDGSYGDRMYYYGMDV

SEQ ID NO: 26363 - protein, 8 aa, Homo sapiens
  light chain complementarity determining region 3 for antibody 13182
QQYNSYSD

SEQ ID NO: 26364 - protein, 15 aa, Homo sapiens
  heavy chain complementarity determining region 3 for antibody 13182
ARAYSSGWYPESFDF

SEQ ID NO: 26365 - protein, 8 aa, Homo sapiens
  light chain complementarity determining region 3 for antibody 13183
QQYNSYSA

SEQ ID NO: 26366 - protein, 15 aa, Homo sapiens
  heavy chain complementarity determining region 3 for antibody 13183
ARACSSGWYPESFDF

SEQ ID NO: 26367 - protein, 9 aa, Homo sapiens
  light chain complementarity determining region 3 for antibody 13184
QQYNSYPYT

SEQ ID NO: 26368 - protein, 17 aa, Homo sapiens
  heavy chain complementarity determining region 3 for antibody 13184
AREGWSDVDLRLFYLDC

SEQ ID NO: 26369 - protein, 9 aa, Homo sapiens
  light chain complementarity determining region 3 for antibody 13185
QQYNSYPYT

SEQ ID NO: 26370 - protein, 17 aa, Homo sapiens
  heavy chain complementarity determining region 3 for antibody 13185
AREEFADVDLRQYYFDY

SEQ ID NO: 26371 - protein, 9 aa, Homo sapiens
  light chain complementarity determining region 3 for antibody 13186
QQYNSYPYT

SEQ ID NO: 26372 - protein, 17 aa, Homo sapiens
  heavy chain complementarity determining region 3 for antibody 13186
AKDLPPYRSGTYLYFDP

SEQ ID NO: 26373 - protein, 9 aa, Homo sapiens
  light chain complementarity determining region 3 for antibody 13187
QQYNSYPST

SEQ ID NO: 26374 - protein, 17 aa, Homo sapiens
  heavy chain complementarity determining region 3 for antibody 13187
AREDWSDVDLRLFYLDC

SEQ ID NO: 26375 - protein, 9 aa, Homo sapiens
  light chain complementarity determining region 3 for antibody 13188
QQYNSYPRT

SEQ ID NO: 26376 - protein, 19 aa, Homo sapiens
  heavy chain complementarity determining region 3 for antibody 13188
ARESPSVRKRPTEYYGMDV

SEQ ID NO: 26377 - protein, 9 aa, Homo sapiens
  light chain complementarity determining region 3 for antibody 13189
QQYNSYPRT

SEQ ID NO: 26378 - protein, 19 aa, Homo sapiens
  heavy chain complementarity determining region 3 for antibody 13189
ARDSTSVRKRPTEYYGMDV

SEQ ID NO: 26379 - protein, 9 aa, Homo sapiens
  light chain complementarity determining region 3 for antibody 13190
QQYNSYPRT

SEQ ID NO: 26380 - protein, 19 aa, Homo sapiens
  heavy chain complementarity determining region 3 for antibody 13190
ARDSPSVRKRPAEYYGMDV

SEQ ID NO: 26381 - protein, 9 aa, Homo sapiens
  light chain complementarity determining region 3 for antibody 13191
QQYNSYPLT

SEQ ID NO: 26382 - protein, 13 aa, Homo sapiens
  heavy chain complementarity determining region 3 for antibody 13191
ASGLHSGYDYFDY

SEQ ID NO: 26383 - protein, 9 aa, Homo sapiens
  light chain complementarity determining region 3 for antibody 13192
QQYNSYPLT

SEQ ID NO: 26384 - protein, 12 aa, Homo sapiens
  heavy chain complementarity determining region 3 for antibody 13192
ARDPFNGWYSDL

SEQ ID NO: 26385 - protein, 9 aa, Homo sapiens
  light chain complementarity determining region 3 for antibody 13193
QQYNSYPLT

SEQ ID NO: 26386 - protein, 16 aa, Homo sapiens
  heavy chain complementarity determining region 3 for antibody 13193
ARAEMAPKSAHWYFDP

SEQ ID NO: 26387 - protein, 9 aa, Homo sapiens
  light chain complementarity determining region 3 for antibody 13194
QQYNSYPIT

SEQ ID NO: 26388 - protein, 13 aa, Homo sapiens
  heavy chain complementarity determining region 3 for antibody 13194
ASGLHSGYDYFGY

SEQ ID NO: 26389 - protein, 9 aa, Homo sapiens
  light chain complementarity determining region 3 for antibody 13195
QQYNSYGWT

SEQ ID NO: 26390 - protein, 15 aa, Homo sapiens
  heavy chain complementarity determining region 3 for antibody 13195
VHLAGFSTNWPLFDL

SEQ ID NO: 26391 - protein, 9 aa, Homo sapiens
  light chain complementarity determining region 3 for antibody 13196
QQYNSLPLT

SEQ ID NO: 26392 - protein, 19 aa, Homo sapiens
  heavy chain complementarity determining region 3 for antibody 13196
ARDRDYTIVDDYGSGVFDY

SEQ ID NO: 26393 - protein, 9 aa, Homo sapiens
  light chain complementarity determining region 3 for antibody 13197
QQYNSLPIT

SEQ ID NO: 26394 - protein, 19 aa, Homo sapiens
  heavy chain complementarity determining region 3 for antibody 13197
ARDRDYTIVDDYGSGVFDH

SEQ ID NO: 26395 - protein, 9 aa, Homo sapiens
  light chain complementarity determining region 3 for antibody 13198
QQYNSLPIT

SEQ ID NO: 26396 - protein, 19 aa, Homo sapiens
  heavy chain complementarity determining region 3 for antibody 13198
ARDRDYTIVDDYGSGAFDY

SEQ ID NO: 26397 - protein, 9 aa, Homo sapiens
  light chain complementarity determining region 3 for antibody 13199
QQYNSFPWT

SEQ ID NO: 26398 - protein, 17 aa, Homo sapiens
  heavy chain complementarity determining region 3 for antibody 13199
ARRSGPYYFDAHNYYDF

SEQ ID NO: 26399 - protein, 9 aa, Homo sapiens
  light chain complementarity determining region 3 for antibody 13200
QQYNSFPPT

SEQ ID NO: 26400 - protein, 19 aa, Homo sapiens
  heavy chain complementarity determining region 3 for antibody 13200
AKDPHPVVVGGLLEPVFDH

SEQ ID NO: 26401 - protein, 9 aa, Homo sapiens
  light chain complementarity determining region 3 for antibody 13201
QQYNRYWYT

SEQ ID NO: 26402 - protein, 20 aa, Homo sapiens
  heavy chain complementarity determining region 3 for antibody 13201
AGTYGSGTYSPDYYYFGMDV

SEQ ID NO: 26403 - protein, 10 aa, Homo sapiens
  light chain complementarity determining region 3 for antibody 13202
QQYNNWPPIT

SEQ ID NO: 26404 - protein, 16 aa, Homo sapiens
  heavy chain complementarity determining region 3 for antibody 13202
AKDYSAYVPVAGAFDY

SEQ ID NO: 26405 - protein, 9 aa, Homo sapiens
  light chain complementarity determining region 3 for antibody 13203
QQYNNLPYT

SEQ ID NO: 26406 - protein, 13 aa, Homo sapiens
  heavy chain complementarity determining region 3 for antibody 13203
ARAKWDPFGYFDF

SEQ ID NO: 26407 - protein, 9 aa, Homo sapiens
  light chain complementarity determining region 3 for antibody 13204
QQYNNLPYT

SEQ ID NO: 26408 - protein, 13 aa, Homo sapiens
  heavy chain complementarity determining region 3 for antibody 13204
ARAKWDLFGYSDF

SEQ ID NO: 26409 - protein, 9 aa, Homo sapiens
  light chain complementarity determining region 3 for antibody 13205
QQYNNIPYT

SEQ ID NO: 26410 - protein, 13 aa, Homo sapiens
  heavy chain complementarity determining region 3 for antibody 13205
ARAKWDLFGYFDF

SEQ ID NO: 26411 - protein, 9 aa, Homo sapiens
  light chain complementarity determining region 3 for antibody 13206
QQYNGRSLP

SEQ ID NO: 26412 - protein, 11 aa, Homo sapiens
  heavy chain complementarity determining region 3 for antibody 13206
ARIQQLGALAH

SEQ ID NO: 26413 - protein, 9 aa, Homo sapiens
  light chain complementarity determining region 3 for antibody 13207
QQYKTDPWT

SEQ ID NO: 26414 - protein, 10 aa, Homo sapiens
  heavy chain complementarity determining region 3 for antibody 13207
IRHEEYVRHY

SEQ ID NO: 26415 - protein, 9 aa, Homo sapiens
  light chain complementarity determining region 3 for antibody 13208
QQYKTDPWP

SEQ ID NO: 26416 - protein, 10 aa, Homo sapiens
  heavy chain complementarity determining region 3 for antibody 13208
IRHEEYVRPY

SEQ ID NO: 26417 - protein, 9 aa, Homo sapiens
  light chain complementarity determining region 3 for antibody 13209
QQYKSYPPT

SEQ ID NO: 26418 - protein, 26 aa, Homo sapiens
  heavy chain complementarity determining region 3 for antibody 13209
ARDQGVNIVPTGQNMPEGDTEGTFDY

SEQ ID NO: 26419 - protein, 8 aa, Homo sapiens
  light chain complementarity determining region 3 for antibody 13210
QQYHTFSP

SEQ ID NO: 26420 - protein, 18 aa, Homo sapiens
  heavy chain complementarity determining region 3 for antibody 13210
ARARRTQHRSDYYDGLDV

SEQ ID NO: 26421 - protein, 9 aa, Homo sapiens
  light chain complementarity determining region 3 for antibody 13211
QQYHSYPPT

SEQ ID NO: 26422 - protein, 19 aa, Homo sapiens
  heavy chain complementarity determining region 3 for antibody 13211
ARDHSHTTMEPGGEGCFDY

SEQ ID NO: 26423 - protein, 9 aa, Homo sapiens
  light chain complementarity determining region 3 for antibody 13212
QQYHSYPLT

SEQ ID NO: 26424 - protein, 15 aa, Homo sapiens
  heavy chain complementarity determining region 3 for antibody 13212
ARGGIHYDILTGPDY

SEQ ID NO: 26425 - protein, 9 aa, Homo sapiens
  light chain complementarity determining region 3 for antibody 13213
QQYHSYPLP

SEQ ID NO: 26426 - protein, 15 aa, Homo sapiens
  heavy chain complementarity determining region 3 for antibody 13213
ARGGIHYDILTGLDY

SEQ ID NO: 26427 - protein, 8 aa, Homo sapiens
  light chain complementarity determining region 3 for antibody 13214
QQYHSVWT

SEQ ID NO: 26428 - protein, 13 aa, Homo sapiens
  heavy chain complementarity determining region 3 for antibody 13214
AKVRAGDYESLDY

SEQ ID NO: 26429 - protein, 9 aa, Homo sapiens
  light chain complementarity determining region 3 for antibody 13215
QQYHSTPYP

SEQ ID NO: 26430 - protein, 21 aa, Homo sapiens
  heavy chain complementarity determining region 3 for antibody 13215
ARPGGQYCSGSNCYYDNWFGS

SEQ ID NO: 26431 - protein, 9 aa, Homo sapiens
  light chain complementarity determining region 3 for antibody 13216
QQYHSPPYT

SEQ ID NO: 26432 - protein, 21 aa, Homo sapiens
  heavy chain complementarity determining region 3 for antibody 13216
ARPGGQYCSGSNCYYDNWFGS

SEQ ID NO: 26433 - protein, 9 aa, Homo sapiens
  light chain complementarity determining region 3 for antibody 13217
QQYHSNPYT

SEQ ID NO: 26434 - protein, 21 aa, Homo sapiens
  heavy chain complementarity determining region 3 for antibody 13217
ARPGGQYCSGSNCYYDNWFGS

SEQ ID NO: 26435 - protein, 10 aa, Homo sapiens
  light chain complementarity determining region 3 for antibody 13218
QQYHSFSQGT

SEQ ID NO: 26436 - protein, 14 aa, Homo sapiens
  heavy chain complementarity determining region 3 for antibody 13218
AKDSTGDYPSYFDH

SEQ ID NO: 26437 - protein, 8 aa, Homo sapiens
  light chain complementarity determining region 3 for antibody 13219
QQYHRVWT

SEQ ID NO: 26438 - protein, 13 aa, Homo sapiens
  heavy chain complementarity determining region 3 for antibody 13219
AKVRAGDYDSLDY

SEQ ID NO: 26439 - protein, 10 aa, Homo sapiens
  light chain complementarity determining region 3 for antibody 13220
QQYGTSPQLS

SEQ ID NO: 26440 - protein, 13 aa, Homo sapiens
  heavy chain complementarity determining region 3 for antibody 13220
ARSPGYYANWFES

SEQ ID NO: 26441 - protein, 9 aa, Homo sapiens
  light chain complementarity determining region 3 for antibody 13221
QQYGTLPQS

SEQ ID NO: 26442 - protein, 13 aa, Homo sapiens
  heavy chain complementarity determining region 3 for antibody 13221
NTWVGGRDDLFDY

SEQ ID NO: 26443 - protein, 9 aa, Homo sapiens
  light chain complementarity determining region 3 for antibody 13222
QQYGSTPYT

SEQ ID NO: 26444 - protein, 13 aa, Homo sapiens
  heavy chain complementarity determining region 3 for antibody 13222
ARGFRYGSGPYVH

SEQ ID NO: 26445 - protein, 9 aa, Homo sapiens
  light chain complementarity determining region 3 for antibody 13223
QQYGSSTST

SEQ ID NO: 26446 - protein, 21 aa, Homo sapiens
  heavy chain complementarity determining region 3 for antibody 13223
AGIGAGVGDHPLGYYYYAMDV

SEQ ID NO: 26447 - protein, 9 aa, Homo sapiens
  light chain complementarity determining region 3 for antibody 13224
QQYGSSTLT

SEQ ID NO: 26448 - protein, 22 aa, Homo sapiens
  heavy chain complementarity determining region 3 for antibody 13224
AKAYCTDGECYRGDYYYYAMDV

SEQ ID NO: 26449 - protein, 7 aa, Homo sapiens
  light chain complementarity determining region 3 for antibody 13225
QQYGSSR

SEQ ID NO: 26450 - protein, 16 aa, Homo sapiens
  heavy chain complementarity determining region 3 for antibody 13225
TATYGDYPPYYYAMVV

SEQ ID NO: 26451 - protein, 9 aa, Homo sapiens
  light chain complementarity determining region 3 for antibody 13226
QQYGSSPYT

SEQ ID NO: 26452 - protein, 16 aa, Homo sapiens
  heavy chain complementarity determining region 3 for antibody 13226
GKDYSASSGFAYWFDP

SEQ ID NO: 26453 - protein, 9 aa, Homo sapiens
  light chain complementarity determining region 3 for antibody 13227
QQYGSSPYP

SEQ ID NO: 26454 - protein, 13 aa, Homo sapiens
  heavy chain complementarity determining region 3 for antibody 13227
ARGSTYGSGTYTS

SEQ ID NO: 26455 - protein, 9 aa, Homo sapiens
  light chain complementarity determining region 3 for antibody 13228
QQYGSSPRT

SEQ ID NO: 26456 - protein, 17 aa, Homo sapiens
  heavy chain complementarity determining region 3 for antibody 13228
ARDDYVSDRIFYKGMDV

SEQ ID NO: 26457 - protein, 9 aa, Homo sapiens
  light chain complementarity determining region 3 for antibody 13229
QQYGSSPRT

SEQ ID NO: 26458 - protein, 17 aa, Homo sapiens
  heavy chain complementarity determining region 3 for antibody 13229
ARDDFVSDRILYKGMDV

SEQ ID NO: 26459 - protein, 9 aa, Homo sapiens
  light chain complementarity determining region 3 for antibody 13230
QQYGSSPRT

SEQ ID NO: 26460 - protein, 14 aa, Homo sapiens
  heavy chain complementarity determining region 3 for antibody 13230
AKDALVIGHDAFDV

SEQ ID NO: 26461 - protein, 10 aa, Homo sapiens
  light chain complementarity determining region 3 for antibody 13231
QQYGSSPPYT

SEQ ID NO: 26462 - protein, 13 aa, Homo sapiens
  heavy chain complementarity determining region 3 for antibody 13231
ARRSYYGSRNFDS

SEQ ID NO: 26463 - protein, 10 aa, Homo sapiens
  light chain complementarity determining region 3 for antibody 13232
QQYGSSPPYT

SEQ ID NO: 26464 - protein, 18 aa, Homo sapiens
  heavy chain complementarity determining region 3 for antibody 13232
ARDLSDIGYSYEGHNFDY

SEQ ID NO: 26465 - protein, 10 aa, Homo sapiens
  light chain complementarity determining region 3 for antibody 13233
QQYGSSPPIT

SEQ ID NO: 26466 - protein, 12 aa, Homo sapiens
  heavy chain complementarity determining region 3 for antibody 13233
AVELGYGNIPIA

SEQ ID NO: 26467 - protein, 10 aa, Homo sapiens
  light chain complementarity determining region 3 for antibody 13234
QQYGSSPPGT

SEQ ID NO: 26468 - protein, 17 aa, Homo sapiens
  heavy chain complementarity determining region 3 for antibody 13234
AGAHYDILTGYFYGMDV

SEQ ID NO: 26469 - protein, 9 aa, Homo sapiens
  light chain complementarity determining region 3 for antibody 13235
QQYGSSPIT

SEQ ID NO: 26470 - protein, 6 aa, Homo sapiens
  heavy chain complementarity determining region 3 for antibody 13235
AIMIVG

SEQ ID NO: 26471 - protein, 10 aa, Homo sapiens
  light chain complementarity determining region 3 for antibody 13236
QQYGSSPAGT

SEQ ID NO: 26472 - protein, 17 aa, Homo sapiens
  heavy chain complementarity determining region 3 for antibody 13236
ARDRSQGVLGYYYGMDV

SEQ ID NO: 26473 - protein, 9 aa, Homo sapiens
  light chain complementarity determining region 3 for antibody 13237
QQYGSSLWT

SEQ ID NO: 26474 - protein, 15 aa, Homo sapiens
  heavy chain complementarity determining region 3 for antibody 13237
ARNVLPDYYAGALHL

SEQ ID NO: 26475 - protein, 9 aa, Homo sapiens
  light chain complementarity determining region 3 for antibody 13238
QQYGSSLWT

SEQ ID NO: 26476 - protein, 14 aa, Homo sapiens
  heavy chain complementarity determining region 3 for antibody 13238
ARGNYGDYDCGMDV

SEQ ID NO: 26477 - protein, 8 aa, Homo sapiens
  light chain complementarity determining region 3 for antibody 13239
QQYGSSLT

SEQ ID NO: 26478 - protein, 13 aa, Homo sapiens
  heavy chain complementarity determining region 3 for antibody 13239
ARQDTDDFYGMDA

SEQ ID NO: 26479 - protein, 9 aa, Homo sapiens
  light chain complementarity determining region 3 for antibody 13240
QQYGSSLRT

SEQ ID NO: 26480 - protein, 15 aa, Homo sapiens
  heavy chain complementarity determining region 3 for antibody 13240
ARNVLPDYYAGAFHL

SEQ ID NO: 26481 - protein, 9 aa, Homo sapiens
  light chain complementarity determining region 3 for antibody 13241
QQYGSMPET

SEQ ID NO: 26482 - protein, 17 aa, Homo sapiens
  heavy chain complementarity determining region 3 for antibody 13241
ARRNYDEGSARLHALDL

SEQ ID NO: 26483 - protein, 9 aa, Homo sapiens
  light chain complementarity determining region 3 for antibody 13242
QQYGSHLYT

SEQ ID NO: 26484 - protein, 14 aa, Homo sapiens
  heavy chain complementarity determining region 3 for antibody 13242
ARALNLSTSFTLAY

SEQ ID NO: 26485 - protein, 12 aa, Homo sapiens
  light chain complementarity determining region 3 for antibody 13243
QQYGSGSSPPYP

SEQ ID NO: 26486 - protein, 12 aa, Homo sapiens
  heavy chain complementarity determining region 3 for antibody 13243
ASCIYGSGTLKV

SEQ ID NO: 26487 - protein, 9 aa, Homo sapiens
  light chain complementarity determining region 3 for antibody 13244
QQYGNSWGT

SEQ ID NO: 26488 - protein, 19 aa, Homo sapiens
  heavy chain complementarity determining region 3 for antibody 13244
ARVGDGHNKRGYYYYPMDV

SEQ ID NO: 26489 - protein, 9 aa, Homo sapiens
  light chain complementarity determining region 3 for antibody 13245
QQYGNSPYT

SEQ ID NO: 26490 - protein, 11 aa, Homo sapiens
  heavy chain complementarity determining region 3 for antibody 13245
VRDKYPGYFDN

SEQ ID NO: 26491 - protein, 8 aa, Homo sapiens
  light chain complementarity determining region 3 for antibody 13246
QQYGNLLT

SEQ ID NO: 26492 - protein, 20 aa, Homo sapiens
  heavy chain complementarity determining region 3 for antibody 13246
SKDRSVNAAMDYYYYTAMDV

SEQ ID NO: 26493 - protein, 8 aa, Homo sapiens
  light chain complementarity determining region 3 for antibody 13247
QQYGNLLT

SEQ ID NO: 26494 - protein, 20 aa, Homo sapiens
  heavy chain complementarity determining region 3 for antibody 13247
SKDRSVNAAMDYYYYPAMDV

SEQ ID NO: 26495 - protein, 8 aa, Homo sapiens
  light chain complementarity determining region 3 for antibody 13248
QQYGNLLT

SEQ ID NO: 26496 - protein, 20 aa, Homo sapiens
  heavy chain complementarity determining region 3 for antibody 13248
SKDRSVNAAMDYYYYAAMDV

SEQ ID NO: 26497 - protein, 8 aa, Homo sapiens
  light chain complementarity determining region 3 for antibody 13249
QQYGNLLT

SEQ ID NO: 26498 - protein, 20 aa, Homo sapiens
  heavy chain complementarity determining region 3 for antibody 13249
SKDRSVNAAMDYYCYSAMDV

SEQ ID NO: 26499 - protein, 8 aa, Homo sapiens
  light chain complementarity determining region 3 for antibody 13250
QQYGNLLT

SEQ ID NO: 26500 - protein, 20 aa, Homo sapiens
  heavy chain complementarity determining region 3 for antibody 13250
SKDRPVNAAMDYYYYSAMDV

SEQ ID NO: 26501 - protein, 8 aa, Homo sapiens
  light chain complementarity determining region 3 for antibody 13251
QQYGNLLT

SEQ ID NO: 26502 - protein, 20 aa, Homo sapiens
  heavy chain complementarity determining region 3 for antibody 13251
AKDRSVNAAMDYYYYSAMDV

SEQ ID NO: 26503 - protein, 9 aa, Homo sapiens
  light chain complementarity determining region 3 for antibody 13252
QQYGISPST

SEQ ID NO: 26504 - protein, 14 aa, Homo sapiens
  heavy chain complementarity determining region 3 for antibody 13252
ARGQSSVSSVPHAY

SEQ ID NO: 26505 - protein, 10 aa, Homo sapiens
  light chain complementarity determining region 3 for antibody 13253
QQYGGSPMYT

SEQ ID NO: 26506 - protein, 20 aa, Homo sapiens
  heavy chain complementarity determining region 3 for antibody 13253
AREFPLAVVDGYYHFYGMNA

SEQ ID NO: 26507 - protein, 10 aa, Homo sapiens
  light chain complementarity determining region 3 for antibody 13254
QQYGASPLVT

SEQ ID NO: 26508 - protein, 16 aa, Homo sapiens
  heavy chain complementarity determining region 3 for antibody 13254
TRRIVGTWLVPYYFDY

SEQ ID NO: 26509 - protein, 10 aa, Homo sapiens
  light chain complementarity determining region 3 for antibody 13255
QQYGALPPGT

SEQ ID NO: 26510 - protein, 16 aa, Homo sapiens
  heavy chain complementarity determining region 3 for antibody 13255
ARGGIEAWRYFYGMDV

SEQ ID NO: 26511 - protein, 10 aa, Homo sapiens
  light chain complementarity determining region 3 for antibody 13256
QQYFNWPLIT

SEQ ID NO: 26512 - protein, 15 aa, Homo sapiens
  heavy chain complementarity determining region 3 for antibody 13256
ASMFEFGSGTYYSNY

SEQ ID NO: 26513 - protein, 9 aa, Homo sapiens
  light chain complementarity determining region 3 for antibody 13257
QQYENLPIT

SEQ ID NO: 26514 - protein, 18 aa, Homo sapiens
  heavy chain complementarity determining region 3 for antibody 13257
ASAPQYSRATYYYYGMDI

SEQ ID NO: 26515 - protein, 9 aa, Homo sapiens
  light chain complementarity determining region 3 for antibody 13258
QQYEDDPLT

SEQ ID NO: 26516 - protein, 11 aa, Homo sapiens
  heavy chain complementarity determining region 3 for antibody 13258
ARRFFKIGFDH

SEQ ID NO: 26517 - protein, 9 aa, Homo sapiens
  light chain complementarity determining region 3 for antibody 13259
QQYDTYPLT

SEQ ID NO: 26518 - protein, 11 aa, Homo sapiens
  heavy chain complementarity determining region 3 for antibody 13259
ARDRSDTSMDP

SEQ ID NO: 26519 - protein, 10 aa, Homo sapiens
  light chain complementarity determining region 3 for antibody 13260
QQYDSYSGEP

SEQ ID NO: 26520 - protein, 21 aa, Homo sapiens
  heavy chain complementarity determining region 3 for antibody 13260
TKDRIAGDSTGYVFIGEYFQD

SEQ ID NO: 26521 - protein, 9 aa, Homo sapiens
  light chain complementarity determining region 3 for antibody 13261
QQYDSLPLT

SEQ ID NO: 26522 - protein, 18 aa, Homo sapiens
  heavy chain complementarity determining region 3 for antibody 13261
ARATGDYDMLRRGYYFDH

SEQ ID NO: 26523 - protein, 9 aa, Homo sapiens
  light chain complementarity determining region 3 for antibody 13262
QQYDSLPLT

SEQ ID NO: 26524 - protein, 18 aa, Homo sapiens
  heavy chain complementarity determining region 3 for antibody 13262
ARASGDYDMLRRGYYFDH

SEQ ID NO: 26525 - protein, 9 aa, Homo sapiens
  light chain complementarity determining region 3 for antibody 13263
QQYDSLHLT

SEQ ID NO: 26526 - protein, 18 aa, Homo sapiens
  heavy chain complementarity determining region 3 for antibody 13263
ARAPGDYDMLRRGYYFDH

SEQ ID NO: 26527 - protein, 9 aa, Homo sapiens
  light chain complementarity determining region 3 for antibody 13264
QQYDSFPYT

SEQ ID NO: 26528 - protein, 17 aa, Homo sapiens
  heavy chain complementarity determining region 3 for antibody 13264
AREDYSDVDWRAFYFDS

SEQ ID NO: 26529 - protein, 9 aa, Homo sapiens
  light chain complementarity determining region 3 for antibody 13265
QQYDSFPYT

SEQ ID NO: 26530 - protein, 17 aa, Homo sapiens
  heavy chain complementarity determining region 3 for antibody 13265
AREDWSDVDLRAFYFDP

SEQ ID NO: 26531 - protein, 9 aa, Homo sapiens
  light chain complementarity determining region 3 for antibody 13266
QQYDSFPYT

SEQ ID NO: 26532 - protein, 17 aa, Homo sapiens
  heavy chain complementarity determining region 3 for antibody 13266
AREDWSDVDLRAFYFDA

SEQ ID NO: 26533 - protein, 9 aa, Homo sapiens
  light chain complementarity determining region 3 for antibody 13267
QQYDSFPYP

SEQ ID NO: 26534 - protein, 17 aa, Homo sapiens
  heavy chain complementarity determining region 3 for antibody 13267
AREDWSDVDLRAFYFDS

SEQ ID NO: 26535 - protein, 9 aa, Homo sapiens
  light chain complementarity determining region 3 for antibody 13268
QQYDNWPLT

SEQ ID NO: 26536 - protein, 22 aa, Homo sapiens
  heavy chain complementarity determining region 3 for antibody 13268
AKGLCSITSCYEAHYYYNGMDV

SEQ ID NO: 26537 - protein, 11 aa, Homo sapiens
  light chain complementarity determining region 3 for antibody 13269
QQYDNSSPGST

SEQ ID NO: 26538 - protein, 16 aa, Homo sapiens
  heavy chain complementarity determining region 3 for antibody 13269
AHRFYYGTNGSVAFDI

SEQ ID NO: 26539 - protein, 7 aa, Homo sapiens
  light chain complementarity determining region 3 for antibody 13270
QQYDNLS

SEQ ID NO: 26540 - protein, 18 aa, Homo sapiens
  heavy chain complementarity determining region 3 for antibody 13270
AHERTSSWYLSSPSWFDP

SEQ ID NO: 26541 - protein, 10 aa, Homo sapiens
  light chain complementarity determining region 3 for antibody 13271
QQYDNLPPFT

SEQ ID NO: 26542 - protein, 16 aa, Homo sapiens
  heavy chain complementarity determining region 3 for antibody 13271
AREVFKGEYDYYAMDV

SEQ ID NO: 26543 - protein, 10 aa, Homo sapiens
  light chain complementarity determining region 3 for antibody 13272
QQYDNLPPFT

SEQ ID NO: 26544 - protein, 16 aa, Homo sapiens
  heavy chain complementarity determining region 3 for antibody 13272
ARELVKGEYDYYAMDV

SEQ ID NO: 26545 - protein, 10 aa, Homo sapiens
  light chain complementarity determining region 3 for antibody 13273
QQYDNLPPFT

SEQ ID NO: 26546 - protein, 16 aa, Homo sapiens
  heavy chain complementarity determining region 3 for antibody 13273
ARELFKGGYDYYAMDV

SEQ ID NO: 26547 - protein, 10 aa, Homo sapiens
  light chain complementarity determining region 3 for antibody 13274
QQYDNLPPFT

SEQ ID NO: 26548 - protein, 16 aa, Homo sapiens
  heavy chain complementarity determining region 3 for antibody 13274
ARELFKGEYDYYAMDA

SEQ ID NO: 26549 - protein, 10 aa, Homo sapiens
  light chain complementarity determining region 3 for antibody 13275
QQYDNLPPFT

SEQ ID NO: 26550 - protein, 16 aa, Homo sapiens
  heavy chain complementarity determining region 3 for antibody 13275
ARELFKGEYDCYAMDV

SEQ ID NO: 26551 - protein, 9 aa, Homo sapiens
  light chain complementarity determining region 3 for antibody 13276
QQYDNLPLT

SEQ ID NO: 26552 - protein, 18 aa, Homo sapiens
  heavy chain complementarity determining region 3 for antibody 13276
ARAPGEYDMLRRGYYFDH

SEQ ID NO: 26553 - protein, 9 aa, Homo sapiens
  light chain complementarity determining region 3 for antibody 13277
QQYDNLPLT

SEQ ID NO: 26554 - protein, 18 aa, Homo sapiens
  heavy chain complementarity determining region 3 for antibody 13277
ARAPGDYDMLRRCYYFDH

SEQ ID NO: 26555 - protein, 9 aa, Homo sapiens
  light chain complementarity determining region 3 for antibody 13278
QQYDNLPLT

SEQ ID NO: 26556 - protein, 18 aa, Homo sapiens
  heavy chain complementarity determining region 3 for antibody 13278
ARAPGDYDMLGRGYYFDH

SEQ ID NO: 26557 - protein, 9 aa, Homo sapiens
  light chain complementarity determining region 3 for antibody 13279
QQYDNLPLT

SEQ ID NO: 26558 - protein, 18 aa, Homo sapiens
  heavy chain complementarity determining region 3 for antibody 13279
ARAPGDHDMLRRGYYFDH

SEQ ID NO: 26559 - protein, 9 aa, Homo sapiens
  light chain complementarity determining region 3 for antibody 13280
QQYDNLPIT

SEQ ID NO: 26560 - protein, 12 aa, Homo sapiens
  heavy chain complementarity determining region 3 for antibody 13280
ARATGDPEYFQH

SEQ ID NO: 26561 - protein, 8 aa, Homo sapiens
  light chain complementarity determining region 3 for antibody 13281
QQYDNLII

SEQ ID NO: 26562 - protein, 21 aa, Homo sapiens
  heavy chain complementarity determining region 3 for antibody 13281
AKDRSADTTMDGYYYYSALDV

SEQ ID NO: 26563 - protein, 10 aa, Homo sapiens
  light chain complementarity determining region 3 for antibody 13282
QQYDNLHPFT

SEQ ID NO: 26564 - protein, 16 aa, Homo sapiens
  heavy chain complementarity determining region 3 for antibody 13282
ARELFKGEYDYYAMDV

SEQ ID NO: 26565 - protein, 8 aa, Homo sapiens
  light chain complementarity determining region 3 for antibody 13283
QQYDKFPT

SEQ ID NO: 26566 - protein, 20 aa, Homo sapiens
  heavy chain complementarity determining region 3 for antibody 13283
ATDRGTYFRSGSYYHYPLDY

SEQ ID NO: 26567 - protein, 11 aa, Homo sapiens
  light chain complementarity determining region 3 for antibody 13284
QQYDKFPPRFT

SEQ ID NO: 26568 - protein, 9 aa, Homo sapiens
  heavy chain complementarity determining region 3 for antibody 13284
TRRMVGFDY

SEQ ID NO: 26569 - protein, 8 aa, Homo sapiens
  light chain complementarity determining region 3 for antibody 13285
QQYDDLIT

SEQ ID NO: 26570 - protein, 20 aa, Homo sapiens
  heavy chain complementarity determining region 3 for antibody 13285
TKDRSVNTSMDYYYYSGMDV

SEQ ID NO: 26571 - protein, 9 aa, Homo sapiens
  light chain complementarity determining region 3 for antibody 13286
QQYASFPYT

SEQ ID NO: 26572 - protein, 17 aa, Homo sapiens
  heavy chain complementarity determining region 3 for antibody 13286
AREDWSDVDLRAFYFDS

SEQ ID NO: 26573 - protein, 11 aa, Homo sapiens
  light chain complementarity determining region 3 for antibody 13287
QQYADSIRALP

SEQ ID NO: 26574 - protein, 13 aa, Homo sapiens
  heavy chain complementarity determining region 3 for antibody 13287
ARDGVAPGIYFDY

SEQ ID NO: 26575 - protein, 9 aa, Homo sapiens
  light chain complementarity determining region 3 for antibody 13288
QQVNSYDYT

SEQ ID NO: 26576 - protein, 16 aa, Homo sapiens
  heavy chain complementarity determining region 3 for antibody 13288
ASTTGFSNKYYHGMDV

SEQ ID NO: 26577 - protein, 9 aa, Homo sapiens
  light chain complementarity determining region 3 for antibody 13289
QQVNSYDYT

SEQ ID NO: 26578 - protein, 16 aa, Homo sapiens
  heavy chain complementarity determining region 3 for antibody 13289
ASTTGCSNKYYYGMDV

SEQ ID NO: 26579 - protein, 9 aa, Homo sapiens
  light chain complementarity determining region 3 for antibody 13290
QQTYSTPVT

SEQ ID NO: 26580 - protein, 16 aa, Homo sapiens
  heavy chain complementarity determining region 3 for antibody 13290
ATLFAASGWSRGWLDP

SEQ ID NO: 26581 - protein, 9 aa, Homo sapiens
  light chain complementarity determining region 3 for antibody 13291
QQTYSTPLT

SEQ ID NO: 26582 - protein, 17 aa, Homo sapiens
  heavy chain complementarity determining region 3 for antibody 13291
ASSPGRKKYYYYYGMDV

SEQ ID NO: 26583 - protein, 9 aa, Homo sapiens
  light chain complementarity determining region 3 for antibody 13292
QQTYSTPAT

SEQ ID NO: 26584 - protein, 14 aa, Homo sapiens
  heavy chain complementarity determining region 3 for antibody 13292
ARLDGSGRSGWFDP

SEQ ID NO: 26585 - protein, 10 aa, Homo sapiens
  light chain complementarity determining region 3 for antibody 13293
QQTYSNPTWP

SEQ ID NO: 26586 - protein, 13 aa, Homo sapiens
  heavy chain complementarity determining region 3 for antibody 13293
ARVGAVAGRAFDV

SEQ ID NO: 26587 - protein, 10 aa, Homo sapiens
  light chain complementarity determining region 3 for antibody 13294
QQTYSNPPWT

SEQ ID NO: 26588 - protein, 13 aa, Homo sapiens
  heavy chain complementarity determining region 3 for antibody 13294
ARVGAVAGRAFDV

SEQ ID NO: 26589 - protein, 9 aa, Homo sapiens
  light chain complementarity determining region 3 for antibody 13295
QQTYRTPMT

SEQ ID NO: 26590 - protein, 12 aa, Homo sapiens
  heavy chain complementarity determining region 3 for antibody 13295
ARRRGYYKSLDY

SEQ ID NO: 26591 - protein, 9 aa, Homo sapiens
  light chain complementarity determining region 3 for antibody 13296
QQSYTFPWT

SEQ ID NO: 26592 - protein, 14 aa, Homo sapiens
  heavy chain complementarity determining region 3 for antibody 13296
ATDPPTDGYNSLDL

SEQ ID NO: 26593 - protein, 9 aa, Homo sapiens
  light chain complementarity determining region 3 for antibody 13297
QQSYTFPRT

SEQ ID NO: 26594 - protein, 14 aa, Homo sapiens
  heavy chain complementarity determining region 3 for antibody 13297
ATDPPTDGYNSLDF

SEQ ID NO: 26595 - protein, 9 aa, Homo sapiens
  light chain complementarity determining region 3 for antibody 13298
QQSYSTPYT

SEQ ID NO: 26596 - protein, 12 aa, Homo sapiens
  heavy chain complementarity determining region 3 for antibody 13298
AVELRYGDIPIA

SEQ ID NO: 26597 - protein, 9 aa, Homo sapiens
  light chain complementarity determining region 3 for antibody 13299
QQSYSTPYT

SEQ ID NO: 26598 - protein, 12 aa, Homo sapiens
  heavy chain complementarity determining region 3 for antibody 13299
AVELGYGGIPIA

SEQ ID NO: 26599 - protein, 9 aa, Homo sapiens
  light chain complementarity determining region 3 for antibody 13300
QQSYSTPYP

SEQ ID NO: 26600 - protein, 12 aa, Homo sapiens
  heavy chain complementarity determining region 3 for antibody 13300
AVELGYGDIPIA

SEQ ID NO: 26601 - protein, 9 aa, Homo sapiens
  light chain complementarity determining region 3 for antibody 13301
QQSYSTPYP

SEQ ID NO: 26602 - protein, 15 aa, Homo sapiens
  heavy chain complementarity determining region 3 for antibody 13301
ARGGAVRPRYYGVDV

SEQ ID NO: 26603 - protein, 9 aa, Homo sapiens
  light chain complementarity determining region 3 for antibody 13302
QQSYSTPWT

SEQ ID NO: 26604 - protein, 18 aa, Homo sapiens
  heavy chain complementarity determining region 3 for antibody 13302
VREKVGDYCTGSCSFYEN

SEQ ID NO: 26605 - protein, 9 aa, Homo sapiens
  light chain complementarity determining region 3 for antibody 13303
QQSYSTPST

SEQ ID NO: 26606 - protein, 12 aa, Homo sapiens
  heavy chain complementarity determining region 3 for antibody 13303
AVELGYGDIPIA

SEQ ID NO: 26607 - protein, 9 aa, Homo sapiens
  light chain complementarity determining region 3 for antibody 13304
QQSYSTPRT

SEQ ID NO: 26608 - protein, 14 aa, Homo sapiens
  heavy chain complementarity determining region 3 for antibody 13304
ARVQVDYSNYVCDS

SEQ ID NO: 26609 - protein, 9 aa, Homo sapiens
  light chain complementarity determining region 3 for antibody 13305
QQSYSTPRT

SEQ ID NO: 26610 - protein, 14 aa, Homo sapiens
  heavy chain complementarity determining region 3 for antibody 13305
ARVQVDYSNYGFDS

SEQ ID NO: 26611 - protein, 9 aa, Homo sapiens
  light chain complementarity determining region 3 for antibody 13306
QQSYSTPRT

SEQ ID NO: 26612 - protein, 14 aa, Homo sapiens
  heavy chain complementarity determining region 3 for antibody 13306
ARVQVDYSNYGCDP

SEQ ID NO: 26613 - protein, 9 aa, Homo sapiens
  light chain complementarity determining region 3 for antibody 13307
QQSYSTPRT

SEQ ID NO: 26614 - protein, 14 aa, Homo sapiens
  heavy chain complementarity determining region 3 for antibody 13307
ARVQVDYSNDGCDS

SEQ ID NO: 26615 - protein, 9 aa, Homo sapiens
  light chain complementarity determining region 3 for antibody 13308
QQSYSTPRT

SEQ ID NO: 26616 - protein, 14 aa, Homo sapiens
  heavy chain complementarity determining region 3 for antibody 13308
AGVQVDYSNYGCDS

SEQ ID NO: 26617 - protein, 9 aa, Homo sapiens
  light chain complementarity determining region 3 for antibody 13309
QQSYSTPPL

SEQ ID NO: 26618 - protein, 13 aa, Homo sapiens
  heavy chain complementarity determining region 3 for antibody 13309
ARVDDTNYLIVAY

SEQ ID NO: 26619 - protein, 9 aa, Homo sapiens
  light chain complementarity determining region 3 for antibody 13310
QQSYSTPFT

SEQ ID NO: 26620 - protein, 14 aa, Homo sapiens
  heavy chain complementarity determining region 3 for antibody 13310
ARLPGRYPRHGLDV

SEQ ID NO: 26621 - protein, 9 aa, Homo sapiens
  light chain complementarity determining region 3 for antibody 13311
QQSYSTPFT

SEQ ID NO: 26622 - protein, 17 aa, Homo sapiens
  heavy chain complementarity determining region 3 for antibody 13311
ARGSYYDVDLNRFYFDY

SEQ ID NO: 26623 - protein, 9 aa, Homo sapiens
  light chain complementarity determining region 3 for antibody 13312
QQSYSTPFT

SEQ ID NO: 26624 - protein, 14 aa, Homo sapiens
  heavy chain complementarity determining region 3 for antibody 13312
AGLPGRYPRHGFDV

SEQ ID NO: 26625 - protein, 9 aa, Homo sapiens
  light chain complementarity determining region 3 for antibody 13313
QQSYSTLGS

SEQ ID NO: 26626 - protein, 13 aa, Homo sapiens
  heavy chain complementarity determining region 3 for antibody 13313
ASGGYSYSDVADY

SEQ ID NO: 26627 - protein, 9 aa, Homo sapiens
  light chain complementarity determining region 3 for antibody 13314
QQSYSTKWM

SEQ ID NO: 26628 - protein, 18 aa, Homo sapiens
  heavy chain complementarity determining region 3 for antibody 13314
ARDSLLGYCSSTSCWFDP

SEQ ID NO: 26629 - protein, 10 aa, Homo sapiens
  light chain complementarity determining region 3 for antibody 13315
QQSYSTHLLT

SEQ ID NO: 26630 - protein, 14 aa, Homo sapiens
  heavy chain complementarity determining region 3 for antibody 13315
ARMAYGGSDYWFDP

SEQ ID NO: 26631 - protein, 9 aa, Homo sapiens
  light chain complementarity determining region 3 for antibody 13316
QQSYSSTWT

SEQ ID NO: 26632 - protein, 23 aa, Homo sapiens
  heavy chain complementarity determining region 3 for antibody 13316
ARGVIGPYASNWYESDYYYGKDV

SEQ ID NO: 26633 - protein, 11 aa, Homo sapiens
  light chain complementarity determining region 3 for antibody 13317
QQSYSSPPENT

SEQ ID NO: 26634 - protein, 12 aa, Homo sapiens
  heavy chain complementarity determining region 3 for antibody 13317
ARPDYGDHKIDL

SEQ ID NO: 26635 - protein, 9 aa, Homo sapiens
  light chain complementarity determining region 3 for antibody 13318
QQSYSSPFP

SEQ ID NO: 26636 - protein, 11 aa, Homo sapiens
  heavy chain complementarity determining region 3 for antibody 13318
VHKGDYASWDY

SEQ ID NO: 26637 - protein, 9 aa, Homo sapiens
  light chain complementarity determining region 3 for antibody 13319
QQSYRPPQA

SEQ ID NO: 26638 - protein, 14 aa, Homo sapiens
  heavy chain complementarity determining region 3 for antibody 13319
ARSKEWSLGAAFDY

SEQ ID NO: 26639 - protein, 8 aa, Homo sapiens
  light chain complementarity determining region 3 for antibody 13320
QQSYRALP

SEQ ID NO: 26640 - protein, 10 aa, Homo sapiens
  heavy chain complementarity determining region 3 for antibody 13320
AHLSRGVNFF

SEQ ID NO: 26641 - protein, 9 aa, Homo sapiens
  light chain complementarity determining region 3 for antibody 13321
QQSYNTPWT

SEQ ID NO: 26642 - protein, 14 aa, Homo sapiens
  heavy chain complementarity determining region 3 for antibody 13321
AAAKVWGYYYGIDV

SEQ ID NO: 26643 - protein, 9 aa, Homo sapiens
  light chain complementarity determining region 3 for antibody 13322
QQSYNLQWT

SEQ ID NO: 26644 - protein, 14 aa, Homo sapiens
  heavy chain complementarity determining region 3 for antibody 13322
ARAGPSGTYSGFDS

SEQ ID NO: 26645 - protein, 8 aa, Homo sapiens
  light chain complementarity determining region 3 for antibody 13323
QQSYNAFT

SEQ ID NO: 26646 - protein, 22 aa, Homo sapiens
  heavy chain complementarity determining region 3 for antibody 13323
AKDIAMIVVVVENPDTPDTLDY

SEQ ID NO: 26647 - protein, 9 aa, Homo sapiens
  light chain complementarity determining region 3 for antibody 13324
QQSYGTPPT

SEQ ID NO: 26648 - protein, 10 aa, Homo sapiens
  heavy chain complementarity determining region 3 for antibody 13324
ARERVEGLDY

SEQ ID NO: 26649 - protein, 10 aa, Homo sapiens
  light chain complementarity determining region 3 for antibody 13325
QQSYGPRPRT

SEQ ID NO: 26650 - protein, 15 aa, Homo sapiens
  heavy chain complementarity determining region 3 for antibody 13325
ARVSGPWVMIYYFDY

SEQ ID NO: 26651 - protein, 9 aa, Homo sapiens
  light chain complementarity determining region 3 for antibody 13326
QQSYDTPST

SEQ ID NO: 26652 - protein, 12 aa, Homo sapiens
  heavy chain complementarity determining region 3 for antibody 13326
ARHYYGNNAAEF

SEQ ID NO: 26653 - protein, 9 aa, Homo sapiens
  light chain complementarity determining region 3 for antibody 13327
QQSYDNPQT

SEQ ID NO: 26654 - protein, 15 aa, Homo sapiens
  heavy chain complementarity determining region 3 for antibody 13327
AREIVGYGDLNAYDV

SEQ ID NO: 26655 - protein, 9 aa, Homo sapiens
  light chain complementarity determining region 3 for antibody 13328
QQSNSYWYT

SEQ ID NO: 26656 - protein, 20 aa, Homo sapiens
  heavy chain complementarity determining region 3 for antibody 13328
AGTYGSGTYSPDYYYFGMDV

SEQ ID NO: 26657 - protein, 9 aa, Homo sapiens
  light chain complementarity determining region 3 for antibody 13329
QQSLTAPLT

SEQ ID NO: 26658 - protein, 17 aa, Homo sapiens
  heavy chain complementarity determining region 3 for antibody 13329
TRSIVSSSGWNAGGFDC

SEQ ID NO: 26659 - protein, 9 aa, Homo sapiens
  light chain complementarity determining region 3 for antibody 13330
QQSHTIPWT

SEQ ID NO: 26660 - protein, 14 aa, Homo sapiens
  heavy chain complementarity determining region 3 for antibody 13330
ARTGPSGTYSGFDS

SEQ ID NO: 26661 - protein, 9 aa, Homo sapiens
  light chain complementarity determining region 3 for antibody 13331
QQSHSYPIT

SEQ ID NO: 26662 - protein, 16 aa, Homo sapiens
  heavy chain complementarity determining region 3 for antibody 13331
ARTQGTRDYYYYAMDV

SEQ ID NO: 26663 - protein, 9 aa, Homo sapiens
  light chain complementarity determining region 3 for antibody 13332
QQSHSTPRT

SEQ ID NO: 26664 - protein, 14 aa, Homo sapiens
  heavy chain complementarity determining region 3 for antibody 13332
ARVQVDYSNYGCDS

SEQ ID NO: 26665 - protein, 9 aa, Homo sapiens
  light chain complementarity determining region 3 for antibody 13333
QQSHDAPYT

SEQ ID NO: 26666 - protein, 13 aa, Homo sapiens
  heavy chain complementarity determining region 3 for antibody 13333
TRDLRRFLNWFDP

SEQ ID NO: 26667 - protein, 9 aa, Homo sapiens
  light chain complementarity determining region 3 for antibody 13334
QQSFVTQRT

SEQ ID NO: 26668 - protein, 14 aa, Homo sapiens
  heavy chain complementarity determining region 3 for antibody 13334
VRNDAYGDYFFMDV

SEQ ID NO: 26669 - protein, 9 aa, Homo sapiens
  light chain complementarity determining region 3 for antibody 13335
QQSFSPPWA

SEQ ID NO: 26670 - protein, 19 aa, Homo sapiens
  heavy chain complementarity determining region 3 for antibody 13335
ATMRYGSGELTYGYYGMDV

SEQ ID NO: 26671 - protein, 9 aa, Homo sapiens
  light chain complementarity determining region 3 for antibody 13336
QQSFSPPWA

SEQ ID NO: 26672 - protein, 19 aa, Homo sapiens
  heavy chain complementarity determining region 3 for antibody 13336
ATMRYGSGDLTYDYYGMDV

SEQ ID NO: 26673 - protein, 9 aa, Homo sapiens
  light chain complementarity determining region 3 for antibody 13337
QQSDTFPIT

SEQ ID NO: 26674 - protein, 16 aa, Homo sapiens
  heavy chain complementarity determining region 3 for antibody 13337
ARGWRQVASGWLYFDY

SEQ ID NO: 26675 - protein, 9 aa, Homo sapiens
  light chain complementarity determining region 3 for antibody 13338
QQRYSTPYT

SEQ ID NO: 26676 - protein, 12 aa, Homo sapiens
  heavy chain complementarity determining region 3 for antibody 13338
AVELGYGDIPIA

SEQ ID NO: 26677 - protein, 8 aa, Homo sapiens
  light chain complementarity determining region 3 for antibody 13339
QQRYRALS

SEQ ID NO: 26678 - protein, 10 aa, Homo sapiens
  heavy chain complementarity determining region 3 for antibody 13339
AHLSRGVNFF

SEQ ID NO: 26679 - protein, 9 aa, Homo sapiens
  light chain complementarity determining region 3 for antibody 13340
QQRTNWPGT

SEQ ID NO: 26680 - protein, 19 aa, Homo sapiens
  heavy chain complementarity determining region 3 for antibody 13340
VRARQYRSSWYGPSDAFDI

SEQ ID NO: 26681 - protein, 9 aa, Homo sapiens
  light chain complementarity determining region 3 for antibody 13341
QQRTNWGLT

SEQ ID NO: 26682 - protein, 22 aa, Homo sapiens
  heavy chain complementarity determining region 3 for antibody 13341
ARHSGYSNTWYMNYYYYYGMDV

SEQ ID NO: 26683 - protein, 10 aa, Homo sapiens
  light chain complementarity determining region 3 for antibody 13342
QQRTDWPHFP

SEQ ID NO: 26684 - protein, 19 aa, Homo sapiens
  heavy chain complementarity determining region 3 for antibody 13342
ARQANSSPAKTGGQYYLDS

SEQ ID NO: 26685 - protein, 9 aa, Homo sapiens
  light chain complementarity determining region 3 for antibody 13343
QQRSSWPLT

SEQ ID NO: 26686 - protein, 11 aa, Homo sapiens
  heavy chain complementarity determining region 3 for antibody 13343
ANRDDKGYFDY

SEQ ID NO: 26687 - protein, 9 aa, Homo sapiens
  light chain complementarity determining region 3 for antibody 13344
QQRSNWRAT

SEQ ID NO: 26688 - protein, 15 aa, Homo sapiens
  heavy chain complementarity determining region 3 for antibody 13344
ARGRGGEISRAYSDF

SEQ ID NO: 26689 - protein, 11 aa, Homo sapiens
  light chain complementarity determining region 3 for antibody 13345
QQRSNWPPSVT

SEQ ID NO: 26690 - protein, 16 aa, Homo sapiens
  heavy chain complementarity determining region 3 for antibody 13345
TRGALVVLVDLNAFDI

SEQ ID NO: 26691 - protein, 10 aa, Homo sapiens
  light chain complementarity determining region 3 for antibody 13346
QQRSNWPMFT

SEQ ID NO: 26692 - protein, 14 aa, Homo sapiens
  heavy chain complementarity determining region 3 for antibody 13346
ARLNKMTRIRYFDS

SEQ ID NO: 26693 - protein, 9 aa, Homo sapiens
  light chain complementarity determining region 3 for antibody 13347
QQRSNWPLT

SEQ ID NO: 26694 - protein, 17 aa, Homo sapiens
  heavy chain complementarity determining region 3 for antibody 13347
AKASSTPSHRGCYYMDV

SEQ ID NO: 26695 - protein, 8 aa, Homo sapiens
  light chain complementarity determining region 3 for antibody 13348
QQRSNWLT

SEQ ID NO: 26696 - protein, 19 aa, Homo sapiens
  heavy chain complementarity determining region 3 for antibody 13348
ARRFYPDSNGYYGPPLDDP

SEQ ID NO: 26697 - protein, 8 aa, Homo sapiens
  light chain complementarity determining region 3 for antibody 13349
QQRSNWLT

SEQ ID NO: 26698 - protein, 16 aa, Homo sapiens
  heavy chain complementarity determining region 3 for antibody 13349
ARATDYTGDLPWYFDL

SEQ ID NO: 26699 - protein, 9 aa, Homo sapiens
  light chain complementarity determining region 3 for antibody 13350
QQRRSWPQT

SEQ ID NO: 26700 - protein, 17 aa, Homo sapiens
  heavy chain complementarity determining region 3 for antibody 13350
TRESPAISAPTTAAYDS

SEQ ID NO: 26701 - protein, 9 aa, Homo sapiens
  light chain complementarity determining region 3 for antibody 13351
QQRNNWGLT

SEQ ID NO: 26702 - protein, 21 aa, Homo sapiens
  heavy chain complementarity determining region 3 for antibody 13351
ARHSGYSNTWYMNYYYYGMDV

SEQ ID NO: 26703 - protein, 9 aa, Homo sapiens
  light chain complementarity determining region 3 for antibody 13352
QQRNNWGLT

SEQ ID NO: 26704 - protein, 22 aa, Homo sapiens
  heavy chain complementarity determining region 3 for antibody 13352
ARHSGYSNTWYMNCYYYYGMDV

SEQ ID NO: 26705 - protein, 9 aa, Homo sapiens
  light chain complementarity determining region 3 for antibody 13353
QQRNNWGLT

SEQ ID NO: 26706 - protein, 22 aa, Homo sapiens
  heavy chain complementarity determining region 3 for antibody 13353
ARHSGYNNTWYMNYYYYYGMDV

SEQ ID NO: 26707 - protein, 10 aa, Homo sapiens
  light chain complementarity determining region 3 for antibody 13354
QQRKRWPPLT

SEQ ID NO: 26708 - protein, 12 aa, Homo sapiens
  heavy chain complementarity determining region 3 for antibody 13354
TDTHVTGGDWDY

SEQ ID NO: 26709 - protein, 9 aa, Homo sapiens
  light chain complementarity determining region 3 for antibody 13355
QQRGGWPLP

SEQ ID NO: 26710 - protein, 16 aa, Homo sapiens
  heavy chain complementarity determining region 3 for antibody 13355
AAGVKAYRRAVRYFDY

SEQ ID NO: 26711 - protein, 9 aa, Homo sapiens
  light chain complementarity determining region 3 for antibody 13356
QQRGGWPLA

SEQ ID NO: 26712 - protein, 16 aa, Homo sapiens
  heavy chain complementarity determining region 3 for antibody 13356
AAGVKAYRRAVRYFDY

SEQ ID NO: 26713 - protein, 9 aa, Homo sapiens
  light chain complementarity determining region 3 for antibody 13357
QQRGGGPLA

SEQ ID NO: 26714 - protein, 16 aa, Homo sapiens
  heavy chain complementarity determining region 3 for antibody 13357
AAGVKAYRRAVRYFDY

SEQ ID NO: 26715 - protein, 8 aa, Homo sapiens
  light chain complementarity determining region 3 for antibody 13358
QQRDSLFS

SEQ ID NO: 26716 - protein, 18 aa, Homo sapiens
  heavy chain complementarity determining region 3 for antibody 13358
AHLGQSFGELSTQKYFDC

SEQ ID NO: 26717 - protein, 9 aa, Homo sapiens
  light chain complementarity determining region 3 for antibody 13359
QQNYNTPRT

SEQ ID NO: 26718 - protein, 20 aa, Homo sapiens
  heavy chain complementarity determining region 3 for antibody 13359
TTDDILLVPTDPRDDNWVDP

SEQ ID NO: 26719 - protein, 10 aa, Homo sapiens
  light chain complementarity determining region 3 for antibody 13360
QQNVSSELFT

SEQ ID NO: 26720 - protein, 16 aa, Homo sapiens
  heavy chain complementarity determining region 3 for antibody 13360
AREIFKGEIDYYAMDV

SEQ ID NO: 26721 - protein, 10 aa, Homo sapiens
  light chain complementarity determining region 3 for antibody 13361
QQNDNLPSVT

SEQ ID NO: 26722 - protein, 11 aa, Homo sapiens
  heavy chain complementarity determining region 3 for antibody 13361
AKSGGFWSFDY

SEQ ID NO: 26723 - protein, 11 aa, Homo sapiens
  light chain complementarity determining region 3 for antibody 13362
QQNDKLSPPHV

SEQ ID NO: 26724 - protein, 16 aa, Homo sapiens
  heavy chain complementarity determining region 3 for antibody 13362
ARDRMVGYDFVYGMDV

SEQ ID NO: 26725 - protein, 9 aa, Homo sapiens
  light chain complementarity determining region 3 for antibody 13363
QQLTIFPLA

SEQ ID NO: 26726 - protein, 17 aa, Homo sapiens
  heavy chain complementarity determining region 3 for antibody 13363
ARGGNPSGNHYYYGLDV

SEQ ID NO: 26727 - protein, 8 aa, Homo sapiens
  light chain complementarity determining region 3 for antibody 13364
QQLSSYPA

SEQ ID NO: 26728 - protein, 23 aa, Homo sapiens
  heavy chain complementarity determining region 3 for antibody 13364
SHISVASRDVPLGTHYYYYGMDV

SEQ ID NO: 26729 - protein, 10 aa, Homo sapiens
  light chain complementarity determining region 3 for antibody 13365
QQLNTYPPIT

SEQ ID NO: 26730 - protein, 14 aa, Homo sapiens
  heavy chain complementarity determining region 3 for antibody 13365
ARDADTPHRRAFDV

SEQ ID NO: 26731 - protein, 10 aa, Homo sapiens
  light chain complementarity determining region 3 for antibody 13366
QQLNTYPPIN

SEQ ID NO: 26732 - protein, 14 aa, Homo sapiens
  heavy chain complementarity determining region 3 for antibody 13366
AGDADTPHRRAFDV

SEQ ID NO: 26733 - protein, 11 aa, Homo sapiens
  light chain complementarity determining region 3 for antibody 13367
QQLNDFTRGIT

SEQ ID NO: 26734 - protein, 17 aa, Homo sapiens
  heavy chain complementarity determining region 3 for antibody 13367
AGERQYCSHLSCYGEDY

SEQ ID NO: 26735 - protein, 11 aa, Homo sapiens
  light chain complementarity determining region 3 for antibody 13368
QQLNDFPRGIT

SEQ ID NO: 26736 - protein, 17 aa, Homo sapiens
  heavy chain complementarity determining region 3 for antibody 13368
ARERQYCSHLSCYGEDY

SEQ ID NO: 26737 - protein, 9 aa, Homo sapiens
  light chain complementarity determining region 3 for antibody 13369
QQLHGYPLT

SEQ ID NO: 26738 - protein, 21 aa, Homo sapiens
  heavy chain complementarity determining region 3 for antibody 13369
ARDWAQSNGYPVGHYYYGIDV

SEQ ID NO: 26739 - protein, 9 aa, Homo sapiens
  light chain complementarity determining region 3 for antibody 13370
QQHNSLPIT

SEQ ID NO: 26740 - protein, 19 aa, Homo sapiens
  heavy chain complementarity determining region 3 for antibody 13370
ARDRDYTIVDDYGSGVFDY

SEQ ID NO: 26741 - protein, 9 aa, Homo sapiens
  light chain complementarity determining region 3 for antibody 13371
QQGYSLPFT

SEQ ID NO: 26742 - protein, 19 aa, Homo sapiens
  heavy chain complementarity determining region 3 for antibody 13371
ARSDYSGDTDRYYDYGMDV

SEQ ID NO: 26743 - protein, 9 aa, Homo sapiens
  light chain complementarity determining region 3 for antibody 13372
QQGYSFPFP

SEQ ID NO: 26744 - protein, 19 aa, Homo sapiens
  heavy chain complementarity determining region 3 for antibody 13372
ARSDYSGDTDRYYDHGMDV

SEQ ID NO: 26745 - protein, 9 aa, Homo sapiens
  light chain complementarity determining region 3 for antibody 13373
QQFYNYPIT

SEQ ID NO: 26746 - protein, 14 aa, Homo sapiens
  heavy chain complementarity determining region 3 for antibody 13373
AKEKGGGGAAGLDD

SEQ ID NO: 26747 - protein, 9 aa, Homo sapiens
  light chain complementarity determining region 3 for antibody 13374
QQFPSYPIT

SEQ ID NO: 26748 - protein, 16 aa, Homo sapiens
  heavy chain complementarity determining region 3 for antibody 13374
ARTQGTRDYYYYAMDV

SEQ ID NO: 26749 - protein, 9 aa, Homo sapiens
  light chain complementarity determining region 3 for antibody 13375
QQFNTYSLT

SEQ ID NO: 26750 - protein, 17 aa, Homo sapiens
  heavy chain complementarity determining region 3 for antibody 13375
AKDLSGVHYDIHHGLDV

SEQ ID NO: 26751 - protein, 9 aa, Homo sapiens
  light chain complementarity determining region 3 for antibody 13376
QQFNTYPPT

SEQ ID NO: 26752 - protein, 17 aa, Homo sapiens
  heavy chain complementarity determining region 3 for antibody 13376
AKDLSGVHYDIHHGLDV

SEQ ID NO: 26753 - protein, 9 aa, Homo sapiens
  light chain complementarity determining region 3 for antibody 13377
QQFNTYPLT

SEQ ID NO: 26754 - protein, 17 aa, Homo sapiens
  heavy chain complementarity determining region 3 for antibody 13377
AKDLSGVQYDIHHGLDV

SEQ ID NO: 26755 - protein, 9 aa, Homo sapiens
  light chain complementarity determining region 3 for antibody 13378
QQFNTYPFT

SEQ ID NO: 26756 - protein, 17 aa, Homo sapiens
  heavy chain complementarity determining region 3 for antibody 13378
AKDLSGVHYDIHHGLDV

SEQ ID NO: 26757 - protein, 9 aa, Homo sapiens
  light chain complementarity determining region 3 for antibody 13379
QQFNPYPLT

SEQ ID NO: 26758 - protein, 17 aa, Homo sapiens
  heavy chain complementarity determining region 3 for antibody 13379
AKDLSGVHYDIHHGLDV

SEQ ID NO: 26759 - protein, 9 aa, Homo sapiens
  light chain complementarity determining region 3 for antibody 13380
QQFNNYPQT

SEQ ID NO: 26760 - protein, 11 aa, Homo sapiens
  heavy chain complementarity determining region 3 for antibody 13380
AREATRGYSQK

SEQ ID NO: 26761 - protein, 9 aa, Homo sapiens
  light chain complementarity determining region 3 for antibody 13381
QQFHSYPST

SEQ ID NO: 26762 - protein, 16 aa, Homo sapiens
  heavy chain complementarity determining region 3 for antibody 13381
ARTQGTRDYYYYAMDV

SEQ ID NO: 26763 - protein, 9 aa, Homo sapiens
  light chain complementarity determining region 3 for antibody 13382
QQFHSYPIT

SEQ ID NO: 26764 - protein, 16 aa, Homo sapiens
  heavy chain complementarity determining region 3 for antibody 13382
TRTQGTRDYYYYAMDV

SEQ ID NO: 26765 - protein, 9 aa, Homo sapiens
  light chain complementarity determining region 3 for antibody 13383
QQFHSYPIT

SEQ ID NO: 26766 - protein, 16 aa, Homo sapiens
  heavy chain complementarity determining region 3 for antibody 13383
ARTQGTRDYYYSAMDV

SEQ ID NO: 26767 - protein, 9 aa, Homo sapiens
  light chain complementarity determining region 3 for antibody 13384
QQFHSYPIT

SEQ ID NO: 26768 - protein, 16 aa, Homo sapiens
  heavy chain complementarity determining region 3 for antibody 13384
ARTQGTRDDYYYAMDV

SEQ ID NO: 26769 - protein, 9 aa, Homo sapiens
  light chain complementarity determining region 3 for antibody 13385
QQFHGYPIT

SEQ ID NO: 26770 - protein, 16 aa, Homo sapiens
  heavy chain complementarity determining region 3 for antibody 13385
ARTQGTRDYYYYAMDV

SEQ ID NO: 26771 - protein, 10 aa, Homo sapiens
  light chain complementarity determining region 3 for antibody 13386
QQDSSSPQLT

SEQ ID NO: 26772 - protein, 13 aa, Homo sapiens
  heavy chain complementarity determining region 3 for antibody 13386
ARSAGYYPNWLES

SEQ ID NO: 26773 - protein, 9 aa, Homo sapiens
  light chain complementarity determining region 3 for antibody 13387
QQDGSSLWT

SEQ ID NO: 26774 - protein, 15 aa, Homo sapiens
  heavy chain complementarity determining region 3 for antibody 13387
ARNVLPDYYAGAFHL

SEQ ID NO: 26775 - protein, 11 aa, Homo sapiens
  light chain complementarity determining region 3 for antibody 13388
QQCYSSPPANT

SEQ ID NO: 26776 - protein, 16 aa, Homo sapiens
  heavy chain complementarity determining region 3 for antibody 13388
AREAGEDYYYKDIFDV

SEQ ID NO: 26777 - protein, 9 aa, Homo sapiens
  light chain complementarity determining region 3 for antibody 13389
QQCYSDPPT

SEQ ID NO: 26778 - protein, 13 aa, Homo sapiens
  heavy chain complementarity determining region 3 for antibody 13389
ARGRSDASDALDV

SEQ ID NO: 26779 - protein, 9 aa, Homo sapiens
  light chain complementarity determining region 3 for antibody 13390
QQCYRDPLT

SEQ ID NO: 26780 - protein, 13 aa, Homo sapiens
  heavy chain complementarity determining region 3 for antibody 13390
ARGRSDASDALDV

SEQ ID NO: 26781 - protein, 9 aa, Homo sapiens
  light chain complementarity determining region 3 for antibody 13391
QQCHSPMYT

SEQ ID NO: 26782 - protein, 13 aa, Homo sapiens
  heavy chain complementarity determining region 3 for antibody 13391
AHIGCRGASCYPV

SEQ ID NO: 26783 - protein, 9 aa, Homo sapiens
  light chain complementarity determining region 3 for antibody 13392
QQAYRFPRS

SEQ ID NO: 26784 - protein, 13 aa, Homo sapiens
  heavy chain complementarity determining region 3 for antibody 13392
TRTYGSGRNWFDP

SEQ ID NO: 26785 - protein, 9 aa, Homo sapiens
  light chain complementarity determining region 3 for antibody 13393
QQAYRFPLS

SEQ ID NO: 26786 - protein, 13 aa, Homo sapiens
  heavy chain complementarity determining region 3 for antibody 13393
TRTYGSWRNWFDP

SEQ ID NO: 26787 - protein, 9 aa, Homo sapiens
  light chain complementarity determining region 3 for antibody 13394
QQAYRFPLS

SEQ ID NO: 26788 - protein, 13 aa, Homo sapiens
  heavy chain complementarity determining region 3 for antibody 13394
TRTYGSGRNWSDP

SEQ ID NO: 26789 - protein, 9 aa, Homo sapiens
  light chain complementarity determining region 3 for antibody 13395
QQAYRFPLS

SEQ ID NO: 26790 - protein, 13 aa, Homo sapiens
  heavy chain complementarity determining region 3 for antibody 13395
TRTYGSGRNWFDH

SEQ ID NO: 26791 - protein, 9 aa, Homo sapiens
  light chain complementarity determining region 3 for antibody 13396
QQAYRFPLS

SEQ ID NO: 26792 - protein, 13 aa, Homo sapiens
  heavy chain complementarity determining region 3 for antibody 13396
TRTYGSGRDWFDP

SEQ ID NO: 26793 - protein, 9 aa, Homo sapiens
  light chain complementarity determining region 3 for antibody 13397
QQAYRFPLS

SEQ ID NO: 26794 - protein, 14 aa, Homo sapiens
  heavy chain complementarity determining region 3 for antibody 13397
ARLNKMTRIRYFDS

SEQ ID NO: 26795 - protein, 9 aa, Homo sapiens
  light chain complementarity determining region 3 for antibody 13398
QQASRFPLS

SEQ ID NO: 26796 - protein, 13 aa, Homo sapiens
  heavy chain complementarity determining region 3 for antibody 13398
TRTYGSGRNWFDP

SEQ ID NO: 26797 - protein, 9 aa, Homo sapiens
  light chain complementarity determining region 3 for antibody 13399
QQANSLPFT

SEQ ID NO: 26798 - protein, 19 aa, Homo sapiens
  heavy chain complementarity determining region 3 for antibody 13399
ARTDYSGDSDRYYDYGMDV

SEQ ID NO: 26799 - protein, 9 aa, Homo sapiens
  light chain complementarity determining region 3 for antibody 13400
QQANSLPFT

SEQ ID NO: 26800 - protein, 19 aa, Homo sapiens
  heavy chain complementarity determining region 3 for antibody 13400
ARNDCSGDTDRYYDFGMDV

SEQ ID NO: 26801 - protein, 9 aa, Homo sapiens
  light chain complementarity determining region 3 for antibody 13401
QQANSFPYT

SEQ ID NO: 26802 - protein, 18 aa, Homo sapiens
  heavy chain complementarity determining region 3 for antibody 13401
ARHEYYFDSRGPTNWFDP

SEQ ID NO: 26803 - protein, 9 aa, Homo sapiens
  light chain complementarity determining region 3 for antibody 13402
QQANSFPLT

SEQ ID NO: 26804 - protein, 15 aa, Homo sapiens
  heavy chain complementarity determining region 3 for antibody 13402
ARDPGDTSGWYYFDY

SEQ ID NO: 26805 - protein, 9 aa, Homo sapiens
  light chain complementarity determining region 3 for antibody 13403
QQANSFPHT

SEQ ID NO: 26806 - protein, 14 aa, Homo sapiens
  heavy chain complementarity determining region 3 for antibody 13403
ARDRSVTYGKYFGH

SEQ ID NO: 26807 - protein, 10 aa, Homo sapiens
  light chain complementarity determining region 3 for antibody 13404
QQANSFLSIT

SEQ ID NO: 26808 - protein, 11 aa, Homo sapiens
  heavy chain complementarity determining region 3 for antibody 13404
AREQTGCYPLY

SEQ ID NO: 26809 - protein, 8 aa, Homo sapiens
  light chain complementarity determining region 3 for antibody 13405
QQAHSFPP

SEQ ID NO: 26810 - protein, 22 aa, Homo sapiens
  heavy chain complementarity determining region 3 for antibody 13405
ARHSGYSNTWYMNYYYYYGMGV

SEQ ID NO: 26811 - protein, 8 aa, Homo sapiens
  light chain complementarity determining region 3 for antibody 13406
QQAHSFPP

SEQ ID NO: 26812 - protein, 22 aa, Homo sapiens
  heavy chain complementarity determining region 3 for antibody 13406
ARHSGYSNTWYMNYYYYYGIDV

SEQ ID NO: 26813 - protein, 8 aa, Homo sapiens
  light chain complementarity determining region 3 for antibody 13407
QQAHSFPP

SEQ ID NO: 26814 - protein, 22 aa, Homo sapiens
  heavy chain complementarity determining region 3 for antibody 13407
ARHSGYSNTWYMNYYHYYGMDV

SEQ ID NO: 26815 - protein, 8 aa, Homo sapiens
  light chain complementarity determining region 3 for antibody 13408
QQAHSFPP

SEQ ID NO: 26816 - protein, 22 aa, Homo sapiens
  heavy chain complementarity determining region 3 for antibody 13408
ARHSGYSNTWYMNYYDYYGMDV

SEQ ID NO: 26817 - protein, 8 aa, Homo sapiens
  light chain complementarity determining region 3 for antibody 13409
QQAHSFPP

SEQ ID NO: 26818 - protein, 22 aa, Homo sapiens
  heavy chain complementarity determining region 3 for antibody 13409
ARHSGYSNAWYMNYYYYYGMDV

SEQ ID NO: 26819 - protein, 8 aa, Homo sapiens
  light chain complementarity determining region 3 for antibody 13410
QQAHSFPP

SEQ ID NO: 26820 - protein, 22 aa, Homo sapiens
  heavy chain complementarity determining region 3 for antibody 13410
ARHAGYSNTWYMNYYYYYGMDV

SEQ ID NO: 26821 - protein, 9 aa, Homo sapiens
  light chain complementarity determining region 3 for antibody 13411
QQADTFPLT

SEQ ID NO: 26822 - protein, 16 aa, Homo sapiens
  heavy chain complementarity determining region 3 for antibody 13411
ARGWRQVASGWLYFDY

SEQ ID NO: 26823 - protein, 9 aa, Homo sapiens
  light chain complementarity determining region 3 for antibody 13412
QQAATFPIT

SEQ ID NO: 26824 - protein, 16 aa, Homo sapiens
  heavy chain complementarity determining region 3 for antibody 13412
ARGWRQVASGWLYFDY

SEQ ID NO: 26825 - protein, 10 aa, Homo sapiens
  light chain complementarity determining region 3 for antibody 13413
QPYSSSPQLT

SEQ ID NO: 26826 - protein, 13 aa, Homo sapiens
  heavy chain complementarity determining region 3 for antibody 13413
ARSAGYYPNWLES

SEQ ID NO: 26827 - protein, 9 aa, Homo sapiens
  light chain complementarity determining region 3 for antibody 13414
QPYGSFLQT

SEQ ID NO: 26828 - protein, 13 aa, Homo sapiens
  heavy chain complementarity determining region 3 for antibody 13414
AGGHGSTSGLIDY

SEQ ID NO: 26829 - protein, 9 aa, Homo sapiens
  light chain complementarity determining region 3 for antibody 13415
QNYDSSPRI

SEQ ID NO: 26830 - protein, 13 aa, Homo sapiens
  heavy chain complementarity determining region 3 for antibody 13415
TRDEDGNNPPFDY

SEQ ID NO: 26831 - protein, 11 aa, Homo sapiens
  light chain complementarity determining region 3 for antibody 13416
QLLNSNSGGFT

SEQ ID NO: 26832 - protein, 19 aa, Homo sapiens
  heavy chain complementarity determining region 3 for antibody 13416
ARGGPCSGTTCFSYYGVDV

SEQ ID NO: 26833 - protein, 11 aa, Homo sapiens
  light chain complementarity determining region 3 for antibody 13417
QLLNSHSGGFT

SEQ ID NO: 26834 - protein, 19 aa, Homo sapiens
  heavy chain complementarity determining region 3 for antibody 13417
ARGGPCSGTTCVSYYGVDV

SEQ ID NO: 26835 - protein, 10 aa, Homo sapiens
  light chain complementarity determining region 3 for antibody 13418
QLFGNSPRYT

SEQ ID NO: 26836 - protein, 20 aa, Homo sapiens
  heavy chain complementarity determining region 3 for antibody 13418
ARDRGGRSSSFTNYQYNIDV

SEQ ID NO: 26837 - protein, 9 aa, Homo sapiens
  light chain complementarity determining region 3 for antibody 13419
QKYNSAPRT

SEQ ID NO: 26838 - protein, 20 aa, Homo sapiens
  heavy chain complementarity determining region 3 for antibody 13419
ARGGRYSDNFPYYHHYGMDV

SEQ ID NO: 26839 - protein, 9 aa, Homo sapiens
  light chain complementarity determining region 3 for antibody 13420
QKYNSAPFT

SEQ ID NO: 26840 - protein, 15 aa, Homo sapiens
  heavy chain complementarity determining region 3 for antibody 13420
AGDRTVAAPNWYFDL

SEQ ID NO: 26841 - protein, 10 aa, Homo sapiens
  light chain complementarity determining region 3 for antibody 13421
QKYNNVPPFT

SEQ ID NO: 26842 - protein, 17 aa, Homo sapiens
  heavy chain complementarity determining region 3 for antibody 13421
ASDPAYGDSYYYSGMDL

SEQ ID NO: 26843 - protein, 10 aa, Homo sapiens
  light chain complementarity determining region 3 for antibody 13422
QKYNNVPPFP

SEQ ID NO: 26844 - protein, 17 aa, Homo sapiens
  heavy chain complementarity determining region 3 for antibody 13422
ASDPTYGDSYYYSGMDL

SEQ ID NO: 26845 - protein, 10 aa, Homo sapiens
  light chain complementarity determining region 3 for antibody 13423
QKYDSAPPFP

SEQ ID NO: 26846 - protein, 19 aa, Homo sapiens
  heavy chain complementarity determining region 3 for antibody 13423
ARELDFDILTGYLGGLFQH

SEQ ID NO: 26847 - protein, 9 aa, Homo sapiens
  light chain complementarity determining region 3 for antibody 13424
QKSYSTPYT

SEQ ID NO: 26848 - protein, 17 aa, Homo sapiens
  heavy chain complementarity determining region 3 for antibody 13424
ARGSYYDVDLNRFYFDY

SEQ ID NO: 26849 - protein, 9 aa, Homo sapiens
  light chain complementarity determining region 3 for antibody 13425
QKRNNWGLT

SEQ ID NO: 26850 - protein, 22 aa, Homo sapiens
  heavy chain complementarity determining region 3 for antibody 13425
ARHSGYSNTWYMNYYYYYGMDV

SEQ ID NO: 26851 - protein, 9 aa, Homo sapiens
  light chain complementarity determining region 3 for antibody 13426
QKLHGYPLT

SEQ ID NO: 26852 - protein, 21 aa, Homo sapiens
  heavy chain complementarity determining region 3 for antibody 13426
ARDWAQSNGYPVGHYYYGMDV

SEQ ID NO: 26853 - protein, 9 aa, Homo sapiens
  light chain complementarity determining region 3 for antibody 13427
QKFHSYPIT

SEQ ID NO: 26854 - protein, 16 aa, Homo sapiens
  heavy chain complementarity determining region 3 for antibody 13427
ARTQGTRDYYYYAMDV

SEQ ID NO: 26855 - protein, 8 aa, Homo sapiens
  light chain complementarity determining region 3 for antibody 13428
QKAHSFPP

SEQ ID NO: 26856 - protein, 22 aa, Homo sapiens
  heavy chain complementarity determining region 3 for antibody 13428
ARHSGYSNTWYMNYYYYYGMDV

SEQ ID NO: 26857 - protein, 9 aa, Homo sapiens
  light chain complementarity determining region 3 for antibody 13429
QHYYTYSET

SEQ ID NO: 26858 - protein, 19 aa, Homo sapiens
  heavy chain complementarity determining region 3 for antibody 13429
ATVKGDQGELDYDYHGVDV

SEQ ID NO: 26859 - protein, 10 aa, Homo sapiens
  light chain complementarity determining region 3 for antibody 13430
QHYTTPPKYT

SEQ ID NO: 26860 - protein, 10 aa, Homo sapiens
  heavy chain complementarity determining region 3 for antibody 13430
ARNGLYSLDY

SEQ ID NO: 26861 - protein, 11 aa, Homo sapiens
  light chain complementarity determining region 3 for antibody 13431
QHYGTSPHCRR

SEQ ID NO: 26862 - protein, 16 aa, Homo sapiens
  heavy chain complementarity determining region 3 for antibody 13431
ARPLLHSNGYFYEVHY

SEQ ID NO: 26863 - protein, 10 aa, Homo sapiens
  light chain complementarity determining region 3 for antibody 13432
QHYGGSPMYT

SEQ ID NO: 26864 - protein, 20 aa, Homo sapiens
  heavy chain complementarity determining region 3 for antibody 13432
AREFPLAVVDGYYHFYGMNV

SEQ ID NO: 26865 - protein, 9 aa, Homo sapiens
  light chain complementarity determining region 3 for antibody 13433
QHRSNRPGT

SEQ ID NO: 26866 - protein, 18 aa, Homo sapiens
  heavy chain complementarity determining region 3 for antibody 13433
ALEPQTEFGSGNYGYFDY

SEQ ID NO: 26867 - protein, 10 aa, Homo sapiens
  light chain complementarity determining region 3 for antibody 13434
QHRNNWAPWT

SEQ ID NO: 26868 - protein, 9 aa, Homo sapiens
  heavy chain complementarity determining region 3 for antibody 13434
IIWFGAIEY

SEQ ID NO: 26869 - protein, 9 aa, Homo sapiens
  light chain complementarity determining region 3 for antibody 13435
QHRNNWALT

SEQ ID NO: 26870 - protein, 22 aa, Homo sapiens
  heavy chain complementarity determining region 3 for antibody 13435
ARHSGYSNTWYMNYYYYYGMDV

SEQ ID NO: 26871 - protein, 9 aa, Homo sapiens
  light chain complementarity determining region 3 for antibody 13436
QHNYSTSPA

SEQ ID NO: 26872 - protein, 11 aa, Homo sapiens
  heavy chain complementarity determining region 3 for antibody 13436
TRDPPGNGMDV

SEQ ID NO: 26873 - protein, 9 aa, Homo sapiens
  light chain complementarity determining region 3 for antibody 13437
QHNYRPYPA

SEQ ID NO: 26874 - protein, 11 aa, Homo sapiens
  heavy chain complementarity determining region 3 for antibody 13437
TRDPPGNGMDV

SEQ ID NO: 26875 - protein, 9 aa, Homo sapiens
  light chain complementarity determining region 3 for antibody 13438
QHNYRPSPT

SEQ ID NO: 26876 - protein, 11 aa, Homo sapiens
  heavy chain complementarity determining region 3 for antibody 13438
TRDPPGNGMDV

SEQ ID NO: 26877 - protein, 9 aa, Homo sapiens
  light chain complementarity determining region 3 for antibody 13439
QHNYRPSPA

SEQ ID NO: 26878 - protein, 11 aa, Homo sapiens
  heavy chain complementarity determining region 3 for antibody 13439
TRDPPGNGMDA

SEQ ID NO: 26879 - protein, 9 aa, Homo sapiens
  light chain complementarity determining region 3 for antibody 13440
QHNYRPPPA

SEQ ID NO: 26880 - protein, 11 aa, Homo sapiens
  heavy chain complementarity determining region 3 for antibody 13440
TRDPPGNGMDV

SEQ ID NO: 26881 - protein, 11 aa, Homo sapiens
  light chain complementarity determining region 3 for antibody 13441
QHNGSSPPGNT

SEQ ID NO: 26882 - protein, 17 aa, Homo sapiens
  heavy chain complementarity determining region 3 for antibody 13441
ARENYDVLTGSNYGMDV

SEQ ID NO: 26883 - protein, 9 aa, Homo sapiens
  light chain complementarity determining region 3 for antibody 13442
QHGHSLPFT

SEQ ID NO: 26884 - protein, 19 aa, Homo sapiens
  heavy chain complementarity determining region 3 for antibody 13442
ARSDYSGDTDRYYDYGMDV

SEQ ID NO: 26885 - protein, 9 aa, Homo sapiens
  light chain complementarity determining region 3 for antibody 13443
QHCDHFSVT

SEQ ID NO: 26886 - protein, 15 aa, Homo sapiens
  heavy chain complementarity determining region 3 for antibody 13443
ARDPTAAGFPAHFDY

SEQ ID NO: 26887 - protein, 9 aa, Homo sapiens
  light chain complementarity determining region 3 for antibody 13444
QHCDHFSIT

SEQ ID NO: 26888 - protein, 15 aa, Homo sapiens
  heavy chain complementarity determining region 3 for antibody 13444
AREPTAAGFPAHFDY

SEQ ID NO: 26889 - protein, 9 aa, Homo sapiens
  light chain complementarity determining region 3 for antibody 13445
QHCDHFSIT

SEQ ID NO: 26890 - protein, 15 aa, Homo sapiens
  heavy chain complementarity determining region 3 for antibody 13445
ARDTTAAGFPAHFDY

SEQ ID NO: 26891 - protein, 9 aa, Homo sapiens
  light chain complementarity determining region 3 for antibody 13446
QGYNNAPLT

SEQ ID NO: 26892 - protein, 15 aa, Homo sapiens
  heavy chain complementarity determining region 3 for antibody 13446
GRHRYSSSQGYGMDV

SEQ ID NO: 26893 - protein, 9 aa, Homo sapiens
  light chain complementarity determining region 3 for antibody 13447
QEYNSYSLT

SEQ ID NO: 26894 - protein, 7 aa, Homo sapiens
  heavy chain complementarity determining region 3 for antibody 13447
ARVPGVS

SEQ ID NO: 26895 - protein, 10 aa, Homo sapiens
  light chain complementarity determining region 3 for antibody 13448
QESYSTPPFT

SEQ ID NO: 26896 - protein, 27 aa, Homo sapiens
  heavy chain complementarity determining region 3 for antibody 13448
ARPRRVLSLGESVAPPTGLWDYYGMDV

SEQ ID NO: 26897 - protein, 9 aa, Homo sapiens
  light chain complementarity determining region 3 for antibody 13449
QDRSNRPGT

SEQ ID NO: 26898 - protein, 18 aa, Homo sapiens
  heavy chain complementarity determining region 3 for antibody 13449
ALEPQTEFGSGNYGYFDY

SEQ ID NO: 26899 - protein, 10 aa, Homo sapiens
  light chain complementarity determining region 3 for antibody 13450
PYHGYSPLYT

SEQ ID NO: 26900 - protein, 12 aa, Homo sapiens
  heavy chain complementarity determining region 3 for antibody 13450
AKGILGRGGMDV

SEQ ID NO: 26901 - protein, 9 aa, Homo sapiens
  light chain complementarity determining region 3 for antibody 13451
PHNYRPSPA

SEQ ID NO: 26902 - protein, 11 aa, Homo sapiens
  heavy chain complementarity determining region 3 for antibody 13451
TRDPPGNGMDV

SEQ ID NO: 26903 - protein, 10 aa, Homo sapiens
  light chain complementarity determining region 3 for antibody 13452
PFYRDWPGWT

SEQ ID NO: 26904 - protein, 17 aa, Homo sapiens
  heavy chain complementarity determining region 3 for antibody 13452
AKEIWIVNRPGGDAFDM

SEQ ID NO: 26905 - protein, 10 aa, Homo sapiens
  light chain complementarity determining region 3 for antibody 13453
MQTLQILPIT

SEQ ID NO: 26906 - protein, 20 aa, Homo sapiens
  heavy chain complementarity determining region 3 for antibody 13453
ARHLPTTVIDGIYYYYGMDV

SEQ ID NO: 26907 - protein, 10 aa, Homo sapiens
  light chain complementarity determining region 3 for antibody 13454
MQNTHWRGNI

SEQ ID NO: 26908 - protein, 16 aa, Homo sapiens
  heavy chain complementarity determining region 3 for antibody 13454
TRDMMDDFWNDYTGDY

SEQ ID NO: 26909 - protein, 9 aa, Homo sapiens
  light chain complementarity determining region 3 for antibody 13455
MQGTYGPIT

SEQ ID NO: 26910 - protein, 15 aa, Homo sapiens
  heavy chain complementarity determining region 3 for antibody 13455
ARGRRTVLTGDTPDY

SEQ ID NO: 26911 - protein, 9 aa, Homo sapiens
  light chain complementarity determining region 3 for antibody 13456
MQGTHWPWT

SEQ ID NO: 26912 - protein, 11 aa, Homo sapiens
  heavy chain complementarity determining region 3 for antibody 13456
ARQVYYYHLDV

SEQ ID NO: 26913 - protein, 9 aa, Homo sapiens
  light chain complementarity determining region 3 for antibody 13457
MQGTHWPWT

SEQ ID NO: 26914 - protein, 11 aa, Homo sapiens
  heavy chain complementarity determining region 3 for antibody 13457
ARHVYYYHLDF

SEQ ID NO: 26915 - protein, 9 aa, Homo sapiens
  light chain complementarity determining region 3 for antibody 13458
MQGTHWPWT

SEQ ID NO: 26916 - protein, 11 aa, Homo sapiens
  heavy chain complementarity determining region 3 for antibody 13458
ARHVSYYHLDV

SEQ ID NO: 26917 - protein, 8 aa, Homo sapiens
  light chain complementarity determining region 3 for antibody 13459
MQGTHWPP

SEQ ID NO: 26918 - protein, 12 aa, Homo sapiens
  heavy chain complementarity determining region 3 for antibody 13459
THDWDFNYGMDV

SEQ ID NO: 26919 - protein, 9 aa, Homo sapiens
  light chain complementarity determining region 3 for antibody 13460
MQGTHWPPP

SEQ ID NO: 26920 - protein, 15 aa, Homo sapiens
  heavy chain complementarity determining region 3 for antibody 13460
ARGRRGFREGMGMDV

SEQ ID NO: 26921 - protein, 9 aa, Homo sapiens
  light chain complementarity determining region 3 for antibody 13461
MQGTHWPPA

SEQ ID NO: 26922 - protein, 17 aa, Homo sapiens
  heavy chain complementarity determining region 3 for antibody 13461
TRDVPGQDITVVSGMDV

SEQ ID NO: 26923 - protein, 9 aa, Homo sapiens
  light chain complementarity determining region 3 for antibody 13462
MQGTHWPPA

SEQ ID NO: 26924 - protein, 17 aa, Homo sapiens
  heavy chain complementarity determining region 3 for antibody 13462
TKDVPGQDITAVSGMDV

SEQ ID NO: 26925 - protein, 7 aa, Homo sapiens
  light chain complementarity determining region 3 for antibody 13463
MQGTHWD

SEQ ID NO: 26926 - protein, 15 aa, Homo sapiens
  heavy chain complementarity determining region 3 for antibody 13463
ARRPFGESAPDAFDT

SEQ ID NO: 26927 - protein, 9 aa, Homo sapiens
  light chain complementarity determining region 3 for antibody 13464
MQGLQFPPT

SEQ ID NO: 26928 - protein, 19 aa, Homo sapiens
  heavy chain complementarity determining region 3 for antibody 13464
ARVAYYYDEEDHYYYAMDV

SEQ ID NO: 26929 - protein, 9 aa, Homo sapiens
  light chain complementarity determining region 3 for antibody 13465
MQGLLNPPA

SEQ ID NO: 26930 - protein, 18 aa, Homo sapiens
  heavy chain complementarity determining region 3 for antibody 13465
ARTRVGMYSGGSPFMFDP

SEQ ID NO: 26931 - protein, 9 aa, Homo sapiens
  light chain complementarity determining region 3 for antibody 13466
MQGLHTPLT

SEQ ID NO: 26932 - protein, 16 aa, Homo sapiens
  heavy chain complementarity determining region 3 for antibody 13466
ARGGFGELGLHNAFDV

SEQ ID NO: 26933 - protein, 9 aa, Homo sapiens
  light chain complementarity determining region 3 for antibody 13467
MQGLHFPLP

SEQ ID NO: 26934 - protein, 19 aa, Homo sapiens
  heavy chain complementarity determining region 3 for antibody 13467
ARVAYYYDEEDHYYYAMDV

SEQ ID NO: 26935 - protein, 9 aa, Homo sapiens
  light chain complementarity determining region 3 for antibody 13468
MQGAHWPYT

SEQ ID NO: 26936 - protein, 10 aa, Homo sapiens
  heavy chain complementarity determining region 3 for antibody 13468
AKYLRRAFDV

SEQ ID NO: 26937 - protein, 10 aa, Homo sapiens
  light chain complementarity determining region 3 for antibody 13469
MQATHWPPLT

SEQ ID NO: 26938 - protein, 11 aa, Homo sapiens
  heavy chain complementarity determining region 3 for antibody 13469
VRDKYPGYFDN

SEQ ID NO: 26939 - protein, 9 aa, Homo sapiens
  light chain complementarity determining region 3 for antibody 13470
MQATHCPPA

SEQ ID NO: 26940 - protein, 17 aa, Homo sapiens
  heavy chain complementarity determining region 3 for antibody 13470
ARGFLDRGSGWTYYFDY

SEQ ID NO: 26941 - protein, 9 aa, Homo sapiens
  light chain complementarity determining region 3 for antibody 13471
MQALQTPYP

SEQ ID NO: 26942 - protein, 19 aa, Homo sapiens
  heavy chain complementarity determining region 3 for antibody 13471
ARGLYKDYWSGYTGDGFDI

SEQ ID NO: 26943 - protein, 9 aa, Homo sapiens
  light chain complementarity determining region 3 for antibody 13472
MQALQTPTT

SEQ ID NO: 26944 - protein, 23 aa, Homo sapiens
  heavy chain complementarity determining region 3 for antibody 13472
ARGGYSAHDVSPDIPTTYYGVDV

SEQ ID NO: 26945 - protein, 9 aa, Homo sapiens
  light chain complementarity determining region 3 for antibody 13473
MQALQTPRT

SEQ ID NO: 26946 - protein, 23 aa, Homo sapiens
  heavy chain complementarity determining region 3 for antibody 13473
ARGRGRYSGYDYRGKWGYYGLDV

SEQ ID NO: 26947 - protein, 9 aa, Homo sapiens
  light chain complementarity determining region 3 for antibody 13474
MQALQTPKT

SEQ ID NO: 26948 - protein, 23 aa, Homo sapiens
  heavy chain complementarity determining region 3 for antibody 13474
ARGGYSANDLSPDIPATYYGVDV

SEQ ID NO: 26949 - protein, 9 aa, Homo sapiens
  light chain complementarity determining region 3 for antibody 13475
MQALQTPGT

SEQ ID NO: 26950 - protein, 15 aa, Homo sapiens
  heavy chain complementarity determining region 3 for antibody 13475
AKGDYGSGIELALDY

SEQ ID NO: 26951 - protein, 9 aa, Homo sapiens
  light chain complementarity determining region 3 for antibody 13476
MQALQTPFT

SEQ ID NO: 26952 - protein, 19 aa, Homo sapiens
  heavy chain complementarity determining region 3 for antibody 13476
ARLDRYCTGSRCYSFWCEP

SEQ ID NO: 26953 - protein, 9 aa, Homo sapiens
  light chain complementarity determining region 3 for antibody 13477
MQALQTPFT

SEQ ID NO: 26954 - protein, 19 aa, Homo sapiens
  heavy chain complementarity determining region 3 for antibody 13477
ARLDRYCTGSRCCSFWFEP

SEQ ID NO: 26955 - protein, 9 aa, Homo sapiens
  light chain complementarity determining region 3 for antibody 13478
MQALQTPDT

SEQ ID NO: 26956 - protein, 19 aa, Homo sapiens
  heavy chain complementarity determining region 3 for antibody 13478
ARGLYKDYWSGYTGDGFDI

SEQ ID NO: 26957 - protein, 9 aa, Homo sapiens
  light chain complementarity determining region 3 for antibody 13479
MQALQSPFT

SEQ ID NO: 26958 - protein, 22 aa, Homo sapiens
  heavy chain complementarity determining region 3 for antibody 13479
VRDRPITRISMMRVSGEEAFDI

SEQ ID NO: 26959 - protein, 9 aa, Homo sapiens
  light chain complementarity determining region 3 for antibody 13480
MQALQLPFT

SEQ ID NO: 26960 - protein, 19 aa, Homo sapiens
  heavy chain complementarity determining region 3 for antibody 13480
VRNDRYCSGDRCFSFWFDP

SEQ ID NO: 26961 - protein, 9 aa, Homo sapiens
  light chain complementarity determining region 3 for antibody 13481
MQALQLPFT

SEQ ID NO: 26962 - protein, 19 aa, Homo sapiens
  heavy chain complementarity determining region 3 for antibody 13481
VRHDRHCSGDRCFSFWFDP

SEQ ID NO: 26963 - protein, 9 aa, Homo sapiens
  light chain complementarity determining region 3 for antibody 13482
MQALPTPFT

SEQ ID NO: 26964 - protein, 14 aa, Homo sapiens
  heavy chain complementarity determining region 3 for antibody 13482
ARDLLGDISAYFDH

SEQ ID NO: 26965 - protein, 9 aa, Homo sapiens
  light chain complementarity determining region 3 for antibody 13483
MQALKTPFT

SEQ ID NO: 26966 - protein, 19 aa, Homo sapiens
  heavy chain complementarity determining region 3 for antibody 13483
ARLDRYCTGSRCYSFWFEP

SEQ ID NO: 26967 - protein, 9 aa, Homo sapiens
  light chain complementarity determining region 3 for antibody 13484
MKGTHWPQT

SEQ ID NO: 26968 - protein, 20 aa, Homo sapiens
  heavy chain complementarity determining region 3 for antibody 13484
ARDGGYYDSSGYYYGASPEY

SEQ ID NO: 26969 - protein, 10 aa, Homo sapiens
  light chain complementarity determining region 3 for antibody 13485
LRYVSSELLT

SEQ ID NO: 26970 - protein, 16 aa, Homo sapiens
  heavy chain complementarity determining region 3 for antibody 13485
ARELFKGEYDYYGMDV

SEQ ID NO: 26971 - protein, 10 aa, Homo sapiens
  light chain complementarity determining region 3 for antibody 13486
LRYVSSELFT

SEQ ID NO: 26972 - protein, 16 aa, Homo sapiens
  heavy chain complementarity determining region 3 for antibody 13486
ARELFKGEYDYYGMDI

SEQ ID NO: 26973 - protein, 9 aa, Homo sapiens
  light chain complementarity determining region 3 for antibody 13487
LQYNNWPRK

SEQ ID NO: 26974 - protein, 16 aa, Homo sapiens
  heavy chain complementarity determining region 3 for antibody 13487
ARDSGIESRGLWYFDL

SEQ ID NO: 26975 - protein, 9 aa, Homo sapiens
  light chain complementarity determining region 3 for antibody 13488
LQTHTTPWT

SEQ ID NO: 26976 - protein, 12 aa, Homo sapiens
  heavy chain complementarity determining region 3 for antibody 13488
ARDWGTGDHLKY

SEQ ID NO: 26977 - protein, 9 aa, Homo sapiens
  light chain complementarity determining region 3 for antibody 13489
LQESTYPLT

SEQ ID NO: 26978 - protein, 19 aa, Homo sapiens
  heavy chain complementarity determining region 3 for antibody 13489
AREEGYYDGSRSWHPESDN

SEQ ID NO: 26979 - protein, 9 aa, Homo sapiens
  light chain complementarity determining region 3 for antibody 13490
LQDYKYPRT

SEQ ID NO: 26980 - protein, 18 aa, Homo sapiens
  heavy chain complementarity determining region 3 for antibody 13490
ARDASPGDSSAWYDAFDI

SEQ ID NO: 26981 - protein, 9 aa, Homo sapiens
  light chain complementarity determining region 3 for antibody 13491
LQDYKYPRT

SEQ ID NO: 26982 - protein, 18 aa, Homo sapiens
  heavy chain complementarity determining region 3 for antibody 13491
AGDTSPGDSSAWYDAFDI

SEQ ID NO: 26983 - protein, 9 aa, Homo sapiens
  light chain complementarity determining region 3 for antibody 13492
LQDYKYHRT

SEQ ID NO: 26984 - protein, 18 aa, Homo sapiens
  heavy chain complementarity determining region 3 for antibody 13492
ARDTSPGDSSAWYDAFDI

SEQ ID NO: 26985 - protein, 9 aa, Homo sapiens
  light chain complementarity determining region 3 for antibody 13493
LQDYKSPRT

SEQ ID NO: 26986 - protein, 18 aa, Homo sapiens
  heavy chain complementarity determining region 3 for antibody 13493
ARDTSPGDSSAWYDAFDI

SEQ ID NO: 26987 - protein, 9 aa, Homo sapiens
  light chain complementarity determining region 3 for antibody 13494
LQDYKNPRT

SEQ ID NO: 26988 - protein, 18 aa, Homo sapiens
  heavy chain complementarity determining region 3 for antibody 13494
ARDTSPGDSSAWYDAFDI

SEQ ID NO: 26989 - protein, 9 aa, Homo sapiens
  light chain complementarity determining region 3 for antibody 13495
LQDHIYPLT

SEQ ID NO: 26990 - protein, 14 aa, Homo sapiens
  heavy chain complementarity determining region 3 for antibody 13495
ALGLDSGGNSPYAY

SEQ ID NO: 26991 - protein, 9 aa, Homo sapiens
  light chain complementarity determining region 3 for antibody 13496
LQATNWPYT

SEQ ID NO: 26992 - protein, 11 aa, Homo sapiens
  heavy chain complementarity determining region 3 for antibody 13496
AKDTQWLPFDC

SEQ ID NO: 26993 - protein, 9 aa, Homo sapiens
  light chain complementarity determining region 3 for antibody 13497
LQATHWPYN

SEQ ID NO: 26994 - protein, 11 aa, Homo sapiens
  heavy chain complementarity determining region 3 for antibody 13497
AKDTQWLPFDC

SEQ ID NO: 26995 - protein, 9 aa, Homo sapiens
  light chain complementarity determining region 3 for antibody 13498
LQALLTPPT

SEQ ID NO: 26996 - protein, 19 aa, Homo sapiens
  heavy chain complementarity determining region 3 for antibody 13498
ARAHLTTYYSGGSAYGMDV

SEQ ID NO: 26997 - protein, 9 aa, Homo sapiens
  light chain complementarity determining region 3 for antibody 13499
LQAKHWPYT

SEQ ID NO: 26998 - protein, 11 aa, Homo sapiens
  heavy chain complementarity determining region 3 for antibody 13499
AKDTQWLPFDC

SEQ ID NO: 26999 - protein, 9 aa, Homo sapiens
  light chain complementarity determining region 3 for antibody 13500
LPYNNWPRT

SEQ ID NO: 27000 - protein, 16 aa, Homo sapiens
  heavy chain complementarity determining region 3 for antibody 13500
ARDSGIESRGLWYFDL

SEQ ID NO: 27001 - protein, 9 aa, Homo sapiens
  light chain complementarity determining region 3 for antibody 13501
HQYSVSRGT

SEQ ID NO: 27002 - protein, 21 aa, Homo sapiens
  heavy chain complementarity determining region 3 for antibody 13501
ARDRGGDCHGDSSYYNRPFDY

SEQ ID NO: 27003 - protein, 9 aa, Homo sapiens
  light chain complementarity determining region 3 for antibody 13502
HQYSVPRGT

SEQ ID NO: 27004 - protein, 21 aa, Homo sapiens
  heavy chain complementarity determining region 3 for antibody 13502
ARDRGGDFHGDSSYYNRPFDY

SEQ ID NO: 27005 - protein, 9 aa, Homo sapiens
  light chain complementarity determining region 3 for antibody 13503
HQYSGSRGT

SEQ ID NO: 27006 - protein, 21 aa, Homo sapiens
  heavy chain complementarity determining region 3 for antibody 13503
ARDRGGDFHGDSSYYNRPFDY

SEQ ID NO: 27007 - protein, 9 aa, Homo sapiens
  light chain complementarity determining region 3 for antibody 13504
HQYNSLPIT

SEQ ID NO: 27008 - protein, 19 aa, Homo sapiens
  heavy chain complementarity determining region 3 for antibody 13504
ARDRDYTIVDDYGSGVFDY

SEQ ID NO: 27009 - protein, 9 aa, Homo sapiens
  light chain complementarity determining region 3 for antibody 13505
HQYATSPLT

SEQ ID NO: 27010 - protein, 10 aa, Homo sapiens
  heavy chain complementarity determining region 3 for antibody 13505
GYSNGWSVHY

SEQ ID NO: 27011 - protein, 9 aa, Homo sapiens
  light chain complementarity determining region 3 for antibody 13506
HQYATSPLT

SEQ ID NO: 27012 - protein, 10 aa, Homo sapiens
  heavy chain complementarity determining region 3 for antibody 13506
GYSNGWFVHY

SEQ ID NO: 27013 - protein, 8 aa, Homo sapiens
  light chain complementarity determining region 3 for antibody 13507
HQTNSFPP

SEQ ID NO: 27014 - protein, 22 aa, Homo sapiens
  heavy chain complementarity determining region 3 for antibody 13507
ARHSGYSNAWYMNYYYYYGMDV

SEQ ID NO: 27015 - protein, 8 aa, Homo sapiens
  light chain complementarity determining region 3 for antibody 13508
HQSYSIPT

SEQ ID NO: 27016 - protein, 28 aa, Homo sapiens
  heavy chain complementarity determining region 3 for antibody 13508
ARTRREAPYYDPLTGYYESVHYYYAMDV

SEQ ID NO: 27017 - protein, 10 aa, Homo sapiens
  light chain complementarity determining region 3 for antibody 13509
HQSTILPRLP

SEQ ID NO: 27018 - protein, 18 aa, Homo sapiens
  heavy chain complementarity determining region 3 for antibody 13509
ARDVGYDRSANYHWYFDV

SEQ ID NO: 27019 - protein, 10 aa, Homo sapiens
  light chain complementarity determining region 3 for antibody 13510
HQSSSLVRLT

SEQ ID NO: 27020 - protein, 18 aa, Homo sapiens
  heavy chain complementarity determining region 3 for antibody 13510
ARDLGYDYNANYHWYFNL

SEQ ID NO: 27021 - protein, 10 aa, Homo sapiens
  light chain complementarity determining region 3 for antibody 13511
HQSSSLPRPT

SEQ ID NO: 27022 - protein, 18 aa, Homo sapiens
  heavy chain complementarity determining region 3 for antibody 13511
ARDLGYDFNAYYHWYFDL

SEQ ID NO: 27023 - protein, 10 aa, Homo sapiens
  light chain complementarity determining region 3 for antibody 13512
HQSSSLPRIT

SEQ ID NO: 27024 - protein, 18 aa, Homo sapiens
  heavy chain complementarity determining region 3 for antibody 13512
ARDVGYDSNAHYHWYFDL

SEQ ID NO: 27025 - protein, 9 aa, Homo sapiens
  light chain complementarity determining region 3 for antibody 13513
HQSSRFPHT

SEQ ID NO: 27026 - protein, 11 aa, Homo sapiens
  heavy chain complementarity determining region 3 for antibody 13513
ARGDYLDAFHF

SEQ ID NO: 27027 - protein, 9 aa, Homo sapiens
  light chain complementarity determining region 3 for antibody 13514
HQSFSPPWA

SEQ ID NO: 27028 - protein, 19 aa, Homo sapiens
  heavy chain complementarity determining region 3 for antibody 13514
ATMRYGSGELTYDYYGMDV

SEQ ID NO: 27029 - protein, 10 aa, Homo sapiens
  light chain complementarity determining region 3 for antibody 13515
HQRTTWPPFT

SEQ ID NO: 27030 - protein, 22 aa, Homo sapiens
  heavy chain complementarity determining region 3 for antibody 13515
TTGGGPIVILPITDSFYYGMDV

SEQ ID NO: 27031 - protein, 9 aa, Homo sapiens
  light chain complementarity determining region 3 for antibody 13516
HQCSVSRGT

SEQ ID NO: 27032 - protein, 21 aa, Homo sapiens
  heavy chain complementarity determining region 3 for antibody 13516
ARDRGGDFHGDSSYYNRPFDY

SEQ ID NO: 27033 - protein, 9 aa, Homo sapiens
  light chain complementarity determining region 3 for antibody 13517
HHNYRPSPA

SEQ ID NO: 27034 - protein, 11 aa, Homo sapiens
  heavy chain complementarity determining region 3 for antibody 13517
TRDPPGNGMDV

SEQ ID NO: 27035 - protein, 9 aa, Homo sapiens
  light chain complementarity determining region 3 for antibody 13518
GQALQTPIT

SEQ ID NO: 27036 - protein, 21 aa, Homo sapiens
  heavy chain complementarity determining region 3 for antibody 13518
VRGEAYNDILTGLPRLRRLDN

SEQ ID NO: 27037 - protein, 8 aa, Homo sapiens
  light chain complementarity determining region 3 for antibody 13519
YQTNSFPP

SEQ ID NO: 27038 - protein, 22 aa, Homo sapiens
  heavy chain complementarity determining region 3 for antibody 13519
ARHSGYSNTWYMNYYYYYGMDV

SEQ ID NO: 27039 - protein, 9 aa, Homo sapiens
  light chain complementarity determining region 3 for antibody 13520
VQGTHAGFT

SEQ ID NO: 27040 - protein, 7 aa, Homo sapiens
  heavy chain complementarity determining region 3 for antibody 13520
TTGDLRN

SEQ ID NO: 27041 - protein, 9 aa, Homo sapiens
  light chain complementarity determining region 3 for antibody 13521
VQGLQTPLT

SEQ ID NO: 27042 - protein, 16 aa, Homo sapiens
  heavy chain complementarity determining region 3 for antibody 13521
ARGGFGELGLHNAFDV

SEQ ID NO: 27043 - protein, 9 aa, Homo sapiens
  light chain complementarity determining region 3 for antibody 13522
VQALQTPIT

SEQ ID NO: 27044 - protein, 21 aa, Homo sapiens
  heavy chain complementarity determining region 3 for antibody 13522
VRGEAYNGILTGLPRLRRLDN

SEQ ID NO: 27045 - protein, 9 aa, Homo sapiens
  light chain complementarity determining region 3 for antibody 13523
VQALQTPIT

SEQ ID NO: 27046 - protein, 21 aa, Homo sapiens
  heavy chain complementarity determining region 3 for antibody 13523
VRGEAYNDMLTGLPRLRRLDN

SEQ ID NO: 27047 - protein, 9 aa, Homo sapiens
  light chain complementarity determining region 3 for antibody 13524
VQALQTPIT

SEQ ID NO: 27048 - protein, 21 aa, Homo sapiens
  heavy chain complementarity determining region 3 for antibody 13524
VRGEAYNDIVTGLPRLRRLDN

SEQ ID NO: 27049 - protein, 9 aa, Homo sapiens
  light chain complementarity determining region 3 for antibody 13525
VQALQPPIT

SEQ ID NO: 27050 - protein, 21 aa, Homo sapiens
  heavy chain complementarity determining region 3 for antibody 13525
VRGEAYNDILTGLPRLRRLDN

SEQ ID NO: 27051 - protein, 9 aa, Homo sapiens
  light chain complementarity determining region 3 for antibody 13526
VQALHTPIT

SEQ ID NO: 27052 - protein, 21 aa, Homo sapiens
  heavy chain complementarity determining region 3 for antibody 13526
VRGEAYNDILTGLPRLRRLDN

SEQ ID NO: 27053 - protein, 9 aa, Homo sapiens
  light chain complementarity determining region 3 for antibody 13527
TQGTHWPWT

SEQ ID NO: 27054 - protein, 11 aa, Homo sapiens
  heavy chain complementarity determining region 3 for antibody 13527
ARHVYYYHLDV

SEQ ID NO: 27055 - protein, 8 aa, Homo sapiens
  light chain complementarity determining region 3 for antibody 13528
RQYNSYPT

SEQ ID NO: 27056 - protein, 15 aa, Homo sapiens
  heavy chain complementarity determining region 3 for antibody 13528
ARVDRATGLRYYFDY

SEQ ID NO: 27057 - protein, 9 aa, Homo sapiens
  light chain complementarity determining region 3 for antibody 13529
RQYNNLPYT

SEQ ID NO: 27058 - protein, 13 aa, Homo sapiens
  heavy chain complementarity determining region 3 for antibody 13529
ARAKWDLFGYFDF

SEQ ID NO: 27059 - protein, 9 aa, Homo sapiens
  light chain complementarity determining region 3 for antibody 13530
RQYDTYPLT

SEQ ID NO: 27060 - protein, 19 aa, Homo sapiens
  heavy chain complementarity determining region 3 for antibody 13530
ARDRSDTSMDPGGEGCFDH

SEQ ID NO: 27061 - protein, 10 aa, Homo sapiens
  light chain complementarity determining region 3 for antibody 13531
RQTYSSPPPT

SEQ ID NO: 27062 - protein, 17 aa, Homo sapiens
  heavy chain complementarity determining region 3 for antibody 13531
ARLTPYTSNWNPFYCDY

SEQ ID NO: 27063 - protein, 9 aa, Homo sapiens
  light chain complementarity determining region 3 for antibody 13532
RQSYSTPRT

SEQ ID NO: 27064 - protein, 14 aa, Homo sapiens
  heavy chain complementarity determining region 3 for antibody 13532
ARVQVDYSNYGCDS

SEQ ID NO: 27065 - protein, 10 aa, Homo sapiens
  light chain complementarity determining region 3 for antibody 13533
RQSYGPPPLT

SEQ ID NO: 27066 - protein, 20 aa, Homo sapiens
  heavy chain complementarity determining region 3 for antibody 13533
TRHFRETLGGLKREFAAFDI

SEQ ID NO: 27067 - protein, 9 aa, Homo sapiens
  light chain complementarity determining region 3 for antibody 13534
RQGLQTPLT

SEQ ID NO: 27068 - protein, 16 aa, Homo sapiens
  heavy chain complementarity determining region 3 for antibody 13534
ARGGFGELGLHNAFDV

SEQ ID NO: 27069 - protein, 9 aa, Homo sapiens
  light chain complementarity determining region 3 for antibody 13535
RQGHSLPFT

SEQ ID NO: 27070 - protein, 19 aa, Homo sapiens
  heavy chain complementarity determining region 3 for antibody 13535
ARSDYSGDTDRYYDYGMDV

SEQ ID NO: 27071 - protein, 9 aa, Homo sapiens
  light chain complementarity determining region 3 for antibody 13536
RQAYRFPLS

SEQ ID NO: 27072 - protein, 13 aa, Homo sapiens
  heavy chain complementarity determining region 3 for antibody 13536
TRTYGSGRNWFDP

SEQ ID NO: 27073 - protein, 9 aa, Homo sapiens
  light chain complementarity determining region 3 for antibody 13537
RHNYRPSPA

SEQ ID NO: 27074 - protein, 11 aa, Homo sapiens
  heavy chain complementarity determining region 3 for antibody 13537
TRDPPGNGMDV

SEQ ID NO: 27075 - protein, 9 aa, Homo sapiens
  light chain complementarity determining region 3 for antibody 13538
RHCDHFSIT

SEQ ID NO: 27076 - protein, 15 aa, Homo sapiens
  heavy chain complementarity determining region 3 for antibody 13538
ARDPTAAGFPAHFDY

SEQ ID NO: 27077 - protein, 10 aa, Homo sapiens
  light chain complementarity determining region 3 for antibody 13539
QYLGYSPLYT

SEQ ID NO: 27078 - protein, 12 aa, Homo sapiens
  heavy chain complementarity determining region 3 for antibody 13539
AKGILGRGGMDV

SEQ ID NO: 27079 - protein, 10 aa, Homo sapiens
  light chain complementarity determining region 3 for antibody 13540
QYHGYSPLYT

SEQ ID NO: 27080 - protein, 12 aa, Homo sapiens
  heavy chain complementarity determining region 3 for antibody 13540
AKGILGSGGMDV

SEQ ID NO: 27081 - protein, 10 aa, Homo sapiens
  light chain complementarity determining region 3 for antibody 13541
QYHGYSPLYT

SEQ ID NO: 27082 - protein, 12 aa, Homo sapiens
  heavy chain complementarity determining region 3 for antibody 13541
AKGILGRVGMDV

SEQ ID NO: 27083 - protein, 10 aa, Homo sapiens
  light chain complementarity determining region 3 for antibody 13542
QYHGYSPLYT

SEQ ID NO: 27084 - protein, 12 aa, Homo sapiens
  heavy chain complementarity determining region 3 for antibody 13542
AKGILGRRGMDV

SEQ ID NO: 27085 - protein, 10 aa, Homo sapiens
  light chain complementarity determining region 3 for antibody 13543
QYHGYSPLYT

SEQ ID NO: 27086 - protein, 12 aa, Homo sapiens
  heavy chain complementarity determining region 3 for antibody 13543
AKGILGRGRMDV

SEQ ID NO: 27087 - protein, 10 aa, Homo sapiens
  light chain complementarity determining region 3 for antibody 13544
QYHGYSPLYT

SEQ ID NO: 27088 - protein, 12 aa, Homo sapiens
  heavy chain complementarity determining region 3 for antibody 13544
AKGILGRGGVDV

SEQ ID NO: 27089 - protein, 10 aa, Homo sapiens
  light chain complementarity determining region 3 for antibody 13545
QYHGYSPLYT

SEQ ID NO: 27090 - protein, 12 aa, Homo sapiens
  heavy chain complementarity determining region 3 for antibody 13545
AKGILGRGGMNV

SEQ ID NO: 27091 - protein, 10 aa, Homo sapiens
  light chain complementarity determining region 3 for antibody 13546
QYHGYSPLYT

SEQ ID NO: 27092 - protein, 12 aa, Homo sapiens
  heavy chain complementarity determining region 3 for antibody 13546
AKGILGRGGMDI

SEQ ID NO: 27093 - protein, 10 aa, Homo sapiens
  light chain complementarity determining region 3 for antibody 13547
QYHGYSPLYT

SEQ ID NO: 27094 - protein, 12 aa, Homo sapiens
  heavy chain complementarity determining region 3 for antibody 13547
AKDILGRGGMDV

SEQ ID NO: 27095 - protein, 10 aa, Homo sapiens
  light chain complementarity determining region 3 for antibody 13548
QYHGYSPLSP

SEQ ID NO: 27096 - protein, 12 aa, Homo sapiens
  heavy chain complementarity determining region 3 for antibody 13548
AKGILGRGGMDV

SEQ ID NO: 27097 - protein, 10 aa, Homo sapiens
  light chain complementarity determining region 3 for antibody 13549
QSHGYSPLYT

SEQ ID NO: 27098 - protein, 12 aa, Homo sapiens
  heavy chain complementarity determining region 3 for antibody 13549
AKGILGRGGMDV

SEQ ID NO: 27099 - protein, 9 aa, Homo sapiens
  light chain complementarity determining region 3 for antibody 13550
QRYNSYWYT

SEQ ID NO: 27100 - protein, 20 aa, Homo sapiens
  heavy chain complementarity determining region 3 for antibody 13550
AGTYGSGTYSPDYYYFGMDV

SEQ ID NO: 27101 - protein, 9 aa, Homo sapiens
  light chain complementarity determining region 3 for antibody 13551
QRYDNVPLT

SEQ ID NO: 27102 - protein, 16 aa, Homo sapiens
  heavy chain complementarity determining region 3 for antibody 13551
GRVDRLRLGELSGRSY

SEQ ID NO: 27103 - protein, 10 aa, Homo sapiens
  light chain complementarity determining region 3 for antibody 13552
QRYDNLPPFT

SEQ ID NO: 27104 - protein, 16 aa, Homo sapiens
  heavy chain complementarity determining region 3 for antibody 13552
ARELFKGEYDYYAMDV

SEQ ID NO: 27105 - protein, 9 aa, Homo sapiens
  light chain complementarity determining region 3 for antibody 13553
QRWNSYPYT

SEQ ID NO: 27106 - protein, 9 aa, Homo sapiens
  heavy chain complementarity determining region 3 for antibody 13553
VAYLAGYPR

SEQ ID NO: 27107 - protein, 9 aa, Homo sapiens
  light chain complementarity determining region 3 for antibody 13554
QRTYSAPLT

SEQ ID NO: 27108 - protein, 14 aa, Homo sapiens
  heavy chain complementarity determining region 3 for antibody 13554
RGYGDYLGPYGMDV

SEQ ID NO: 27109 - protein, 7 aa, Homo sapiens
  light chain complementarity determining region 3 for antibody 13555
QRTYIAP

SEQ ID NO: 27110 - protein, 22 aa, Homo sapiens
  heavy chain complementarity determining region 3 for antibody 13555
AKGPYCSGGSCDRDAYYYGMDV

SEQ ID NO: 27111 - protein, 9 aa, Homo sapiens
  light chain complementarity determining region 3 for antibody 13556
QRTCNAPIT

SEQ ID NO: 27112 - protein, 9 aa, Homo sapiens
  heavy chain complementarity determining region 3 for antibody 13556
VRGYDVSDY

SEQ ID NO: 27113 - protein, 9 aa, Homo sapiens
  light chain complementarity determining region 3 for antibody 13557
QRRNSYPYT

SEQ ID NO: 27114 - protein, 9 aa, Homo sapiens
  heavy chain complementarity determining region 3 for antibody 13557
VAYLSGYPR

SEQ ID NO: 27115 - protein, 7 aa, Homo sapiens
  light chain complementarity determining region 3 for antibody 13558
QRNYIAP

SEQ ID NO: 27116 - protein, 23 aa, Homo sapiens
  heavy chain complementarity determining region 3 for antibody 13558
AKGPYCSGGSCDRDAYYYYGMDV

SEQ ID NO: 27117 - protein, 9 aa, Homo sapiens
  light chain complementarity determining region 3 for antibody 13559
QRGNSYPYT

SEQ ID NO: 27118 - protein, 9 aa, Homo sapiens
  heavy chain complementarity determining region 3 for antibody 13559
VAYLSGYPR

SEQ ID NO: 27119 - protein, 9 aa, Homo sapiens
  light chain complementarity determining region 3 for antibody 13560
QRCSSYPYT

SEQ ID NO: 27120 - protein, 9 aa, Homo sapiens
  heavy chain complementarity determining region 3 for antibody 13560
VAYLAGYPR

SEQ ID NO: 27121 - protein, 9 aa, Homo sapiens
  light chain complementarity determining region 3 for antibody 13561
QRCNSYSYT

SEQ ID NO: 27122 - protein, 9 aa, Homo sapiens
  heavy chain complementarity determining region 3 for antibody 13561
VAYLAGYPR

SEQ ID NO: 27123 - protein, 9 aa, Homo sapiens
  light chain complementarity determining region 3 for antibody 13562
QRCNSYPYT

SEQ ID NO: 27124 - protein, 9 aa, Homo sapiens
  heavy chain complementarity determining region 3 for antibody 13562
VAYLAGYPQ

SEQ ID NO: 27125 - protein, 9 aa, Homo sapiens
  light chain complementarity determining region 3 for antibody 13563
QRCNSYPYT

SEQ ID NO: 27126 - protein, 9 aa, Homo sapiens
  heavy chain complementarity determining region 3 for antibody 13563
VAYLAGYPP

SEQ ID NO: 27127 - protein, 9 aa, Homo sapiens
  light chain complementarity determining region 3 for antibody 13564
QRCNSYPYT

SEQ ID NO: 27128 - protein, 9 aa, Homo sapiens
  heavy chain complementarity determining region 3 for antibody 13564
VAYLAGYPL

SEQ ID NO: 27129 - protein, 9 aa, Homo sapiens
  light chain complementarity determining region 3 for antibody 13565
QRCNSYPYT

SEQ ID NO: 27130 - protein, 9 aa, Homo sapiens
  heavy chain complementarity determining region 3 for antibody 13565
VAYLAGDPR

SEQ ID NO: 27131 - protein, 9 aa, Homo sapiens
  light chain complementarity determining region 3 for antibody 13566
QRCNSYPYT

SEQ ID NO: 27132 - protein, 9 aa, Homo sapiens
  heavy chain complementarity determining region 3 for antibody 13566
VAYFAGYPR

SEQ ID NO: 27133 - protein, 9 aa, Homo sapiens
  light chain complementarity determining region 3 for antibody 13567
QRCNSYPYT

SEQ ID NO: 27134 - protein, 9 aa, Homo sapiens
  heavy chain complementarity determining region 3 for antibody 13567
VADLAGYPR

SEQ ID NO: 27135 - protein, 9 aa, Homo sapiens
  light chain complementarity determining region 3 for antibody 13568
QRCNSYPYP

SEQ ID NO: 27136 - protein, 9 aa, Homo sapiens
  heavy chain complementarity determining region 3 for antibody 13568
VAYLAGYPR

SEQ ID NO: 27137 - protein, 9 aa, Homo sapiens
  light chain complementarity determining region 3 for antibody 13569
QRCNSYPYN

SEQ ID NO: 27138 - protein, 9 aa, Homo sapiens
  heavy chain complementarity determining region 3 for antibody 13569
VAYLAGYPR

SEQ ID NO: 27139 - protein, 9 aa, Homo sapiens
  light chain complementarity determining region 3 for antibody 13570
QRAYRFPLS

SEQ ID NO: 27140 - protein, 13 aa, Homo sapiens
  heavy chain complementarity determining region 3 for antibody 13570
TRTYGSGRNWFDP

SEQ ID NO: 27141 - protein, 9 aa, Homo sapiens
  light chain complementarity determining region 3 for antibody 13571
QRANSFPWT

SEQ ID NO: 27142 - protein, 14 aa, Homo sapiens
  heavy chain complementarity determining region 3 for antibody 13571
ARLNKMTRIRYFDS

SEQ ID NO: 27143 - protein, 6 aa, Homo sapiens
  light chain complementarity determining region 3 for antibody 13572
QRADSV

SEQ ID NO: 27144 - protein, 15 aa, Homo sapiens
  heavy chain complementarity determining region 3 for antibody 13572
ARLFYYYDGSGYLDY

SEQ ID NO: 27145 - protein, 9 aa, Homo sapiens
  light chain complementarity determining region 3 for antibody 13573
QQYYVTVWT

SEQ ID NO: 27146 - protein, 16 aa, Homo sapiens
  heavy chain complementarity determining region 3 for antibody 13573
TTQGGLWFGYWQGATS

SEQ ID NO: 27147 - protein, 9 aa, Homo sapiens
  light chain complementarity determining region 3 for antibody 13574
QQYYTYSET

SEQ ID NO: 27148 - protein, 19 aa, Homo sapiens
  heavy chain complementarity determining region 3 for antibody 13574
ATVRGDQGELDYDYHGVDV

SEQ ID NO: 27149 - protein, 9 aa, Homo sapiens
  light chain complementarity determining region 3 for antibody 13575
QQYYTYSET

SEQ ID NO: 27150 - protein, 19 aa, Homo sapiens
  heavy chain complementarity determining region 3 for antibody 13575
ATVKGDQGEPDYDYHGVDV

SEQ ID NO: 27151 - protein, 9 aa, Homo sapiens
  light chain complementarity determining region 3 for antibody 13576
QQYYTYSET

SEQ ID NO: 27152 - protein, 19 aa, Homo sapiens
  heavy chain complementarity determining region 3 for antibody 13576
ATVKGDQGELDYDYHGGDV

SEQ ID NO: 27153 - protein, 9 aa, Homo sapiens
  light chain complementarity determining region 3 for antibody 13577
QQYYTYSET

SEQ ID NO: 27154 - protein, 19 aa, Homo sapiens
  heavy chain complementarity determining region 3 for antibody 13577
ATVKGDQGELDYDCHGVDV

SEQ ID NO: 27155 - protein, 9 aa, Homo sapiens
  light chain complementarity determining region 3 for antibody 13578
QQYYTYSEP

SEQ ID NO: 27156 - protein, 19 aa, Homo sapiens
  heavy chain complementarity determining region 3 for antibody 13578
ATVKGDQGELDYDYHGVDV

SEQ ID NO: 27157 - protein, 9 aa, Homo sapiens
  light chain complementarity determining region 3 for antibody 13579
QQYYTTPFT

SEQ ID NO: 27158 - protein, 17 aa, Homo sapiens
  heavy chain complementarity determining region 3 for antibody 13579
ARGRYESGDYYNNVFDF

SEQ ID NO: 27159 - protein, 9 aa, Homo sapiens
  light chain complementarity determining region 3 for antibody 13580
QQYYTAPRT

SEQ ID NO: 27160 - protein, 18 aa, Homo sapiens
  heavy chain complementarity determining region 3 for antibody 13580
ARGRYYSESSGYSYFFDH

SEQ ID NO: 27161 - protein, 9 aa, Homo sapiens
  light chain complementarity determining region 3 for antibody 13581
QQYYSYPYT

SEQ ID NO: 27162 - protein, 20 aa, Homo sapiens
  heavy chain complementarity determining region 3 for antibody 13581
ARGYYYYDSSAMKYAYYFDY

SEQ ID NO: 27163 - protein, 9 aa, Homo sapiens
  light chain complementarity determining region 3 for antibody 13582
QQYYSTPYT

SEQ ID NO: 27164 - protein, 14 aa, Homo sapiens
  heavy chain complementarity determining region 3 for antibody 13582
ARELMDYESSSEVP

SEQ ID NO: 27165 - protein, 9 aa, Homo sapiens
  light chain complementarity determining region 3 for antibody 13583
QQYYSTPRT

SEQ ID NO: 27166 - protein, 17 aa, Homo sapiens
  heavy chain complementarity determining region 3 for antibody 13583
AHIPWDIGYASDCHFDY

SEQ ID NO: 27167 - protein, 9 aa, Homo sapiens
  light chain complementarity determining region 3 for antibody 13584
QQYYSTPPT

SEQ ID NO: 27168 - protein, 19 aa, Homo sapiens
  heavy chain complementarity determining region 3 for antibody 13584
ARAHLTTYYSGGSAYGMDV

SEQ ID NO: 27169 - protein, 9 aa, Homo sapiens
  light chain complementarity determining region 3 for antibody 13585
QQYYSTPLT

SEQ ID NO: 27170 - protein, 19 aa, Homo sapiens
  heavy chain complementarity determining region 3 for antibody 13585
AHGSYYDSNDYYYSEYFQH

SEQ ID NO: 27171 - protein, 9 aa, Homo sapiens
  light chain complementarity determining region 3 for antibody 13586
QQYYSSPYS

SEQ ID NO: 27172 - protein, 14 aa, Homo sapiens
  heavy chain complementarity determining region 3 for antibody 13586
TPDPRHDSFRGMDV

SEQ ID NO: 27173 - protein, 9 aa, Homo sapiens
  light chain complementarity determining region 3 for antibody 13587
QQYYSSPYS

SEQ ID NO: 27174 - protein, 14 aa, Homo sapiens
  heavy chain complementarity determining region 3 for antibody 13587
PTAPRHDSFRGMDV

SEQ ID NO: 27175 - protein, 10 aa, Homo sapiens
  light chain complementarity determining region 3 for antibody 13588
QQYYSPLTWT

SEQ ID NO: 27176 - protein, 16 aa, Homo sapiens
  heavy chain complementarity determining region 3 for antibody 13588
ARHLPLRFGEVRPFDP

SEQ ID NO: 27177 - protein, 9 aa, Homo sapiens
  light chain complementarity determining region 3 for antibody 13589
QQYYSNPYS

SEQ ID NO: 27178 - protein, 13 aa, Homo sapiens
  heavy chain complementarity determining region 3 for antibody 13589
AKATSDGSGALHY

SEQ ID NO: 27179 - protein, 8 aa, Homo sapiens
  light chain complementarity determining region 3 for antibody 13590
QQYYSNPT

SEQ ID NO: 27180 - protein, 14 aa, Homo sapiens
  heavy chain complementarity determining region 3 for antibody 13590
ARQGRGVGMTYFEN

SEQ ID NO: 27181 - protein, 8 aa, Homo sapiens
  light chain complementarity determining region 3 for antibody 13591
QQYYSLWT

SEQ ID NO: 27182 - protein, 17 aa, Homo sapiens
  heavy chain complementarity determining region 3 for antibody 13591
ARGRYCGSDCYPPDLDY

SEQ ID NO: 27183 - protein, 9 aa, Homo sapiens
  light chain complementarity determining region 3 for antibody 13592
QQYYSIPNT

SEQ ID NO: 27184 - protein, 7 aa, Homo sapiens
  heavy chain complementarity determining region 3 for antibody 13592
TTEDNKN

SEQ ID NO: 27185 - protein, 9 aa, Homo sapiens
  light chain complementarity determining region 3 for antibody 13593
QQYYSFLRT

SEQ ID NO: 27186 - protein, 15 aa, Homo sapiens
  heavy chain complementarity determining region 3 for antibody 13593
ARDVGSVVASGPFDS

SEQ ID NO: 27187 - protein, 9 aa, Homo sapiens
  light chain complementarity determining region 3 for antibody 13594
QQYYSAPRP

SEQ ID NO: 27188 - protein, 20 aa, Homo sapiens
  heavy chain complementarity determining region 3 for antibody 13594
VRDDILTGYYQSDYYHAMDV

SEQ ID NO: 27189 - protein, 9 aa, Homo sapiens
  light chain complementarity determining region 3 for antibody 13595
QQYYPTPYT

SEQ ID NO: 27190 - protein, 13 aa, Homo sapiens
  heavy chain complementarity determining region 3 for antibody 13595
TRLEGSGSYWFDP

SEQ ID NO: 27191 - protein, 10 aa, Homo sapiens
  light chain complementarity determining region 3 for antibody 13596
QQYYNWPPFT

SEQ ID NO: 27192 - protein, 14 aa, Homo sapiens
  heavy chain complementarity determining region 3 for antibody 13596
ARGMTRAPEFCFDL

SEQ ID NO: 27193 - protein, 9 aa, Homo sapiens
  light chain complementarity determining region 3 for antibody 13597
QQYYIFPLT

SEQ ID NO: 27194 - protein, 15 aa, Homo sapiens
  heavy chain complementarity determining region 3 for antibody 13597
ARDHPKSSSWIFFDY

SEQ ID NO: 27195 - protein, 9 aa, Homo sapiens
  light chain complementarity determining region 3 for antibody 13598
QQYYHTPNT

SEQ ID NO: 27196 - protein, 13 aa, Homo sapiens
  heavy chain complementarity determining region 3 for antibody 13598
TRLEGSGSYWFDP

SEQ ID NO: 27197 - protein, 9 aa, Homo sapiens
  light chain complementarity determining region 3 for antibody 13599
QQYYGTVWT

SEQ ID NO: 27198 - protein, 16 aa, Homo sapiens
  heavy chain complementarity determining region 3 for antibody 13599
TTQGGLWFGYWQGATS

SEQ ID NO: 27199 - protein, 9 aa, Homo sapiens
  light chain complementarity determining region 3 for antibody 13600
QQYYGNPRT

SEQ ID NO: 27200 - protein, 17 aa, Homo sapiens
  heavy chain complementarity determining region 3 for antibody 13600
ARDRDCGSTSCYNVFDY

SEQ ID NO: 27201 - protein, 9 aa, Homo sapiens
  light chain complementarity determining region 3 for antibody 13601
QQYYFTPRT

SEQ ID NO: 27202 - protein, 19 aa, Homo sapiens
  heavy chain complementarity determining region 3 for antibody 13601
ARAKREQLVDSYSFHGLDV

SEQ ID NO: 27203 - protein, 11 aa, Homo sapiens
  light chain complementarity determining region 3 for antibody 13602
QQYVTSPLMFT

SEQ ID NO: 27204 - protein, 10 aa, Homo sapiens
  heavy chain complementarity determining region 3 for antibody 13602
AKNGYYSLEE

SEQ ID NO: 27205 - protein, 10 aa, Homo sapiens
  light chain complementarity determining region 3 for antibody 13603
QQYVSSELFT

SEQ ID NO: 27206 - protein, 16 aa, Homo sapiens
  heavy chain complementarity determining region 3 for antibody 13603
AREIFNGEIDYYAMDV

SEQ ID NO: 27207 - protein, 10 aa, Homo sapiens
  light chain complementarity determining region 3 for antibody 13604
QQYVSSELFT

SEQ ID NO: 27208 - protein, 16 aa, Homo sapiens
  heavy chain complementarity determining region 3 for antibody 13604
AREIFKSEIDYYAMDV

SEQ ID NO: 27209 - protein, 10 aa, Homo sapiens
  light chain complementarity determining region 3 for antibody 13605
QQYVSSELFT

SEQ ID NO: 27210 - protein, 16 aa, Homo sapiens
  heavy chain complementarity determining region 3 for antibody 13605
AREIFKGEIGYYAMDV

SEQ ID NO: 27211 - protein, 10 aa, Homo sapiens
  light chain complementarity determining region 3 for antibody 13606
QQYVSSELFT

SEQ ID NO: 27212 - protein, 16 aa, Homo sapiens
  heavy chain complementarity determining region 3 for antibody 13606
AREIFKGEIEYYAMDV

SEQ ID NO: 27213 - protein, 10 aa, Homo sapiens
  light chain complementarity determining region 3 for antibody 13607
QQYVSSELFT

SEQ ID NO: 27214 - protein, 16 aa, Homo sapiens
  heavy chain complementarity determining region 3 for antibody 13607
AREIFKGEIDYDAMDV

SEQ ID NO: 27215 - protein, 10 aa, Homo sapiens
  light chain complementarity determining region 3 for antibody 13608
QQYVSSELFT

SEQ ID NO: 27216 - protein, 16 aa, Homo sapiens
  heavy chain complementarity determining region 3 for antibody 13608
AREIFKGEIDCYAMDV

SEQ ID NO: 27217 - protein, 10 aa, Homo sapiens
  light chain complementarity determining region 3 for antibody 13609
QQYVSSELFT

SEQ ID NO: 27218 - protein, 16 aa, Homo sapiens
  heavy chain complementarity determining region 3 for antibody 13609
AGEIFKGEIDYYAMDV

SEQ ID NO: 27219 - protein, 10 aa, Homo sapiens
  light chain complementarity determining region 3 for antibody 13610
QQYVSSELFP

SEQ ID NO: 27220 - protein, 16 aa, Homo sapiens
  heavy chain complementarity determining region 3 for antibody 13610
AREIFKGEIDYYAMDV

SEQ ID NO: 27221 - protein, 10 aa, Homo sapiens
  light chain complementarity determining region 3 for antibody 13611
QQYVSSALYT

SEQ ID NO: 27222 - protein, 16 aa, Homo sapiens
  heavy chain complementarity determining region 3 for antibody 13611
ARGLFKGEYDYYAMDV

SEQ ID NO: 27223 - protein, 10 aa, Homo sapiens
  light chain complementarity determining region 3 for antibody 13612
QQYVSSALYT

SEQ ID NO: 27224 - protein, 16 aa, Homo sapiens
  heavy chain complementarity determining region 3 for antibody 13612
ARELFKGEYDYYAVDV

SEQ ID NO: 27225 - protein, 10 aa, Homo sapiens
  light chain complementarity determining region 3 for antibody 13613
QQYVSSALYT

SEQ ID NO: 27226 - protein, 16 aa, Homo sapiens
  heavy chain complementarity determining region 3 for antibody 13613
ARELFKGEYDCYAMDV

SEQ ID NO: 27227 - protein, 10 aa, Homo sapiens
  light chain complementarity determining region 3 for antibody 13614
QQYVSSALYP

SEQ ID NO: 27228 - protein, 16 aa, Homo sapiens
  heavy chain complementarity determining region 3 for antibody 13614
ARELFKGEYDYYALDV

SEQ ID NO: 27229 - protein, 10 aa, Homo sapiens
  light chain complementarity determining region 3 for antibody 13615
QQYVSPELFT

SEQ ID NO: 27230 - protein, 16 aa, Homo sapiens
  heavy chain complementarity determining region 3 for antibody 13615
AREIFKGEIDYYAMDV

SEQ ID NO: 27231 - protein, 10 aa, Homo sapiens
  light chain complementarity determining region 3 for antibody 13616
QQYVRSDLLT

SEQ ID NO: 27232 - protein, 16 aa, Homo sapiens
  heavy chain complementarity determining region 3 for antibody 13616
ARELFKGQIDYYGIDV

SEQ ID NO: 27233 - protein, 10 aa, Homo sapiens
  light chain complementarity determining region 3 for antibody 13617
QQYVPSQKYT

SEQ ID NO: 27234 - protein, 22 aa, Homo sapiens
  heavy chain complementarity determining region 3 for antibody 13617
ARHSPFLEMLGERWLQFGAFDI

SEQ ID NO: 27235 - protein, 8 aa, Homo sapiens
  light chain complementarity determining region 3 for antibody 13618
QQYTSYSA

SEQ ID NO: 27236 - protein, 15 aa, Homo sapiens
  heavy chain complementarity determining region 3 for antibody 13618
ARAYSSGWYPESFDF

SEQ ID NO: 27237 - protein, 9 aa, Homo sapiens
  light chain complementarity determining region 3 for antibody 13619
QQYTSFPWT

SEQ ID NO: 27238 - protein, 17 aa, Homo sapiens
  heavy chain complementarity determining region 3 for antibody 13619
ARRSGLYYFDAHNYYDF

SEQ ID NO: 27239 - protein, 9 aa, Homo sapiens
  light chain complementarity determining region 3 for antibody 13620
QQYSTSPGP

SEQ ID NO: 27240 - protein, 18 aa, Homo sapiens
  heavy chain complementarity determining region 3 for antibody 13620
ARYLYHDYWGGLLQPFDN

SEQ ID NO: 27241 - protein, 9 aa, Homo sapiens
  light chain complementarity determining region 3 for antibody 13621
QQYSTLPYT

SEQ ID NO: 27242 - protein, 17 aa, Homo sapiens
  heavy chain complementarity determining region 3 for antibody 13621
AREQYNDVDLRQFFFDY

SEQ ID NO: 27243 - protein, 9 aa, Homo sapiens
  light chain complementarity determining region 3 for antibody 13622
QQYSTFPYT

SEQ ID NO: 27244 - protein, 17 aa, Homo sapiens
  heavy chain complementarity determining region 3 for antibody 13622
ARETWNDVDLRQFYFDY

SEQ ID NO: 27245 - protein, 9 aa, Homo sapiens
  light chain complementarity determining region 3 for antibody 13623
QQYSTFPYN

SEQ ID NO: 27246 - protein, 17 aa, Homo sapiens
  heavy chain complementarity determining region 3 for antibody 13623
AREDWNDVDLRQFYFDY

SEQ ID NO: 27247 - protein, 9 aa, Homo sapiens
  light chain complementarity determining region 3 for antibody 13624
QQYSSYSPT

SEQ ID NO: 27248 - protein, 16 aa, Homo sapiens
  heavy chain complementarity determining region 3 for antibody 13624
ARGNRGVINYYYVMDV

SEQ ID NO: 27249 - protein, 9 aa, Homo sapiens
  light chain complementarity determining region 3 for antibody 13625
QQYSSYPPT

SEQ ID NO: 27250 - protein, 15 aa, Homo sapiens
  heavy chain complementarity determining region 3 for antibody 13625
ARGGIYYDILVGLDS

SEQ ID NO: 27251 - protein, 10 aa, Homo sapiens
  light chain complementarity determining region 3 for antibody 13626
QQYSSSPQLT

SEQ ID NO: 27252 - protein, 13 aa, Homo sapiens
  heavy chain complementarity determining region 3 for antibody 13626
ARSAGYYPNWLDS

SEQ ID NO: 27253 - protein, 10 aa, Homo sapiens
  light chain complementarity determining region 3 for antibody 13627
QQYSSSPQLT

SEQ ID NO: 27254 - protein, 13 aa, Homo sapiens
  heavy chain complementarity determining region 3 for antibody 13627
ARSAGYYPNGLES

SEQ ID NO: 27255 - protein, 10 aa, Homo sapiens
  light chain complementarity determining region 3 for antibody 13628
QQYSSSPQLT

SEQ ID NO: 27256 - protein, 13 aa, Homo sapiens
  heavy chain complementarity determining region 3 for antibody 13628
ARSAGYFPNWLES

SEQ ID NO: 27257 - protein, 10 aa, Homo sapiens
  light chain complementarity determining region 3 for antibody 13629
QQYSSSPQLP

SEQ ID NO: 27258 - protein, 13 aa, Homo sapiens
  heavy chain complementarity determining region 3 for antibody 13629
ARSAGYYPNWLES

SEQ ID NO: 27259 - protein, 10 aa, Homo sapiens
  light chain complementarity determining region 3 for antibody 13630
QQYSSSLQLT

SEQ ID NO: 27260 - protein, 13 aa, Homo sapiens
  heavy chain complementarity determining region 3 for antibody 13630
ARSAGYYPNWLES

SEQ ID NO: 27261 - protein, 10 aa, Homo sapiens
  light chain complementarity determining region 3 for antibody 13631
QQYSSPPQLT

SEQ ID NO: 27262 - protein, 13 aa, Homo sapiens
  heavy chain complementarity determining region 3 for antibody 13631
ARSAGYYPNWLES

SEQ ID NO: 27263 - protein, 9 aa, Homo sapiens
  light chain complementarity determining region 3 for antibody 13632
QQYSSFPYT

SEQ ID NO: 27264 - protein, 17 aa, Homo sapiens
  heavy chain complementarity determining region 3 for antibody 13632
AREQWNDVDLRQFYFDY

SEQ ID NO: 27265 - protein, 9 aa, Homo sapiens
  light chain complementarity determining region 3 for antibody 13633
QQYSSFPYP

SEQ ID NO: 27266 - protein, 17 aa, Homo sapiens
  heavy chain complementarity determining region 3 for antibody 13633
AREDYSDVDLRQFYFDY

SEQ ID NO: 27267 - protein, 9 aa, Homo sapiens
  light chain complementarity determining region 3 for antibody 13634
QQYSSFPDT

SEQ ID NO: 27268 - protein, 17 aa, Homo sapiens
  heavy chain complementarity determining region 3 for antibody 13634
AREDYSDVDLRQFYFDY

SEQ ID NO: 27269 - protein, 9 aa, Homo sapiens
  light chain complementarity determining region 3 for antibody 13635
QQYSRYPVN

SEQ ID NO: 27270 - protein, 11 aa, Homo sapiens
  heavy chain complementarity determining region 3 for antibody 13635
AREQTGYYPLY

SEQ ID NO: 27271 - protein, 9 aa, Homo sapiens
  light chain complementarity determining region 3 for antibody 13636
QQYSRYPAT

SEQ ID NO: 27272 - protein, 11 aa, Homo sapiens
  heavy chain complementarity determining region 3 for antibody 13636
AREQTGYYPLY

SEQ ID NO: 27273 - protein, 11 aa, Homo sapiens
  light chain complementarity determining region 3 for antibody 13637
QQYSGSPGGGT

SEQ ID NO: 27274 - protein, 16 aa, Homo sapiens
  heavy chain complementarity determining region 3 for antibody 13637
AHLDWLQFRGSVFFDY

SEQ ID NO: 27275 - protein, 9 aa, Homo sapiens
  light chain complementarity determining region 3 for antibody 13638
QQYNTYPYT

SEQ ID NO: 27276 - protein, 17 aa, Homo sapiens
  heavy chain complementarity determining region 3 for antibody 13638
AREDWNDVDLREYYFDY

SEQ ID NO: 27277 - protein, 9 aa, Homo sapiens
  light chain complementarity determining region 3 for antibody 13639
QQYNTYPYT

SEQ ID NO: 27278 - protein, 19 aa, Homo sapiens
  heavy chain complementarity determining region 3 for antibody 13639
ARDQSSSYGDYYYYDGMDV

SEQ ID NO: 27279 - protein, 9 aa, Homo sapiens
  light chain complementarity determining region 3 for antibody 13640
QQYNTYPYT

SEQ ID NO: 27280 - protein, 19 aa, Homo sapiens
  heavy chain complementarity determining region 3 for antibody 13640
ARDQGSSYGDYYYYYGMDV

SEQ ID NO: 27281 - protein, 9 aa, Homo sapiens
  light chain complementarity determining region 3 for antibody 13641
QQYNTYPYT

SEQ ID NO: 27282 - protein, 19 aa, Homo sapiens
  heavy chain complementarity determining region 3 for antibody 13641
AKVFPGLAAGYNSSVGNDY

SEQ ID NO: 27283 - protein, 9 aa, Homo sapiens
  light chain complementarity determining region 3 for antibody 13642
QQYNTYPST

SEQ ID NO: 27284 - protein, 19 aa, Homo sapiens
  heavy chain complementarity determining region 3 for antibody 13642
ARDQSSSYGDYYYYYGMDV

SEQ ID NO: 27285 - protein, 9 aa, Homo sapiens
  light chain complementarity determining region 3 for antibody 13643
QQYNSYWYT

SEQ ID NO: 27286 - protein, 20 aa, Homo sapiens
  heavy chain complementarity determining region 3 for antibody 13643
SGTYGSGTYSPDYYYFGMDV

SEQ ID NO: 27287 - protein, 9 aa, Homo sapiens
  light chain complementarity determining region 3 for antibody 13644
QQYNSYWYT

SEQ ID NO: 27288 - protein, 20 aa, Homo sapiens
  heavy chain complementarity determining region 3 for antibody 13644
AGTYGSGTYYPDYYYFGMDV

SEQ ID NO: 27289 - protein, 9 aa, Homo sapiens
  light chain complementarity determining region 3 for antibody 13645
QQYNSYWYT

SEQ ID NO: 27290 - protein, 20 aa, Homo sapiens
  heavy chain complementarity determining region 3 for antibody 13645
AGTYGSGTYSPDYYYLGMDV

SEQ ID NO: 27291 - protein, 9 aa, Homo sapiens
  light chain complementarity determining region 3 for antibody 13646
QQYNSYWYT

SEQ ID NO: 27292 - protein, 20 aa, Homo sapiens
  heavy chain complementarity determining region 3 for antibody 13646
AGTYGSGTYSPDYYYFGMGV

SEQ ID NO: 27293 - protein, 9 aa, Homo sapiens
  light chain complementarity determining region 3 for antibody 13647
QQYNSYWYT

SEQ ID NO: 27294 - protein, 20 aa, Homo sapiens
  heavy chain complementarity determining region 3 for antibody 13647
AGTYGSGTYSPDYYYFGMDD

SEQ ID NO: 27295 - protein, 9 aa, Homo sapiens
  light chain complementarity determining region 3 for antibody 13648
QQYNSYWYT

SEQ ID NO: 27296 - protein, 20 aa, Homo sapiens
  heavy chain complementarity determining region 3 for antibody 13648
AGTYGSGTYSPDYYYFGMDA

SEQ ID NO: 27297 - protein, 9 aa, Homo sapiens
  light chain complementarity determining region 3 for antibody 13649
QQYNSYWYT

SEQ ID NO: 27298 - protein, 20 aa, Homo sapiens
  heavy chain complementarity determining region 3 for antibody 13649
AGTYGSGTYSPDYYYFGIDV

SEQ ID NO: 27299 - protein, 9 aa, Homo sapiens
  light chain complementarity determining region 3 for antibody 13650
QQYNSYWYT

SEQ ID NO: 27300 - protein, 20 aa, Homo sapiens
  heavy chain complementarity determining region 3 for antibody 13650
AGTYGSGTYSPDYYYFCMDV

SEQ ID NO: 27301 - protein, 9 aa, Homo sapiens
  light chain complementarity determining region 3 for antibody 13651
QQYNSYWYT

SEQ ID NO: 27302 - protein, 20 aa, Homo sapiens
  heavy chain complementarity determining region 3 for antibody 13651
ACTYGSGTYSPDYYYFGMDV

SEQ ID NO: 27303 - protein, 9 aa, Homo sapiens
  light chain complementarity determining region 3 for antibody 13652
QQYNSYWRT

SEQ ID NO: 27304 - protein, 15 aa, Homo sapiens
  heavy chain complementarity determining region 3 for antibody 13652
TRDLAVYGDYGIGGY

SEQ ID NO: 27305 - protein, 9 aa, Homo sapiens
  light chain complementarity determining region 3 for antibody 13653
QQYNSYWNT

SEQ ID NO: 27306 - protein, 20 aa, Homo sapiens
  heavy chain complementarity determining region 3 for antibody 13653
AGTYGSGTYSPDYYYFGMDV

SEQ ID NO: 27307 - protein, 10 aa, Homo sapiens
  light chain complementarity determining region 3 for antibody 13654
QQYNSYSQGP

SEQ ID NO: 27308 - protein, 14 aa, Homo sapiens
  heavy chain complementarity determining region 3 for antibody 13654
AKDDTGDYPSYFDH

SEQ ID NO: 27309 - protein, 9 aa, Homo sapiens
  light chain complementarity determining region 3 for antibody 13655
QQYNSYSHT

SEQ ID NO: 27310 - protein, 20 aa, Homo sapiens
  heavy chain complementarity determining region 3 for antibody 13655
AREQSYTVAGINYYYYAMDV

SEQ ID NO: 27311 - protein, 8 aa, Homo sapiens
  light chain complementarity determining region 3 for antibody 13656
QQYNSYSA

SEQ ID NO: 27312 - protein, 13 aa, Homo sapiens
  heavy chain complementarity determining region 3 for antibody 13656
ASGLHSGYDYFDY

SEQ ID NO: 27313 - protein, 8 aa, Homo sapiens
  light chain complementarity determining region 3 for antibody 13657
QQYNSYSA

SEQ ID NO: 27314 - protein, 15 aa, Homo sapiens
  heavy chain complementarity determining region 3 for antibody 13657
ARSYSSGWYPESFDF

SEQ ID NO: 27315 - protein, 8 aa, Homo sapiens
  light chain complementarity determining region 3 for antibody 13658
QQYNSYSA

SEQ ID NO: 27316 - protein, 15 aa, Homo sapiens
  heavy chain complementarity determining region 3 for antibody 13658
ARAYSSGWYPESLDF

SEQ ID NO: 27317 - protein, 9 aa, Homo sapiens
  light chain complementarity determining region 3 for antibody 13659
QQYNSYPST

SEQ ID NO: 27318 - protein, 19 aa, Homo sapiens
  heavy chain complementarity determining region 3 for antibody 13659
ARDQSSSYGDYYYYYGMDV

SEQ ID NO: 27319 - protein, 9 aa, Homo sapiens
  light chain complementarity determining region 3 for antibody 13660
QQYNSYPRT

SEQ ID NO: 27320 - protein, 19 aa, Homo sapiens
  heavy chain complementarity determining region 3 for antibody 13660
ARDSRSVRKRPTEYYGMDV

SEQ ID NO: 27321 - protein, 9 aa, Homo sapiens
  light chain complementarity determining region 3 for antibody 13661
QQYNSYPRT

SEQ ID NO: 27322 - protein, 19 aa, Homo sapiens
  heavy chain complementarity determining region 3 for antibody 13661
ARDSQSVRKRPTEYYGMDV

SEQ ID NO: 27323 - protein, 9 aa, Homo sapiens
  light chain complementarity determining region 3 for antibody 13662
QQYNSYPRT

SEQ ID NO: 27324 - protein, 19 aa, Homo sapiens
  heavy chain complementarity determining region 3 for antibody 13662
AGDSPSVRKRPTEYYGMDV

SEQ ID NO: 27325 - protein, 9 aa, Homo sapiens
  light chain complementarity determining region 3 for antibody 13663
QQYNSYPRP

SEQ ID NO: 27326 - protein, 19 aa, Homo sapiens
  heavy chain complementarity determining region 3 for antibody 13663
ARDSPSVRKRPTEYYGMDV

SEQ ID NO: 27327 - protein, 9 aa, Homo sapiens
  light chain complementarity determining region 3 for antibody 13664
QQYNSYPIT

SEQ ID NO: 27328 - protein, 13 aa, Homo sapiens
  heavy chain complementarity determining region 3 for antibody 13664
ASGLHSGYGYFDY

SEQ ID NO: 27329 - protein, 9 aa, Homo sapiens
  light chain complementarity determining region 3 for antibody 13665
QQYNSYPIT

SEQ ID NO: 27330 - protein, 13 aa, Homo sapiens
  heavy chain complementarity determining region 3 for antibody 13665
ASGLHSGYDCFDY

SEQ ID NO: 27331 - protein, 9 aa, Homo sapiens
  light chain complementarity determining region 3 for antibody 13666
QQYNSYPIT

SEQ ID NO: 27332 - protein, 16 aa, Homo sapiens
  heavy chain complementarity determining region 3 for antibody 13666
ARPYSSSWYRTEYFQY

SEQ ID NO: 27333 - protein, 8 aa, Homo sapiens
  light chain complementarity determining region 3 for antibody 13667
QQYNSYPA

SEQ ID NO: 27334 - protein, 15 aa, Homo sapiens
  heavy chain complementarity determining region 3 for antibody 13667
ARAYSSGWYPESFDF

SEQ ID NO: 27335 - protein, 9 aa, Homo sapiens
  light chain complementarity determining region 3 for antibody 13668
QQYNSYHLT

SEQ ID NO: 27336 - protein, 15 aa, Homo sapiens
  heavy chain complementarity determining region 3 for antibody 13668
ARGGIYYDILTGLDS

SEQ ID NO: 27337 - protein, 10 aa, Homo sapiens
  light chain complementarity determining region 3 for antibody 13669
QQYNSWPTYA

SEQ ID NO: 27338 - protein, 12 aa, Homo sapiens
  heavy chain complementarity determining region 3 for antibody 13669
ARRYWDLEFFDD

SEQ ID NO: 27339 - protein, 8 aa, Homo sapiens
  light chain complementarity determining region 3 for antibody 13670
QQYNSVWT

SEQ ID NO: 27340 - protein, 17 aa, Homo sapiens
  heavy chain complementarity determining region 3 for antibody 13670
ARGSIVDFWSGYSPFDH

SEQ ID NO: 27341 - protein, 9 aa, Homo sapiens
  light chain complementarity determining region 3 for antibody 13671
QQYNSTPYT

SEQ ID NO: 27342 - protein, 21 aa, Homo sapiens
  heavy chain complementarity determining region 3 for antibody 13671
ARPGGQYCSGSNCYYDNWFGS

SEQ ID NO: 27343 - protein, 9 aa, Homo sapiens
  light chain complementarity determining region 3 for antibody 13672
QQYNSLPIT

SEQ ID NO: 27344 - protein, 19 aa, Homo sapiens
  heavy chain complementarity determining region 3 for antibody 13672
ARDRYYTIVDDYGSGVFDY

SEQ ID NO: 27345 - protein, 9 aa, Homo sapiens
  light chain complementarity determining region 3 for antibody 13673
QQYNSLPIT

SEQ ID NO: 27346 - protein, 19 aa, Homo sapiens
  heavy chain complementarity determining region 3 for antibody 13673
ARDRDYTIVDNYGSGVFDY

SEQ ID NO: 27347 - protein, 9 aa, Homo sapiens
  light chain complementarity determining region 3 for antibody 13674
QQYNSLPIT

SEQ ID NO: 27348 - protein, 19 aa, Homo sapiens
  heavy chain complementarity determining region 3 for antibody 13674
ARDRDYTIVDDYGSGVLDY

SEQ ID NO: 27349 - protein, 9 aa, Homo sapiens
  light chain complementarity determining region 3 for antibody 13675
QQYNSLPIT

SEQ ID NO: 27350 - protein, 19 aa, Homo sapiens
  heavy chain complementarity determining region 3 for antibody 13675
ARDRDYTIVDDYGSGVFDS

SEQ ID NO: 27351 - protein, 9 aa, Homo sapiens
  light chain complementarity determining region 3 for antibody 13676
QQYNSLPIT

SEQ ID NO: 27352 - protein, 19 aa, Homo sapiens
  heavy chain complementarity determining region 3 for antibody 13676
ARDRDYTIVDDYGSCVFDY

SEQ ID NO: 27353 - protein, 9 aa, Homo sapiens
  light chain complementarity determining region 3 for antibody 13677
QQYNSLPIT

SEQ ID NO: 27354 - protein, 19 aa, Homo sapiens
  heavy chain complementarity determining region 3 for antibody 13677
ARDRDYTIVDDYGPGVFDY

SEQ ID NO: 27355 - protein, 9 aa, Homo sapiens
  light chain complementarity determining region 3 for antibody 13678
QQYNSLPIT

SEQ ID NO: 27356 - protein, 19 aa, Homo sapiens
  heavy chain complementarity determining region 3 for antibody 13678
ARDRDYTIVDDYGAGVFDY

SEQ ID NO: 27357 - protein, 9 aa, Homo sapiens
  light chain complementarity determining region 3 for antibody 13679
QQYNSLPIT

SEQ ID NO: 27358 - protein, 19 aa, Homo sapiens
  heavy chain complementarity determining region 3 for antibody 13679
ARDRDCTIVDDYGSGVFDY

SEQ ID NO: 27359 - protein, 9 aa, Homo sapiens
  light chain complementarity determining region 3 for antibody 13680
QQYNSLPIT

SEQ ID NO: 27360 - protein, 19 aa, Homo sapiens
  heavy chain complementarity determining region 3 for antibody 13680
AGDRDYTIVDDYGSGVFDY

SEQ ID NO: 27361 - protein, 9 aa, Homo sapiens
  light chain complementarity determining region 3 for antibody 13681
QQYNSHPRT

SEQ ID NO: 27362 - protein, 19 aa, Homo sapiens
  heavy chain complementarity determining region 3 for antibody 13681
ARDSPSVRKRPTEYYGMDV

SEQ ID NO: 27363 - protein, 9 aa, Homo sapiens
  light chain complementarity determining region 3 for antibody 13682
QQYNSFSWT

SEQ ID NO: 27364 - protein, 20 aa, Homo sapiens
  heavy chain complementarity determining region 3 for antibody 13682
ARDLSTHYHDASGGGNWFDP

SEQ ID NO: 27365 - protein, 9 aa, Homo sapiens
  light chain complementarity determining region 3 for antibody 13683
QQYNSFPYT

SEQ ID NO: 27366 - protein, 17 aa, Homo sapiens
  heavy chain complementarity determining region 3 for antibody 13683
VREDWSDVDLRLFYLDY

SEQ ID NO: 27367 - protein, 9 aa, Homo sapiens
  light chain complementarity determining region 3 for antibody 13684
QQYNSFPYT

SEQ ID NO: 27368 - protein, 17 aa, Homo sapiens
  heavy chain complementarity determining region 3 for antibody 13684
AREDCSDVDLRLFYLDY

SEQ ID NO: 27369 - protein, 9 aa, Homo sapiens
  light chain complementarity determining region 3 for antibody 13685
QQYNSFPWT

SEQ ID NO: 27370 - protein, 17 aa, Homo sapiens
  heavy chain complementarity determining region 3 for antibody 13685
ARRSGLYYCDAHNYYDF

SEQ ID NO: 27371 - protein, 9 aa, Homo sapiens
  light chain complementarity determining region 3 for antibody 13686
QQYNSFPPT

SEQ ID NO: 27372 - protein, 19 aa, Homo sapiens
  heavy chain complementarity determining region 3 for antibody 13686
AKDPQPVVVGELLEPVFDH

SEQ ID NO: 27373 - protein, 9 aa, Homo sapiens
  light chain complementarity determining region 3 for antibody 13687
QQYNSFPPP

SEQ ID NO: 27374 - protein, 19 aa, Homo sapiens
  heavy chain complementarity determining region 3 for antibody 13687
AKDPHPVVVGELLEPVFDH

SEQ ID NO: 27375 - protein, 9 aa, Homo sapiens
  light chain complementarity determining region 3 for antibody 13688
QQYNSFPCT

SEQ ID NO: 27376 - protein, 17 aa, Homo sapiens
  heavy chain complementarity determining region 3 for antibody 13688
ARRSGLYYFDAHNYYDF

SEQ ID NO: 27377 - protein, 8 aa, Homo sapiens
  light chain complementarity determining region 3 for antibody 13689
QQYNSDPT

SEQ ID NO: 27378 - protein, 19 aa, Homo sapiens
  heavy chain complementarity determining region 3 for antibody 13689
ARDTWSSGRPNRGYFYFDL

SEQ ID NO: 27379 - protein, 9 aa, Homo sapiens
  light chain complementarity determining region 3 for antibody 13690
QQYNNWPRT

SEQ ID NO: 27380 - protein, 17 aa, Homo sapiens
  heavy chain complementarity determining region 3 for antibody 13690
AKEAVVVVHANSRYFHH

SEQ ID NO: 27381 - protein, 9 aa, Homo sapiens
  light chain complementarity determining region 3 for antibody 13691
QQYNNWPRS

SEQ ID NO: 27382 - protein, 15 aa, Homo sapiens
  heavy chain complementarity determining region 3 for antibody 13691
VKSGTYSSSSGWFDS

SEQ ID NO: 27383 - protein, 9 aa, Homo sapiens
  light chain complementarity determining region 3 for antibody 13692
QQYNNWPRS

SEQ ID NO: 27384 - protein, 15 aa, Homo sapiens
  heavy chain complementarity determining region 3 for antibody 13692
VKSGTYSSSSGWFDA

SEQ ID NO: 27385 - protein, 9 aa, Homo sapiens
  light chain complementarity determining region 3 for antibody 13693
QQYNNWPRS

SEQ ID NO: 27386 - protein, 15 aa, Homo sapiens
  heavy chain complementarity determining region 3 for antibody 13693
VKSGTYNSSSGWFDT

SEQ ID NO: 27387 - protein, 9 aa, Homo sapiens
  light chain complementarity determining region 3 for antibody 13694
QQYNNWPRS

SEQ ID NO: 27388 - protein, 15 aa, Homo sapiens
  heavy chain complementarity determining region 3 for antibody 13694
VKSGSYSSSSGWFDT

SEQ ID NO: 27389 - protein, 10 aa, Homo sapiens
  light chain complementarity determining region 3 for antibody 13695
QQYNNWPPYT

SEQ ID NO: 27390 - protein, 11 aa, Homo sapiens
  heavy chain complementarity determining region 3 for antibody 13695
ARGGVVIGFDI

SEQ ID NO: 27391 - protein, 10 aa, Homo sapiens
  light chain complementarity determining region 3 for antibody 13696
QQYNNWPPLP

SEQ ID NO: 27392 - protein, 15 aa, Homo sapiens
  heavy chain complementarity determining region 3 for antibody 13696
AKFYKFPAVGNWLDY

SEQ ID NO: 27393 - protein, 11 aa, Homo sapiens
  light chain complementarity determining region 3 for antibody 13697
QQYNNWPPADT

SEQ ID NO: 27394 - protein, 22 aa, Homo sapiens
  heavy chain complementarity determining region 3 for antibody 13697
ARGRPFPDTHINRNYYYYGMDV

SEQ ID NO: 27395 - protein, 9 aa, Homo sapiens
  light chain complementarity determining region 3 for antibody 13698
QQYNNLPYT

SEQ ID NO: 27396 - protein, 13 aa, Homo sapiens
  heavy chain complementarity determining region 3 for antibody 13698
ARAKWELFGYFDF

SEQ ID NO: 27397 - protein, 9 aa, Homo sapiens
  light chain complementarity determining region 3 for antibody 13699
QQYNNLPYT

SEQ ID NO: 27398 - protein, 13 aa, Homo sapiens
  heavy chain complementarity determining region 3 for antibody 13699
ARAKWDLFGYLDF

SEQ ID NO: 27399 - protein, 9 aa, Homo sapiens
  light chain complementarity determining region 3 for antibody 13700
QQYNNLPYT

SEQ ID NO: 27400 - protein, 13 aa, Homo sapiens
  heavy chain complementarity determining region 3 for antibody 13700
ARAKWDHFGYFDF

SEQ ID NO: 27401 - protein, 9 aa, Homo sapiens
  light chain complementarity determining region 3 for antibody 13701
QQYNNLPYT

SEQ ID NO: 27402 - protein, 13 aa, Homo sapiens
  heavy chain complementarity determining region 3 for antibody 13701
ARAEWDLFGYFDF

SEQ ID NO: 27403 - protein, 9 aa, Homo sapiens
  light chain complementarity determining region 3 for antibody 13702
QQYNNLPYT

SEQ ID NO: 27404 - protein, 20 aa, Homo sapiens
  heavy chain complementarity determining region 3 for antibody 13702
AGTYGSGTYSPDYYYFGMDV

SEQ ID NO: 27405 - protein, 9 aa, Homo sapiens
  light chain complementarity determining region 3 for antibody 13703
QQYNNLPCT

SEQ ID NO: 27406 - protein, 13 aa, Homo sapiens
  heavy chain complementarity determining region 3 for antibody 13703
ARAKWDLFGYFDF

SEQ ID NO: 27407 - protein, 9 aa, Homo sapiens
  light chain complementarity determining region 3 for antibody 13704
QQYNNFPYT

SEQ ID NO: 27408 - protein, 13 aa, Homo sapiens
  heavy chain complementarity determining region 3 for antibody 13704
ARAKWDLFGYFDF

SEQ ID NO: 27409 - protein, 8 aa, Homo sapiens
  light chain complementarity determining region 3 for antibody 13705
QQYNNCPS

SEQ ID NO: 27410 - protein, 12 aa, Homo sapiens
  heavy chain complementarity determining region 3 for antibody 13705
VQGNGAGSYSRH

SEQ ID NO: 27411 - protein, 10 aa, Homo sapiens
  light chain complementarity determining region 3 for antibody 13706
QQYNNAPPFT

SEQ ID NO: 27412 - protein, 17 aa, Homo sapiens
  heavy chain complementarity determining region 3 for antibody 13706
ASDPTYGDSYYYSGMDL

SEQ ID NO: 27413 - protein, 8 aa, Homo sapiens
  light chain complementarity determining region 3 for antibody 13707
QQYNHWPL

SEQ ID NO: 27414 - protein, 14 aa, Homo sapiens
  heavy chain complementarity determining region 3 for antibody 13707
ARSLKGWEFLYFDL

SEQ ID NO: 27415 - protein, 9 aa, Homo sapiens
  light chain complementarity determining region 3 for antibody 13708
QQYNGRSLT

SEQ ID NO: 27416 - protein, 11 aa, Homo sapiens
  heavy chain complementarity determining region 3 for antibody 13708
ARIQQVGALAH

SEQ ID NO: 27417 - protein, 9 aa, Homo sapiens
  light chain complementarity determining region 3 for antibody 13709
QQYNGFPWT

SEQ ID NO: 27418 - protein, 17 aa, Homo sapiens
  heavy chain complementarity determining region 3 for antibody 13709
ARRSGLYYFDAHNYYDF

SEQ ID NO: 27419 - protein, 9 aa, Homo sapiens
  light chain complementarity determining region 3 for antibody 13710
QQYNDYPWA

SEQ ID NO: 27420 - protein, 13 aa, Homo sapiens
  heavy chain complementarity determining region 3 for antibody 13710
ATGGYDGTIARVD

SEQ ID NO: 27421 - protein, 9 aa, Homo sapiens
  light chain complementarity determining region 3 for antibody 13711
QQYNDWPYT

SEQ ID NO: 27422 - protein, 17 aa, Homo sapiens
  heavy chain complementarity determining region 3 for antibody 13711
VRFFTDVDGWYPGDTDY

SEQ ID NO: 27423 - protein, 12 aa, Homo sapiens
  light chain complementarity determining region 3 for antibody 13712
QQYNDWPPVRFP

SEQ ID NO: 27424 - protein, 15 aa, Homo sapiens
  heavy chain complementarity determining region 3 for antibody 13712
ARCGSGWQLPDYFDY

SEQ ID NO: 27425 - protein, 9 aa, Homo sapiens
  light chain complementarity determining region 3 for antibody 13713
QQYNAYPRT

SEQ ID NO: 27426 - protein, 11 aa, Homo sapiens
  heavy chain complementarity determining region 3 for antibody 13713
ARDPRVRGNDY

SEQ ID NO: 27427 - protein, 9 aa, Homo sapiens
  light chain complementarity determining region 3 for antibody 13714
QQYKTYPYT

SEQ ID NO: 27428 - protein, 17 aa, Homo sapiens
  heavy chain complementarity determining region 3 for antibody 13714
AREDWNDVDLREYCFDY

SEQ ID NO: 27429 - protein, 9 aa, Homo sapiens
  light chain complementarity determining region 3 for antibody 13715
QQYKTYPYT

SEQ ID NO: 27430 - protein, 17 aa, Homo sapiens
  heavy chain complementarity determining region 3 for antibody 13715
ARDDWNDVDLREYYFDY

SEQ ID NO: 27431 - protein, 9 aa, Homo sapiens
  light chain complementarity determining region 3 for antibody 13716
QQYKTDPWT

SEQ ID NO: 27432 - protein, 10 aa, Homo sapiens
  heavy chain complementarity determining region 3 for antibody 13716
SRHEEYVRPY

SEQ ID NO: 27433 - protein, 9 aa, Homo sapiens
  light chain complementarity determining region 3 for antibody 13717
QQYKTDPWT

SEQ ID NO: 27434 - protein, 10 aa, Homo sapiens
  heavy chain complementarity determining region 3 for antibody 13717
IRHEGYVRPY

SEQ ID NO: 27435 - protein, 9 aa, Homo sapiens
  light chain complementarity determining region 3 for antibody 13718
QQYKTDPWT

SEQ ID NO: 27436 - protein, 10 aa, Homo sapiens
  heavy chain complementarity determining region 3 for antibody 13718
IRHEEYVRAY

SEQ ID NO: 27437 - protein, 9 aa, Homo sapiens
  light chain complementarity determining region 3 for antibody 13719
QQYKTDPWN

SEQ ID NO: 27438 - protein, 10 aa, Homo sapiens
  heavy chain complementarity determining region 3 for antibody 13719
IRHEEYVRPY

SEQ ID NO: 27439 - protein, 9 aa, Homo sapiens
  light chain complementarity determining region 3 for antibody 13720
QQYKSYWYT

SEQ ID NO: 27440 - protein, 20 aa, Homo sapiens
  heavy chain complementarity determining region 3 for antibody 13720
AGTYGSGTYSPDYYYFGMDV

SEQ ID NO: 27441 - protein, 9 aa, Homo sapiens
  light chain complementarity determining region 3 for antibody 13721
QQYKSYPRT

SEQ ID NO: 27442 - protein, 24 aa, Homo sapiens
  heavy chain complementarity determining region 3 for antibody 13721
ARGSTDGTVATFGVPVLEYYYFDN

SEQ ID NO: 27443 - protein, 10 aa, Homo sapiens
  light chain complementarity determining region 3 for antibody 13722
QQYKNWPPLT

SEQ ID NO: 27444 - protein, 15 aa, Homo sapiens
  heavy chain complementarity determining region 3 for antibody 13722
AGVVSGWYAPRWFDT

SEQ ID NO: 27445 - protein, 9 aa, Homo sapiens
  light chain complementarity determining region 3 for antibody 13723
QQYKNWPLT

SEQ ID NO: 27446 - protein, 20 aa, Homo sapiens
  heavy chain complementarity determining region 3 for antibody 13723
VRGLGACSSTSCWGLDWFDP

SEQ ID NO: 27447 - protein, 9 aa, Homo sapiens
  light chain complementarity determining region 3 for antibody 13724
QQYKDYPIT

SEQ ID NO: 27448 - protein, 22 aa, Homo sapiens
  heavy chain complementarity determining region 3 for antibody 13724
ARENAHSDYDLGDFSPYDVFDI

SEQ ID NO: 27449 - protein, 9 aa, Homo sapiens
  light chain complementarity determining region 3 for antibody 13725
QQYHSYSPT

SEQ ID NO: 27450 - protein, 21 aa, Homo sapiens
  heavy chain complementarity determining region 3 for antibody 13725
AREQSYTVAGINYYYYYAMDV

SEQ ID NO: 27451 - protein, 10 aa, Homo sapiens
  light chain complementarity determining region 3 for antibody 13726
QQYHSYSPAA

SEQ ID NO: 27452 - protein, 14 aa, Homo sapiens
  heavy chain complementarity determining region 3 for antibody 13726
AKDRGLLWFGELSH

SEQ ID NO: 27453 - protein, 9 aa, Homo sapiens
  light chain complementarity determining region 3 for antibody 13727
QQYHSYSHT

SEQ ID NO: 27454 - protein, 21 aa, Homo sapiens
  heavy chain complementarity determining region 3 for antibody 13727
AREQSYTVAGISYYYYYAMDV

SEQ ID NO: 27455 - protein, 9 aa, Homo sapiens
  light chain complementarity determining region 3 for antibody 13728
QQYHSYPLT

SEQ ID NO: 27456 - protein, 10 aa, Homo sapiens
  heavy chain complementarity determining region 3 for antibody 13728
ATDLEQAGDN

SEQ ID NO: 27457 - protein, 8 aa, Homo sapiens
  light chain complementarity determining region 3 for antibody 13729
QQYHSVWT

SEQ ID NO: 27458 - protein, 15 aa, Homo sapiens
  heavy chain complementarity determining region 3 for antibody 13729
ARCARGGDTYDAFDM

SEQ ID NO: 27459 - protein, 8 aa, Homo sapiens
  light chain complementarity determining region 3 for antibody 13730
QQYHSVWT

SEQ ID NO: 27460 - protein, 13 aa, Homo sapiens
  heavy chain complementarity determining region 3 for antibody 13730
AKARAGDYDSLDY

SEQ ID NO: 27461 - protein, 8 aa, Homo sapiens
  light chain complementarity determining region 3 for antibody 13731
QQYHSVWT

SEQ ID NO: 27462 - protein, 13 aa, Homo sapiens
  heavy chain complementarity determining region 3 for antibody 13731
AEVRAGDYDSLDY

SEQ ID NO: 27463 - protein, 8 aa, Homo sapiens
  light chain complementarity determining region 3 for antibody 13732
QQYHSVWS

SEQ ID NO: 27464 - protein, 13 aa, Homo sapiens
  heavy chain complementarity determining region 3 for antibody 13732
AKVRAGDYDSLDY

SEQ ID NO: 27465 - protein, 8 aa, Homo sapiens
  light chain complementarity determining region 3 for antibody 13733
QQYHSVWP

SEQ ID NO: 27466 - protein, 13 aa, Homo sapiens
  heavy chain complementarity determining region 3 for antibody 13733
AKVRAGDYDSLDY

SEQ ID NO: 27467 - protein, 9 aa, Homo sapiens
  light chain complementarity determining region 3 for antibody 13734
QQYHSPMYT

SEQ ID NO: 27468 - protein, 13 aa, Homo sapiens
  heavy chain complementarity determining region 3 for antibody 13734
AHIGCRGASCYPA

SEQ ID NO: 27469 - protein, 9 aa, Homo sapiens
  light chain complementarity determining region 3 for antibody 13735
QQYHSPMYT

SEQ ID NO: 27470 - protein, 13 aa, Homo sapiens
  heavy chain complementarity determining region 3 for antibody 13735
AHIGCRGASCFPV

SEQ ID NO: 27471 - protein, 9 aa, Homo sapiens
  light chain complementarity determining region 3 for antibody 13736
QQYHSHPLT

SEQ ID NO: 27472 - protein, 15 aa, Homo sapiens
  heavy chain complementarity determining region 3 for antibody 13736
ARGGIHYDILTGLDY

SEQ ID NO: 27473 - protein, 8 aa, Homo sapiens
  light chain complementarity determining region 3 for antibody 13737
QQYHSGWT

SEQ ID NO: 27474 - protein, 13 aa, Homo sapiens
  heavy chain complementarity determining region 3 for antibody 13737
AKVRAGDYDSLDY

SEQ ID NO: 27475 - protein, 9 aa, Homo sapiens
  light chain complementarity determining region 3 for antibody 13738
QQYGTSWHT

SEQ ID NO: 27476 - protein, 20 aa, Homo sapiens
  heavy chain complementarity determining region 3 for antibody 13738
ARDPHRYGGKDLLYHYGMDV

SEQ ID NO: 27477 - protein, 8 aa, Homo sapiens
  light chain complementarity determining region 3 for antibody 13739
QQYGTSPT

SEQ ID NO: 27478 - protein, 12 aa, Homo sapiens
  heavy chain complementarity determining region 3 for antibody 13739
ARGSVGDLSFPY

SEQ ID NO: 27479 - protein, 10 aa, Homo sapiens
  light chain complementarity determining region 3 for antibody 13740
QQYGTSPRYA

SEQ ID NO: 27480 - protein, 12 aa, Homo sapiens
  heavy chain complementarity determining region 3 for antibody 13740
AGGISSRFYFDY

SEQ ID NO: 27481 - protein, 9 aa, Homo sapiens
  light chain complementarity determining region 3 for antibody 13741
QQYGTLPQS

SEQ ID NO: 27482 - protein, 13 aa, Homo sapiens
  heavy chain complementarity determining region 3 for antibody 13741
NAWVGGRGDLFDY

SEQ ID NO: 27483 - protein, 9 aa, Homo sapiens
  light chain complementarity determining region 3 for antibody 13742
QQYGSSWLP

SEQ ID NO: 27484 - protein, 22 aa, Homo sapiens
  heavy chain complementarity determining region 3 for antibody 13742
ARQGACGGDCYSLGYYYYAMDV

SEQ ID NO: 27485 - protein, 9 aa, Homo sapiens
  light chain complementarity determining region 3 for antibody 13743
QQYGSSRYT

SEQ ID NO: 27486 - protein, 22 aa, Homo sapiens
  heavy chain complementarity determining region 3 for antibody 13743
ARIYDDSAKQYSAGYYYYAMGV

SEQ ID NO: 27487 - protein, 7 aa, Homo sapiens
  light chain complementarity determining region 3 for antibody 13744
QQYGSSR

SEQ ID NO: 27488 - protein, 16 aa, Homo sapiens
  heavy chain complementarity determining region 3 for antibody 13744
TTTYGDCPPYYYAMVV

SEQ ID NO: 27489 - protein, 9 aa, Homo sapiens
  light chain complementarity determining region 3 for antibody 13745
QQYGSSPYT

SEQ ID NO: 27490 - protein, 13 aa, Homo sapiens
  heavy chain complementarity determining region 3 for antibody 13745
ARGSTYGSGTYAS

SEQ ID NO: 27491 - protein, 9 aa, Homo sapiens
  light chain complementarity determining region 3 for antibody 13746
QQYGSSPYT

SEQ ID NO: 27492 - protein, 13 aa, Homo sapiens
  heavy chain complementarity determining region 3 for antibody 13746
ARGSTYGSGPYTS

SEQ ID NO: 27493 - protein, 9 aa, Homo sapiens
  light chain complementarity determining region 3 for antibody 13747
QQYGSSPYP

SEQ ID NO: 27494 - protein, 12 aa, Homo sapiens
  heavy chain complementarity determining region 3 for antibody 13747
ARRSWDSGYDPS

SEQ ID NO: 27495 - protein, 8 aa, Homo sapiens
  light chain complementarity determining region 3 for antibody 13748
QQYGSSPT

SEQ ID NO: 27496 - protein, 21 aa, Homo sapiens
  heavy chain complementarity determining region 3 for antibody 13748
ATRTSGKYSNSDDYYYYGMDV

SEQ ID NO: 27497 - protein, 9 aa, Homo sapiens
  light chain complementarity determining region 3 for antibody 13749
QQYGSSPST

SEQ ID NO: 27498 - protein, 14 aa, Homo sapiens
  heavy chain complementarity determining region 3 for antibody 13749
ARGMTSYNSAPYDP

SEQ ID NO: 27499 - protein, 9 aa, Homo sapiens
  light chain complementarity determining region 3 for antibody 13750
QQYGSSPST

SEQ ID NO: 27500 - protein, 13 aa, Homo sapiens
  heavy chain complementarity determining region 3 for antibody 13750
ARGFRYGSGPYVH

SEQ ID NO: 27501 - protein, 9 aa, Homo sapiens
  light chain complementarity determining region 3 for antibody 13751
QQYGSSPPP

SEQ ID NO: 27502 - protein, 20 aa, Homo sapiens
  heavy chain complementarity determining region 3 for antibody 13751
ARAGGRIPGRRGYDHYGLDV

SEQ ID NO: 27503 - protein, 9 aa, Homo sapiens
  light chain complementarity determining region 3 for antibody 13752
QQYGSSPNT

SEQ ID NO: 27504 - protein, 11 aa, Homo sapiens
  heavy chain complementarity determining region 3 for antibody 13752
ARVMGLDIFDV

SEQ ID NO: 27505 - protein, 9 aa, Homo sapiens
  light chain complementarity determining region 3 for antibody 13753
QQYGSSPLT

SEQ ID NO: 27506 - protein, 20 aa, Homo sapiens
  heavy chain complementarity determining region 3 for antibody 13753
TRDREAVAGAFRIINDFFDF

SEQ ID NO: 27507 - protein, 9 aa, Homo sapiens
  light chain complementarity determining region 3 for antibody 13754
QQYGSSPLP

SEQ ID NO: 27508 - protein, 18 aa, Homo sapiens
  heavy chain complementarity determining region 3 for antibody 13754
VKIYHYDTNEFPRGYFDH

SEQ ID NO: 27509 - protein, 9 aa, Homo sapiens
  light chain complementarity determining region 3 for antibody 13755
QQYGSSPLP

SEQ ID NO: 27510 - protein, 20 aa, Homo sapiens
  heavy chain complementarity determining region 3 for antibody 13755
ARDREAVAGAFRIINDFFDF

SEQ ID NO: 27511 - protein, 9 aa, Homo sapiens
  light chain complementarity determining region 3 for antibody 13756
QQYGSSPGP

SEQ ID NO: 27512 - protein, 12 aa, Homo sapiens
  heavy chain complementarity determining region 3 for antibody 13756
AGGFLEWLLFEY

SEQ ID NO: 27513 - protein, 10 aa, Homo sapiens
  light chain complementarity determining region 3 for antibody 13757
QQYGSSPGFT

SEQ ID NO: 27514 - protein, 14 aa, Homo sapiens
  heavy chain complementarity determining region 3 for antibody 13757
ARPDSIYYYYAMDV

SEQ ID NO: 27515 - protein, 9 aa, Homo sapiens
  light chain complementarity determining region 3 for antibody 13758
QQYGSSPEP

SEQ ID NO: 27516 - protein, 11 aa, Homo sapiens
  heavy chain complementarity determining region 3 for antibody 13758
AKDTQWQPFDH

SEQ ID NO: 27517 - protein, 9 aa, Homo sapiens
  light chain complementarity determining region 3 for antibody 13759
QQYGSSPAT

SEQ ID NO: 27518 - protein, 10 aa, Homo sapiens
  heavy chain complementarity determining region 3 for antibody 13759
ARESMGPMEY

SEQ ID NO: 27519 - protein, 9 aa, Homo sapiens
  light chain complementarity determining region 3 for antibody 13760
QQYGSSLWT

SEQ ID NO: 27520 - protein, 15 aa, Homo sapiens
  heavy chain complementarity determining region 3 for antibody 13760
ARNVLPDYYAGASHL

SEQ ID NO: 27521 - protein, 10 aa, Homo sapiens
  light chain complementarity determining region 3 for antibody 13761
QQYGSSFPFT

SEQ ID NO: 27522 - protein, 18 aa, Homo sapiens
  heavy chain complementarity determining region 3 for antibody 13761
ARPNYYYASGSYYPQFDH

SEQ ID NO: 27523 - protein, 10 aa, Homo sapiens
  light chain complementarity determining region 3 for antibody 13762
QQYGSSALYT

SEQ ID NO: 27524 - protein, 16 aa, Homo sapiens
  heavy chain complementarity determining region 3 for antibody 13762
ARELFKGEYDYYAMDV

SEQ ID NO: 27525 - protein, 9 aa, Homo sapiens
  light chain complementarity determining region 3 for antibody 13763
QQYGSLPLT

SEQ ID NO: 27526 - protein, 18 aa, Homo sapiens
  heavy chain complementarity determining region 3 for antibody 13763
ARAPGDYDMLRRGYYFDH

SEQ ID NO: 27527 - protein, 12 aa, Homo sapiens
  light chain complementarity determining region 3 for antibody 13764
QQYGSGSSPPDT

SEQ ID NO: 27528 - protein, 12 aa, Homo sapiens
  heavy chain complementarity determining region 3 for antibody 13764
ASCIYGSGTLKV

SEQ ID NO: 27529 - protein, 10 aa, Homo sapiens
  light chain complementarity determining region 3 for antibody 13765
QQYGRSPRYI

SEQ ID NO: 27530 - protein, 12 aa, Homo sapiens
  heavy chain complementarity determining region 3 for antibody 13765
TRGLGSRYGMDV

SEQ ID NO: 27531 - protein, 10 aa, Homo sapiens
  light chain complementarity determining region 3 for antibody 13766
QQYGRSPRYI

SEQ ID NO: 27532 - protein, 12 aa, Homo sapiens
  heavy chain complementarity determining region 3 for antibody 13766
TGDLGSRYGMDV

SEQ ID NO: 27533 - protein, 10 aa, Homo sapiens
  light chain complementarity determining region 3 for antibody 13767
QQYGRSPRDI

SEQ ID NO: 27534 - protein, 12 aa, Homo sapiens
  heavy chain complementarity determining region 3 for antibody 13767
TRDLGSRYGMDV

SEQ ID NO: 27535 - protein, 10 aa, Homo sapiens
  light chain complementarity determining region 3 for antibody 13768
QQYGPSHKYT

SEQ ID NO: 27536 - protein, 22 aa, Homo sapiens
  heavy chain complementarity determining region 3 for antibody 13768
ARHSPFLEMLGERWLQFGAFDI

SEQ ID NO: 27537 - protein, 10 aa, Homo sapiens
  light chain complementarity determining region 3 for antibody 13769
QQYGPLPPVT

SEQ ID NO: 27538 - protein, 14 aa, Homo sapiens
  heavy chain complementarity determining region 3 for antibody 13769
ARDRLGVESSRFDY

SEQ ID NO: 27539 - protein, 10 aa, Homo sapiens
  light chain complementarity determining region 3 for antibody 13770
QQYGNSPLIT

SEQ ID NO: 27540 - protein, 12 aa, Homo sapiens
  heavy chain complementarity determining region 3 for antibody 13770
ARGPLRWRHFDY

SEQ ID NO: 27541 - protein, 8 aa, Homo sapiens
  light chain complementarity determining region 3 for antibody 13771
QQYGNLLT

SEQ ID NO: 27542 - protein, 19 aa, Homo sapiens
  heavy chain complementarity determining region 3 for antibody 13771
SKDRSVNAAMDYYYSAMDV

SEQ ID NO: 27543 - protein, 8 aa, Homo sapiens
  light chain complementarity determining region 3 for antibody 13772
QQYGNLLT

SEQ ID NO: 27544 - protein, 20 aa, Homo sapiens
  heavy chain complementarity determining region 3 for antibody 13772
SKDRSVNAAMDYYYHSAMDV

SEQ ID NO: 27545 - protein, 8 aa, Homo sapiens
  light chain complementarity determining region 3 for antibody 13773
QQYGNLLT

SEQ ID NO: 27546 - protein, 20 aa, Homo sapiens
  heavy chain complementarity determining region 3 for antibody 13773
SKDRSVNAAMDYYYCSAMDV

SEQ ID NO: 27547 - protein, 8 aa, Homo sapiens
  light chain complementarity determining region 3 for antibody 13774
QQYGNLLT

SEQ ID NO: 27548 - protein, 20 aa, Homo sapiens
  heavy chain complementarity determining region 3 for antibody 13774
SKDRSVNAAMDYYDYSAMDV

SEQ ID NO: 27549 - protein, 8 aa, Homo sapiens
  light chain complementarity determining region 3 for antibody 13775
QQYGNLLT

SEQ ID NO: 27550 - protein, 20 aa, Homo sapiens
  heavy chain complementarity determining region 3 for antibody 13775
SKDRSVNAAMDCYYYSAMDV

SEQ ID NO: 27551 - protein, 8 aa, Homo sapiens
  light chain complementarity determining region 3 for antibody 13776
QQYGNLLT

SEQ ID NO: 27552 - protein, 20 aa, Homo sapiens
  heavy chain complementarity determining region 3 for antibody 13776
SKDRSGNAAMDYYYYSAMDV

SEQ ID NO: 27553 - protein, 8 aa, Homo sapiens
  light chain complementarity determining region 3 for antibody 13777
QQYGNLLT

SEQ ID NO: 27554 - protein, 20 aa, Homo sapiens
  heavy chain complementarity determining region 3 for antibody 13777
SKDRSANAAMDYYYYSAMDV

SEQ ID NO: 27555 - protein, 8 aa, Homo sapiens
  light chain complementarity determining region 3 for antibody 13778
QQYGNLLT

SEQ ID NO: 27556 - protein, 20 aa, Homo sapiens
  heavy chain complementarity determining region 3 for antibody 13778
PKDRSVNAAMDYYYYSAMDV

SEQ ID NO: 27557 - protein, 8 aa, Homo sapiens
  light chain complementarity determining region 3 for antibody 13779
QQYGNLFT

SEQ ID NO: 27558 - protein, 20 aa, Homo sapiens
  heavy chain complementarity determining region 3 for antibody 13779
SKDRSVNAAMDYYYYSAMDV

SEQ ID NO: 27559 - protein, 9 aa, Homo sapiens
  light chain complementarity determining region 3 for antibody 13780
QQYGISPYT

SEQ ID NO: 27560 - protein, 14 aa, Homo sapiens
  heavy chain complementarity determining region 3 for antibody 13780
ARGQSSVSSVPPAY

SEQ ID NO: 27561 - protein, 9 aa, Homo sapiens
  light chain complementarity determining region 3 for antibody 13781
QQYGISPYT

SEQ ID NO: 27562 - protein, 14 aa, Homo sapiens
  heavy chain complementarity determining region 3 for antibody 13781
ARGQSSVSSVPHDY

SEQ ID NO: 27563 - protein, 9 aa, Homo sapiens
  light chain complementarity determining region 3 for antibody 13782
QQYGISPYT

SEQ ID NO: 27564 - protein, 14 aa, Homo sapiens
  heavy chain complementarity determining region 3 for antibody 13782
ARGQSSASSVPHAY

SEQ ID NO: 27565 - protein, 9 aa, Homo sapiens
  light chain complementarity determining region 3 for antibody 13783
QQYGISPYP

SEQ ID NO: 27566 - protein, 14 aa, Homo sapiens
  heavy chain complementarity determining region 3 for antibody 13783
ARGQSSVSSVPHAY

SEQ ID NO: 27567 - protein, 10 aa, Homo sapiens
  light chain complementarity determining region 3 for antibody 13784
QQYGGSPMYP

SEQ ID NO: 27568 - protein, 20 aa, Homo sapiens
  heavy chain complementarity determining region 3 for antibody 13784
AREFPLAVVDGYYHFYGMNV

SEQ ID NO: 27569 - protein, 9 aa, Homo sapiens
  light chain complementarity determining region 3 for antibody 13785
QQYGGLPIP

SEQ ID NO: 27570 - protein, 17 aa, Homo sapiens
  heavy chain complementarity determining region 3 for antibody 13785
ARVDGYILTGYPYHSDY

SEQ ID NO: 27571 - protein, 10 aa, Homo sapiens
  light chain complementarity determining region 3 for antibody 13786
QQYGDSPLFT

SEQ ID NO: 27572 - protein, 16 aa, Homo sapiens
  heavy chain complementarity determining region 3 for antibody 13786
TRRIVGTWLVPYYFDY

SEQ ID NO: 27573 - protein, 10 aa, Homo sapiens
  light chain complementarity determining region 3 for antibody 13787
QQYFNWPLIT

SEQ ID NO: 27574 - protein, 15 aa, Homo sapiens
  heavy chain complementarity determining region 3 for antibody 13787
ASMFEFDSGTYYSDY

SEQ ID NO: 27575 - protein, 9 aa, Homo sapiens
  light chain complementarity determining region 3 for antibody 13788
QQYETSPFP

SEQ ID NO: 27576 - protein, 11 aa, Homo sapiens
  heavy chain complementarity determining region 3 for antibody 13788
GRGSVTPDMGY

SEQ ID NO: 27577 - protein, 9 aa, Homo sapiens
  light chain complementarity determining region 3 for antibody 13789
QQYENVPFT

SEQ ID NO: 27578 - protein, 16 aa, Homo sapiens
  heavy chain complementarity determining region 3 for antibody 13789
AAQEKVTVKGLGVYDS

SEQ ID NO: 27579 - protein, 9 aa, Homo sapiens
  light chain complementarity determining region 3 for antibody 13790
QQYENLPVT

SEQ ID NO: 27580 - protein, 11 aa, Homo sapiens
  heavy chain complementarity determining region 3 for antibody 13790
ARDGPIWSGYT

SEQ ID NO: 27581 - protein, 9 aa, Homo sapiens
  light chain complementarity determining region 3 for antibody 13791
QQYENLPPS

SEQ ID NO: 27582 - protein, 19 aa, Homo sapiens
  heavy chain complementarity determining region 3 for antibody 13791
ATKRGYSYGPPYYYYDMDV

SEQ ID NO: 27583 - protein, 9 aa, Homo sapiens
  light chain complementarity determining region 3 for antibody 13792
QQYDTYPLT

SEQ ID NO: 27584 - protein, 19 aa, Homo sapiens
  heavy chain complementarity determining region 3 for antibody 13792
ARDRSDTSMDPGGESCFDH

SEQ ID NO: 27585 - protein, 9 aa, Homo sapiens
  light chain complementarity determining region 3 for antibody 13793
QQYDTYPLT

SEQ ID NO: 27586 - protein, 19 aa, Homo sapiens
  heavy chain complementarity determining region 3 for antibody 13793
ARDRSDTSMDPGGEGCSDH

SEQ ID NO: 27587 - protein, 10 aa, Homo sapiens
  light chain complementarity determining region 3 for antibody 13794
QQYDSYSGAT

SEQ ID NO: 27588 - protein, 21 aa, Homo sapiens
  heavy chain complementarity determining region 3 for antibody 13794
TKDRIAGDSTGYVFIGEYFQD

SEQ ID NO: 27589 - protein, 9 aa, Homo sapiens
  light chain complementarity determining region 3 for antibody 13795
QQYDSYPYT

SEQ ID NO: 27590 - protein, 17 aa, Homo sapiens
  heavy chain complementarity determining region 3 for antibody 13795
AREDWSDVDLQTYHFDN

SEQ ID NO: 27591 - protein, 9 aa, Homo sapiens
  light chain complementarity determining region 3 for antibody 13796
QQYDSSPYT

SEQ ID NO: 27592 - protein, 14 aa, Homo sapiens
  heavy chain complementarity determining region 3 for antibody 13796
ARDRWGFRGDAFDI

SEQ ID NO: 27593 - protein, 9 aa, Homo sapiens
  light chain complementarity determining region 3 for antibody 13797
QQYDSSPWT

SEQ ID NO: 27594 - protein, 12 aa, Homo sapiens
  heavy chain complementarity determining region 3 for antibody 13797
VKDPRNSWFPNA

SEQ ID NO: 27595 - protein, 9 aa, Homo sapiens
  light chain complementarity determining region 3 for antibody 13798
QQYDSSPWT

SEQ ID NO: 27596 - protein, 17 aa, Homo sapiens
  heavy chain complementarity determining region 3 for antibody 13798
ARGVYGACLGYYFGMDV

SEQ ID NO: 27597 - protein, 9 aa, Homo sapiens
  light chain complementarity determining region 3 for antibody 13799
QQYDSSPWT

SEQ ID NO: 27598 - protein, 17 aa, Homo sapiens
  heavy chain complementarity determining region 3 for antibody 13799
ARGAYGAYLGYYFGMDV

SEQ ID NO: 27599 - protein, 8 aa, Homo sapiens
  light chain complementarity determining region 3 for antibody 13800
QQYDSSPT

SEQ ID NO: 27600 - protein, 20 aa, Homo sapiens
  heavy chain complementarity determining region 3 for antibody 13800
ATPLVTYYYDSRGYLNAFDI

SEQ ID NO: 27601 - protein, 9 aa, Homo sapiens
  light chain complementarity determining region 3 for antibody 13801
QQYDSLPLT

SEQ ID NO: 27602 - protein, 18 aa, Homo sapiens
  heavy chain complementarity determining region 3 for antibody 13801
ARAPGDYEMLRRGYYFDH

SEQ ID NO: 27603 - protein, 9 aa, Homo sapiens
  light chain complementarity determining region 3 for antibody 13802
QQYDSLPLT

SEQ ID NO: 27604 - protein, 18 aa, Homo sapiens
  heavy chain complementarity determining region 3 for antibody 13802
ARAPGDYDVLRRGYYFDH

SEQ ID NO: 27605 - protein, 9 aa, Homo sapiens
  light chain complementarity determining region 3 for antibody 13803
QQYDSLPLT

SEQ ID NO: 27606 - protein, 18 aa, Homo sapiens
  heavy chain complementarity determining region 3 for antibody 13803
ARAPGDYDRLRRGYYFDH

SEQ ID NO: 27607 - protein, 9 aa, Homo sapiens
  light chain complementarity determining region 3 for antibody 13804
QQYDSLPLT

SEQ ID NO: 27608 - protein, 18 aa, Homo sapiens
  heavy chain complementarity determining region 3 for antibody 13804
ARAPGDHDMLRRGYYFDH

SEQ ID NO: 27609 - protein, 9 aa, Homo sapiens
  light chain complementarity determining region 3 for antibody 13805
QQYDSLPLT

SEQ ID NO: 27610 - protein, 18 aa, Homo sapiens
  heavy chain complementarity determining region 3 for antibody 13805
ARAPGDDDMLRRGYYFDH

SEQ ID NO: 27611 - protein, 9 aa, Homo sapiens
  light chain complementarity determining region 3 for antibody 13806
QQYDSLPLT

SEQ ID NO: 27612 - protein, 18 aa, Homo sapiens
  heavy chain complementarity determining region 3 for antibody 13806
AIAPGDYDMLRRGYYFDH

SEQ ID NO: 27613 - protein, 9 aa, Homo sapiens
  light chain complementarity determining region 3 for antibody 13807
QQYDSFPYT

SEQ ID NO: 27614 - protein, 17 aa, Homo sapiens
  heavy chain complementarity determining region 3 for antibody 13807
ARGDWSDVDLRAFYFDS

SEQ ID NO: 27615 - protein, 9 aa, Homo sapiens
  light chain complementarity determining region 3 for antibody 13808
QQYDSFPYT

SEQ ID NO: 27616 - protein, 17 aa, Homo sapiens
  heavy chain complementarity determining region 3 for antibody 13808
AREDWSDVDLRALYFDS

SEQ ID NO: 27617 - protein, 9 aa, Homo sapiens
  light chain complementarity determining region 3 for antibody 13809
QQYDSFPYT

SEQ ID NO: 27618 - protein, 17 aa, Homo sapiens
  heavy chain complementarity determining region 3 for antibody 13809
AREDWSDVDLRAFSFDS

SEQ ID NO: 27619 - protein, 9 aa, Homo sapiens
  light chain complementarity determining region 3 for antibody 13810
QQYDSFPYT

SEQ ID NO: 27620 - protein, 17 aa, Homo sapiens
  heavy chain complementarity determining region 3 for antibody 13810
AREDWSDVDLRAFHFDS

SEQ ID NO: 27621 - protein, 9 aa, Homo sapiens
  light chain complementarity determining region 3 for antibody 13811
QQYDSFPYT

SEQ ID NO: 27622 - protein, 17 aa, Homo sapiens
  heavy chain complementarity determining region 3 for antibody 13811
AREDWSDADLRAFYFDS

SEQ ID NO: 27623 - protein, 9 aa, Homo sapiens
  light chain complementarity determining region 3 for antibody 13812
QQYDSFPYT

SEQ ID NO: 27624 - protein, 17 aa, Homo sapiens
  heavy chain complementarity determining region 3 for antibody 13812
AGEDWSDVDLRAFYFDS

SEQ ID NO: 27625 - protein, 8 aa, Homo sapiens
  light chain complementarity determining region 3 for antibody 13813
QQYDQFPT

SEQ ID NO: 27626 - protein, 20 aa, Homo sapiens
  heavy chain complementarity determining region 3 for antibody 13813
ATDRGTYFRSGSYYHYPFDY

SEQ ID NO: 27627 - protein, 8 aa, Homo sapiens
  light chain complementarity determining region 3 for antibody 13814
QQYDQFPT

SEQ ID NO: 27628 - protein, 20 aa, Homo sapiens
  heavy chain complementarity determining region 3 for antibody 13814
AADRGTYFRSGSYYHYPLDY

SEQ ID NO: 27629 - protein, 8 aa, Homo sapiens
  light chain complementarity determining region 3 for antibody 13815
QQYDNTTT

SEQ ID NO: 27630 - protein, 19 aa, Homo sapiens
  heavy chain complementarity determining region 3 for antibody 13815
ARLESYFDNSGYFREKFRH

SEQ ID NO: 27631 - protein, 11 aa, Homo sapiens
  light chain complementarity determining region 3 for antibody 13816
QQYDNSSPGHT

SEQ ID NO: 27632 - protein, 16 aa, Homo sapiens
  heavy chain complementarity determining region 3 for antibody 13816
AHRFYYGTNGSVAFDI

SEQ ID NO: 27633 - protein, 11 aa, Homo sapiens
  light chain complementarity determining region 3 for antibody 13817
QQYDNSSPGDT

SEQ ID NO: 27634 - protein, 16 aa, Homo sapiens
  heavy chain complementarity determining region 3 for antibody 13817
AHRFYYGTNGSVAFDI

SEQ ID NO: 27635 - protein, 11 aa, Homo sapiens
  light chain complementarity determining region 3 for antibody 13818
QQYDNSSPGCT

SEQ ID NO: 27636 - protein, 16 aa, Homo sapiens
  heavy chain complementarity determining region 3 for antibody 13818
AHRFYYGTNGSVAFDI

SEQ ID NO: 27637 - protein, 10 aa, Homo sapiens
  light chain complementarity determining region 3 for antibody 13819
QQYDNLPSVT

SEQ ID NO: 27638 - protein, 11 aa, Homo sapiens
  heavy chain complementarity determining region 3 for antibody 13819
AKSGGVWSFDY

SEQ ID NO: 27639 - protein, 10 aa, Homo sapiens
  light chain complementarity determining region 3 for antibody 13820
QQYDNLPSVT

SEQ ID NO: 27640 - protein, 11 aa, Homo sapiens
  heavy chain complementarity determining region 3 for antibody 13820
AKSGGLWSFDY

SEQ ID NO: 27641 - protein, 10 aa, Homo sapiens
  light chain complementarity determining region 3 for antibody 13821
QQYDNLPSVT

SEQ ID NO: 27642 - protein, 11 aa, Homo sapiens
  heavy chain complementarity determining region 3 for antibody 13821
AKSGGFWSLDY

SEQ ID NO: 27643 - protein, 10 aa, Homo sapiens
  light chain complementarity determining region 3 for antibody 13822
QQYDNLPSVA

SEQ ID NO: 27644 - protein, 11 aa, Homo sapiens
  heavy chain complementarity determining region 3 for antibody 13822
AKSGGFWSFDY

SEQ ID NO: 27645 - protein, 10 aa, Homo sapiens
  light chain complementarity determining region 3 for antibody 13823
QQYDNLPPLT

SEQ ID NO: 27646 - protein, 16 aa, Homo sapiens
  heavy chain complementarity determining region 3 for antibody 13823
ARELFKGEYDYYAMDV

SEQ ID NO: 27647 - protein, 12 aa, Homo sapiens
  light chain complementarity determining region 3 for antibody 13824
QQYDNLPPGGWT

SEQ ID NO: 27648 - protein, 16 aa, Homo sapiens
  heavy chain complementarity determining region 3 for antibody 13824
ARELFKGEYDYYALDV

SEQ ID NO: 27649 - protein, 10 aa, Homo sapiens
  light chain complementarity determining region 3 for antibody 13825
QQYDNLPPFT

SEQ ID NO: 27650 - protein, 16 aa, Homo sapiens
  heavy chain complementarity determining region 3 for antibody 13825
ARELFKGEYDYYAMDD

SEQ ID NO: 27651 - protein, 10 aa, Homo sapiens
  light chain complementarity determining region 3 for antibody 13826
QQYDNLPPFP

SEQ ID NO: 27652 - protein, 16 aa, Homo sapiens
  heavy chain complementarity determining region 3 for antibody 13826
ARELFKGEYDYYAMDV

SEQ ID NO: 27653 - protein, 9 aa, Homo sapiens
  light chain complementarity determining region 3 for antibody 13827
QQYDNLPLT

SEQ ID NO: 27654 - protein, 18 aa, Homo sapiens
  heavy chain complementarity determining region 3 for antibody 13827
ASAPGDYDMLRRGYYFDH

SEQ ID NO: 27655 - protein, 10 aa, Homo sapiens
  light chain complementarity determining region 3 for antibody 13828
QQYDNLLSIT

SEQ ID NO: 27656 - protein, 23 aa, Homo sapiens
  heavy chain complementarity determining region 3 for antibody 13828
ARHPNALLVHCSAGSCYRNSFDY

SEQ ID NO: 27657 - protein, 8 aa, Homo sapiens
  light chain complementarity determining region 3 for antibody 13829
QQYDNLLP

SEQ ID NO: 27658 - protein, 20 aa, Homo sapiens
  heavy chain complementarity determining region 3 for antibody 13829
AKDRSVNAAMDYYYYSGMDV

SEQ ID NO: 27659 - protein, 9 aa, Homo sapiens
  light chain complementarity determining region 3 for antibody 13830
QQYDNLLHT

SEQ ID NO: 27660 - protein, 17 aa, Homo sapiens
  heavy chain complementarity determining region 3 for antibody 13830
ARAPPVEYYDSSGYYNY

SEQ ID NO: 27661 - protein, 9 aa, Homo sapiens
  light chain complementarity determining region 3 for antibody 13831
QQYDNIPLT

SEQ ID NO: 27662 - protein, 18 aa, Homo sapiens
  heavy chain complementarity determining region 3 for antibody 13831
ARAPGDYDMLRRGYYFDH

SEQ ID NO: 27663 - protein, 9 aa, Homo sapiens
  light chain complementarity determining region 3 for antibody 13832
QQYDNFPPT

SEQ ID NO: 27664 - protein, 20 aa, Homo sapiens
  heavy chain complementarity determining region 3 for antibody 13832
ARLRGYCSGGSCQAHKLFDF

SEQ ID NO: 27665 - protein, 9 aa, Homo sapiens
  light chain complementarity determining region 3 for antibody 13833
QQYDNFPPT

SEQ ID NO: 27666 - protein, 20 aa, Homo sapiens
  heavy chain complementarity determining region 3 for antibody 13833
ARLLGYCSGGSCQARKLFDF

SEQ ID NO: 27667 - protein, 9 aa, Homo sapiens
  light chain complementarity determining region 3 for antibody 13834
QQYDKVPLT

SEQ ID NO: 27668 - protein, 20 aa, Homo sapiens
  heavy chain complementarity determining region 3 for antibody 13834
AKARRRDTSMDYFYYSAMGV

SEQ ID NO: 27669 - protein, 9 aa, Homo sapiens
  light chain complementarity determining region 3 for antibody 13835
QQYDELPIT

SEQ ID NO: 27670 - protein, 21 aa, Homo sapiens
  heavy chain complementarity determining region 3 for antibody 13835
ARDLVHYASSGRYGGSDHFQR

SEQ ID NO: 27671 - protein, 9 aa, Homo sapiens
  light chain complementarity determining region 3 for antibody 13836
QQYCSSPET

SEQ ID NO: 27672 - protein, 11 aa, Homo sapiens
  heavy chain complementarity determining region 3 for antibody 13836
AKDTQWQPFDH

SEQ ID NO: 27673 - protein, 10 aa, Homo sapiens
  light chain complementarity determining region 3 for antibody 13837
QQYASSPPGT

SEQ ID NO: 27674 - protein, 19 aa, Homo sapiens
  heavy chain complementarity determining region 3 for antibody 13837
AREEGYYDGSGSWHPESDN

SEQ ID NO: 27675 - protein, 10 aa, Homo sapiens
  light chain complementarity determining region 3 for antibody 13838
QQYARSDLFT

SEQ ID NO: 27676 - protein, 16 aa, Homo sapiens
  heavy chain complementarity determining region 3 for antibody 13838
ARELFKGQIDYYGIDV

SEQ ID NO: 27677 - protein, 9 aa, Homo sapiens
  light chain complementarity determining region 3 for antibody 13839
QQYANSPLT

SEQ ID NO: 27678 - protein, 19 aa, Homo sapiens
  heavy chain complementarity determining region 3 for antibody 13839
AKQGASGFTSGWYRFPFDS

SEQ ID NO: 27679 - protein, 11 aa, Homo sapiens
  light chain complementarity determining region 3 for antibody 13840
QQVSHYEQGIT

SEQ ID NO: 27680 - protein, 17 aa, Homo sapiens
  heavy chain complementarity determining region 3 for antibody 13840
ARERQYCYGDRYYGEDL

SEQ ID NO: 27681 - protein, 9 aa, Homo sapiens
  light chain complementarity determining region 3 for antibody 13841
QQVNTYPLP

SEQ ID NO: 27682 - protein, 18 aa, Homo sapiens
  heavy chain complementarity determining region 3 for antibody 13841
ARYEDYGDSPTVYYGLDV

SEQ ID NO: 27683 - protein, 9 aa, Homo sapiens
  light chain complementarity determining region 3 for antibody 13842
QQVNNYPIT

SEQ ID NO: 27684 - protein, 14 aa, Homo sapiens
  heavy chain complementarity determining region 3 for antibody 13842
AKEKGGGGAAGLDD

SEQ ID NO: 27685 - protein, 9 aa, Homo sapiens
  light chain complementarity determining region 3 for antibody 13843
QQVMNFPIT

SEQ ID NO: 27686 - protein, 11 aa, Homo sapiens
  heavy chain complementarity determining region 3 for antibody 13843
ARNYDSSGFDD

SEQ ID NO: 27687 - protein, 9 aa, Homo sapiens
  light chain complementarity determining region 3 for antibody 13844
QQVMNFHIT

SEQ ID NO: 27688 - protein, 11 aa, Homo sapiens
  heavy chain complementarity determining region 3 for antibody 13844
ARNYDSSGFDY

SEQ ID NO: 27689 - protein, 8 aa, Homo sapiens
  light chain complementarity determining region 3 for antibody 13845
QQVHSFPP

SEQ ID NO: 27690 - protein, 22 aa, Homo sapiens
  heavy chain complementarity determining region 3 for antibody 13845
ARHSGYSNTWYMNYYYYYGMDV

SEQ ID NO: 27691 - protein, 9 aa, Homo sapiens
  light chain complementarity determining region 3 for antibody 13846
QQTYSVPQT

SEQ ID NO: 27692 - protein, 18 aa, Homo sapiens
  heavy chain complementarity determining region 3 for antibody 13846
ARVRGEAYGSGWISVLDY

SEQ ID NO: 27693 - protein, 9 aa, Homo sapiens
  light chain complementarity determining region 3 for antibody 13847
QQTYSTPVT

SEQ ID NO: 27694 - protein, 16 aa, Homo sapiens
  heavy chain complementarity determining region 3 for antibody 13847
ATLFPASGWSRGWLDP

SEQ ID NO: 27695 - protein, 9 aa, Homo sapiens
  light chain complementarity determining region 3 for antibody 13848
QQTYSTPRT

SEQ ID NO: 27696 - protein, 14 aa, Homo sapiens
  heavy chain complementarity determining region 3 for antibody 13848
ARGGGPTSAIREDY

SEQ ID NO: 27697 - protein, 9 aa, Homo sapiens
  light chain complementarity determining region 3 for antibody 13849
QQTYSTLWT

SEQ ID NO: 27698 - protein, 16 aa, Homo sapiens
  heavy chain complementarity determining region 3 for antibody 13849
AYSPPVVDTVKDGFHV

SEQ ID NO: 27699 - protein, 9 aa, Homo sapiens
  light chain complementarity determining region 3 for antibody 13850
QQTYSTLWT

SEQ ID NO: 27700 - protein, 16 aa, Homo sapiens
  heavy chain complementarity determining region 3 for antibody 13850
AYAPPVVDTVKDGFHV

SEQ ID NO: 27701 - protein, 10 aa, Homo sapiens
  light chain complementarity determining region 3 for antibody 13851
QQTYSSPPPT

SEQ ID NO: 27702 - protein, 17 aa, Homo sapiens
  heavy chain complementarity determining region 3 for antibody 13851
ARLTPYASNWNPFYCDY

SEQ ID NO: 27703 - protein, 10 aa, Homo sapiens
  light chain complementarity determining region 3 for antibody 13852
QQTYSNPTRT

SEQ ID NO: 27704 - protein, 13 aa, Homo sapiens
  heavy chain complementarity determining region 3 for antibody 13852
ARVGAVAGRAFDV

SEQ ID NO: 27705 - protein, 9 aa, Homo sapiens
  light chain complementarity determining region 3 for antibody 13853
QQTYSAPYT

SEQ ID NO: 27706 - protein, 18 aa, Homo sapiens
  heavy chain complementarity determining region 3 for antibody 13853
ARDVYCSGGGCYENWFDP

SEQ ID NO: 27707 - protein, 9 aa, Homo sapiens
  light chain complementarity determining region 3 for antibody 13854
QQTYRFPLS

SEQ ID NO: 27708 - protein, 13 aa, Homo sapiens
  heavy chain complementarity determining region 3 for antibody 13854
TRTYGSGRNWFDP

SEQ ID NO: 27709 - protein, 9 aa, Homo sapiens
  light chain complementarity determining region 3 for antibody 13855
QQTISFPIT

SEQ ID NO: 27710 - protein, 11 aa, Homo sapiens
  heavy chain complementarity determining region 3 for antibody 13855
ARERSSWDFDY

SEQ ID NO: 27711 - protein, 9 aa, Homo sapiens
  light chain complementarity determining region 3 for antibody 13856
QQSYTTPRT

SEQ ID NO: 27712 - protein, 19 aa, Homo sapiens
  heavy chain complementarity determining region 3 for antibody 13856
ARYGPILRFFDDPVYGMDV

SEQ ID NO: 27713 - protein, 9 aa, Homo sapiens
  light chain complementarity determining region 3 for antibody 13857
QQSYTTPRT

SEQ ID NO: 27714 - protein, 19 aa, Homo sapiens
  heavy chain complementarity determining region 3 for antibody 13857
AGDGPILRFFDDPVYGMDV

SEQ ID NO: 27715 - protein, 10 aa, Homo sapiens
  light chain complementarity determining region 3 for antibody 13858
QQSYTNPALS

SEQ ID NO: 27716 - protein, 17 aa, Homo sapiens
  heavy chain complementarity determining region 3 for antibody 13858
ARHRSRSARYENHGMDV

SEQ ID NO: 27717 - protein, 9 aa, Homo sapiens
  light chain complementarity determining region 3 for antibody 13859
QQSYTAPYT

SEQ ID NO: 27718 - protein, 16 aa, Homo sapiens
  heavy chain complementarity determining region 3 for antibody 13859
ARGGYLTSTPYYGMDV

SEQ ID NO: 27719 - protein, 9 aa, Homo sapiens
  light chain complementarity determining region 3 for antibody 13860
QQSYTALYT

SEQ ID NO: 27720 - protein, 16 aa, Homo sapiens
  heavy chain complementarity determining region 3 for antibody 13860
ARRGYLTSTPYYGMDV

SEQ ID NO: 27721 - protein, 9 aa, Homo sapiens
  light chain complementarity determining region 3 for antibody 13861
QQSYSVPYP

SEQ ID NO: 27722 - protein, 13 aa, Homo sapiens
  heavy chain complementarity determining region 3 for antibody 13861
ARGSIYGSGKYEY

SEQ ID NO: 27723 - protein, 9 aa, Homo sapiens
  light chain complementarity determining region 3 for antibody 13862
QQSYSVPST

SEQ ID NO: 27724 - protein, 13 aa, Homo sapiens
  heavy chain complementarity determining region 3 for antibody 13862
ARGSIYGSGKYEY

SEQ ID NO: 27725 - protein, 9 aa, Homo sapiens
  light chain complementarity determining region 3 for antibody 13863
QQSYSVPSS

SEQ ID NO: 27726 - protein, 13 aa, Homo sapiens
  heavy chain complementarity determining region 3 for antibody 13863
ARGSIYGSGKYEY

SEQ ID NO: 27727 - protein, 9 aa, Homo sapiens
  light chain complementarity determining region 3 for antibody 13864
QQSYSTSWT

SEQ ID NO: 27728 - protein, 16 aa, Homo sapiens
  heavy chain complementarity determining region 3 for antibody 13864
AGDRGSSWYENNWFDP

SEQ ID NO: 27729 - protein, 9 aa, Homo sapiens
  light chain complementarity determining region 3 for antibody 13865
QQSYSTPYT

SEQ ID NO: 27730 - protein, 13 aa, Homo sapiens
  heavy chain complementarity determining region 3 for antibody 13865
TRTYGSGRNWFDP

SEQ ID NO: 27731 - protein, 9 aa, Homo sapiens
  light chain complementarity determining region 3 for antibody 13866
QQSYSTPYT

SEQ ID NO: 27732 - protein, 12 aa, Homo sapiens
  heavy chain complementarity determining region 3 for antibody 13866
AVDLGYGDIPIA

SEQ ID NO: 27733 - protein, 9 aa, Homo sapiens
  light chain complementarity determining region 3 for antibody 13867
QQSYSTPYT

SEQ ID NO: 27734 - protein, 15 aa, Homo sapiens
  heavy chain complementarity determining region 3 for antibody 13867
ARGDCRDETCCPGAY

(The sequence listing continues in the following parts.)

The invention claimed is:

1. A pharmaceutical composition comprising a library of recombinant polyclonal proteins (RPPs), wherein the library comprises at least 100 RPPs specifically binding to an antigen and has been generated by the process of:
   a. isolating single cells from a spleen, lymph node, or peripheral blood sample from a donor exposed to the antigen, wherein the single cells are CD43$^+$ plasmablasts, CD27$^+$ memory B cells, or peripheral CD138$^+$ plasma cells;
   b. amplifying polynucleotides, wherein each of the polynucleotides encodes a cognate pair of heavy chain and light chain variable regions from one of the single cells by overlap extension reverse transcriptase polymerase chain reaction (OE-RT-PCR);
   c. cloning the polynucleotides obtained from the amplification into an expression vector, thereby obtaining the constructs encoding antibody fragments;
   d. generating antibody expression constructs using the constructs or a subset of the constructs, wherein each of the antibody expression constructs encodes a light chain variable region, a kappa or lambda-type light chain constant region, a heavy chain variable region, and a heavy chain constant region,
   e. introducing the antibody expression constructs into a cell line, and
   f. expressing antibodies from the antibody expression constructs in the cell line, thereby obtaining the at least 100 recombinant polyclonal proteins (RPPs); wherein each of the RPP is an antibody comprising a cognate pair of heavy chain and light chain variable regions from a single cell out of the sample.

2. The pharmaceutical composition of claim 1, wherein the process further comprises the step of obtaining the subset of the constructs after step c. by expressing the antibody fragments from the constructs and enriching the subset of the constructs based on the binding activities of the antibody fragments against the antigen.

3. The pharmaceutical composition of claim 1,
   a. wherein the antigen is an antigen of *Haemophilus influenzae* type b (Hib), or
   b. wherein the antigen is an antigen of *Streptococcus pneumoniae*, or
   c. wherein the antigen is an antigen of Influenza A, or
   d. wherein the antigen is an antigen of Hepatitis B virus, or
   e. wherein the antigen is an antigen of human thymocyte or human T cells, or
   f. wherein the antigen is selected from CD4, CD45, and CD81.

4. The pharmaceutical composition of claim 1, wherein the library comprises at least 1000 or at least 10,000 RPPs.

5. The pharmaceutical composition of claim 1, wherein the single cells from the sample are CD138+ plasma cells.

6. The pharmaceutical composition of claim 1, wherein each of the RPP is an IgG1 antibody.

* * * * *